United States Patent 9,567,581 (SELECTIVE REACTIVATION OF GENES ON THE INACTIVE X CHROMOSOME) - sequence listing, part 14

SEQ ID NO: 1145 - DNA, 33091 bp, mus musculus
tgagtgttaaaggctaagcgtgtctagctggacccgtggccccgaagaagcgagacaaggcgacgcggagctgtccctgacaccccgaggaccgagggacagcgaagggccggggccgccggccattgccaggcgccattaggtgacgcggccgtcacgcgatgacgcgctgaccggcagtggcctccacgtcgcaggttccgcaaagacctgtgggagcgacccgggagaaggagggccaagatggcggaagcggaggagtctccaggagacccggggacagcatcgcccaggcccctggtgagcttgggatctgcgacaaaagggaccgagggtgaggcagagtgccccctaaagaagtcgggggacgggctcgtggcctgagagccggagctccttccgcccggcaggcccttcttgtacccgatgccagaaccagtcccaacactgcacctgttctttgcgctaaccgctttgccccctgccctcgtggttccttccaggtctttttgtgaaactccgatctttcctttcccatcctcccaggtctcgtcatcgtcccctacattgtgttaaatggcgaactttaggtgatttcttaagttatcttttcttctgctgtcccctcattttatcaaaacctgtcaccagcctttgttgaaggaataatgagagattgcttcccgtgggacattaacgttttgttgcttataactttagtattgacttgttcagtgaccccagtaggccaggtttaacccctgtcgcagctccttgccattctcttcaccatacttgttctcctttcttattttttacttttttaaaaatcgagacaaggtctcactctgtcacccaggctggagggcagtggcgcggtctctgctcactgcaacctctgcctcccaggctcacgtgatcctcccacctcagcctccctagtagctaggaccacaggtgcgtgtcaccacaccaggctaatttttagtatttttttgtagagacggggttttaccatgttgcccaggctggtctcgaattcctgggctcaagctatcctcctgcctcggccttccaaagtgttgggattacaggcgtgagccactgtgcccggccatcttcactatactctcttgctcctgtctctgcaagggatagaatttccactgcaagcccaaagtgtggacaagtattttaagaacacaggctttggagttaaactttacttgggatggaatccacccactttgtgagtttcggcaagtcattttagggagggtgtttcttcatctgtaaaatggagataaaaatacctgcctcaaaacagtttttagaaagatcaaatggcataatttatgtaacgtgtctaatactatcagtaccatgaactgaggagtataatgaggtcaatattctgctcctgtccctcttctcaatgtgtttagttatatagtagttgctcagtaaatggttcttccctttcctctttttttttctttttctttttttgagacggagttttgctcttgtcacccaggttggagcacaatggcacaatctcagctcactgcaacctccacctctggggtttaagtgattctcctgcctcagcctcctgagtagctgggattacaggcgcctgccactacgtccagctaatttttgtatttttgtagagacgggctttcaccacgttggccaggctagtctcgaactcctgacgtcaggtgatctgcccgcctcggcctcccaaagtgctgggacacaggtgtgagccaccgtgcctggccccctttcctctgttttgaattagcaacttaacatagtgaactgagctgggagatcagtgaacttaattctagtcctagctctgctgcttactagctccatttgttcacctcttcactcactcaacaaatatttattgagcatccgctactatgttccaggcactcctttaggcactggggatatggcaataagagtgagttgtgttaagttctatcgtgaccttgagtaaaatcaggctgaaccccagtttcctcctttggaaaatggtgataggaacacatcactgaattagtgagagtactaaatgagataatatatacattgtgcctactgtgacattgtcataggtgcttagtagtttttagtttctttcatttaaacttctccacccctcttctgtgaagctttccccagttaacttcagtggttctgatcactcattactcaatatgcaatccgcttccattcaacaaatgtttagtgaactcccacaatgagtaatgcactgtgctagttgctgtagggaatgcaaagggcctgcctctatggtgctaccagtcttaagttttagggataagacaagtatacaatgctaaaataaggcagtatgtaagagaaagttacacaaagaatattacagaaatttaaaggaaaatgctatcatgtccagttggggtgaccaagctacatggtggaagttatatttgaaaggacttcaaaggatgggtaggatttgaaattgcaagtgagtataagagctatcaataactgagcacctgctacatgccaggtattgtgctagacatcctctgcgtatttgctactaaactttacagcaatcatttcagttaggtggcttttaactacattttatgtgcagatgaggatatgacatgcagggaggtttgatgatttccctagggtctacatccagttagtgccatgcatgaaatttgaacctagatctgactctgaagcccagacttatatatccatttatatataagtggatatatccattcatatatatatagaagcgcagacttatatatatccatttgtgctacacagcctcttgtgaacaaaggcacagaagttggaaggtgctagtatatttatagaacaacactttggctgaagcacagagaattattaggagataagccttcagaggtaagcctactgagttagggaggcagtatggaacagtggtggtttggaatgtgtactctggagtcagcttgcttaggtttgattctaagcactgtcacttaactagtgggatattggggaaattaccaaacccctccttgcctcagtttccccatctgtaaaatagagatataacaatacttagttcatagggttattaggtggaatgagttaacacattggataaattaacacacttaatagaatgcctggcatataataatgcaatgtgttatttcttattattggctactaacctgggaggcttaatgggctacaaagagccagtggaaatttttgaggagggaagaatttgaaatcatgaattggacaacataatagagggtaagttacagtgggggaatatctggaatctagagggccagtgaagctgttacagtagttctgagaagaaatgataaggatctggacaacagcagtggcaggagacaagaggatttgagacaaggcagaatccacgagggtttgtagcgtgtgaaggaggatttgtcttagatcagtattttccaaactttagtgtgctagcagtcatctggggaatcttgttaatttgcaggttctgattcagttggtctgggatagggcccgagattttgcatttcttacagactccctggagatgctgctgctgctgctcccagtaccacattttgaagagcatggctatagacacccaagagtatagtgacactctgaacaaaaatagataatatataaggagggttagctggatgagggccttaaaagttgactaattcagtttgggacatgtttagtttgagatactggcaggccattcaatagatatccaacaggcagttggactttaaaacatgcacttcagggcgcagaagaggtcttgcctagagttgttgatttaggagtcatctgcacagggttaaaaagacagaatcttgggtaatgcctgtatttagggggcaggaagaagagataggctgtaataatggctgcagtctggggtcttttttttttttttgagccggagttttgctcttgttgcccagggttggagtgcaatggtgccacctcggctcactgcaacctctgcctcccaggttcaagtgattctcctgcctcagcctccccaagtagctgggatcacaggcatgcaccaccatgtgcagcaaatttttgtatttttagtagagacagggtttcacagtgttggccaggctggtcttgaactatagtctgggatctttggaagatctcaggctatgaggaagctggccccaggtgaaggggctggctggagaccatgccactggctaccccgtcatccactcctgggagccaggcctctttgagctgattcctgcttcatgcttccccgtgttgattcctttttccaggattttggtcaatagtataacccatttgctcccagctattttttttagggttgcagtccctgcttttattgtgtgttttttggccctgcctctacctgttccccttactggcccaagccaggcagagcaatgttcatgtgtgtttctgtgagcacatctatatatgtgcaagagcctgcctgctgatgggaaaggggagggacatggatccaagtcgcctttcccgctgagggctagacagagagcagggtccattagctgaggtcctggaagtcctgtcttttatacatggagctggagggccatagttcctgactcagctcatggaacactgttgctgattcttgaagagacaaaggggagagagtaggggatcacatgggacttcagtgactacagagacttctgataccaactacctggagttaggccaaactgcacaggttaaaagcacagtcctctacaagactgctcttcagacaccagccacaattttgggggttcccaggaccatcctcacttcagagcaagtagcaacaaattcacgggttcccacgttccgctcaggtttatttcttttttggcacaatctcagctcactgcagcctctgccttagcctcctgagtatctgggactacaggtacatgccaccatgcccggctaacttttgtattttgggtagagacggggtttcaccctgttggccaggctggtctcgaactcctgacctcaagttatccgcccatcttggcctcccaaattgctgggattacaggcgtgagccacggcacctggccctcccctcaggtttcataattcactagaatgactcataggactcagaacagcactctacttaaaattacagttttattatagcaaagggatacaaatccaaatgtgcaaaagagagagatacacagggcgaggtctgacagggtcccaaacacaaagattccttgtcttgtccctgtggattcaagacatgttaccctcctggtttgctggtatgtgacaatatgcagagtattgccaatcagggaagttcactcatgtgtctatagtttttattggggtttcattatgattaattggaccattgctcacataatggaactcaatctccagggtcccaccactcccgaaagtttgggcttatatgttgtgacttaaagccccaaacctctagtcatatgtgcggtgtttctgacgtggttagcccccatcctgagtcatcaccagagtacaaactacgtaagggcctactgtgactcacctgtaagcataaactaccagagcccctgtgaatatcaaaaatactcctctgtcattcaggaaattctaagtttagaggctaactctcaagtacaggggacaaaggccagctaaattctttattatacagtagtgacagaactggaattgactccatgggaatcttgaacttgagctaacatttatccagcccctattgtgttcctgtattaatacatttcttcctcacaataaccctgtgatgatggtaccattatctcaattttacagaggaggaaactgaagcacagagaggctaagtaacctgctcagtgtcacatggatagtacaagatggaactgggatttgaactcaggctatttggcctgcactcttaaccagtattctccaaataccatgttgagcattgagtatgtgctaggtgctgtgcagtgttatttatctttatagcagtattgtttccatgtgagatccctgtttgactttaaagcctgtttttttcctactgtactacaatgcttctcctagcagtagcaggcaacagggaaactgaaaacaagcaatcctggcacttgaaagggcagtgttatagtagtgaggagaaaatatggcttcaaaaagtgttggttttggctgggcatggtgcctcacgcctgtaatcccagcattttgtgaggccaaggcgggcggatcacttgaggtcaggagtttgagaccagcctggccaacatggcaaaaccctgtctctactaaaaatacaaaaattacccgggcatggtggtgggtgcctgtaatcccaactactaggggggctgagacaggagactcgcttgaatccaggaaacagaggttgcagtgagccgagatcacgccactgcactccagcctgggtgacagagcaagactgtctcaaaacaaaccaaatgggttggtttacgcattacatgctgcagagtattcaaagagagtgaggcttgaatgcagatccttgtatttcttgattatgtgaggctacttttggagagcacaatgtcagtaaagtggtgagaaggccaatgccagattacagaggattaagtgcgaaagtaaagtttgatcaagcaagagaaggagagtagtttgagagaatggcagaaacaagggagtgatgtatttttaaattttattacagaagctttcaaatgtgtaaataaaatgaagagtagcataatgaacctcatatacctatcaacattctattattttattggtctcaccacattttttttggcctttttatttaaaactaattttaggcatatagaaaagtgcaaaaatagtagagagagtgcctgtattcccttcgcccagattcctctaatgctaacgttgtacataagcatagtacactgataagaaccaagaaattaacattagtaaaacactattacctatagaccatatttgaattttagcaggttttccacttatggccttttttgttccaagatcttatctaggatcccacattgcatttagttgttatttttccttcatttcttccagtctgtaatggttcttcagtcttttcttatctttcataatcttttctgagtattttaaagcaaagcccagacatatcatcttcatttgtaaatacttccctacgtttctctaacaggtaaggactttttctttgttatcatacataacaaaactaataataactgcactccagcctgggcaacagagtgagactccatttcaaaaaaaaaaagaaaaggtaaattggatccccatatacaccttcaacaattatctacttacgatgaatcttctttcttctacagccctacctactttctttattattttgaagcaaatcccaggcatcattacattagtaaatatttggtatgtatctctaaaagataaggattctggctgggcacggtggctcatacctgtaatcccagcactttgggaggccgagatgggcagattgcttgagcccagaggttcgagatcagcctgggcaacatgacaaaaccctgtctctactaaaaatttaaagagtagcctggtgtggtggcacatgcttacagtcccagctacttgaaaggctgagatgggaggattgcttgagcctgggagattgaggctgctgtgagctatgatcatgttattgcaatcctgcctatatgacagagcaagaccttgtctctaaaaaaaaacaataaataaataaataagaaatttttttttgattttgtattattttagagttgccttcttgctatgttgcccaggctggagtgcagtggctgttcacagtcgtgatcatagcacccgcagccttcaacttctggcctgaagggacactctcacctcagtctcccaactagctggaactataggtgtgtgccacagttcccaaattagaattctgcttttaaagagaacataaccacaataacattaatgcatgtaaaaaattaataacttcttaatatatctcagggttcaaatttccaattatctcctaaattatatttttataatttaaaaattggcccactgcctgtttttctaagtatagttttctgggaacagagctacacttatttatttatgtgttatctttagctgctttcatgctacaatggcagagttcagcagttgcaacagaaaccatatggctctcaaaacctgaaatatttactgtttgaccctttacagaaagtttggtgacccctgctttaggcaattatcttttagaataattaaaaataggaagaaatgtcatatttactttcattttaactaatttgggagatcatttatttatgtaaatccaagtttccttctgatatcatattccttcttccagaggaacttcctttagcatttcttgtagaatatattttagcttttgcttgtctgaaaaacgtttttactttgactttatttttaatagttattgctgggtttagaattcagtgttgatagttttattcttttagcactctaaaagtgtccctccattttcttttggtttgcatagtttctggtgagatgtctttctttgtttatttgtttgtttatattttgttagagatgtctattataatttttttttttttttgagatggagtctcgccctgtcacttaggctggaatgctgtggcatggtcttggctcactgcaacctccgcctcctgagttcaagctattctcctgtctcagcctcccaagtagctgggattacaggcacctgccaccatgcccagctaattttttgtatttttagtagagatggggtttcaccatgttggccaggctggtcttgaactcctgatctcaggtgatccacctgcctcggcctcccaaagtgctcagattacaggcgtgagccaccatgccggccttttattgtgattcttatctttgttcctgtaaatgcaatgcctttctctttggctactttcaagattttctctttatctttggttttcaatagtttgtgtctaggtttgtggattttttcattttgtcctttggtattcatcttgattggggttctcttggcttgtatctgtcatttgatgtctcattatttttggaaaattctcagctattctttttttttttttttgagacagagtctcactctggagttcagtggcgtgatcttgggctctgcaagcctcgacctcctgggctcaggtgatcctcccaccatagccttctgagtagctgggactagaggtgtgtgccaccactcctggctaatttttaaatatttttttgtagagatggggtttcgccatgttgcccaggctggtctggaactccctggctcaagcaatctgtctgccttggcctcccaaagtgctaggattacaggcatcagccactgcggttagcctatatctcttcagagccattatctttctattcttctgggattccaattatttacataataagaccatttaatgttttcccatagttcctagatactctattcttttttcttttcttcttttactcttctccttttgttttagtttgcataattttgactgacctagctctgaattctttctttggtattgaggtaactgataaggctggcaaaggcattctttatctgttactatgttcatgtatttctagcattgccatctgattcttacagtttccatctctttgcagaaattcatcatcattcatgcatgtaccttttctactagagccttttgcatattaaacatagtaatcttaaatttcttttctgataattctaacatcttggtcatctcagagcctggttttgttaattgctttgtctcatagtgggttgttttttcatgtgagtatgggggagataatttgttattgatattgaacgctggacatcatgtacacactgctagaagtggcacatctctgctgctgagttgtcagtcagtaggggttaagtcagtctagtcagggttgagctttgtttgttttgttgttgttgttgttgctatggttaccttcagtgcatcaccagcttcagattcctctgttgttaccttgagtttaggggtgggggtgctatgttgtcccagtgttttgttttttgttgttgtttttttttttttgagacagcatctcactctgttgcccaggctggattgcaatggcgtgatcatatcttactgcagccttgacctcctgggctcaagtgatcctcccactttagcctcctcagtagctgggaccacagttagttgcatgccaccatgcccaactaattttttaaaaacattttttgtagagatgggggtctcactgtgttacccagactagtctcaaactcctagcatcaagcgattctcctacctcagctacccagagttggggttacaggcatgagccactgcacccagccccaatgtttttattaatgttcatgttctgtactcagcttctgtctttgcccttgcatctcatggtgagtctctttctaagctctagcacttcctccagcagtagactgctgttgtttattactccatacttgctagcctggtgataggggccagggaaaggggattctttgttttcatagtctagtctctgccttaggcagaccatgtgtccctgggtctcctgggtagcactttcttagtgatcctgtccccctcctagctgaaggaaactcttaatggtctgggcccaggatggttttctgtccatcccttagtagtagagagcttttccttttccctttctccagcttcagtgagttgtcacctgtgttctgaaggcaacttgtttttgtctaagtggctttaaggctctttcctctaggggcttttttctagagaagagcctgtaagtgggtgtgaactccccttgcgtctattgcttccagggattctgtactcttgtgctgatccatacttggactttagcaatttatttaaaattttatttgaattcttacccatctgtgtggtgtggtgtgcagcattgtcttcccctcatgctttgctactgttgagccagtgctgatgtctcttcgtggaagcacctggctttctttagatttcatccaggctacttggtctccctacaactcagttctcagatgaattcagggaaagttatgattcagtaaagtatctagccttttctcattattctacttggggaatggtctttccagcttcctatatcttaatcagaagtcaaattacagtgttatatagtcacttgaaataggtgctatctttgtggttgtgtgtttatttcaatacatggtagtttcattggtttaattttttctctcagtttcagggattgcttccttcaaattttaattttgtttaataattgtgtgaagtgtttatatgattgcaagtcatttatatggacaacatatattgaaaaaagcctagtttctctccctgtctgctctatcctattcctttctttcctctataagaaacctttaaaaaaaaattctatggcatgtttcttatatttaagaaatatgagtgtggttaagaaattgtttttgttttattttattttattttattttatattttatattttatttattttatttatttatttatttgtttattttttgtatttttttgtattttattttattataacggagttttgttcttgttgcccaggctggagtgcaatggcgtgatctcggctcaccgcaaccttcacctcccgggttcaagcgattctcctgcctcagcctcccgagtagctgggattacaggcatgcgccaccacgcgcagctaattttgtatttttagtagagatgggatttctccatgttggtcaggctggtctcaaactcccgacctcaggtgatctgcccgcctcggcctcccaaagtgctgggattacgggcatgagccaccatgcccagccttttacaaattctttgaacatcctcattccttctaaaatttcagtatactgtctgcatttcatttatctgcaactgttgcccattaaaaattgtgcctactgggccaaaaactgtatgagaagtcattgcctctattttcttaggaatttgtagatttgagttttggttgtaataaaatttgacggatgtgaacatcctcattctttctaaaatttcagtatactgtcttgtgtttcctttatctgcaactgttgcccactaaaaattgtgcctactggcccaaaaactgtatgagaaggcattgcctctattttcttaggaatttgtagatttgagtttcggttgtaataacatttggcagatgactatgaatttaaaagttcacattctttattcactttgaaaattttatttgctctgtgattgccaggtaacctgtaaagactgtaatcaaggtatattttgctatttccctgtttcccgcacttgcctttatggttcatgtaatgctcatttttagccagcagaggccactagagcctgttagggagcagaagtgcaacagaaacgtggccattctaagacagtgattgctaaaaggtcactttttaataactttacaattattatctcagtcttgctagcttgtgccatgtgaagattttatgctaaatgttggtgggcaagaaggtgtctatgacatttactttagttttttcattatgtttaatctttaaagaaataaatttgaggattattgttaactgcattgtgtaatgtctgttgagctaacacctactttcctatgtaaaaccctacaaaatacatggtcccaactctctaggaaatgatgatatatatgaggaatgctacagtttattacaggcttactttttttcccctgactcttctcagtttgcaggcctttcagatatatccatctcacaagacatccccgtagaaggagaaatcaccattcctatgagatctcgcatccgggagtttgacagctccacattaaatgaatctgttcgcaataccatcgtaagttagactagttgagagaacttctgttcagtatcatgggactaagtaactaatagtactttgcaatattttcatttggttcactgattttgaatatattttatatactgaagtttaatattttatcctagagattaatttggtacagcctttttggagagcagtttggttataatgcatattaataatcttaaaacagcaaggtgcggtggctcgcgcctgtaatctcagccctttgggaggccaaggcaggcggatcacctgagctcaggagttcgagaccaacctggcccagatggtgaaacccccatctctactaaaaatacaaagattagccagacatggtggcatatgcctgaaatcccagctgcttgggagactgaatcgcttgtctccgggaggctgaggttgcagtgagccgagatcgcaccactgcactctggcctgggcgacagagcaagactccatctcaaaaaacaaaaaaaaggtcttaaaatgtccaaatctttttaaaccaatatattatcatacttctccaaatgtagtataaggaaagttttaaaatgtaaaacaaaaattttcaacattaaagtatcaatatacaaagatgtttattatagcattctttgtaataggggaaagctagaaataaatgaaccacagatgaggtattggttaggtaaattatgttatatctttgtggtgggatgctaagcaactattataaattatgtttacaaagtgtttaataacgggtaaaattctaggtgaaaaaattaaaacagaattagctcagtggtgctttgagaggttgtatttgtattactgaacccttcttccagtttcttgattttttttttttttttgtatctggcatctaggattcatttaccaattaaattgggaatgttaaaaatttatttcatatattgcaaagaatgtagtagctagagagcaggctaattggtccttggaacctcatcttctatgaactgaatgtcacatactgtgttttgtagagcagctttttatagtacaattgttttagtttctttaagcagcctattgggagggctgtgtttcttttttatggattttttcaacatcaaaacagaacagatcaaaacagatgtggaaaggtgttaaaagttggcttaagaagttaatagaaaaagcataccctacctctctggtttgtttgtgtagtgaaggagttgaactggaattatctgcaaaattcagtgaagagttcacaggagattgaaatgaaagaaattttagcaaattaagtaaggctgctggcaaccttggtcatcacaatacaacaagttgtttctgtctttcagatgcgtgatctaaaagctgttgggaaaaaattcatgcatgttttgtacccaaggaaaagtaatactcttttgagagattgtaagtatatgaggtttttaagggtttgcttaatctatctcactgtaccttatcgtaagtactttataaggcaaagtctctgtggtaataaaactgacatcattttgtaggataaaaaaatatgtaaacgaatatgtaaatcaaacttctggcagaaattaaaaattgattttattttatttttattttcatttttttttgagacagagtctcactctgacttccaggctggagtgcaatggtatgatcttggctcactgcaacctccgcctcctgtgttcaagtaattttcatgcctcagcctcctgagtagctgggattaaaggcgcccaccaccatgcccagctaatttttttgtatttttagtagagacggatttcaccaggttggccaggctggtttccaactcccgatctcaggtgatccacccacctcggcctcccaaagtgctaggattacaggcagacattaaaaatttagattggaatctcagagattgaaacattttgcttattatattgtcctcatcagtaaatgtacactggccaggcatggtggctcatacatgtaataccagcactttgggaggccgaggcaggagaattgtttgaactcaggagtttgagaccagcctgggcaacatggcgagacctcatttctactaaaaataaaaaaactagccaggcctggtagcacaagcctgtagtcctagctacttgggaggctgaggtgggaggattgcttgagtccaggagatcaaggctgtagtgccgtgactgtgccactgcaccctagcctgggtgacagagtgagacctgtctcaaaaaaaaaaaaatatatatatatatatatatatattttaaaaaatgctctagtggttactacaaaatacatttctggaggctgctaatttacaatatttacatttattacataatattcctggaagctgctgacacataaagagttaatgatctccaagggaaaggcaaatgtttaaatttttgtttgttagttttttgagatggagtctcgctctgttgcccaggctggagtgcaatggcacaatctcagcttactgcaacctctgcctccagggttcaggagattcttctgcctcagcctctggaacagctgggattacaggtgccccaccaccacatccagctaatttttgtgttgttagtagagacgggttttgccatgttggccaggctggtctcgaactgctgacctgaagtgatccacctgccttggcctcccagagtgctgggattacaggcaagagccaccaccccggcctaaatgttaaattaatatgatagtaaatacccgtaaacatttaacaaattaatagtacctttattgacagtttgattttcaagcctatcatttagtctgatgactgctttctttattagagttctgtcaaaacagacagcgtctcattctgttacccaggctcaaatgcaatggcgtaatcatagctcactgcagtctcaaactcctgggctcaagcagtccttctgccagtctcctgagtagctgggactgtaggcacacatggctagtttttaaatattttgtagagatgggggtctccctatgttgcccaggcttgtctaaaactcctggccttggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggtgggcgcctgtaatcccagctactcgggaggctgaggcaggagaatggcatgaacccaagaggcggagcttgcagtgagccgggatagcgccactgcagtccagcttgggcgaaagagtgagactccgtctcaaaaaaaaaaaaaataaaaaaaataaaaaaataaaactcctggcctcaagcagtctgcccacctcagcctcctaaagtgctgggattacaggcaagagccactgcccagccaatgttttattttttcaactttttgttaaaaactaagacaaaagcacacactttggtctaggccttcacagggtcagaattggatcattagtacaattgtcttccacctctgtatctgtcctattggaaggtcttctggggcattaacacgcatgaaactgccatctttgatgataacaatgccttcttctggaatatctactgaaggacctgcctgagactgtgttatggttgactttttttttttttagagacatgatcttgttctgtcactcaggctggaatgcagtggtgtgattatagctcactgtggcctcaaacttctaggctcaagccattctcccacctcaggctcccatgcccggagcctgtgccaccatgcccagctaatttttaaatttttttgtctgggcacgatggctcatgcttctaatcccagcgctttggcaggccgaggtgggtggaacacctgaggtcaggagttccaggctagcctggccaacatggtgaaaccctgtctcattacaaatacaaaaattagctaagcgtggtggcaggcgcctgtagtcccagctactccggaggctgaggcggaagaatcgcttgaacccgggaggtggaggttgcagtgagccaagattgcaccattgcactccagcctgggtgaaaagagggaaactctgtctcaaaaaaacaaaaaacaaaaaacaaaccacatttttttagagacagggtcttgctatgttacccaggctgaactttttaagtagaagtatactccaacataacaatgaaaagtataatatagtaaacacgtaaaccacagtaacatagtcattttttgtcattatcaagtagagtattatgtagtgtacataattgttctatatttttatatgactgtcaacatactaggtttgtttataccagcatcaccacagacacgtgagtaatgtgttgtactagatgtcactaggtgataggaatttttcagctccattataattttatgggaccactatcattgaccgaaatatcattatgtggcacatgacagtacacttgaattcagtttttaagttgagcagttaaaaaaaaattaatgaaattagcagcagttttattagaagtggtaggattatggttttttatgtcttttccaaactttccacaatggtgtcaaaattacttatacaattaaaaaataaacaatattaagtatataaatttgcgtacctctcttgggtaaggttatatacatgtgaggttaaagttcgatgtggaatatttgcctttttggaatgaattgaggaaggtaattgtgctctaagctatgtgctactgaactgttggcatgcaaatcactcagcagctttttttgtttgtttttttgagacagagtcttgctctgtcacccaggctggagtgtagtgagtggaggttgcgatcttggctcactgcaacctctgcctcctgggtttaagggattctcctgcctcagcctccctagtaggtgagattacaggtatgtgccaccacacctggctaatttttttgtatttttagttagagacgggatttcaccatgttggccaggctcatctcaaactcctgaccttaagtgatcttcccgcctcagcttcccaaagtgctgggattacaggcatgagctaccgaacccgaccaaatcactcagcagctgtttttgtttgtttgtttgtttgtttttgagacggagtcttgcactgtcacccaggctggagtgcagtggcacaatcttggctcactgcaacctctgccacccgggttcaagcaattcccatgcctcagcctcccaagtagctgggattacaggcacgtgccaccatgcccagcgaatattttgtatttaatagagatgggatttcatcatgttgcccaggcaggtctcaaactcctgagctcaggccatccgcccgcctcggcctcccaaagtgctaggattacaggcgtgagccacagcatccagcctgcagcttttgattgaggaccatgtttgctagacctgatgttggcagagcctgcagagccttttgcagttttcagaaagctttcatatgttattaaagtttaaccttgtgaaattaccaatactgggctgttttttcacctagaagaatagcaactctatattaattcaatatactaattataaaagggaagcagtatgacagagtggcaagaactttggtctaagaatcaaaagaccaggctgggtgtggtggcttatgcctgtaatcccagcactttgcgaggctgaggcaggtggatcgcttgaggccaggagtttgagaccagcctgggcaacatggtgaaactccatctgtacaaaaaataaaagttagctgggtgtggtggcgtgtgcctgtagtcccaattattcaggaggctgaggtaggaggatcacctgagcctgggaggttgaggctgcagtgagccatgatcgcaccactgcactctagcctgggcaacagagtgagaccctgtttcaaaaaaaaaaaaaaaagaaaagaatcaggccaggtgcggtggctcacgcctgtaaccccagcactttgggaggccaaggtaggcagatcacctgaggtcagttcgaaatcatgctggccaacatggtgaaaccccgtctctactaaaaacacaaaaattagccaagtatgatagcgggtgcctgtaatcccagctactcgggaggctgaggcaggagaattgcttgaacccaggaggcagaggatgctatgagctgagattgcgccattgcactccagcctgggcaacaaaagccaaactccatctcaaaaaaaaaaaaaaaaatcaatagccctaggttctggtcccacctccacatataaagctaggcaagtcatttccttctcagcttcattttttgtatttgtgaactgagcatgattatacttgccttgtctaatgcagtctctgactggtaaagtgccttggctatagtctttttttcttagaatatggggtagggaacctaggtctgctgattgtttgtccattggtctttaattatagcgtgccagcatgtgtcttagtagatggggagaaggaaagggtgatttgtgggatatgaaataagcgaaactggaagtctatgtaaagaagtgcattcaggattaggggacagggagggcaggtggtgggagaggagaggtaggaaggcttggccagccaaagagagccttgatgtctgaattctaggagggagagaggtagatattagaataaagacagaaaatattaccttcgcttctgtcttttcttgtcttgtaggggatttgtggggccctttgatcctttgtgtgacactcgcattgtaagtacttgcattttctttctttgtcatttgagctagactagacttttttgtggatttccaaaattgtgggggattttgattgaatatttcatttaggacttatatgacatgttgtacatgttatactccttaggtatttaagcctctaaagtcactttccaaatcaattaaaatatgatgaaattaggctcaccttccttaaccaatgacattttagtctgttttagccatgtctattcaacaaacatttatttacttatttactctcctgttcctccctattattaaactaagtgaattaaggtttaagcaccctttgtttgcaaacataattctctgtaatcttactaaaaatatgaatgagaatgagaataaattaggagagttaaaagcaagatcatgtttcagagtgttgtacttttccatacacattgtaggtaaaggaagaggacggggaaggagaagaaggttacactagagagatgaatataaccattgatagagcgggaaaaaatactgccctggaattcagttctgagttcgcattctgactctgctgtcagctagctatgtgactttgggctactaataaccaatgtttgtataatttttcccagtttgcagaaaactttaaaatactttctcttattttaacctcattgcaataattaaaattattttatttttctttttttttttgacaaacaagctcaggttcaaaaaggttgaggatttaaccaagatcacataatcagtggtagacctgagattcaacctcaggtttcctcactacctattttgtacctctagggttcattacacatctcttcccacctggtcactctgggtcgcctcttccatatctgtaaagggagtggttgagggtcctttccaggcttaaccctttatgggtctaaattcactaagtttcttgctgacctctctaattttttaaatttaaattgagcatatattaatttaggtaataatgtagagtactatttcttatgcttttagtaaccatgttaagggatgcagcctaatgccttgatggaggggtttatattagatgtcccgagcatatatattttttttacttttgaaagtttaaccttatagattatgtagtttaaccccacttagttgcagagaaaactggagtcccaggacatcaagtgacatatctagtgacagaattaggatcagtatctgggtctcttgccttccaggctagttaatattctttccatcataccatgctgaagcaacagggattccagacaacaagtgatgagtgctggccattctttgcatctggttgtcacgacttggaatggaatatgcatatcatagaatacaaaagcctgtgcatactgccaagtagcatagcagggcaagaaagacttacagtgtgacttctctatactgtttaataagaagaggttgtgagcttacagttattatttttcttggtaataacaccaagtccaaatattcaaaacagtttatatctgtaaaattcttagacaaagaaaggatatttaagtggttgttcaactactcaattccaaagcaaaaccctttagtaataatctgtatgttttgattttttaaaaatcaacaactaaaaaggtttatagactgtttccatttttatttattatttttattttgttttgaggcagtctcactcagttacccaggctgagttggtggtgtgattacagctcactgcagcctcaacctcccaggctcaagcgattctcccaactcagcctttctagtagctaggactataggcgtgtaccaccatggccaactaattttttattttttgtagagacgggggtttcgtcatgttgcccaggctggtatcgaactcctggcctcaagcgatctgcctgtcgtggcctcccaaagtgctgagattacaggctaagccaccatacctggcctatttccatttttaaatatctcaactgaaatcttaacccaagaactacaaattctgatgtgtctaaaggctagaatagtaacctaaatgcatgtagtagtgatatggtgactgtaagccccttgtacttatgtcagttacacttgattgttgcagtgttggaatgcaggctcaatgttagaaagtctaacagttttttcaagaaaatctagaaattcatattcttatgtgaaataaaatagtgtcaacttaaattcaaaatcatcttaaatattatataagcccaaggcctcattatatatgagccacatttgacccttcagtttataacctctgcttaaaaaaaaggtcttcaataattcatttaaacatttcaacaaggtcaaatggagcaccccttgtagtcctgaggcatttggaatttgcagtaagggagccttgccaaatgcttgtgtcattttccttttagcacaacctacatattacagatcttcaggtgaggtatggcacagcaatctgattcaaagtttgagaacccatgccttaactttgttgccctaagtaaaagattaagcaattcttacgctgtttccttttctcagaatgctgcaaagagactctgcagatagtgaaaaagatggagggccccaatttgcagaggtgtttgtcattgtctggtttggtgcagttaccatcaccctcaactcaaaacttcttggagggaacatgtgagtattattaaaatgcattctttttttcctcttgccaggtagtatatcttagattaaggaatacaggctagctagatttttttttttttttgagacagggtgtcactctgtcacccaggctcgagtgcattggtgtgatcatggcttactgcagcctctatctcccaggctcagcgtcccaagtagctgggatcctcctgccccagcatcccgagtagctgggactacaggcatgtgctactatgcctggctaattaaaaaaatttttttttttgtagagatggggtcccactgtattgcctaggctggttttgaactcctgggttcaagtgatcctcccaccttggcctcccaaaatgctgggattacaggcatgagccaccatacctggcctcatattttgttttaaagaaaaatcaaactaaataagggccaaagagaagtgttcttaaaaccactaccactgtacagagataaccttgttaagttaaattatcttaaattatcagaggtcctttgataagcttcagatgccctttccaggccctgaaatcataggcagacttttttgtgtaagaagagtatgtacgttttggggggcaagtggtccctagcttttaacaaattctcaagtataataggtctataaactagaaaggattaagaaccactaccttagaggttcagagaaagatatctgtaggaactagagcagatcatctggtgttagatgattgacttttaaggaatttgagaggagaggaggaagagtatggggaaagaaaattaaagcatgtacttaattttttttttttttgagatggagtctcgctctgtccaggctggagtgcagtggcacaagctcagctcactgcaacctccacctcccaggttcaagcgattttcctgcctcagcctcctgagtagctgggattacaggtgcctgccacaatgcccggctaatttttttttgtatttttagtagagacggggtttcaccatgttggccaggctggtcttgaacttctgacctcaggtgatccacccccccacccttggcctcccaaagtgttggtattacaggcgtgagccatcgcgcccagccaaaagcatgtacttaataattaatgttaggatgtagatgttatgtaccaagaaggaggcaacattccgttacatagagaaatctatgtaataagctgtgtcataacacccatcagttgtatttatgatctttattaatgtattttgtttttaagatctttttttcagagcctctgtgtgctgggttactgtatacttcccttgacagtagcaatgctgatttgccggctggtacttttggctgatccaggacctgtaaacttcatggttcggctttttgtggtgattgtgatgtttgcctggtctatagttggtaagtatgtacttatttccacaataacagaacagacaaaaacatgatttaatgatgaagaccagatgaggagcagtataagtccaaagttagatgtgagtgatatgattcttgatagtattatccatagaaccctcttccctgagtaggcaatgatggggcttatctgagttggatatctggacttataagatgtggagagtcacatcttttttctttctttaaaaaaaaaaaaaggttgggaaagtggattacactacatttagcctagtcctggtatatacaaggcattaggtgacttgtggaatgactgggatcttttcctgataaactaattaaaataaaaataataacatttacagattgcttatcaaaggccaggcactgtttaagtgctttatatatattatcccatttaagcctcacagcaactctaatagagaaatactgttattagtcccatcttacagatgaagaacagttacagagaagttgagcagcttgccctaggttgcattacttgtgagtaagagagtcaaattgcaaaccaggcagtcatgaacctttaagaactatactataccaccttccagtgtagattgtaagtatcattatatagcacttttctgcttcagtagaacattttgctaaagactaggaagggcctatagcaatgataatgaatgctatgtgctcattgtttttatattcctaaagttctcttaagattccagcttaaatttagaagtgttcactagcttctgctttaatggataggcagactgcttaatatttttaagtgtagtaacatctcattgctctggaacatggttgaaagctaagaagtaatccaacaaaggtctgagagagccagaactgatattccaaagactgtatattaagcttgggtgcttttcccatggggagagcccctcattctctcactgagaatctcataattaccataaatgtaattatacttacttagttatccagtgtccaggctcacaggtgatcacgaagtagaatcataggagagagaaactttaattcagcaaacattaatcacaaactatgcgtcaggcataattttaggcatggtctttgtccttggagttcacaatctaacagagcagcccgacgtgaaaacatttaaaggcaataggtgttctaagtgggaaatggagatttatacacagtacagtgggacagacatgattattcaggaaagatttcccagagatgtgatgatgatgatgattagtatttgagacagagtctcactctgtcacccaggctggagtgcagtggcactatctcggctcactgtaacctccacctcctggattcaagcagttctcctgcctcagcctcccgagtagctgggattacagctatgtgccaccacatccgattaatgtttgtgtttttagtagagatggggtttcaccatgttggccaggctggtctcgaactcctgacctcaggtgatccacccgccttggcctctcaaagtgctgggattacagacatgagccaccgcacctggctgattattttcatttatttatttatttggctaaaaatatatatatatatatatgtttttatattattattatactttaagttctgggatacatgtgcagaacatgcaggtttgttacataggtatacacatgccatggtggtttgctgcacccatcaacccatcatctacattaggtatttctcctaatgctattcctcccctagcccccccagcctctgacaggccccagtgtgtgatgtacccctccctgtgtccatgtgttctcattgttcaacccccacttatgagtgagaacatgtggtgtttggttttctgttcctgtggtagtttgctgagaatgatggttttcagcttcatacaaaggatatgaactcaaccttttacgtggctgcatagtattccatggtgtatatgtgccacattttctttatccagtctatcattgatgggcatttgggttggttccaagtctttgctattgtgaacagtgcagcagtaaacataggtgtgcatgtgtctttatagtattacccagtaatgggattgatgggtcaaatggtatttctggttctagatccttgaagaatcgccacactgtcttccacaatgcttgaactaatttacactcccaccaacagtgtaaaaatatttctatttcttcacatcctctccagcatctgttgtttcctgactttttaatgatagccattctaactggcgtgagatggtatctcattgtggttttgatttgcatttctctcatgagcagtgatgatgagcttttattcatatgtttgttggccgcataaatgtcttctcttgagaagtgtctgttcatatccttcgcccactttttgatggggttgtctttttcttgtaaatttgtttaggttctttgtagattctggatattagccctttgtcagatggatagattgcaaaaattttttcccattctgtaggttgcctattcactctgatgatagtttcttttgctgtgcagaagctctttagtttaattagatcccatttgtcagttttggcttttgttgctattgcttttggtgttttagtcatgaagtctttgcctatgcctatgtcctaaatggtactatctaggttttcttgtagggtttttatggttttaggtgttacatttaagtctttaatccatcttgagttaatttttgtataaggtataaggaaagggtccagtttcagttttctgcatatggctagccagttttcccaacaccatttattaactagggaatcctttccccattgctggtttttatcaggcttgtcaaagatcagatgattttggatgggaggcattatttctgaggcctctgttctgttccatcggtctatatatctgttttggtaccagtactgtgctgttttggttaccatagccttgtagtatagttggaggtcagatagagtgataactccagctttgttctttttgtttaggattgtcttggctatatgggctcttttttggttccatatgaaatttaaagtagttttttctacttctgtgaagaaagtcaatggtagcttgacggggatagcattgaatctgtaaattactttgggcagtatggccattttcatgatattgattcttcctatccatcagcatggaatgtttttccatttgtttgtgttctctcttatgtccttgagcagtggtttgtagttctccttgaagaggtccttcatatcccttgtaagttggattcctaggtattttattctctttgtagcaattgtgaatgggagttcactcatgatttggctctctgtctgttattggtatataggaaggcttgtgatttttgcacattgattttgtatcctgagactttgctgaagttgcttatcagcttaaggagattatgggctgagacgatggggttttctaaatatacaatcatgtcatctgcaaacagagacaatttgacttcctgtctttctatttgaataccctttatttctttctcttgcctgatttccctggccagactttatgttgaataggagtggtaagagagggtatccttgtcttgtgctggttttcaaggggaatgcttccagcttttgcccattaagtatgatattggctatgggtttgtcataaatagctcttattattttgagatacgttccatcaatacctagtttattgagagtttttagcatgaagcggtgttgaattttatcaaaggccttttctgcatctgttgagataatcatgtggtttttgtcattggttctgtttatgtgatgaattacgtttattgatttgcatatgttgaaccaaccttgcatcccagggatgaagctgacttgatcatggtgggtaagctttttgatatgctgctggattcagtttgcaagtattttattgaggattttcacagtgatgttcatcaaggatattggcctgaaattttctttttttgttgtgtctttgccaggttttggtttcaggatgatgctggcctcacgaaatgagttagggaggaatccctcttcttctattgtttggaatagtttcagacggaatggtaccagctcctcttgtacctctggtagaatttagctgtgaatctggctggtcatgggctttttttgattggtaggctattaattactgcttcaatttcagaacttattattggtctattcagggattcgacgtcttcctggtttagtcttgggagggattatgtgtccaggaatttatcaatttcttctagatgttctggtttatttgcatagaggtatttatagtattctctgatggtagtttgtatttctgtgggatcagtgttgatcttcaatttatcagtttttattgtgtctatctgattcttctctcttttcttctttattagtctggctagcggtctattttgttaatctttccaaaaaaaacagttcctgtattcattgattttttgaagggtttttcttgtctctatctccttcagttctgctctgatcttagttatttcttatcttctgccagtttttgaatttgtttgctcttgcttctctagttcttttaattgtgatgttagggtgtcagttttagatctttcccgctttgtcctgtgggcatttagtgctataaatttccctctaaacactgctttagctctgttgcagagattctggtatgttccgtctttgttcttattggtttcaaaaaacttgtttatttctgccttaatttcgttgtttacctagtagtcattcaagagcaggtcgttcagtttctgtgtagctgtgcggttttgagtgagtttcttaatcctgagttctaatttgattgcactgtgatctgagagactatgatttccattcttttgcattctgttgttatgatttccattcttttgcctttgttgaggagtattttacttccaattatgtggtcaattttagaataagtgtgatgtggtgctgagaaaaatgtatattcagttgatttggggtagatatcttttaggtccatttggtccagagctgagttcaagtcctgaatatccttgttaattttctgtctcgtctatctgtctaatattgacagtggggtgttaaagtctcccactattattgtgtgggagtataagtctctttgtaggtctttaagaatttgttttatgaacctgggtgctcctgtattgggtgcatatatatttaggatagttagctcttcttgttgcattgatccctttaccattatgtaatgcccttctttgtcttttttgatctttgttggtttaaagtctgttttatcagagactaggattgcaacccctactttttttgctttccatttgcttggtaaatattcttccatccctttattttgagcttatatgtgtctttgcacgtgatatgggtctcctgaatacagcacactgatgggtcttgactctttatccaatttgccagtctgtgtcttttaattggggcatttagcccatttgtattttaggttaatattgttatgtgtaaatttgatactgtcattatgatgctagctcgttattttgcccattagttgatgccatttcttcatagtgtcgatagtctttacaattagttacgtttttgcagtggctggtactggtttttcctttccatgtttagtgcttccttcaggagctattgtaaggcagtcctggtggtgacaaaatctctcagaatttgcttgtctataaaggattttatttctccttcacttatgaagattagtttgtctggatatgaaattctgggttgagaattcttttctttaagaatgttgaatattggcccccactctcttcttgtagggtttctgccgagagatcagctgttagtctgatgggcttccctttgtgggtaacccgacctttctctctggctgcctttaacattttttccttcatttcagattggtgaatctgacaattatgtgtcttggggttgttcttctcaaggaatatctttgtggtgttctctgtatttcctgaatttgagtattggcctgccttcctaggttggggaagttctcttggataatatcctgaagagtgttttccaacttggttccattctccctgtcactttctggtacaccaatcaaaggtaggtttggtcttttcacatagtcccatatttcttggaggctttgttcattcctcttcattcttttttctctaatcttgtcttcctactttatttcattaagttgatcttcaatctctgatatcttttcttctgcttgatcgattcagctattgacacttgtgtatgcttcatgaagttctcatgctgtgtttttgagctccgtcaggtcatttatgttctctaaactggttattctagttagcaatttctctaacctttcttcaaggtggttagcttccttgcattgcattagaacatgctcctttagctcagaggagtttgttattacccaccttctgaagtctactgtcagttcgtcaaactcattcttcatccagttttgttcccttgctggcaaggagttgtgatcctttggaggagaagagacattctggtttttggaattttcggcctttttgtgctggtttttcctcatcttcatggatttatctacctttggtctttgatgttggtgaccttcagatggggtttctgtgtggatgtcctttttttgatgttgatgctattcctttctgtttgttagttttccttctaacagtcaggcccctctgctgcaggtctgcttaagtttgctggaggtccactccagaccctgtttgcctgggtatcaccagcagaggctgcagaacagccaagattgctgcctgctccttcctctggaatcttcatcccagaggggcacctgccagatgccagccagagctctcctgtatgaggtgtccgtcaacccctgctgggaggtgtctcccagtcaggaggcatgggggtcagggatccacttgaggaagcagtctgtcccttagcagagttgaagcactgtgcgctgctctcttcagagctggcaggcaggaatgtttaagttgctgaagctgtgcttacagctgctccatcccccaggtgctctgtcccatgaagatgggagttttatctataagcccctgactggggctgctgactttctttcagtgatgccctgcccagagaggagaaatctagagaggtagtctggctacagcagctttgctgagctgtggtgggctctggccagtttcaacttccctgtggctttctttacactgtgaggggaaaactgcctactcaagcctcaataatggtggttgcccttccctccaccaagctcaagcatcctaggtccacttcagactgctgtgctggcagtgagaatttcaagccagtggatcttagcttgctgggctccatgggggtgggatccgttgagctagaccacttggctccctggcttcagctccctttccaggggagtgaacacttctgtctcgctggtgttccagacaccactagggtataaaaaaaaactcctgcagctagcttggtgtctgcccaaatggccgcccagttttgtgcttgaaatccagggccctggtggcataggcatccgagggagtgtcctggtgtgcgggttgtgaagaccatggggaaagtgtagtatctgggctggaatgcaccgttcctcatggcacagtccctcatggcttcccttggctagggtagggagttccccgaccccttgtgcttcctaggtgaggcgattccccaccctgcttcagctcaccccccgtgggctgcacccactgtctaaccagtcccaatgagatgaactgggtacctcagttggaaatgcacaaatcacctgccttctgtattgatcttgctgggagctgcagaccggagctgttcctattcggccatcttgccagccacctcctgttatttttctttaaagagatggggtttcactctgtcattcagtctggagtggaatggtgcaaccgtaacatattgcagccttgaactcttggcttcaagcagttctcccacctcagcctcccgagtagccgagattacaggcataagctgtagcacccagcgagaggaatgattcttttttgtttgtttgtttgtttgtttgttttttgagactgggtctttctctgtcacccaggctggagtgcagtggcgccatcttggctcactgcaacctctgcctcttgagttcaaacaattatcctgcctcagccacccgagtagctgggattacaggtgcccgccaccacacctggctaatttttgtatttttattagagatggggtttcaccatgttggccaagctggtctcgaactcctgacctctggtgatccgcctgcctttgcctcccaaagtgctggaattacaggcatgagccactgtgcctggtcagaagggtgattcttgatgagtaaaacgatgattaggtttttcttagatggacaagggagggatggcgtttaaaagagctgacaatttcagaagcacagttagctcaaaaagcagagcagcacgaggccgtttaccataggaacaaataaccttacacatctttgtaagccttttcagtacagttcaataacttttccagaaaagggtaaaaaactccttttagaaagatttccatccaaaatggtttagtacttgaaataagtcctcggcctcggctctctgaaaaactatgttgcagaatgcctttatctctgaggatcaccagtataactaaacttttagtgtaattctgtgttctagatgatgccaagctcatgaatgtttagtaaatgttaatagttgtgacaatattactgtattaaacattcctttttgttttgtcttgttttgtttagcctccacagctttccttgctgatagccagcctcc

SEQ ID NO: 1146 - DNA, 28617 bp, mus musculus
aggtgggcggggcgtccctacagccctactcgccgacgctccctccccacttgagctgagtggactcgggttgacaacggctaagcagccgcggcagctgctcttctggctggcaccgtcacccctgcccgaccccaggccccgcgtgtgtcccggacggagcagtccctcctgggctcgcctcctgcccgctcgctctgtgtcagcgcccgaacccaaaggggtggacgcggcctccaggtaggagtctgggcgacggcagggggagatccagacaaacgggggcgcctggggctccctctccccgctttgcctctctggcgcgctccggctcggcccttctcctagcggttccgccgggcggcgtacgcaagagacagggaggaagcgagccgagccacccccgcccctgggattggggggtcagaatcgccgaaattgggggacccccgagcgcgccagccgcgcgtcttccagcgaagcctcgcgagtggggcggtggaaggcagctgtccgcctgttaccgccgggcccgtgggtctcgcagccgtcgctctggggctttggaggggcgttgcagctggccgggggcggcagagcttcaggctctgttgccgggtcgcgccagatctcctgccctctcctttctctgctttcgagggcatttccaggaagcccccgtccggctgtatgggttttcccgtcggccactgcctcattgctttctctcctgagaaatgcccaggacttcttggtattaagatagctgcggggaccaagcgaaaacgtttggacacgtctcatcttcataggcctcattttcccataaagtccaaaatgggtttggattagaggaaaggcttttagtggaagtttttggaatttccaaattaggtagtgtggggttctctccacgttcctcctgacacttgtgaaagttgcgcgctgaattacgactcaggaaactggggttcagccagtccatgtgaccttaggcgagtcatactactgtgtgggccatagtgttttcagccacacctcaggtggcagcttgatttcagtatctaaagggcccggtctctttcaccctgacatttgtttacttggtacctggggtcaggctcctaactggcaggtaaaaggttgtctctgagacgctcggggtggcagcagctatgcacacggagagctttgtggtgattatgcagctaagccagctggaaaactagagtgtgcgtggaggggtgggcgacagcagccagaccaaggtagggagaggtgggagttttcttccagagcctggggccccagaggttgggggcctcagagattgggctggcttggagcctatgcttacccccaagtcccagggcctggcttctctcccagtcagagcctaagcggggaggaggggttaatgaatcacacccagggctattttcaaaccctgactcctcctgtgcgacctgctccctccccactctagggtttgccgcccccccgccccccacacctgtattattgccctctgagttttcctctcattttcatcctcctggaatgaaagggggacaaatcttgtctgcggatgcgatgggaaggtgggcagcccaaaggcatggagaagaaggctgcaggtgatttctgggtggctttcgcagtgggaagagtgtgatgggaagggtggtgttttgctgtaagggcataggggtcggtagtgaaactctttcactctaaaggtacagctgccatctagctggacattctgggctggttttcattttagggacgtggccttttgttaatgtgttggactttggattttggatttctgctccctagacctctatatttagtgctaggaaacaccacactggacactgcctctcctgtttttggagaattatgctaaacctctctgtgcatctacagctcccctcccccacctagagaggagaagctgcctacagatgatatctggaggtgtttagagcaagaagggctgaactgaaggtgtgcaaagcaaaggggctgtgtgcgctgtgtgcttgcttgagacagggcttgcagtgagtcatgtggggaggatggcagagccttccttattcaaacacaatacctcctgagttccagcagagaagcaaagaaagtggcaccaagaagactcgaatgttgtccctctctgtcctcttaaagttttaaaattccattattgggactacagattggagagggagcagaagacccctgtgtctaggtttagaggatagcaacagggacacaaaggcaagaaggtcccaaaggaaggaggggatggagtctccaattgggaagctgtcacagctgcagctgctttgctgctaggagactcctggagctccttatttgagccatggaaagttcaggttcaacagatggcaggtttatcacgtgcaggctgtgccctcacctcttttctggctagaagaaagggttgcctctgccttgaaaagaagagaaggaccttttgccttaggctcccagtttggttaggatcaggtgtcatggccctgggccttgggaaagctgttcagcagataaaatagggacagcagatttcaaagatacaagggctttagggtgggaagtgtgagctcccggagatctaggtgagttttacattcttccccaccccacaacagggtagttgggcactgggttgggcacacagttgctggtgtcaggtgtttattaaggggtcttggtttgtgtgtgcgcacgtgtgcatgggcatgcattcgggaagggtcctggtagataggaatcagtggactggaggccacagcctgggcccttgtcacaagtctgaagtgctgtgtttgtgggtggagtttccttttccccagccctgcaggttggtaacttgcatgctaaacagttgctgttcctgtttacctcgaccacacacaggaattttagaactgaatgttaagttccctaggagttcagggtggtgtggagcaaagaacaggggattgggagttgaacatggggagctttaactccaggctctgccgcccccctcaaattctccgactctgggtttctcctcattttttccacttcactggattaaactaggggatccatagctaagtgctttgtaaactaccatgtgctgtataaattattagtcattaagtttaggcttggtgctaggtcttgtggaggacacagagtaaaaacccccagttccagggaatgtaccatctagtttgggggttagtggcataaataatacatgccactaattatttatgtattaaataataataccttggtgaggacttcaaaaaaattattgtgaataatttcaaacatatataaaaatagagataattagtgtactaagaccccatgtacccatcacccagtttcaacagccatttgcccatggccaatcctgccctgtccatactcttatctacatcatgcccttgttattttgaaacaaatcccagaaaccttatcagttcatctatacatatttcaatacgtatttctaaaagataaggattcataaaaacaaccattatcacacctaaaatagtttcttaatattatcaaataaccggtaagtgttcatatttccaattgttgagaaggacttatttgccctggacgtccattctgccctgggaaatccattccagggagtgattgcttttgactgaggggaaggtgacggacagaggcagtggcatttgagctgaaccttggaagagaggcccaggaaaggtcccagcccagatgttagccgcctctagggctccagatctggaggctgacccatggaggcttcttgcggagacttcctgcctttgtttctctagcagtaaatgacagttctcactctcacacttgcttccccagtccagggcacccaggagtttggggtacgcaggtctgggagaattctgggaggctgctctccacctaggcccctcccctgcgcctggcccctgaggccagttcagagcaaaacaggatgcattcaggatgaacgtctttcccagcttgtcatctaatcaccaaggcccagcttggagcttcctctctcattcatgataaaaaccctcactgtctctcttttcccttccgccccagtaagggtgtgctgacttcctccatatccgggccagccctctacccccatgtggggctgagggagagattccctcagtgcaggcctctgcccccacccacctcaccacagcctgtcagagagggagagaaagaccccaggaatgttctccctgactgcaggctcctgctcttgggctgtctttgggaaaagagcagcctccttccaacaagcctggggtcctgccactgcttggttaatcattgagccacataataaccaccttggaaagtcatctctaggggatggtcattaactaactccctgtccacctcaggccttaaagagaccatatcctgaaccctcaccttcccccaagggaacattgacaaacattcactcacgggaacttctggggccagtgaaaagtctgcccctccatcctttacttggcaaacggaagcagttattcacaccatttgaaggacatgggttcagcttggatggtattgagaaggggagcggagtgaattgatggggatttggatgggcagtggggtccagcatcagagttaaaaaggggtaggggggtgtttctaggagtagttgatcgcctcatctcaatttgaaagtctaaaagagcaagaaatgcccacccaaagggtctgccgatgctgggtatggggtgaggctgtgtgaatgtgtgtctgttttcagtacagctgtgggtccctccacaccaggctgcagtggaaatggggacagccaaccacatgattgctgctgagaggctgaggacctctgtaagtggaggaggatgccttcctccgggagcctgtatctggacaagcagtggcacttggtaagggtcgggccaggacccagacccagacccagacccagacccagacccagacccagacccaatttagaaagctccagaccatatgcagtttcctgcagtttcagtaggaagagaaggaaccaccccgtgggcctactacagagttgggaaacggcttctggttctgccccctctatagctttctctcggtgagtgatttttgctttctctgggcctcaatttccacaactataaagtgggtagggcagttggcaggcagactcagtggtctgtgagccttcctttcagctatgcaagtatgcctccccactcaagacccttttcttatctaccaggcaatggtgagctggcttcaaattcaatcaggcccagacactgaatgttctcagctggctgggtcagttggagctggccaagccctgaattgccacagcttgggttctccttgtgcttgggcatttctgcagtttgctctctggcccctccccaagcctgtgtctgtccctagtggccagccactctctgacccattcagccacaagttaatgagtgaactgctccccctgggtcgtaccagcccaaggtgctcctgggatcctaggtccctgtgggaagcagccaagggcctagccagctccagtcacctttatgctctctcccacaacccctctagaggtaggtatgcaggcagagctcagggcagaaggacctttagagggcactaggtccaactttccttctgaagcttggggcttcccgacaggtacttgtgcagttcctgctcactcatgttcaatacctgggaatgtgatatgtttcaagcaagttgctttcgtctttggaatgtgtgaaagttttctcttatgttgaacttaactgtgcctccctgaggcttctaaccctgggttccgagtgtgccctctgggaccacctggaccctgtctgctctctctgaccttcagggatctgaggatggaacccaagtgcacctgtgtcttctctaggccaaacaaccttcaagcgtctgcgctccttctcagacctggagcagcccccttcccagcctcatcactgtcctctgtcctccctacatgctactgtttatggcccccttaacatgtgggggcaggaaatggggcactggaaacccctcactccccttagtttatttatagtctgaacttgttcagatgacttttccataatccttttctggttaccacaacaggtagactcctaacccccagaatcttgggtgcaaataccttagacaacactgatttgtttatggttcaggtccagccagctctcacgattggagagcccttggaaggtagggccttcttattggtgcccccatagtggaggacaagcctggtgttagtaggtgttccccttgttgagttaaatacaatgtaatatgtggggggcttccagcgtaccctgctttcctgccactcggttttatctttggagttggtcaggggtgggtggagggaaggggatattttagggagtactgaagccggaaatgagtatgagccatgcccacagtggggcctagaagagtgaatcagacagtgagaaataccaacgtagccattccttcccctggcagttgatgatgatgactatgagtcctcccatttcttcagttgccaaggcactttcacttccatgattccattgtgttcttagagcagccctgtaaagtagatggtatgatttccccagaatgatctgtggtggtctccacctgaggcccagggaagggaagaacagtctccagtgagggaggatttggagcccaggtctcctgaccctcagccctccctgttttccccaaaccacacccagcagccatggcagccggggctgactcggcagcttccccaccacagaggaacccctgccctggctgcaactctgttcctgtgagagagtgagctccaagggacgtggcctaggatttcctgtcctttatctgggctggccaaaggctggcctgtctgaggtgtgagataggcacctgcagccagcctttctgctccaggctgaggtcaagtcaggctgtggcagaggcagtgagcttgtgggaagagcttgtccccaaacatctgtcctgagcagtgcccacaccagcagggccttctaaatgggaaaaacagagaggggaatgtggaaaaggggtcagagtggagcagaagtaaaatacgtcctgagctgtacacaagctctcatgttcacagtgctgggagactttgggcaaattacttaacttctctgagccttcattttgtcagctctaaaatggagatatgtacccacctcatggagttgttgaatattaaatccaacaatataaataaaattattgccattattgttgcttggtagtaccttctgcagtcctgtcatttggttgtttttcactgacctgggggtgggcagttctcaaacctgccacctcgtgggcattcggtctggactttgcagtcatttcagagtccaccttacccagaaaagctccctttggccatgcccacccacagggctcccttcctctggccttctttagtggcattcgcgacactcaacaggctatagtagtgatggtgacaccaataataatagtgaactcttctaaattcttggcaaattttaacttctttagcattcatggcaattccataaggtaggtactgctatctttgtctctcttttatttaataaacttgcccaaggtcacatatccggggagtgatggagctgggatcaggacccaggtggtctgactccacctcctgacatctttaatgactgggccatgcctctctccagatgcctggccaggaggcaagagctgaggttcgggtctccttccccacctgagtgctcatcacacgcaccagtgatcagtcacttctggacaggcagtccccaggtccttgcctgtctgctctgtgcacttcttctcaccctccatcaccaaggtggacagatggatagagggaagacatggaggagtgggtattcatgctctaaaacagagctgcattggggtggggagggagtgcaggagggagttgggcagtgggggtggcagtgtgggcagtgggggtggcagtgtggttctgacatcagcaccaggcctgcctgattagcaccttctagtactgggggtggagaacagggtgctgggtggcatcagggaggaagagacatttgaatatgctctcttgacaaccaggttgcattatttagaaggcatgggtggttaggggctggcaggaggctggctggattagctcttatgatcactagctggcgtgtcccatgctagaattgggtgggaggaggttgtccagaagctgtagccctccccgaagtgcttccatctcagggtcttgggggctgcaagcttccttccctcaggctgtactagctgccagctccattgcttcagggcttattcccctttatcttgcctccgaagcaagctccagggagtgctacgaaggccagtccatggtagcctgtctccctgagaaggatgggcctggcagcagctctggccgagtgctgcaggagaattcagtttttgttctgttttcagaccttagtacccagcatagggcttggcaccaagtaggtgcttgggtattattagttgaataaattcacagtccatggggagtggattctaaagggagagccgagggaggctgaaatgggaacaggtcaacaggagggctgtggttatttaggtaggcttctggcccaatctgtagtccaacagaagctacatgacctattgcagcctcagttttcccatttgtaccataggcattacctgctttggaggagttcttgtggggaccaagtgacatacaggatgatcaagtgctttcctggctgataggaagttaaattcaggctaaccactcttactacaaaaaccctggtagatgattttgtgtctgctgtgtgccaggccccagcctagacaatttcttttctttaatgaggaagattctaacttggtagctctgactctagagccaaactgcctggatttgcatcttggctcacctcttcttagctgctgaccttgggcaagttactccatatctctgggcctcagtttcctcctctgtaaaatagagatattattggagcacttagctcacaggtttgttgtgaagattcaatgacataatacacattaaaaaaaaaaacttaaagaaatgtctgggatataataatggctcagtacaaagtccatggctcagggcacatagtaagtactgtataactattagtgtctgctatattttattaataattacattcagtatcttaaatattgctgtcattaatgagtaagaagtatagagccaggaccaggggcggtggtggctcacaccagcaatttggaaggctgaggcagaaggattgcctgagccaaggagtttgagaccagcctgggcaatatagggagacacctatctctacaaaatataaaaaatacaaaaattagctggacatggtggtgcacgcctgtagtcccagctactctggaggctgaggtgggaggattgcttgagcccgggaggtcgaggctgcagtgagctgtgattgtgctactacactccagccctggtgacagagtgaggcctcattttaaaaaaagaaaaggaagaggtacagagaggtgacaaataggctacgtcttcaggtggctagcctgttaactcttcccactgtaccctgtaacttctacgcccataggccctacagagctgtaagaccaccatttggggttctccttcccttggccctaccatggcctgagcatgcacgtcatcacccttgcccccagagccctaggctccgccccttgctatgtgctcagcatcacagccctccctctggctctccttggggctgggggaggggtcgtgtctgctcccttcccggggaggccacttctctcaggcccatttcctttctatcagagataattttctctggatctcagggtggggccaggctccttcaaggcatttcctgcccaggagtttatatttggcctgagcaaaaggaaagggaagtaggcaagggggtgggatgcagacgtggtggcacagggtcaaaacagacaagtgccaagactttccagaccaagagagggaggcaggaggtaggcatgccccttctctcaagtgaacgtgggtgccctcccctgagcttggcagagtgaagtgctccttcaggtcataatgcctccaccatcaagcagagttcattttctgttcgcacatctctgagccttggttcctggctatgtggtttctgtcctagggcaaggctttgaggtgaagacatgtgctcaattccatttctagtgctgtggtgataccagacaagggagcagagtcagaggcctctatactgtgtagtgggaagtagggcttcctgtctgtgtgttgccagaacattcggtagcccttaacacactgcagcggcaacacaaagaccaaaagtacccagtgcagagaagcccccagttgaatgggggatagactcacatgctgctgagatgatcatggaaatgtgttaggggactgcttcattgaactgagccactgggtgttagggggttggtgagaggtcaggggaggcttcgcgggagtgggtgtttgacctccagcttgatgaagaaatagcagtttgaagcttcaaatcaggccatgtctagattgtgcagagccttgaatgccagggagcagtcaagactatctgccccaggctgtgggagctctttaggttgtagagtaggggagcggccaggttagagctgggctcttggaagaagcagctggcaggatggccccttgaaaggagaggctggaggctgggaacttggagggctgaagtaatccaggcaggagaacctagagcacagttgggcaggaaaaaacccaaccatttgatggaaaagttggtagaatttggtgcctaaatacatgtggccagaagagagcaaggatgacttgaggtttaagcctaggcagtgggcgtattgggaggcaggaacatatagagagctggtttgtggggaaagatgggtttggtttgcgttgccactgaggttcctcgcttgggtcctcagaagagaatgtgaaggaaggaagctccccgcactgagacagccactacgcatcacacacacctctgctgcagctctagattttggggaacggccattaggagatgtggaaactgaggttcagacagaggtaatggcttgcctgaggttatgcaagttgctcatggagctaaggccagaaggtagttcacctgaccgttagtccaatactttccactcaaaccacagtggagagcagtcaccgctggcctaatatctgccccagactggtttggctggcatcatttatctctaggccagggactggagatggtggagtagcacatggctcattaaaacaactctctctttcctaggcaccatgaccttgtcagagcacctgggactgggttgggggcaggagccccttgggggcaagaaaactaatggagcaactgcagcagagcaggtggcagctttgaccttccttgtcatagggaaacccagtgccaggcaggaatgttagctgtctactttggtcctgccataccaagctcaagcccaggagcccacaggctgggctgcctctggacccaaattctccagcagcctcagtgggcctgaggtctggtttaacctcagggtgctcgtgactctccctcatttacagctgcacacaggagctcaggccactgcttcacggagaggagcggggaaccacagttgggggtttcttgtgtaacttccatttttaaataaaatgccaaaccagaattgccacctcttcctggccgatcctgcaaggtgtccacggtgtgcaaaggctagggaccaccactgaatgttgcacccattcttcacttcagcccccaggacatcctggggggagggtgggctgcccagaggggccggaggccccagataaggcagaggccaaccctcaggatctcgtgcttcagatctggagtcaaccttcctttgtctggggctgtctggtgtggtgtatgatgtttagcaacatccctggcctctactgagtagatgctagcagcatttactccttgacccccaccaattgagatgaccaaaaacgtctccagacattgccaaatgtcccctgggggaaaaattgtccctggttgagaatccctgtggtagagactagaagttttttctggggtgtgcagtgttgagagagggatgttatacagaaggtagaaccacacacctgaacctaccactggccagctaaaagattcagtggcttgtttttcctgccaccctgtcctaggggcccctcctgggctgtttgctttggtggtgcctcatttgtgacagggaggctccagaagtgttgctcgcatgggcctggaacttggcatccagctgtagccccggccaagaccgaggctggcatctgaacaggtgcagcagggccctgagttctgcccggtgacctaacaagccagaggccagccagggtccagcactgccaacctaggctgggtgaaatacagaggcccttcctgcggtgcccctcctgtgaggtttggaatgtaggatgagagctattttggtcctgtctcctttcctccctgtgcctccctctgtaagaatcaagttagagttgtgattccagtgaagagcagcaggagcagagagaggcaccagtgaactggaccgccccatagatagggcactgcagacccccttgcatgtctgcttcaaggtcaggagggaaagtcttggtggccctgtaatccctgacagctcttagtacaggtcctcatgaaggtccctttcccactgtcccccagggagagaggtggcatagccagtcagccacccattacagcacttcttctaggggcactgccaacctagagggtagctttgtgcaaattcaaatgaaacagtgcccctgagggatgcagccctgtgccagggctcaagccttggtgggcaagcttattttggcctgggtcccttagtgtttccttaggggagggtaaaagaagctgctcagagcagttggggccacatgctgaggatggtagcttctgagatacaagccctctgccaaaaggccagcaccttctccttaagaggggtccctctctagggttggagagcgggcaaaggaaatgggccttgtagcaaccaaaagaaatgatctgagaagcagtttgccagggcctagcatttctgagcagcagtagcagggcctgcagtggtaggcgactccttgcctgcctcctagccctgccttgagggaccagcctcacagagcctgccttgggaactggggttgtcacatagatagtggcatcacaggtctttctccgccgctcaggacactggcttttcctcctgcactcactgaaggtgggagagacaaacatggagaccagaccctgttttggaggcccccatcctctggcgagggccacggaggagatgcttttccaaataggaagctaagtcaggtaaaggaggccaccacgtgtttaaagtcaccttaaggagcaggtcagctaactcaatgaccttcacaaacaccgactgcctgccttccctcagccatcatagacattcacactgatgctggtcactctccctgctcctgcactcaggtctagagagaacgtgggcctatgaatagaacaggcctgtgactggtctctgggtagaattttccagggacctatatctgtggctttctagcaggccttttctgtttagggcggtggtctttatctcaggctgtactttagaagaaccgggagagctctcaaaaacaaacaaacaaaaatgaaccctatccccagagagtttaatttaactagtcatgggtggggcccattagtaaaagctccccaggagattttaatgtgcagccagatttgagaggtgagggaggaatgggacgggacacccaagagctccagcagtaataaaggatgctttcatctatgtccctgtgacatccatccattgcttgtcttgagtcctgtatcttcccgcctggtccccatgcctgatactgtctttatgggtaggcatgagcaggctgaacccaggaccgggcagctctcttataacccactgagtgaccagaaggtacaaggactagggttgcctagtagtggtgtgaagagggggtacccagcccaagagtggggttggtgatactggctggctgaggccttacttcctgtagtctagattagatgcctgttgccttctctcttcctcctggctctcttctctcacctcttttcaactggtacacaatctgaactgtgtcttaaagactagatgggtacaaaattcagctcatcttaacaaaaatagccttcattaatgataacttttatatagccactttcaaaaccagcaaaagcccgatcaaatctataaggtaaccacagtggtagacaggaaagtcgttagtctccactgtataaatttggaaaccaaagcttagagaatgacacgagttgtctcagatgacttagtggcaagcatggaagctggcttgattagaaaaaagctttttttccaacttagtgatcatctttgggcattattgcatctcccagtgagaaatgttgctgcctctttcctgggtgcataagccctatgcttgagtgtttctcaagaccagaaggcctgcttttttcctggttgcatccttctcagcatagaaaactgctctgtgctgtctctgggacgtggcctgtgtaaatgtaggtgcagatactgtcattgacctcagaaagcatgtgctgctgctcagcctttccttctttgatgctccctccaggagacctgtgggtttggctctgaggcctgattggactctggagctttctagtatgccctctcccctgactctcccagcctgggtcatctgggcccctcccccaggggcttaagtctcagtggaatccagtttgtgccagctgactgctgttactgacctatcctggcacatcacctaagctttggccagagcatgcactgcctgcagaatatagcctttaaaactgctggcagccatgccttggaatctgcatatctggatacagaggtagggcaaggggccacagacattcctacctcactcacctcagcctgcccgttgtcactctccccaccagatacataagcccatcctcagtccgggccacctgggcttcagccccaggtgaatcgagtctactgggggtgggggtggggtcgctcctggcctcagcctgggtaggctgagacgagtgggagggacaaggcagagcacctcagttcagcctttaatcaccaagacatatgtctctgactgatccatctgggagggagcctcggggcctcccagccctccatgagatggtgtattgtggggagccaatgtccctgacatcctgtttggtaataacccattacattctctagattcctgttaaggagggctggtggggaattcagtctgtagccctactccaaactcctttgctcctttgtctttggagcaattgcagcctctttgaaggctccttacctcacttcccccagccatttggctgcaattctgacagtggtctgggcaaagccattgtccggacccacaggggaacgcagcagctgggcttctttctctaatttcctctttttctttgggacccttcagagtcagagttggggtggaacacatttgttgagtgcttggtattatgtgccaggggcttttactttctgtagtattttatttaatgctctcagtagctataagatgtggatgctggctgggtgtggtggctcacacctgtaatcctagcactttgggaggctgagacagggagacaggaggatcactggaggccaggagatggatatcagcctgggcaatatagtaagaccctgtctctacaaaaaataaaaagaaaattaaccaggtgtggtgtggtggatgctattgtagtcctagctactcaggaggctgagatgggaggatcacacaaacccaggagtttgagcctgcagtgagctgtgatagcgccactgcactccagcttggttgacagagtgaaaccctgtctcaaaaagaaaaaaaaaacccataaacatgaaaaataaaataaaaatagaaaaaagatgtggatgccatggctcctattttaccaagaaggaaacagaaacctggagaggttatacaactcgcccaaagtcaaagagctagtgactgacagcatcaggatttgaaccctgggttgtgactccactagaccagaaggagcaggaaaacagcctggggggctggggttggttcctttgagtctgagctccttgcttggctggcatgagggcaggtggcataatgcaatggcaaagagcactgaacatggagtgaaaagatcagggttatagtctcagctgtgacactttaccctgtatgaccttggaaaagtctcttgggcctcagtaggccttatactgtaacttttaaaaaataccaatgtggagagtcctaccgcagatcaattaagccagccttctggggaaggggccctgggcactggtattttttaaaataacacttcctagctgattcttatgtgcatccaggggtgagaatcactgagcaatgtgatttagaccaagacttttcaaactttaatgtgtttgcccaagggtcttcttaaatatagtggttctgggtgtggggcttgggattctgcatttctaacaagctcccaggtgatgttgatgctgctagtctgggactacactttgagtagcaaggggctacagggctctaggtagtcatgaaagaacttggcattgacctgagtgagatggtccccttctgccaacccccagctagggccaatgcctagcatcaggggagggaggtgcctctcctaccctctccattagccatgagtaactgagggctgcagtgggattttaagggtgtgttcctggcatgcaggcctaccctagagatttgctccctttcctggggtggccatacttgtgaccctttaggggccactgtctgctcctgcgcctgcctctctggaagtcctaacctggtccattttctggcacctcccttttgtcctaataacaggaaagcagagctggctgccaggatgcgtgctaagatggggaaagggtctcatcccaggggcatgacaggaacagggacagggaagtggctgtggcagccagctcagctgtcctagcagcagaaccatgttcctcacaggctccctgggcagctccctttggactggtcttacatcacctagactaccactggcctggagcacaggatcctttttcaggcttgcattgccccctgccagacaggtggaggtactgctagcagggctctgtcagacactttccagggacccctcagaggtcctggcgattcctagatctctatcttaggttaggaagttgcagtaacataaaacatacatgtatgcatgcacacacacacacacacacacacacacggagagaaagagacgagagagagagagagacagagagacagagagagaaagagaggcagatgcatgcacagactgaggtgcctgtgggtatatacaggtgcatggtcccacagtgatcctcatgagtcatggacatgagcagatttggctacagctacatgtagagacagatgctgtggtgggcactgacctgttgcattcactcacagaaatgcagagatgttcatccttgcccttacccccatttgcccccaaaacctgcaggggctccaggggctgcagagccctctcttctttccctcaaatcctcatcagtgtgtgacccttgaggagcccattactttttctgactgacttctgacttcccccactcttccctccactgtctactcacctagcatctctgaaatactgttttgtccttcatcttatctgtcccagccactaggatttcatcctgggtttccttgtgagtgagcactgggaagagagagctcttcctgtcttggaaaaacctcaccagcctccttagagtcctctggtcaggggggccaggcgagactgtggccacaggtgctgaggaaatggaggatgtgttgggggcaggactccatggcaggatcagctctgctgaagccagctgacttccccaaccaacccggtgatgccaggtcccatggtcccagccccattcatcttggcatcacctgggtgggaagcaaataaccgcccaggcaggtgcagggctttgctgctggtatttggcctaccctgactaggagcgcctcctctgtggctttagtccagctgcacatctctgctggtgctggcaggggtgctcagctctgtgccagaactcccagagcagaggcgacaggctgacctagccatggccccccaagaccccgacaggccagtactgtgtcttcatgacactcagcactgcactatgacacaaataggccaagagggctggggcagtactgggaagctccctgaggagggaggactataatgagcatgggggtgctgctgtcagactcagctgggattccaaccctggcactgctgctttgtccactgtgagaccataggctgagcctgtttgtttgtctgtaaaatggggatagcaaagccatcaccagttattgtgtgtgtgaaatgagagttggctgtcaaagtgctgaagaatgttagatgcgatgatgagaaagagaatgataggaatggttgaacatttctacttcctgcctgggctaaggtggtctacccagggccttggaagggggtgagtccctcagaaaggctcgggggtggacacagctgtggcttcttatcccagcaggcctccttgaccccagatgatcctggttcctgggcagggggtgggagagtgggaggggtttggaacaggcagggaatgagactcaagaaagccagggccaggatgcccagacagtagggcttggggagcagagggcctcctggctggctatgacttggagcaaatgtgctaggacctctggccttctcttgccattgctagatcaccagaatgagacatgtctgcctgctggggttgggcagcatgcacctagggccctggtgtcagcaccctcctaaccccatttctttgcctgtttctttcccttgttctgttttagaagccgaggccaaaagagcatgtgagtggcttcaagcaacaggattccctcagtatgtgcagctttttgaaggtaaggccactcaactgtttaccctcccatacttcccctagccctcagtttttcatctgttagatggggcaagtcagattctctttccaactacacacaagcagtgtctcctggccctgctccgatttttttcagggactttgctcctgcagttgcacctttctctcctgcatcatctctaagggattgctctcacaactgccacaagctctgctgttgcccatgcctttaaagtaccttgtcttgaccagggtcatcacgtggtaccaatcctgaggatgccatgtaggtacacacggtgtgaagaatgccgcctggagttgtacaccctggtggcccaggcttggcctcacttgccccacagtgatggcctcatttctctgttttccttcatttctctttcgggtttttctagagttcttcgcacttgctgtttcccttccccttttctccccacacccctactgcaccctggcttcacctccacctcgcctggtcaacttgcctggtcaattcaccagtgacctccatgtggtcacactcagtggtcacttcccagtcctcatcttgctccatctctcagcagcattcggtgccactggccactccttccttcggcttctggaatgcccccctttcctggctgcctctctggctgggttctgtctccttagctgactctgcttcctctaactgatatctaaagtttaggatatcccagggctctgtccggggccctcttctctctcaacatttctttctcatgagatctttgtctaagtactatccatattctgatgacttccaaatgtccagacctcatccccaagctccagattcatatattcacagctgccaattcaatctctctactcagatgtctgattggtgtctcggattaaacaggtctgaaaccaactcatgatggtaccaccatttacccacttgctcaagccccatacccaggagtcatccttaatttaattcctccttgttcccatctcctatctctaacccttcagcaagacctttttccctccagaacgtatcttgaatcaatccactgcttactacctccactgccacagcctggtgtgacccagtgtcacagctcacctgggctagtgcagcagcttcctgtgctcttgcactctcatctctacactgcagctggagggctctttttggccataggtctgactgtcactcctgctccaaaccctccgatggcctcccagcacactcagaatgtaatacacacagacactctgctctggcctgtcagactgcattctccaacttccattgattactcttacctttgttcacagggctcctctctacacttgctcacaccaagctctttccctcttcagagccttgatgctgatgttcctcctgcctggaactctctctgcagtttccttgcacagctggctgcttctcatctttcaggactcagctcggatgtcactgctttcagaaagctctctgctgaccacctctctacaagcagcctccacccctaccagcctccctttacactatcatgctggctgatgtcttccatgactgcaccatcttggttttaagtactgttgcttatctttttcctttaagagtgtaaactccaagaaggcaggaaccgtttttgttgtgttcactgttgtatgctgtatggtttgctcaagtgtctggcacaaagtaaatgctcaattggatactcattagttgaatgagtaaaggaacaaatgggcttgcttcaccagtaaggtagagagctgtgagacttctcagattctctcttccattcccccaactcctttctttcccctctcccctccctaagtcccagggagtgtgctctgggccacagggggatgcaaggtattgtttggctactgtgctgtcctgtcccttctgtccttgctcccaccctactcccccaagttcaccttgggccaaggagaagtttccctgcctgagcagcccaggattcaaaggggaatgggggagcccgtgttgggctcttggcagccacccggggtcttgggcctgctatctcccatggacctgccttactgactgacagagttctttgggtccagctcagccctctaggcctctcccagacctttccctgaactccctgggcaccctcctttattcctgactttttttccttctgctttgcctcttgtcttcctgctccccctccttcctggccgttcccttccagcccaagggctgctgaggctgagtttgtgatataccactgcactcatctttgcttctctctgccatacagaaggttcgtttcccctggatattggctctgtgaagaaaaaccacggttttctggacgaggactctttgggggccctgtgtaggtaggtgggctgagggccaggcctgggaagccaaaggcctggcttgaagcttcctcgtggaaaaaaacatcccttgtaccctctaacagaggaggagcccagcttactaacaaagctcatcttctgtggtcacattgctcattctgttctttgtgtttgtgataccctcaaccacccagtcactctagctagaaagccaagatctggccttgtttcttttctcctaaagttatagcccccaaatattcctctgcttcagtccctctctacttacaccagcttggcccttgtttgaggccaaaccatggcttctccttggatcgatcacaaggcttcagcctaactggctttagtcttgatagcccatctctcccctcccctctccctcttccctcaccctactcccagatcgatctagatccaccagcgtcgcattgtaacagctccaaatggttgttctttctgcttaaaatgtgtcactgcctaaggataaaaatgcaaagactttttagcataccacccaaagccctttgcgagctggctcattagccttagccccattggtctcatgcccacactggtctgtttgctgactgtatacctacagtgtcctgtgtaagcttgggtaagagtccctgtttctctcaccttcaaaatcccatttgcatcctccaggaagccttctctgactgcatccctccttcatggaagttgcttgtctctccctgtgtttgtctgctgtgccttctgtctgctctgtctttgaacacgccccatttctgtagggtttatttccactctctttgtaagctcctggagggcagaggccataatcttcccagcattgtgtctggttcttaaaccttcacgaatattggagcttgcgagaagttttgatggcttgggcatgtgaagtggcaggtgcatcttggtaggctctgccaggctttggggatggggacccttggttggacacttccattttgttacaggaggctgatgaccttgaataattgtgcctcgatgaaactggaggttcattttcaaagcaagcaggtgagtcatggcaaagcgtgggtctgtggtcttgtggtgccataaggaaacccagggcatacgtaaaccatttgtaaaactagctccagtatcccaggagtctgagatgtccagagcagtgcctttccccagctaggggtagagatggaggagatctaggaccccattctttcctgggaacttgctttcttgcttttttttttctggggctttctataccagaggcctgtagtcaggtggggcagccaagtgaccaaagccctgggctgtgagacaggaggcccatggggcctggtctcagctctaccactgattactgagggacctcagggaaacctcttcccttctgggcctcagtttccccattttgcaaagaaggagatgaactagaaaatctccaattccgtccagctctgttgtgattctaatctaagactacagcctagagcttgggaaggtctgtcactgacttaatgtatatcattgaccttgggcaagtggcttctggtttgtaggtttgttttcctatctgtaaaattggaaggggggttagattaattagttgaccattaccattaccatacatctgggctctgtctgtgactgctggcttcctctggcactcccagagctagctctccccacctaggccatgttctcagccagaaagcagggcccttcacctcagagtcccccaagagtttggaagcagagagtggagtacaagcaaggacttgtggcctgggcttctctgacctgatcctgcagtgcctttcccagaatgaagactcagaagaggaagagcagtgtaccatcagtagccactgggccttccagcaggaaagtaagtgctggtctcctatggggtcctctgatctgttggccccaccgagccctggcctgccagcgacctcaagctgtgagagcgtcctcaccgagcttagtgccacctctctgccagtcatcaccgtgagcctaccacccgagccagcagacttgcccttgccaggccgtgcccccagctcgagtgaccggcccctcctcagccccacccagggccaggagggtccccaggacaaagccaagaagcgccatcgtaaccgtagcttcctcaagcaccttgaatctctgaggcggaaggaaaagagtggcagccagcaagcagagcccaagcatagtccagccacctcagagaaggtctccaaagcctcatctttccgcagttgtcgtggcttcctctcagctggattttacagggccaagaactgggccgccacctcagccggtggcagtggtgccaatactcggaaggcctgggaggcctggcctgtggcctcgttccggcatcctcagtggacacaccggggtgattgcctggtgcacgttcctggggaccacaaaccaggcacattccctcgctccctgtccattgagagcctgtgtcctgaggatggacaccgcctggcagactggcagccaggtaggcggtggggctgtgaggggcgccggggctcctgtggctcaacgggcagccatgccagcacgtatgacaacttgcctgagctgtacccagctgagcctgtaatggttggggctgaggctgaagatgaagatgatgaggagagtgggggcagctatgctcacctagacgacatcctccagcacgtgtgggggctacagcaacgagtagagctgtggtctcgggccatgtacccagacctggggcctggagatgaggaagaggaggaggccacttcatcagtagaaatagccacagttgaggtcaaatgccaagctgaggctctcagccagatggaggttccggcccatggagagtccccagcctgggcccaggctgaagtccagccagcagtcctggctccggctcaggctccagctgaggctgaaccagtggcacaggaagaggctgaggccccggccccagccccggccccggccccagcccaggacagtgagcaggaggcacattcaggcggggaacccacctttgcctctagcctgtctgtggaagaaggacactccatttctgacactgtggcctcctccagcgaacttgacagtagtgggaactccatgaatgaggctgaggctgcggggcccctggctggactccaggcatcaatgccccgtgaacggcgcgattcaggtgttggggcctcacttaccagaccctgcaggtgagagtttgggttgggatggggcggacgcagggtctcctgttctctctctgtctctgaagctgatttctcagtcatgaggcccagggctaagtgcttggcggctgcgttatcccctcacagccagctcaggagagagagtacaggacttgggaatccagaaagttaggtccagaacctgcctgtgctgtggccttgaggaaatgatgctctcctctctgggcctcagtttcctcatctgtaaagtgagggaggatgctagaggagatggtctctggtccccagctttgcccattcagggtttcttggagcagcccctccacagtagtcttgggatgggcaggggtcttcactgcttattggcactagatgggcctgagctctgtgccaccctccccaagaacttcttggcccctaagaagctgagtccaagctttttccaccctggggcctcagcagcagcactagaaagtgttcccagctccctgcattttttctttggggagaaaaaaggggaccacaataacaccttttctaaggtttagccaaacctgctcctctgggcttctccacccctctcaccgccccccaccaggaagctccgttggcatagcttccagaactcccatcgtcccagcctcaactcagagtcgctggagatcaaccggcagtttgcaggccagatcaacctcctgcacaagggctcactgctgcggcttaccgcgttcatggagaagtacactgtgccccacaagcagggctgggtctggtgagtggctcctgggccatggagggtggggaactgctgactcaggtccacgtccccaggcagggtcagcccaggaggtgggtgcaggcaggcagggcccacaggccaggggagcggtgagatatgccaggaggctggaggggcttggtgaggctgggtatggggcagaggacctgaggtcctccagctgtatcttctccatcccaatctctgtgctgcaactagtgagattgtcctaaaatgcagctgtggttgtcactctccagataaacacttttctctggctccccattgtccagattccctcccaccatgactccttcctgttctggtcccgctccatccttctggctctttagcctaccgctcctaagcaaccccaccttacagaccagtgggaccagtcatccttccgtgaacgtgctatgatctttttcctgcctctttgcctttgtttgtgctgtgctctctgcctggaatgcattttccccatttctcctctgggacaatgccttcctatccctcaagagcctgctgagttaccacgtcctctccgaagccttccctaactcactaggtacagttcccctccctcaatgggtcttcccctaagttcttggcctcctactggccacatgagttgttactgcctattgacacagttatctccttggccagactgagagctctctgtgttcctctgtgactccctggggctgggcccaaaacaggtgctcaatgagtgttgactctggggcagtggtgtgtgccttacccccctcaccccacctgatcctctgagactgcaggcagagtctccaaactgtgttccccctatctgatcacttgtcattctcccaaacaggtcaatgcccaagttcatgaggaggaacaagaccccagattaccggggacagcacgtatttggggtgccacccctcatccacgtgcagcgcacgggccagccactgccacagagcattcagcaagccatgcgctacttgcgcagccagtgcctggaccaagtgagccctcgtggggcagcctgccgggagatggtgcaggggtggggtggtggtgggcattgggctgaaggctgaggagctggggagaggaactgctctggccttccccctcacttgggctggtccaccagaggcctttgctgttctcagcaaggaccagcaaggatgaaactcctttctactccttatgcccagctctgtgctaccttctttctggcccaggctctgtagtccttatcttctgggagcctgaatttgcctagatccacctttttctactcatctccacaaaagcatcttttttcttttgtcctgaagctgtaaaaatccttctctttggttttcccatttgtctcctaccctgcccctcaggaggcctgataagctttgaagtctctggggtggcctaggctcctgacacccagtctagggctggcctcacagtctgcctcctactcatgcatgttttcctcactccctccctcccctgcatggagtaggtaggcatcttccgcaagtctggggtcaagtccaggatccagaacctgcgtcaaatgaatgagacctcgcctgacaatgtctgctacgagggccagtcagcctacgacgtggctgacctgctaaagcagtatttccgggacctgcctgagcccatcttcaccagcaagctcaccaccactttcctccagatctaccagcgtgagtcgcccactcctatccccaacaacctgtcccattctcaacctccctgaatcccagaacttgtggaagataaacctggtgcaggcaaatgtagctggacctgtgagctgattggaacagttactatctggagttggaatggcccttgcagagagaccattctgcttccccaaacccattatatggaaaggtagactgaggccctgagggaagaactacataaggttacactgtatgttagtaataaagctagatcaagcacccagagacctcacagaactgacattttcccttccctctcaccgctccccttgggactgctgtgccttttgcccccttggaaacaggaggctggctgctaaggcctctggggaagtaaggaaggctcttcttccattgcttcctcacagtcctccccaaggatcagtggttggcagcagcacaagccgccaccttgctgctccccgatgagaaccgagaggtgctacagaccctgctctacttcttaagtgacattgcctctgccgaggaaaaccagatgacagcaggcaacctggcagtgtgcctggcgccctccatcttccacctcaatgtctctaagaaggatagcccctctcccaggtgaaatggtgcacggcatgtcagggccgggctgggtccagacaatttgggccccactggacttttggcttttgatggctggcactgctgtgtctcagcctcaccacaaggagtgagcctgactcctcaggggccctgggctggtgggatgctgtggagcagggccttccaaaaggcagcaggttgttttgtggccaggtttggcaaagtggcttcctggcagctagaaggcagcctgtctgccatcttgtcttgtgctcttgtgccatctctcctctcaccacctcctgctccatctaggatcaagagcaaacgcagcctcattggcaggccaggccctagggacctgagtgacaacatggcagccacccagggcctgtcgcacatgatcagtgactgcaagaaacttttccaggtgagtaaccccaggccatgacacctacttaccagacctggg

SEQ ID NO: 1147 - DNA, 23019 bp, mus musculus
gacagccaggggaggcaccaaggtgggatgaggtcccctgcttggaggcctgcagggaccctgtgaacagcaggtgtttaacagatgtcacggcatgtgggagggagcaagggagggggtgaggagcatgcatgtcaggaaggagtcctggggagctgattctagtgatggccccaaggttaatgaccccttgcagtgatggtcctaaggttaatgatcccttgcactgatgttcccatagttaataaccccttgctccctgcagacttgggtcggaatgttccctacacctcctgcgtaattataaaccaggccagttctatcagcagaggcattgttccctgccccagcacctgtccccctcctggaaaagggggctagttttctctctcaggatcagaggtgtgggctgcattctccttataccttccccagaccatctgtcccttactgtcactcactccatgaaagagagtggccagagatataggaggcaaacgaagtgaggatggtggccgagaatgtgagctggccccttgggcaggcccagggtgtgagagggaaatgctacggctgctgaaagccaagatccttgcagaatgggggctggggtcaggagggcagagaggggtagaggtcgctacctcccctctatactggactatatcctctctcatggagggcttctcgggaaggagactgggagggctgggagttgggggtgagtaggcaagattaaacgggtcaggaaaagtccccagagacaggggcctctgacaaagacttgaaggagatgagggagggagccagctagatatctgaggaactccaaaggaaacagccagggcaaaggtcctgaggtgggaatgtacctgatttgttcaaggtctacaagggggctggtgtggttagtgtggagagagcaagaagagaagctggaggtgaggtcagaaaggggactcggaggttagaccacgcaggaccttgtaggccatggtaaggactttggcttcaacgctgagtgaggaggaaggcatgacagggttgcaagcagaggagaaacacaaaccgtgttaggatttaacaggaagcccctgaatgctgagtgtacaatggggtctagggcctgaatgtggaagcaggggaccagcaaggagctggctactgcagtagtctaggtgactggtgatagtgctggcagtggaggtggtgagaagaggatggatttggtaaatatttttaatagacagccaaaaggatttgttgaagactgagagtcttggagccagatcgggacagacaatgcccaaaccaggtgggcaggaaggagtccctggactatttgccagcttgaacttttaggtgagaaaaaaataaagttctgtcttgcttaagcccccattattttatgatttttctgttacttgcagctgaacatattcatttctaactcatggacatcctgaacatggagacctggggagaggggctgctggaaggatcacctccctcctaggatgctgtgaggttctaatgagataacagcatgctcagaacctggcactcagtaggtgttcagtaaatcttcccaggatggagaaggaatgtatgaatggatgtgttcagcggacaaaagctgcagttgagttcccacagaaggtgagaccccaaagggagagcgaaaggagtttactagatggaagcagcagaaggaacagcactcttgggagagggaacagtagaagcagagatggggggacagaaagaagggaggtgaggcccctgtggggtgtggagtgtcaggttgggcaagaaggacagggctttgattgtgattccattagtcagaagctacccatatgcccaatcaacttctggtagcacacagtcaggtcagtgtttgctgagctgaaatttaaaaaagtgaatccttcagaaagttaaatttcctattcggccattcattcaacaatagtatcaagtcctggagagtgcttgcggctaacaatcaggggcattcttggcttgtggcactgctcaagaaaaggttgtagttgggcagggaggacccagtaagtaactaactgcaacaggacagtcattttcactttcctagttcacacaccaaggtgtggtctaggccttcaggggctctgggtattcctggggcaatggggagtcacggagggttagggagagggtaaccccatccctgagaagcacatttttcctaatggctgcctgcgttctatggttctgctgtccggccacccaatacctcagactctgtctacacagcgtcctcctctccagcctccttattggctactcatgcctcccttcacaccacctacactgcccccgtcggctctgcttttttccccatcttgcctccaagtcctccctccgtcccgctgcactatctagcctcggcattggctcatcccatactagtactgtcctttgaggtctctacgccttcaccctggctccctcattggctatccgccagctctcgtcctcgctcccgccttcagcctccacctccattggctcggctccctacacacccgcctcttggtctccttttagccttcgtattggctagctccaccttggcaccaccccttcgaagccgcagtgcacgctcacaagcctccccattggctcgctgcagccattgtcgtcatcccacgcgtggctctccattggctgttctctctctctagctaccgttccaccgcctacgcaacccgcgggatctcccactttttgggcctctgcgttcgttcccggctgccctcatcgcctgtagccattccacttttcccaccgcccacatgcctctctcgctcagacttccgcattagctgtctgcttctgttttcttcatcatggatttcgcaccacccccattccggcctctccattgattcctcgatcatcccgccccctacaccgcccactcccgggcatccccattggctgcgtgcttctccggctctcaattcgctgtacgtcatccgtgcatggctgcccattggccctctgcaatacttgtcttcatctcaccgcctatgcccccgtgagccgtacccctccgcgctggccttcccattggctgcccgccccttcaggccctgcccccgccggtcccgccgccggtgccgtcggtgccgccgccgccgccgatatggcgcgtacggcccctgtggagcccccgctgcggcattccgcgcccccctcgccggccgcgggtgagccccgcacctcggtcgaggcggcggtggccccgcggagggtgctgttcgccgacgaggccttggggctgccgctggcgcagttgcgccgctaccggccgtggggcgggcccggggcgggcaagatggcggcggcggccgggcaagatggcggcggcggcggcggggccgacgaggacgacgatggcgaggatggggatgaaggggaggaggaagaggaggcttgccccgagccctcaccgctgtgccccgtccccgctggcggggggttttacctggtccccacattttcgctgccgcccgcgccgggccgtctggagcgcttggggcgcgtcatggtggagctggaggcgctgctgccgcctcccggagcggtccccgggggtgccggggtgtgggtgcctgggggccgcccgccggtgctgcgcgggttggtacgcgtgctgaaccgctccttcgagaaggcggtgcacgtgcgggcctcacacgacggctgggcttccttttgcgaccacccagcgcgctacgtcccgcgcagcccgccgtgggcaggagcgggaggaacaggagcaggagatcccatcctggatccggggctcggcctgggtcccggccaggcatccgcctcctcgcccgacgacggcggccgcaccgaccgctttgccttccagctgccctttgctgagggcgcgggcgatggggcgcgcctcgacttcgtggtgcgctatgagacccctgagggcactttctgggccaacaaccacggccgcaactacacagtcctgctccggatcgcacccgctcccacacccactgatgccgaagggctgccccagcagcagcagctgccgcagctggagccacagcccgagtgccagggtcccgtggaggctgaggccaggcagctgaagagctgcatgaagccggtgaggcgcaggtaatgtcagccagcgccacctccgccaacgcagggctgtgtctgggatggaggacaagcattccggcccaggaacccctcaggcctgctctccaggacagggaggagggtgcattgagtcagtcagtcaaagagtgatggaggtcaaacacgtgctaggcactgttttaactggggttttattcctccatttattgagttccactgtaaagccctgaacaagacagacatctaccctaccctcaaggattcatacaggctcctatgggagacagtttgaaaaaacaagcaagcaagcagataggataaatagggacaaagttagctgctgaagggagtaaggggatagattgggagggaatgactgtgtcagacatgctgttaaagggagggcctttgaggaggtgagtcccgaatgatgataaagaagagttatgcagatacggtggggaggtgggggagagtttgtaggaaaaggaacagggaggacttttctgaggaggtttcatttaaactaagtcctggatgatgaataacagttatgtgcatatatggaacaagggtgttctaggtagaggaaacagcaagtgcaaagtcctggggtggaaatgagcttggtgtgaatgatcagcagtgtgctggagtggagagaactgcaatgacatagtgtggaccaagggctttgccagtggggggtagagcagattctctttctgacagagcaggaaaccaggattccagaggtggagaaactggttgaggcagtgatggcacctggctcttccagttcacccatgcctgaccttgaagcctgtgcactctactgttaacgctgtaatctacttttgagtcctgtggaggcgaggggctgagcccatgctctcacaagaaagcagtggctctagcagagagacagaaccagatgggtactggacttgaagtttttgtcccttgtttttttgccacaccacctgtgatcatttagggacagggagaaataatcagttataccccagggggccccagaagatttccctaggtttcctctatcaagctatgagttctttaagggcagcagctagtcctgattctttttgcggtcacctaagtctggcccaggatcactagattctccctaaaatgtatacatttccctgttcctgggaggactgggaatggaaatgggaaaatgctttttggaccttgtatgtatacgcttggtcagaagcccctggctgcagtaagacatttgtgggttctgctggttctggtaaggccttaggctgtgagtggttcagaaaggtctagctccggtctggtgggcagatgtgcctgggtaactgagcaggcaggcaggtacccactcacccacctgtgagccccaccataatctgagacttcatttaaagggggcaggcagcatggtttttcttacagcattaagagtgtggattctggcatagattgcctgggttcaaatcctggcgctgccacttactggccttgtgaccttggccaacgcatttaactacaccatgcctcaggaccctcacctgtaaaacagaattatagcatctactttacgggataagagtaaaggtgctcagaaccgagtctggctcaaagtagtatcatacaggtgttagctagtgtcagtatttagggagccacacctacagtttcctggattcctctcctaaattcggctccgcccatcagctgtgtggccttgcctccgtttccttctctgctaagggaaatgacagtcactttgcatggttggattgaatgcagcaaacatgggcaaggtaactgaagcatggtggtaactgcaaaagataactggccagcatttactgatttctgtgctatgaacatcagatccattctctccgtgaggcctgctgtgcatgctgtgttgtgtaggtgctatgattatccccatttagtagaggggagacaggtagctcagagagatgagccagcttgctcaaagcctctcagctagtgagtgacagggccagggaagaaatgctagggacatttatttttttctatttttttttttttaaactggtcctctagaaagcgtggcatgattcagggcaaattctggatttcactcttggtgttcccagcatgtcgtgctttccttttacctttttttttttttttgctttatcgaggtatacctacataaagtgtactgatattctgtgtatagcccagtggatttgtacatatgtatgcacttgtgtagccaccacccagatgaagatactgagcaggtccagtaccccagagctaccttcatttctatcactttcccaagctgtcatccccgccggctgtcatgggaaccctgtctgtaagatgcgacagtttgggtaaaggagtttggtcattttaaagagtgtgaaaggcagagaacagagaaatcaaaaccttgcagggccaaggtgggtggagagggtgtttttcttttaacatacatgggcggttttaaggagaaattgaagcagcctgttcagacaattgttttggtatctggccccaggtctgtggttcctaacatgacttgtgatattattttaagtgggcagatggctttttgatagcttctttatctttcgatctcagctcttgcaaaggggaggttggtgctcattgcaagatcagcgataagggtttctttgtaggtcggtggctttcttggtgagtacatttcaacatattattgttttagaacctgtgtgctgccagtgacttgcagcactgttgaagactagccaccctttgtgacctagccctcttgggaaatggcggaggatctcagggtatatcccttacctgtgggagccctatcagagggcttcctgttgaggaaatgttggctgtaggccctctgtgcactgagcacagccacatcaggtgagggcatgggagaagtccgtggtagccatcaggatagagttcagaaacccaaatggctgctttccctgggttgctggaccaggcatttggtaactctaaagcttagagatgattcatcgacaagcatttattgactgcctactgtgtgctgggcacagtgctaggttccagcagggaaagagatgcagagtggtcctaagatgtcacagggcttgtgggatggagtacagaggatttgttgtatgagacctggctgagcccctgctcttcgccaggcacttcactgagtactatattttcatgcaaggtctggtttaattccgacaacattccctgtgaagtagagggttttaaatttctctttcctggatgagcaaactgaggctcccagagtccaaagtcctagggctggtgtggggaaaagccctcctgatcttccttggcacttgacactaccctttggaagtgtcctattcttcttaaaagtaaagaccaagagagcctcaccatggtcttcaagcaccctcccatcccattccccaatctggcctccactggctcatagtcttaacaccagtggtctttctgagctcctgtcaccatggtctttctgttactccaaagggcctcgctcctttctgctgcagggcctttgcccctgctgtttccttcaccaggaacatttatcccgtaccccttgcagtctcctccagtgttgatccctcagttctaagaggacttccccaggggagcctgtccaccccagtgtcctcgggcccctggctttttcatagcactcatcagcccagcacgtgctaagctttgttagagaatgtcccatggcagagcagatgaacatcgccaccagtcgaggggtcatcggccaccctgcctagcagttctactatatttttttgatccactcgtttctcctctgaagtgactctttcaaatgttctttaccttcagactttctctcctgcttcaaaaaacaaaacagaagccataagaatggaactccctataacttgtggcccccaagtctgcacgctgatttccctcccctgtgttacagatgacgaggagtcccttcttgctcaggccacttctccctcctgtgctctgggtcccagtttctgctacttgctctagaatctgacatcatcagtcaccttttctctcctggcaggttttctgctgccctccttgcttgatcctctattcacctttgcctgtgccagcatcccttctgtctccgctgaccccacgttctctccctcctgcttctggccagcacctcatcaccctccccttcactgctgacccctgcagagttgcctgtacttgccttctgcacttgctcacccccgtaagtgttagcccccggcatctgccagattctgcaggtggttttttagttttcctcttgaagtggttgaccactcctacttaaaacactttgtcttcccttgccttgagaccacactctgctggttttcctcttaactctctggcccttctctttctcctggctcttcccttagcttcatgtatccaaactcggcatctccacttgactgatggcccaaataattcctcaaactcaccttgtcggggactgcattcatcacctctcccacagtgttcccaagcagcctctcactcccctacctccccacttgctcgttttgcttttcagcatccttaagtaagccctgcctgaccctgtagattgggccagggacccttattctagggcattctttccttttctaaaggcactgatcgcagtttgtagttatatctttattagggggttgctggatgactctctgccccgctagactgtaagctccgtgaggggtagggacatggtctgctttcattcaccactgtattcctgcaggcctgccacagtgcctggcacttagcaggtgctcaataaatgtttgttgaaataatgagtttgagtatttttttaatgtcttcctccatactgaattgtaagcttcctagttgggtttgctcaccatggtgtctccaggatccgtcactggggctgatgcacaggaaggcccactgtctttcagtgcacctataactgaagggatggggatccaacctgctatctgagttggcagcctcaggggaaaccagaataactggagttgaacgggacaagtcaggggcatcttagttttctgtagagtgaggaattaatgtgaacgtgatcctcttttatgccacagaaaacttggtagggcattatggttaaggacatgggcctgaggccacgtgctaagaaagtggcagagctgggatctgagcctgtgtggtcctgctctagtgctccagctcttagctactgtaccaggctgggtgatgcattttaccagcagggcaacactgggcaagttgctttcctttcagagcttcagtttccctcaatggaaatttggagggggttactgttaagtgctttataggtacttttcaaatatttctttgatctgctgaacaactcactgatgtaggtattattatcccctccttagagatgaggtaactgaggcacagagaggttaagtaacttgccccaggtcacacagctgataggtggcagagctggaattgttcaaaattgcatatcctaaccctttattgagttgtgaaatcaatttactgggtttcaacaagcattaaaaagaaaaaggaaatagcataagaaatgccagtgtatcaccacatgcagtaaaggtaagtattgtttcactcgaagaacaaccatttttcagttatttatatgtctgtttacacgtgtgggtgtgctgggttatgatgtagaatggatttcttactatgggtcgtggccaaagaatgaagtcatggctgttgaagaagctcatggcacgagaaactgctctccctctaccccactggatcacccgcaagtcccagagttgaggctgacacacttgttggggaaggcaaagcagtgccccacataacttggtggctttcacagccaccttcaaaccctgttcttttcagaaagcagatggctcagggtaactgcaattctgagtatcgtggggcaggtttctgaagccactcatccccccggaaagtcagcgttatcttcaggttgactacatgggagccggggtctgctgagtttccctttgggtttcagtgcctgacccactttgggctggcaaaattctttgaaaacatgaatgctgggggtgctccagaggactcgggtggtggtggcaatggcagtctgtgactgctctgaaagtctgctttgcttttctccacagggcttgtcagccctcacccgctcgcttactctgtgactggcgaatcacctttcttggctttcttggctggcctaggccggggccaacaccacctctttccaaatcctcaccctctggtctcctcggggcctatcagcttggcagccattgtgtttcctgatggccggaggaatttgcacgcccaggagactggcgtgcaggcctgagatggccccttttagtcgacaccagcttgactagtgctcactagcacccaaatgatgcatgtccaagattttccagatctgtgtgccctggcccctatggctcactgcccttgaggggatgccacgtggtacttgtggggctggtgccaaaagaacaggtttccttcttgaaaacgagcaggcatactgcaggtacagttttgttcttaatcttctccctccccatttttctaagaacccctcttctctgttaccgatcagtgagtcagtatacatttgtacttgatttctcttactatcctcatgttgattgaagtcatagctgcccttgagtttttactgtgaaagacggttcaaagataacttgtttctttttaagcccacaatttcaaactctcttcaaagtggagccctcctggagtgtttgttaccagcgtggttgtgtagtcagtgagtgtagagatgcagttccttgagttttagtttttgcatttgtaaaaaggaagggtgttgttttgaaggatagatgtgaaggttttcaaatgccttggtgtgtcaatgagaggggcccatggtggaggaggtgaacaatacatgcttgtgctttctgctttcatatctgactttggagaacgacttgtttgcttctgtcgatgttgtggatcttgggattggctcaatggcgtgacctgctttttggatgttctcgccctcctcagccatggaaagggtgctctgggggctgaaggattgattgtgtatttgtttttctttctccttcctccaactgaattgtggagtcctttacctgctggctagctgattcctgagtgttctcctttttctgtctcacatctatgactgcagtggcttttagaagcctgtttgtaatatatgtccggactaggccagatggaggagaaggcttgcctgctactgcgcacaggtgggagggctggctttctgtctgtctgtgggccttcttgaagaggcttggtttagaagatcctaggaggaggatgttttctgtcatgaaggactatggtaacaaaaagaagtaagttagtgcagcctggcagaaattgtgttgaaacaaaagtccaaagacctggattttaggaccacggaggggattggtgtgagaccaagctggtttgctctgaatctctctttctcatctgtgatgtgtgggaggtggcagctgggctcccagagtcacccaccctaggccctgtagtattctgattcaagtacctctggtgggatttgtgagtcctagacagtagagaaagacagacggtcccttctagactctagatccgtatatatggttcaaatgttctccccgagggtgtttatagaaagcagttcttgcagccattctgtgtctagtggcctcctagccacgcatgtcccaggcccatggaggtagggaaatggggaatgaatatgtgggcaaaggcaggtccaaagaaaagcctgcatgaaggaggagggagggatcttgtctagtattgatgcctccctctatctacttctagaaaggatggagatgggttgggtaagaccccagtctccctcatccaagaagcagcagctgactgggtaagagccaaaaggcctgggttgtgatgtgaagtgtatgaccttgagccatttactcagcctctgttttatcctctgtaaaatggagacaatagtactgcctgcttcagaggattacaagtacctgtctcatagggtgattgtgaggattgaattaacacatgttgcccaggcaccgtggctcatgcctgtagtactaggacttcgggaggctgagatgggaggatcgcttgagtccaggagttcacgaccagcctggtcaacgtaggaagaccccatctctaaaaacaaaatacaaaaaaacaaaaacaaaaaccaaaaaaccccaaaaacttctttaaaaaaatgtgaagcacttagaacagtgtgtaatgccatagtaggtactatgtatgggtcagatggtgatactcgtttctgtgaaggtaattggttatgggttttcaaaaagtttcaaccaggccgggcacggtggctcatgcctgtaaccccagcacattgggaggccgaggagggtggatcacctgaggtcaggagtttgagaccagcctggccaacatggcgaaaccccgtctctattaaaaatacaaaaattagctggctgtgatggtgggtacctgtaatccctgatacttgagaggctgaggcaggagaatcacttgaacctgggaggcagaggttgcagtgagccgagatcatgctattgcactccagcctggcgacagaacgagactccatctcaaaaaaaaaaatttttcaaccattgtcagaagtatcaagaatgtcacattgcctcttaggaagaaaaaggtgtgggcattcgccccagctcctctcaggttttagtcaatgcttccctcatttaccttaatctgtagacacttgatactcattttcagaataagaacagtgacttctccatgatgagatgccacccctgggaggacccacctgaaatgcactcggcttatgccactcagggatctgactggcctggtgaaggaggagcaagacccataaatatctacagttgattcaatcccagctgtgtgtcaggccctgatttctggctgtccatcctcattcctcttgactgccctgtgcttagtgcacatcctgactccccggggctctgttttatgagtgaggaggtgaagcgacctgccaggctgatacggggacgagagggttagcatagggacccaggcctctgtgacctccctcccagtctccatttgcattccttcctctgcctcacagtcttgtctacctgccatttcttagaaaaggtgtttttgttttgttttgttttgttttgtttttgtgagataatctctcactctgtcgcccaggctggagtgcagtggtgtgatttcggctcactgcaatctctacctcttgggttcaagcgattttcctgcctcagcctcccaggtagttgggattacaggcgcccaccaccacgcccagctaatttttatatttttagtagagacggagtttcaccatgttggccaggctggtcttgaattcctgacctcaggtgatccacctgcctcggcctcccaaactgttgggattacagatgtgagccaccgcgtctggccctttttttttttttgagactgagtttcactcttgtcccctaggctggagtgcaatggcgcgatcttggctcactgcaacctccgcctcccaggttcaaatgattctcctgcctcggcctcccaagtagttgggactatgggcgtgcaccgccatgcccagctaattttttgtatttttagtagagacagggtttcatcatgttgcccaggctggtcttgaactcctaacctcaagtggtctccctgcctcggcctcccaaagtgctggaattacaggtgtaagccaccacgcccagccgaaaagatgggttcttctatcttttctctttccatagccaggaatgtatcctaaagaaatgatacaagtgtcgataaaactatgcccaatgctgtttgctggtttgctttgcaacctctaaatgaaagaacttagctgctcagtaggaagggaatggtatgatatgagtattaagcagccatttgaaatgtttgcaaaagtgtataatgatgtttcttactgttaaatggacaaagctagctgtgaaattatgtctgtagaatctaaatgatttcgtagaatatctggaaggaaattttccagaatggtaacagtagttgtctctggctgatgtgtgattgtttttcttgcttctttagactttcctgtattttgcgaattttctataatgaggctgtaggacttttaggatgaggggataaacaaaggcagcagaagagaaaacagcagctgtcaggtgaaggtgggctagcacagaggctcagaaggtgccagtgggtggcagaagtgacctctcagggtattattagatccatgtactctctcctctgccctgcaggcctgccgaggaggaactgaagacgaagaacatggatgataacacctttgccatgggtaagcaattggcaagcttcggaagttttagcttgtatttaccatgtctttcttcctactgtttttctttctataaaaatgaaaaaggctgggctcagtggctcatgcctgtaatcccagcactttgggaggctgaggcaggaggattgcttgaggccaggagttcgagatgagcctgggcaacatagtgagacctcatctcttaaaaaaaaaaaaaaaagacgggcatgctggcatgcatccgtagtccctgctactcgggaggctgagctgggaggatcatttgagcctgggaggttgatgctgcagtgagtcatgattgtgccactgcaccccagccttggtgacacatcgagaccctatctcaaaaaaaaaatgaaggggtaccctctgctttagattgtcacagaaagcttcagaggcaaaactgccagttggctaggatggcagattttcttaacaaaaccatacctacttgtatgcctgtcttgcccaatgctgcctttctcttccctctagcagagcatcctgatgtccaggagtcagtgggtccactggtagcccccacccctctccgtccatggccccagatgacacttcaggtaagtgggtccttgcagccttggagtagacagcccaataggaggctcacagtgtgactattgctgggctgggtggtggggcccactagctctgggtcctccctgggttggagggagggcacaaaactcagaacctgatgggggagggggagaatgcagttactcagctgggcttgtagaaatgtcatttgttaatttagcaaaaatttatggagtgcttgttctgtgctaagcactgttacaaacatgcaaaaacgctctttgagggggcttatgtgttagtagggtgagacatgataaagtaatagaatatatggtactttaggtgatgatgagtgataaggaaaaatagaaaggaatagggagtgggtgagagactctgtgtgtgtgtgtgtgtgtgtgtgtgtgtgtgtgtgtgtgtgtgtgtgttgtgggcgggggtcggttgcaactttagattgggtggcctgggaaggctttagtgattagtgagatctgagcgaagatctgaggaaggtgagagagtgagccacgtggataactaagggaagaacatcccaggcgagtgtgaagttcctgaggtgaggccatgactaacgtgtgtgagggacagtgtagaagccagcgcagcaggggcagaacgagggagggggagagtggtgcggggtgagggagagaggtggctgaggacagattgggtggtgcctcacaggccatggtgaagactttggcttttactccgagtgagggggagccgcaagagcattgtggacggaggagggatgtaatctgatttaggatttaacaggctccctctggctgctgcttggaaaatagacgtcagagtaagggtggaaacaggcgactcgtgaaggggaggccactgcagtggtccaggcgagagtgatggtaggtaggggaggtagagacattttggagggtgtgtgtgtgtgtgtgtgtgtgtgtgtgaactttttaattacaaaaagtttcaaacatacaaaagtaaaatagtataatgaacctacgtacaccatcccccagcttcagtaaatatcaacacgtgctcattcttattttatctgtaccccgtctcctccctcccattccctctggaattattttggaagacatccagacatcatcccatccataaatacttctgtttgtatctcagaaaattaagaactcttttttgtttttttttttgagacagagtctcactctgtcacctaggctggagtgcagtggtgtgatctcagcttactgcaacctctgcctcctgggttcaagcaagtacatccagctaatttttgtatttttagtagagacgggatccgttgccttggcctcccaaagtgctgggattacaggtgtgagccatcacgtctggccagaaaattaagaattcttaaccccacaatactatcatcacaccttagaaaataaacggtaattcctcagtatcatcaagtatttggtcagtgttcaagttttcttctctcataagtgtttaggatccaaacaaagttgacatgttgcatttgattgatgtgtctctttagatttttaaaatctcccccactttgtttctttgcaatttgttggttgaagaaactttgcttgtcctgtagaattttccagtctgggtctggctgattacatccaggtggaaatacatttcttactccatttttattaatttattaattatattaattaatgtaatcttattaaatttatttaatttatcaaattgtattaaacgaatgtatttaatcttttattattaaattaactagaattaactctatttaattctattattcccacttcctttattagctagaattcttctctaaagaaaaactgtcccacaccagctatttggctactttgagatatagtttgtgcagaaaaagcagtgtaaatatttaattttttccattttatttaccagttttcagagaagtactactacaaaggtgaccaataaaaggatttttggttttgtgtcattatgaactcatgaattctaaacatatttgaatgagtttcaatccattgcacttatttgtttgctttttttgatgcttaaattgaactatccctggctagtaggagcttattgagatgggctactctgtccttttgacacgccctcatcattctgtgagcctttctcacatcttccatgacaatatgtgctaggttcatcctgtactctccctgccccaagcctggaaacagccatttctttcttgcttttcttttctttattttctttttctttttctttcttttctttcctttcctttctttccttacctttcctttctttctttcctttcctttgtctctctctttctttcttttcttttactttatttttctttcctttctttcctctctctctctctttctttcttttttctttttctttcttttttttttttttttttttgagtcagagtctttctctgtcgcccaggctggagtgcagtggcacaatctcggttcactgcaacctctgccttctgggttcaagcaattctcctgtctcagcctcttgagtagctgggattacaggcacatgccaccacacccggctgatttttgtatttttgcagagatggggtttcaccatgttggccaggctggtcttgaactcctgacctgcctggtgatccacctgccttggcctcccaaagtgctgggattacaggcgtgagccactgagcctggccagaaacagctatttctttaaggagcactgattcctttcagtggagagtggcattcaaaggccaagatttgggggctcggcatgcttgctgctactagattggtcattgtttctaggccctttcaaaagatggagctaggaaataattgttttttaaagagaagatgatacatcatgggttcatatggacatcctggctatgttttgggatttttttgcattttattttttttaaaatttttttaatttttaatttttgaggggacatagtaagtgtatatatttatggagatgttttgatataggcatgcattgtgtaataatcacatcatggagaatgaggtatgcatctcctcaagcatttatcctgtgtgttacaaacaatccacttacactctttattttttttttttttgagacaaagtctctgtcgcccaggctgcagtgcagtggcacagtctcggctcactgcaatctctgccctctgggttcaagtgattctcctgcctcagcctcttgagattacaggcgcacaacaccacgcccagctaatttttgtatttttggtagagacggggtttcaccatgttggccaggctggtctcgaactcctagtttcatgtgatccgcccgccttggcttcctaaagtgcttggattacaggtgagagccactgtgcctggctacttacacttttagttattttaactggctctgttttgaaggtaagccagcagtatttagtgatgatcattcaccaaatattcacacccaccgaattcctcagctttataatctgcaagaagccctgttttactgcatccaattgtgttattttaccatagatgacagtctttggagtctagacagtgacagagggcgctttaaggcatttttatatagaaacccctgtggggctggctgtgggctgtcacacttcttactgtctctgcttgttccatcccctcctctgcttcattcccttgctttttctctgcccccttgccccggccatggctccaggtttctgacgttccgatgactggcaaccccgcagaagaaggtgatgtccccagaagcagtccacctgtggcttttacagaggtcctccaggcaccggccatcaggattcccccctcctcccctctctgtggcctgggtggctcccccagagaccaggcctcagggcccgatgcgagcgagggggccaccgggcctttcctggagcccagtcagcagcaggcagaggccacatggggagtatcgagtgagaatggaggggggctggaggctgtgagtgggtcagaggagctgctcggtgaggacaccatcgaccaggagctggagcagctctacctgtctcacctgagccgcctacgggctgctgtggctgcgggtggggcagggggtggtggggagggctccacagatggagggatgtcccccagccatcccctgggcatactgacggaccgcgacctgatcttgaagtggcctggccctgagcgggccctgaacagcgccctggctgaggagatcacgctgcactatgcccggctggggcgtggcgtggagctcatcaaggacaccgaagaccctgatgatgaaggggagggtgaagaggggctctctgtcacaccctccagcccagaaggggacagccccaaggaatcgcctccagaaatcctctccggggcccgttctgtggtagccacgatgggagatgtgtggctcccatgggcagagggctcaggatgtgacggccctgtggttctgggtacagagggtcagttcattggggatcctgagaaagggatgggcaaggacaccagctctttgcacatgaatagggtgatagctggggtgactgagtccctgggggaggccgggacagaagcccagatagaggtcaccagtgagtgggcaggcagcttggatcccatatctggcaaggagccagcctctcccgtccttctgcaggggcaaaatcccaccctcctcagtcccttgggggccgaagtctgtctctctagtgtagccaggcctcatgtgagctcccaggatgaaaaggatgcaggcccaagccttgaacccccaaagaagtctcccaccctagcagtccctgcagaatgtgtgtgtgcactgcctcctcagctccgggggcccttgacccagactctgggggtcctggccgggctagtggtggtccctgtggctctgaacagcggtgtgtccctcctggtgcttgcgctgtgcctctctctggcttggttctcataggctctgcttgtgggatcagcagaggcttaagatgggatacatggcctgtgcagtgaggggacctgggtcctttgcttctgagaatgctcaactgaaagagaggccttctcatccccaagctctccagtcaacacagggctccctgtggtgacaccagtggagatgagggaacgggtagatggtgtgagtgaggggaacttttagagtggaactgggcatgtcctccgcctaccccccgagcctgtatttatttttgtataattctctggatgagggagagtggtcgtgagctggtcttggggcacaattacccagagatatatttattaacagccaacctgtgcaacctgctggagctttatttttaatttaatttatatagagtacctattattatatgccacaatagagctctatgagaaacagtgtcttgcggtgtagtgttctcctgtttgggcatgagtgtgcagggtggtcactttctgtgggaggatcacagtggggagttgggggtgggacgtggtcgcctgctgctgcttcaacatgtctttccttgaagatgtgtgtctcctcgtctcgtggtcctaatccatatggttctttgtcttttccacattctgcctgtgggaccctacaggtgtgtatttggatggtggtggtgggagccagggaggaagagtggcagccacatgagggtttggtgtcagtcacatggttgcagtggtagctgtggtctcctgtggatgtggggacatcagttgtgaatcagccacaaggttttgaggttactgaaaaaacagcctttgacaccagcagggagaccccttagtccctgagataaggaaggcctcagaaaggaaagaggagttaatgtactgcagtacttggtagcacagttgctgtccacagacatcacatttctactaaaaacaggaagcccagaagctttgaaagaaagatatatatttattgcatgcaaataaaaaactgctcaacaaaataaaacaccacatatttatttacttccctttacagcaaaacctattggaagaaatatctatacgagctttcttcagttcttctatgatgcctttctgaaatagccccaatcagatcttttttgcccaaccatttcagcaaaactgctgaagatattcacattgttatagccatggttaagtctcagatgtcatcttacttgggatattggcagcatttgacatagttgatcatctctaccttgcaaccctttcttcacttggtttccaagataccacactctcctcatttcccttcttcctcactggccactgtgcaaagctgtcagttctcttgaaactgctttgtaggttcaatgcaaatccaaccacaattccaatagagttttgcctgtgtgtagatcatgacacattaattcttaaatttatgtagaagtgccaagactagccaggacactgatacttattgtaatggtatattcagatggcacgatatttttgcaagagtagacaaatcgaccaataaaaaaacagtgatctcggaaacagtgtagacacactcgtgtagacacagaactggtgaccaaggaagtgtgttagaccagtggggaaatgattggattttgaataaatagaacaattggttacccgcattgaaaaatatgaacttggatccctactttacaacacaaataaaaataattctaagtgggtttaaagcctaaatgcgaagggcaaaaccaaagcgctttaagaatacaatgaggcagggccgggtgctgtggctcactcttgtaatcccagcactttgggaggtctagatgggcggatcaggagtttgagaccaccagcctggccaacatggtgaaaccccgtctctactaaaaatacaaaaattagctgggcatccacctgtagtcccagctgtttgggaggctgaggcgggacaatcgtttgaactcagggggcagaggttgcagtgagccgagatggcaccactgcactccagcctgggccacagatcgagactccatctcaaaaacaaaacaaaacaaaaaacaaggcaaaacaccttcgtatactcatggtagcaaagtttttcttcatcacgacacagaaacaaccataaatgaaaattacgaaacattcagtgaccttaaaattaggaatgtccattgatcaaaagacaccataaagagagtgaaaaccttatgtagtaggttgctatgaataaaagcaaaacaaaaaggagtgaaaacacaagtgaaaaattgggaggagataatggaatcacatataactgatgaagggctcaaaccttagatgccaataagcatctaaataaattgtggtatattcgcagaatggaatattgtataatgagaatggaagatccataactgcacgaaagcatacagatgaatcacaaaaagccaaaaaaaagcttccacactgatccatttatgcaaagttcacaagcaggcaaaactcatgaattaccacctaaatggtgacattgtaaagaaaagcgaggggctgattaccagagtcaggatagtgttcacctctggcagagggagggatgtggctgagaaggggcccagagga

SEQ ID NO: 1148 - DNA, 836 bp, mus musculus
ctgcggggacgtgtgtgtctctactgcatttcccctttcgctcgctcgtttcggtgcatgtctgcgccggttcgcgccccctccccgggcgcccctgccgccccgtgtcttggcccggccctccccggcgtccgccccgctccccgcgcgctccaccccgccccccgccccgttttatcaggggcgccgccgtctcacctggtatttgcatctctccctccaacttgccattggcggcgcgaagtgtgggagagccctgcgcctcgcccgcccggaccagcctgccccggcgccgaggtgagtcacgggcgcggggtggcgggggcaggcgggcggggaagaagggcgggcggggaggagggcgggggacggcggccccggcggccgcggggaccgaccgggcgccgcgctcaacttccacttctcctttcgccggcgccgagttcctggcgccgctcgcccggcccggcttccgaggggagaggacgggctggcggggctggggacccgcgtctcggcccccggagcggggaccacggagacagaccccggcccggcgaccgagctgggcccgtgagccactcggcctcaggtacgtcgatggcgccggttcttcgagccttgggggacgtggaaaagtttgcttgagggcggaatcgagagcgccggggccccggcgtggggctgggggcccagggaagggcgggagagtcgcggagtgtcgcgagccgccctggagtcgccccgccgcgcgtgtgatggagaacccgggctcccgatcccgggatggaagtggaatggattccccgagtcggggagtcggggtaggggcccct

SEQ ID NO: 1149 - DNA, 836 bp, mus musculus; identical to SEQ ID NO: 1148

SEQ ID NO: 1150 - DNA, 640 bp, mus musculus
cgctgcggtgctagacagctgagagaacagacacagacctgtcggaaggtcctctgcaggtcccccttccgctctgccgatcgacttccgcctcgggcagtcaacatgtacgttgcggctgtctggcgaagctgcttctgagcgtttgcggaggcgcagcttcccctctgcggggccgccctgcttcccccccatccccgcctccccccgcccctcgctcctgtccctggggtcggcggacttctcgctacatgggggcgggcttccgcggtcggcgcacggcttcctgttctgaggcggcccggcggtaggcggtggcgactctgcccgctcccgtttcggcgcggtgaccgagcgcccgggaggctcgaggaccgcatcgtgtgccgttgcgccaagcccggtcctgcgccgccatggccccagtgcagctggagaaccaccagctggtcccgcccggaggcggcggcgggggcagcggcggacccccgtcagccccagcccctcctcccccgggagccgccgtggcggcggccgctgcagctgcggctagcccgggctaccggctgagcaccctcattgaatttctgctgcaccgggcctactcggagcttatggtgttgacggacctgtaagtgcc

SEQ ID NO: 1151 - DNA, 640 bp, mus musculus; identical to SEQ ID NO: 1150

SEQ ID NO: 1152 - DNA, 53322 bp, mus musculus
ggaatgagccattggtagaaacagtgtggctgtcgtcaggagagtggtgatctcagcctggctggccccacctggcttgggctcacccagcaggtaggtggaagagcggcgagccgtgtggggaaggagaagggcagcaaggaaggtcattcaggtggcccatggctccccaaggtgaggtcagcctttttcatcaaggggggtggggctagctttggctgcaacgcgcagatcatggggctgtggttagttctgagaggctggggaaggtgggaacttatgggattcccacaagccgtgggctgcagggcgctggcaggcattagggccagtcaccatgagctggttggcagtgctgacctctcttcctgcccttcccaaaaggaaaacctctccttgcatgctgccttgaggcttcagccttggttcaaactacattcacttacgggagggatccaccattagtcctgagcaacttcagccctggccctgtcatactttctcctgagagctgggttgagaaagggaaatgaagatgaacatgacacctaagagagctaacatttattgaagacttactgggcaccagacactgccatagacatttgttatctcattcagtccttgccacagccttgggaggtaggttcatattgtctccaatttaaaaataagaaaagtgaggctgggggcagggaagtgcagatggttaatgggtacaaaaatatagttagaatgagtaagatctagtacctgataacactacagggtgcctgcagtcaacaataatttattgcacatttaaaaataactagggccaggcgcggtggctcacacctgtaatcccagcactttgggaagccaaggcaggcgcatcacctgaggtcaggagtttgagaccagcctgaccaacatggagaaaccccatctctactaaaaatacaaaaattagccaggtgtggtggcgtatgcctataatcccagttactcgggaggctgaggcaggagaatcgcttgaacccaggaggcagaggttgcggtgagccgagatcacaccattgcactccagcctgggcaagaagagtgaaattccgtctcaaaaaaaaaaaaatctaaactaaaagagtataactggattgtatataacacaaagaaagaggccgggcgcagtggctcacgcctgtaatcccagcactttaggaggccgaggcgggtggatgacgaggtcaggagatcgagaccatcctgactaacacagtgaacccctgcctctactaaaaaatacaaaaaattagccgggcatggtggcgggttcctgtagtcccagctactcaggaggctgaggcaggagaatggcatgaacccgggaggtggagcttgcagtgagccgagatcgcgccactgcactccagtctgggagaaagagcgagactccatctcaaaaaaaaaaaaaaaaaaaaagaaggaaaaaaaaaaaagaaaaagaaaacacacaaagaaaggagaaatgcttgaggtgacagataccccatttaccctgatgtgattattacacattgcatgcctgtatcaaaacatctcatgtaacccataaatacacacacctacaatgtacccataaaaataaaaaacaaaaataaaaaaattaatttatttaatttatttatttttttgagatggagtctcactgtgtcatccaggctggagtgcagtggcacgatctcggctcactgcaacctctgcctcccaggttcaagtgactctcctgcctcagcctcccgagtagctggaactacaggcatgcaccaccacaccggctaatttttgtatttttagtagagatggggtttcaccatgttggccaggctggtcttgaactcctgacctcaagtgatccaccccgctcggcatcccaaagtgctgggattacaggcatgagtcaccacacccagcctagtttttgtttttgttctgttttaaagaagaaaagtgaggctcagagagtttaagtgacttgcctgaagtcacacagctggtaaatagtgagctggaataggaacccaggtctgtctgaggttacagaccactgagctcttagcaaaatgggaaagtgtgtgtgtgtgcacgcgtgtgcagacgtgtctgtccattcgtgaatttcaaagtcaaggtaaagagggcttagggacatccggaacctaccccaaatttgagaggggacctcgtggatgagaggccagcagagaactgtgtgtctccaggatctggaatcccctgggaaaagcatgcccgcttggaaaagacaaagtgcttgttttggggacttgattctgagtatccaggaggtctcaggggccggcgccccagtccagccacaggatctttccttgggaacttgtaatctgcagctgcctttgtggccatcatccaccaccactcctgtcccccagtcctgcgcctgagatgatcctttcccaaggcaggagaagcaggccgatgctggaggctgagtaggtccttcaacctcaagccctttagaaggccccatcccctggggctccttcagtcttgatgctttctgccaaggcttaggccttgctgcccccacccccaaaaaggccacgtggaactatacagagtaacaattcccagcgcactctctccagagcctcctatcagcagacccacgtaggcggcggtattgatgttgaggcaggtcagagagggcaaaggggagatagaaggggagcgtgcctgagtggctttcaagtgggcgcgtggagcagagcagcctggctttggacaggggaagaaaggtaggcatgggctttcttccagcacccgaactctggctctctttgcacttgctgggccagcccctctccccctagcccttcccctgactcatatcttgccagcgtcccccaccccaacttcccgcaggagtcctagactcgacttccctaagaagtcgccgaaactctccagtcaccccaggtgttacgcccaggattctgcggagtcgggcatatggttccaaaattgtatcctctgggcatctcgcggcctcacccgccgcacggcccgccctcccgctggggcctgcacaccccaggagctcaataatgtggagcgcagggcttggcccaaaggcgtcaagcaagtctccacttgcacgggccgagggggctggacgaaaccttcccgagtccgcggggaagggatttctctgcggggcgttgtatgggggcttcgcaccgggaagggcgcggaacgagcagagagctcggagtctcgctggctagaagcagagtggggagcgcccgcccgggccgcggcgcacgacgcgggctctgcgggcgccctgcctcgtggtcccccgggcgcgagcgagccgcgaggggaatgagaggccgcgcgggcccctggcacggctccccatgccgtgctggcgaccgcggcgggcgggccggggcggacgggcgctgtttccaccgagatgcctcgtccctccctcgttccctcccccaccccgcccgcccgcagtccctcccgtcggtccctccctccggctcttccctccctcccgccctgcctccttcgcgcccgccccatccgccgcctgcggggacgtgtgtgtctctactgcatttcccctttcgctcgctcgtttcggtgcatgtctgcgccggttcgcgccccctccccgggcgcccctgccgccccgtgtcttggcccggccctccccggcgtccgccccgctccccgcgcgctccaccccgccccccgccccgttttatcaggggcgccgccgtctcacctggtatttgcatctctccctccaacttgccattggcggcgcgaagtgtgggagagccctgcgcctcgcccgcccggaccagcctgccccggcgccgaggtgagtcacgggcgcggggtggcgggggcaggcgggcggggaagaagggcgggcggggaggagggcgggggacggcggccccggcggccgcggggaccgaccgggcgccgcgctcaacttccacttctcctttcgccggcgccgagttcctggcgccgctcgcccggcccggcttccgaggggagaggacgggctggcggggctggggacccgcgtctcggcccccggagcggggaccacggagacagaccccggcccggcgaccgagctgggcccgtgagccactcggcctcaggtacgtcgatggcgccggttcttcgagccttgggggacgtggaaaagtttgcttgagggcggaatcgagagcgccggggccccggcgtggggctgggggcccagggaagggcgggagagtcgcggagtgtcgcgagccgccctggagtcgccccgccgcgcgtgtgatggagaacccgggctcccgatcccgggatggaagtggaatggattccccgagtcggggagtcggggtaggggcccctgttttccctcgcccccggcagcctgggttccgtgacggggccgatcatgacagcgggcccccagaagctgggcgcccgagggcagaggaggtggggcggaccgcggcggagctgctagatggatccgactgcccccggggcttctggggccagggctttagggtcacacgcacacacgcgcacgcagacctatgatgtggagaactggatcgccaaaatagagacctcttggcaggggccggagtttccgtgtgagccagccgccagccttcccgctcccgcgttcccgctctccccgactctcccgcctccgggttccctcctgggccgccgcctaggggattcagcagccgcaccgtgcggggtcccctcacgccagcgccttgctttggaggcttgagggactgctgaggcggtgaccgctttatgaattcctggctcctccaccgcaccctaaccctgactcccttttctcaccaccgtatgcctgcacatcaccttcctgaccagagtcacctcctgaccccttggcacctcggctcagcgaggtcctcctgggccgcccccgccccgcaccataccccagctgagggatttgatggccatttgattcctgcccctcatccctcggcctgtgatagaggcctgtctggtcctgcagcctcttctggttaatgtttgacagttcattgtggctaattattttaattagctcttaaagtgggaaagaacagttaaccttggacttctcgattttggcctggtggggcctcaaatgggaggagtgctggggaggtggggaggtaggagcggaagtgaggtcaccaccccagggcctgaaccaccactgctcagccccaacagctggtgggcacgcccattggggactcaccccctgccagctgacccctggcccgagtgccaggttggaggtgggtgaagggaacagttctagctcttccctttggggagactttggcactgaaaatgcccggggaacacatatgcccagcaagaatgccagtccttccttgcagttagttacactgggttttcctggttataaagtgctttctcaaccattaattcagattcagtgcatccagtacaggagcagcgtagggggagctctctggagttcagtgaagattatcagggaggacttcctatcccagccagctggtgtgaggaagaggctaccttgcatctggttgtttttggggctggattcagagcctgggatctcttgttgggggcaggggtgggggggaccatgaagcaggctccatgctaccaccctcacccagcctcttgctgtgagccgaaggagtggcttgtttgcaactatgtctggcattcctccctgtgctgcactgtttgctcggtggttgctcaggaactggcgcccacccctggacaacctaggggcccaaaattcactctccctcacctagtgctaagtggtgacacagtggcttctgtcttctctggcatatattgggatctaaaatagagggtgctgtggtctgtctctaggggcctgagtgatagcatgtccaaaatgcccctcatcttgcaaaaatcaggccctgtgccgcacagacccagctagacacaggctgaggagtttgctttcctggggaaacctctgctcttctgctcttaagcttggccttcttcctttccacatcccctacccccgcaatgtaattttacatccagtttttgtttttgcgtttagagtgttgttttttttttggtttttgttttttaattcagggtctcactttgtcacccaggctggagtgcagtggcacagtcacagctcactgtaatcttgaactccttacctccagttctttttttttttttgagatggagtttcactcttgttgcccaggctggagtgcaatggcacgatcttggctcgccgcaacctccgcctcccaggttcaagtgattctcctgcctcagcctcccgagtagctgggattacaggcatgtaccaccacgcccggctaattttgtatttttggtagagacggggtttctccgtgttggtcaggctggcctcgaactcctgacctcaggtgatccacccgcctccgcctcccaaagtgctggattataggcgtgagccactgtgcccagctacctccagttcttaaagcctggctgtctaggttgaaatcccagcattgttatttactagctatgtgatcccagtcaattgtatgccccagtttccttatctgtcacatgagaccactttataacactttggtgaggatcaaatacatgaatgaatacatataagatgcttattagaacagcacatggcacacagtaagtgctagctgcccttacgatattgcctaatgcagcgcctaaaactcagattcaattcagcaaacacttgctcagagccggtcctagtaccagaccccaatgaagtggcagtgaggaaaacatggatgtgaggaagacaccacctgccttccgggattgtgtgtaccttttcgtgtgggctggagtcagagcaggtgtacaggaaggggtcagggagaggggatatgtcatctatataaataattgtaattggaagccaggatcaaattcctgagccagtgtgggggatcaagcaccctagacttgggggcttctctttgcctgaagaccctggccagattctggtctagatgcacctcccaccctccccacacacagagtcttgccctaggatttgggtgaatgagagggaaaggaacactggttttcttttcttttcttttcttttctttttgagatggagtcttgctctgtcgcccaggctggagtgcagtggcccaatctcggttcactgcaagctctgcctcccaggcccaagcatttctccctgccttagccttctgaatagctaggattacaggtgcccacaaccttccccagctaatttttgtatattttagtagagacggggtttcaccatgttggccaggctggtcttgaactattgacctcaggtgatccgcccgtcttggcctcccaaagtgctgtgattacaggcgtgagccattgctcctggctgggacactggtttctgcatgagctacaggtggcaatcttgcaggatgtcatttgttgggttccagggcaggatggcatttcttagggacaccccccaaacatccctatagccccctgcagtggaaggggtcatgtctgccatgccccctgtctccccaggatctcccaccgagctgggaaaggccctgggcagccttctgtcctcagggtagggcctgaccccaacccgggcttggcatctctcctggatttctaagctgcaaagaggtttctggcttctcttccaatttattctttttgtggttctcagactgaaaactacttctgcaggggagaaaggaaactcctgcaaggcacccagaatcccataggcgctttcctaggggtcaggggcttttctcatcaacaccaacctgcctgcaaatctctggccgctgagcctcgtgtgtcctgtaatagcagccacactgctaatgccctgtagctcgggccccagtgctggttgccaagaaactgctggtcggggtgcttatgagggttctgacctcataggggctgctgagtttcaattcaacagacatttattaatacctactgtgtgcccaaccgatgctaggcgccgtgggggagatgagagaaggaggcgctggggaagagatgactaagacactgaaacaatcagaggcgaggacaagcagccgggccagtggctggtcaggtgctaattgtgcttgttggagcagaggccagcacggctgggactggaggtcagcagcagctggaggagggagggaaggctttgtgagggatgcgggcctaggctagaccttgaaggggggagagggggaagcaagggggagatttggctcagcagaaaaggaagaaaagacgcctttctctctattccctggccacgaactgaccttcgaagcctggatgattgtttggcaaatgtgtgtcacataaaagaccaggtcagctagtgtgggtggctcagtgcaaacccctgtctccactccgggagatataaactggctggccagcctgccacccaagctgaggggatttcgtttgaaacccctcccttaccagacacacacacacacacacacacacacacacacacacacacacacacaggcccctggggagtgggagagatggcaggggagacgtagggcacttaaatgacaggaaaactgacatgccacttgtgctcatggcagtctcaggctggctggatcccaccttttccccagggttctgggatttctctggaagcccagagcttcaggtggaggaaagagattttcataattgttccccactccaccatctgggaaatgaagaatgtagagtttcatgtgtttctgcccagaccgctaaggactagccatatattgcttccactgattctgtgtctcccaaggctggacatggaggaagcttggccctggttgggtttaattggataaaaaactcccggacatccccctgccacatacacacactcatcattttccctctctcactgccctgcctcctccccagcacatttcaacaccaaagggacataccagagggccctgacttcttggttgggaaatcatgccctaaggtgagtttctcggcaaagagaccccagcctgcttccagggtgaggaggagggtcagggagcagggaagggtgtttcatgcaggaaggtctgcaagggaaagtgccagaacatttctcagagaggctaacaagaagcaagctgagcagcttgtagaggctgagcaagctttcccttgagttgccaccttcttttctttttttaatttgaggcagagtcttgctctgtcgcccaggctggagtgcagtggtgtgatcttggctcactgcaacctccatctcccgggttcaagcaattctcctgcctcagcctcctaagtagctgggattacaagcacctaccaccatgcccagctaattttcttttttttttgtattttttagtaaagacggggtttcaccatgttggccagcctggtctcgaacccctgacctcaggtgatccacctgtcttggcctcccaaagtgctgggattacaggcatgagccaccgcacccagccgagttgccaccttcttgatgggtcattttcttggcccagtgtgggcacttcctgcctctcagaacacctgactctcctgaagcttcctttcctcttccagtgtgacccaatatccttcccaatacatgttattgtctagaggaggaagagcacaggctctctacatttatatgccaaacttactggctgtgtgactatttgctgttgagctagttacttaaccactctgggagtcagcgcccatctcacagggttggagtgaagcttaaatgagacgatgcatataaagcactcagcagagtgcctggcatatagtacccacccagtaagtgttcactgctgttattattattcctgtgacagttattattattgttgtcaccatttccccttcacacacccttgactttgccaggctctagggaccaactacttcttcggcaatgcgggcagggcatgccacacccatttctgaaactaagcgggagattttccaggtttttctgctttttgttaactcggccattgcacaggatagggaaaggatgtaatagaaggtgtgtgtgtgtgtgtgtgtgtgtgtgtgtgtgtgtgtgtgtaatatactgaatggcaggcagtgctgtagtgaagagcaaaactcaaatcgttaatatttgtactaacattgccttctttagtccttcaccattttcatcttgagcatcattcactgcagaaataagagtaagttagtttctttgagaggcctaacgttgtactcctgggaactatttagcaatcatcagattgttgttattatcctactgagtgtaaaattctgggagccaactggctgactaccactcactctcacccttcactagaatagatgatgggtccattctgggccaatgcccagaggccttgagttgaggctggggcactgcctttgcccagaagagctcccaggggactgggggccagtgcccttccagaggcctcccagagagtaacttggaggttccatttgctattgactggattgtgtttgcttgaggagcctgtgaccacccgcagggacaggcagcctaggataaactggaccacccctgagtaaagcactccactcagtcccttggtccccacccctcagttagaactgctaggctttgggggatgggagggtggcaattattcttaacctcccgaaattcctgatgacccgataacaaggaggtatttagacatagaatgaggagctaatctttttcctataatgccccctgaggataacagaggctagttcagctctgctaattctatgagaatctatgcacagaaaacacctgtctcattagatgaccacttctaattagccattctaataagtgtgcagtggtatctcattgtgattttaatttgtattttcctgatgatgtttgtattgactgatgatgttgaacatcttttcatatagttgctgtccatatgtcttctttgttgaggtgtctgttcaaatcttttgcccatttttaaactgaattgtttgttttcttgtagttgagttgtgagagttctttatattttttggatacaagactttcatcagatacatgctttgtaaatactttctcgtagtctgtggcttcttttaatccccttctcagtgtcttttgactttagcaaacattttaaattttgatgaaagtgcaacttttcaacttttctttttatgggtcatagttttggtgctgtatcgaagaactcttcccctagccttagttcacaaatattttgtctcatattttcttttataggttttataatattagtctttacattttagtctatggtctgctttgagttaatttttctgtatgttgagtggtatggatccaaattcttttccttccttccttccttccttccttcctccctcccttccttccttcctccctccctccttctctctctttctttctttctttctttctttctttctttctttctctctctctctctctctctctctctctctctcatctttatcttgctttcttgctttcttctttctttctttttcttggtcttgctctgttgcccaggctggagtgcagtggtatgattatggttcattgcagccttgacctcctgagctcaagtaatcctaccaccttagccttccaagtagctgggaccacaagagtgtgccaccatgcccagctaattttaaattttttttttgtagaggtatgttctcactatgttgcccaggctgatcttgaactcctggcctcaagctatcctcccagcttggcctccctaagtactaggattacaggcgtgagccactgcacccagccttttttttctttttctttatgcatatgaatatctaattattctagcactatttttgaaaaagctatcatcagtctactaccattgtctatatgtgggcccatttctgcactctattcaattccattgattggtctacttatttctctttacattaacaccaactgttttgattactgtagctttataatcattcttgaaatcaggtagtattagcctttcaactttgcttttgtttgaagttgtttttggctagtttaagtcctttgcgatttcatgtgatttttagggctgacttgtccataacattttcttttaatatttgcatttatcccacttgcgttaatttttgttgtaacaaatatgtttggtgttttattttattttgagatggagtcccactccgtcgcccaggctggagtgccagtcgtgcgatctcagttcactgcaacctctgcttcctgggttcaagcaattctcctgcctcagcctcccaagtagctgggattgcaggcatgtaccaccacacccagctaaatttttttttaaatatatttttagtagagacacggtttcaccatgttggccaggctggtctcaaactcctgacctcaaatgatccactggcgttggcctcccaaagtgctgggattaccggcgtgagccactgcgcccagtctggccttgtttttgttttgttttgttttgttttgttttgttttgttttgttttttgagacggagtttccctcttgtcgcccaggctggagtgcaatggcgtgatctcggctcactgcaacctctgcctcccgggttcaagcgattctcctgcctcagcctcccgacctcccgagtacctgggattacagtcatgcgccaccacacccggctaattctgtatttttagcagagacgaggtttctccatgttggtcaggctggtctggaactccgacctcaggtgatccacccgcctcggccttccaaagtgctgggattacaggcacgagccaccgcgcccggcttgttttttaaatcttattttataatcatgtttgttccttatgttaccattattttagatgatgcttatcttttaattgatattcttagcctaaaaagttgcttaactttattatgcatttgtaaaataggactacttatttgttatttgctcttcatttattaccaatttttggttaataaatccatgactatctgcctcatacatcattttatagatgccaatcatattcttgctcagccttgtctgtccagaaaacaaaaggcttctttaaataaaatttttcctcatatagttatcctcatacccctgttttcttgaatcactttacttcttagacctgatccagaatgaagtctttcctgagggttcagtgatcaaccaataaccccagggtggaaacattgtggttttgtacaaagacagaatgctttggtgatgacctgatcatcaactgccttctcaatgccacttagaataaatgactctagctaatacatcttgtccctaacagaggcctggagcaagagaggaaaagtaacattggagccctggagacatttgcccaactctatggctaccttacccctagtctgtagccctaagatctatcaggacctgtggtctcatttctagagatctcactcttgttgagaatttaggtgaacttcattcatgaatgcccaaacctgtgttagtcaggagatgaaatgggctttgatcccgtggattttactacctgttggggaaacaagagatacacgtgaaataattaaagggcaattcaagaccctgtgggattaataaatcttgtggtagaatttaagggtcatgggggcttagagaagggggttccatgggtgcagaccgtaattatgagggtacaaccagctccatggggttggtggatgtgattgggcccttgctggataggcactatttgattagccaaaaaggagcagcaaaggcatggcaggcctgagaaactccgtgaatgagcctggaatgttccctcaggggaccatgaggagaccaactgggcttcaagcccaggcttaagttgggaaatcatgggaaacaagccggagtaggtagggtggggtcagactgtgaaggacctttggaaactgagcagatgagtttggaccataaggctctgccgagtctggctggtgtggtcacagccatcgatgtcaatgtgtgtcctggagtaggagttggcgccagctcagaagctgagggaggagctaggcagaggctgggccaagactggaacttgatcttcctcactcccagtcaagtgggttttctgctgcaccaggcctagtttttagctttccaaaggattttcacattcactccatatagcttcctaacagaacccacaggtatggggtacagatggtgaagaccagctcactccatggctactggggtgacaggaggtagaaccactgagaaacactctatagttcacctgctggttggccccaccaggtgaccacttgccctggagccccttctcaggctcaaacatgttagttccagatggtatccttaaaagaaaatgtattaagaggcaggcggtggctcatgcctgtaatcctagcactttgggaggccaaggcgggtggatcacttgaggtcaggagttagagaccagcctggctaacatggcaaaacccgtctctagtaaaaacacaaaattagcagggcatggtgatgcgcacctataatcccagatacttgggaggctgagacatgagaattgcctgaacctgggaggtggaggttgccgtgagccgagatagcactgctgcactccagcctgggcaacagagtgagactctatcaaaagaaaaaagaaaatctattaaggagagagatgacacttaacacaatatcagttttttggtttttttgtttgtttgttttttgagacggagtatcgctcttgtcacccaggctagagtgcagtggcgtgatctcggctcactgcaacctccactttctgggttcaagcaattctcctgccttagccttccaagtagctgggattacaggcgcccgccaccacacccagataatttttgtatttttagtagagacggggtttcaccatgttagccaggttggtcttgaactcctgacctcaggcgatccacccgcctctgcctcccaaagtgttgggattacaggcgtgagcccctgcgcctggctggcctgaacatttcgatagagggaagaaatgtggagccctgatagccactatggtcaataagcctgcgtggagctctggatagcatgaaatctctagggagggaggcccgaggctgcgagagccctgtgacgtggcgtgcctgtggttacatagcccattaatggcaaaattgacttagcagagtttttccaaactttcccacccaagtgctcccaaactactgaaaattgtattctagagacctagaaggacagttaaaatttcttggaagtatgacttttgatcttaaatgtgaatgttgcaatctactgcctcgagtacattttaagtgatttatcagtgaacaaaatggaggcccctggaagatgagcccagtctggactgtggctttgacgcctagtctggggcttggtcagctttggcatgcaggccctgtctctgtagggcctgcctgcaggtgggtcagaggttgaactttcagaaatgtagcctaaagtgctggaagggaaatctgtcaccctcagcatcttcatttgcttccagtctccgtccctgtctccctttgtgattcaaacacatttgatggaaaaatctaggcccttctgtcctgggggataatcttttagctcgctcagtggttaggtctggcctcatcctagcctttgggtgggtgcatagatcccagggtgggatggacacagacagcttgggacccatgaggctcagaagcctgggtatggattggccaagattgtgcccaaggacttcccagcctcatctcctccatcacagtcagcctgcagcccctcattcagccccacctttagcttagagtgtttacagtgctctccagtaaaaaacaaatatatctgcccggacttgcagtgcctttcagcctagagctacccaccgtcatctctgggtggctaagtacagaagagccgaggaggcactccaggtcaaagttagcttccttagcagcaccacgtctcattcctgtctccatagcctgcagatagagaaggtacaatttaaaaagaacgcatgccctctccagcttgagcaagctgcataaagcactatgaatattcaggtttcgctctggcaggcagggccccaggcactgcgggcctgtgccaggcagcaatccttcgtccacaccccctgcctgcccatggctcaggggggctccaggctgcgggagcctgtagtgacgaaagagcaggtagggccctgggcaggctgtctgggccaggcagggcgggggcagccggctgggtgaggcccagattccccaggctgataaggcagcctgtaaacacccggcaaggggagggggcagagggcaggcgaccagatggcaggagaggggggaaaccggagcccaggcctagctgcaggaagtggggcttgatgtggaaacatcctgtccagcgggggctaggctggtggccatcaaggatcactccctccaccatgaaggcaagctcagtgcaaggtggggctgctggcctgggcgccagcccaagaacctggttcctgacatctccaaaggacatgatcaatgggtctctattatgggttgctctaccacctagcactgctgaggcgaaatcagaactgagctgcccctcatggagacagtcaacagaaggattgtcatagagaatttgaatctcatgggaaaatcttcatcatcactatcagtgaggagcatctatttgaacacttaattgtgtcaaaggcctcctgcagcacccaaaggagagccacgtatctgacactccattctattctgccttacagtgctcgctttttttcctttctttttctttttcttttcttttcttttttttgagacagtcttgcactgtcgctcaggctggagtgcagtggcgcgatctcaactcactgcaacctctgcctcccaagttctagagattctcctgcctcagcctcccgagtagctgggattacaggcatataccaccatgcccagctaattttgtatttttagtagagacggggtttctccatgttggtcaggctggtcttgaactcctgacctcaggtgatctgcctgcctcagcctcccaaagtgttgggattacaggtgtgagccgccgcacccggctgcttttttttttttttttttttaatagagatggatttcatcatgttgtctaggcttgtctcaaacccctggcctcaagccaccttcccacctcggcctcccaaagtgctaggattacaggcgcaagccaccatgcccggccccttgcagtactttctaattagaacctcagaggttcagaactggctgagcctttagcaaaagattaccaaactcgcctacttcactttacagatagggaaattgggatccagagaggggcagggacttggccacattaatggaagacctgaaattaaagtccttagttggaagtgttttccactgcttaccccaaggaaagcagcttgcataaggttggacctgccatgcatactcagtgaccctgtacttacccttgcctaggattatagggaggctgggaggaggaaacagccttggagccatcaaccagaggaccttagcttgtgcatggccttcagtgggccgctgcccttctctgggcctcagttaaaaaaaaaagacaactgctttattagatatagttattagatatagttcaaataccatataattcatcctcttaaagcatacacttcagtagtttttaatctattctcagagttgtacatccatcaccagaatccattttagaacattttcatcacccccaggcagggcatggtggctgacgcctatcacctcagcactttgggaagctgaggtgggcggatcacttgaggctaggaatttgagaccagcctggccaacatagtgaaaccccatctctaataaaaatacaaaaattagcccggtatggctggcacacacctgtagtcccagctatttgggaggctaaggcatgagaataacttgaacccgggaggcagaggttactgtgagctgagatcgtgctactgcactccagcctgggcgacagagtgagactctgtctcaaaaacaaaacaaaacaaaaaaaaacccaaaacattttcatcacccccaaaagaaatcccatacccattagtattcactccccattttctcccaacccttgggcctcaattttgaagataacttgctacaaacatgttttgagggggtggagcacccagcaatattgtttaggcagatgggctactgagcttagtgggaatttggatacaaagagactctaccacagagaatagggtgggccccgtgattagtcccctggccctgggcctggcacctatgaggtgttcaaggctgactttccataaatatttgaataaacatgtgaaccaacaccccaagataagagcccagacttacattatatgtaagccaagagcaagtgtatatttatggggcagggaccatgctgtggctacttgaggtctggagccaggaactctctggaaacagcagagcttataggaagagtcggcctccacatcatcagagctggaaggctccccctccacaatactccttctccgcagctggccacaggagctcacatggtcaccattggaagttagaattgacttactagatggagcttgggttgacattgagtccttgaggggcttgggacacaagcctgggaagcctctgttgaagcggccccacaggggctctgaggcttcgaagtggagagctgtgagccagccttgagctagggatcctagcagatggttgctagcatggacagaggaaaaagcagggacttcaagatcaaggtcacaccggccccagtttgagttctgcctccattcttgggcagtggtggccttgatcatgttacctaatctctgagcctcacttctactgtttttcaaatgaaactattaaaacagaattattaccaaagcagatttcactgaaaacaaagttcattgtgtgtagtagttggaaataaagctaggttcaaaccccggctctgccacttactggctcctttgcagggacggtgtagcaccccagaactacacatccctgccaccttccctgcacaccaccctgtcatcttgtcatttttactgtttggccctccttttcccgaagcagggggagcaacttgaagtggtatcagagagcgcaaaagaaaatcttgcccacctttacacaagcacccacgccccactgcccctcccccagcaggccatgcctgagaccacagtggccacacccaccaccctcggcccaccagcagctcaggtcactgccaaccccacaagtgctcaccctgagctggcaccaacctcaagcgcttccaccccctccacccaaacacgtgccgccagctttgagccaggcttgtaaccaaaccctggccctgggtttgtgctgcagatgtagggaggggctggcagaagcccaggtgcacatccagatgttgtttctaaggtttccttggcgttctccctaccagctgtgaagccgtattcactccagcttgcaggagtggacaagcaggtactcccctcaggggcggcggggccctatctggagggaactggttcctctttgtcctaggggggacatagagtgagaggggacagggaaaagtgggaccctgctctctctctctctctttttttttttttgagatggagtctcctctgtcacccaggctggagtgcagtggcgtgatcttggctcactgcaacctctgcctccgggtttcaagcgattctcctgccttagcctcccgagtagctgggattataggcgcccgccaccatgcatggctaatttttgttttgttttgttttgtttttgtttttttgagatggagtctcactctgtcacccaggctggagtgcagtggcgtgatctcggctcactgcaacctctgcctcctgggttcaagtgattcttctgcctcagcctcccgagtagctgggactacaggcttgcaccaccacgcctggctaatatttgtattttcagtagagatggagtttcaccatattgaccaggctggtctcgaactcctgacctcatgatccgcccacctgacctcatgatccgcccaccttggcctccaaagtctgagattacaggcgtgagccaccacacccggccaatttttgtatttttagtagagacggggtgcctccatgttggccaggctggtcttgaactcctgacctcaagtgattcacccacctcgtcctcccaaagtgttgggattacaggtgtgagccaccacgcccggcccctgctctcatgacaggaggcctggctgggcagggttcttggccaaagatacaagaatatggccccgagctgagagaggtatcaagatcaccttctcagccattttttttgcaggcccatccagaaccatcatttgtaggaatccccttagcttcttgcacagctgcttgaacctcagggaacaatatcactacggggaagccaaggtgattgtgtccatccaccacgaggcccccgaaccaggcagcaaggcttctagagccagcatcacatagttctggcctgtccccaggaggactggcaactgggcagagaggtccaaagcctcaggctgcttacagctgttctgacccatggccttgggagggtctcactgagtgggtcacctgcctgcacaataacctcacaggcacacagccctacggctaggaaccccaccttgcaacagcacctgggaggtacttaagagtggaagtcaccacaccaagtcatcagccaccatggaatgtgagagtttcctgctacatcacccagaaaatgcctctacccttgacccatatgtgatataatacagttgacccttgaacaacatgggtttaaaccacacggatccactttatatgtggattttttttttttttttctgagacagagttttgctctgtcacccaggctggagtgcaatggcgcgatcttggctcactgcaacctccgcctcctgggttcaagcaattctcctgcctcagcctcccaagtagctgggattataggctcaccactgcactccaacctgggggacagagtgcctgccaccacgccatcatgttggccaggctggtctcgaactcctgacctcaggtgatctgcctgccttggcccaaaatgctggaattataggcatgagccatcacacccggcctatatgtggattttttttttttttaacagtattctcaagattcgaaacctgagtacagggagggccacctttttggatttgtgggctccacaggccaactgcgggacttgagtgtgcatggattttggtattcccaggtggtcctggaaccaatccccaagtatgccaggggacaactgtactttgccctccgttgtcgcctgtgtccattggtgctagggacaaggcccctgcaaaattacgaagtgacattgatttcaatgtcatctgccccagtgaactaacctctcatcctcttgcttcattaaacctgtccctccattcgaagccaccctgggctagtccttcctggacattgacctcagcatttatattccagttttttatccagtcctctaaggccaggctcactccacccctcaaggtgacagctaggtaaagtgataaagtcatttctactcatctggtagtaggagagggtttgtggagagggtttgtggtagcaagagagccccaatctccctcccaggtactgcatccgcttgtacctgctcctagcccaaagcagtctggtagacctgccactggggcgtccccttgtgtagacagctgtctcctcagccttcctgtgagggatcctccccactcaccacgcagggcccttccctctctgcactccctgacctgtgtgaggcaggggcggggctgggagggccagcaggccccgaaggggaaactgctgaaacccctgggacaggaagtggcagagaagggctgtttccgctggcagagcaggggtgcggtgagagctggccctatctcctactccactgcctgtctgctgtgggccctgggaggctggggagaggtgagagtcctttccctgtctccctcccaaaaaagtggaggcttttagcccaccggactggagggaggggagggctctttcagaggaggccatcttcattttgcaaggagaggaattccgagaggagggcagaaaggtcagcagacgggaagggtggggcagggcaggtgagtgtggagtgagggaggcccatgggggcagcggaaaaccacagctgggcagaggacccttctgtaagcttttgttctgagggtaaatgatcaggaccatgcctgctaagaactgtgggagatggtaatgcagttgatcactgcctgtctaagtcatagggctagacaggcccttaggtcacccagtccaaccccctcattgtgcagatgaggtaaccgaggcacacaaagcagaagtgacctgctcgaggtcacatcatgggcagaactcacgtctcctaaccccagcccaggaccttctttctgatgagaatctgctgagttgtatttggcatcccacacctccctgcaggcacctccatccccaagtgctctgtgacattcttctcagaaatcaacatgatggggtgggtgtggtggctcacgcctgtaatcccagcactttgggaggtggaggtgtgaggatggcttgaggccaggacttggagaccagcctgggcaatatagcaagaccccatctctgaaaaataaataaatacaaatttgaaaaaatatatatttttttgagatggagtttcactcttgttgcccaggctggagtgcagtggcacgatgtcggctcactgcacctctgcctcccgggttcaagcgattctcctgcctcagcctcctgagtagctgggattacaggcgcccacaaccatgcccaactaattttttgtatttttagtagagacggggtttcatcatgttggccaggctggtctcaaactcctgaccttaggtaatccacccgcctcggcctcccaaagtacagggattataggagtgagccactgtgtctggcctaaaataaattttaaaaaagaaatgaacttggtgaatttattcacactgaagcctttagtccagcattcagcaaacctttcctacaaagaattggttgagccagtttatttgagaccaacctggacaacatggcaaaaccctgtctcaacaaaaaatacaaaaagttagccgggcacggtggcgtgcacgtgtagttccagctacttgggaggctgaggcgggaggattacttgagcctaggagacagaggttacagtgagccatgattgtgccactgcactccaacctgggtgacagatcaaaacccagtctcaaaaaatacatatattaaaaaatcactatatgtcaggaaatatttttcttttgatttttcccaatcattaaaaaatgtaaaacccattcttagctcatgggccgtctaaaaatggaccgcagggctgggtttggcacatgagccatagtttatgaacccctgctttggtctaagaagtaaagctaaggtgtcatgaggaggaggagagagtgtgccaggtggggaggaagcagggaaggctttgaaaagaaggtgacatttgcttcagatcttgaaggacttgtgggcattgggcttgcagaagttgaagaagggcctgtcaggcctgggggacagtgtgaacacaggcacggaggtggaggtggggaaggcactgtggaggtggggaaggcactgtgaaggttcaatgtgccctgcatgtgtgtggcttcttcttcttcttcttcttttttttttttgagacagagtcttgctctgtcgcccaggctggagtgcagtggcgtgatcttggctcactgcaacctccatctcccgggttcaagcaattctcctgcttcagcctcctgagtagctgggactacaggagggcgccaccacacctggctaatttttgtattttttattatagacaaggcttcaccatattggccaggctggtcttgaactcctgacctcatcatccgcctgcctcggcctcccaaagtgctaggattacagacgtgagccaccacgcctggccctaatttttgtatttttagtagagatggggtttcaccatgttggccaggctggtcttgaactcctgacctcaggtgatctgcttgcctcggcctcccaaagtgctgggattacaggcatgagtcaccacgtccagacaatttttttgtattttttagtagagacagagtttcaccatgttggccaggctgatctcgaactcctgacctcaagtgacctgcccgccttggcctcccagagtgctgggataacaagcatgagccaccacgcccagccgtggcttcattgttattggccagccctgaatctttgactgctgtgtgttcttgccagaggaaagggttgcttttttgaggatgccaggagacaatgagcaaggaaggaggcaaggaagaagagtcacttgggagtcacagtgcaactagctgtgtcaccttgagcaagtcacttcctctcctatggtagcagaagttggatgataagagggatggatgcaatgatctttcaggtctcttataactttgatatcctgggactctgactcaaggagaggtgttttttttttttttttttttttttttttgagctgaggtctcactcttgttgccctggctgaagtgcagtggtgcgatctcagctcactggggcccccacctcccaggctcaagcgatcctcccacctcagcctcctgagtagctgggactacaggcgtgtgccaccacgtctggctaatttttgtatttttttttttagtagagacagggttttgccatgttgcccaggctggtctcgaactcctgagctcaagcaatccacctgcctcggcctcccaaagtgctgggattacaggtgtgtaccaccgcacctggccttctaacttgaggagaggttttaatcgtgccggtgagagagaaggaggaaccccaggagctctcgatgacttctggagccgaggctgccctccctgtctggccaggccctggtaggctgtcttcccacctcatcctttctggcacccctcccttctgtgaaagggatgctggagtactgctcttgtgcctgaagtactgtcctttgcttttgctggcctggggattggccagtggcagaagggcgcatttgggaggggcagccagtgccaagcaggcagcaaccacaccatggcccctgctgcccaggaaagttccagatctgagcaaggaggcttcacgttagtttctaggacacacactgggctggcagggaccttgacaaagaacactgtcccttcaataaaagttatctgacttaatatcctgtgggtaccaacatagattatcccagcttctaaaaaacccactaatgaatttaattagtctctagtcagtgtttgtttttttgagatggagtctcgctctgtcacccaggctggagtgcagtggcgcgatctcagcttactgcaacctccccctcccaggttcaagcgattctcttgcctcagtctcccgaatagctgggattacaggtgcacgccgccacactccggctaatttttgtatttatagtagagacgggcttttgctgtgttggccaggctgatctcaaactcttgacctcaggtgatccaccctccttggcctcccaaagtgctgggattataggcatgagccaccgcacccggcaatatcttttaacattcttagcgagaacaccctgcacatcttggggtctctacagctactgtatctccccatagtccatcaatttctttactttggggtggctctgggattcacctcctggttccagctaccctacctggtctccctccatctcctccactcacagacccactcttattttatttatttatttatttttttgagatggagtgttcactcttgtcgcccaggctggagtgcagtggcgcgatctcagctcactgcaacctccgcctcctgagttcaagtgattctcctgcctcagacccactcttatacccagaccaaactgcccttcctaaagggctgcttgttatgcccctcccttgctcaagaatctacagtaactcacagtcgctttccatattaagttctcattccacagttccagggatccacttatccagcttcccaagcaatgttcctctctccctctaatcaaactggtttcttctctctaccatacattttatatttgttgcttttgtcccctcagccttcatttcatcccgccacctccatttccctttcttcctctatatctaggtaaagacatgctaaatgtttaatgaactaccacagccccagagtaacgaatcagaccagggaattggaaaacacactggccaggcgcggtggctcacgcctgtaatcccagcacttcgggaggctgaggcgggtggatcacttgaggtcaggatttcaagaccagcctggctaacatggtgaaaccccatctctattaaaaataaaaaaaatagccgggcgtggtggcacacacctataatcccagctactcaggaggctgaggcacaccctggaggcggaggttgcagtgagccgagatcgcgccactgcactccagcccgggtgacagagtgagactccgtctcaaaaaataaaaaaagaaaaacacgtttcgggctaacagagagcttttgcctacattagctcattggccttttgcaacaaccccttgagctaaataggagatccctgttttacaaaagaggaaagtgacctgcctcaaccccaaggcagagctggggcttctagctggaaagccgatgatcttaggatctgcaggggcttctgggggctctcctaggctggagctggcagaccgttatactggggtttagtggctgccccacacttgggtttctcccttttcctgcagtgggttctcccgtcattggcttagtgccactgtcctgtgcttcgtgcatgaagcactagagatggtgatgtggtggccgcaggcacttccagggggtgctcttttggccttctcagagcagctggggaaataggttctctttgtcactaaccctccccctcctcttcctcccctatggggcttctgtagtgtagtgctctttcttgccacataaccacaacccaaagtgctggggcggggtgaggacaggggatccagtgcgctgcaccagccgcagcagcctgctcctccctccctgccaggtccccagcccaggcaaggagtcagccccttgccacccaacaactggaaccctccagccccaccctgtgtattctggagccagtggggtccaccgtctggagcttaatggggcccacagcccctgttgctctctgggaggtcacctgaaactcatcatctggatgaacgctttttaattttcaaagtgcttttccactgccatctttattcacccgagactccctggtgagcacctgctaagcctggattactcacaaccctcacctgctcgaaggatgacagaaaccacagcccagaaagatggccgacttttccatggtcacacatcttgctaggatgcagccagaacgcctccctcctcctccccggccctaggcagtctacactgtgggtgggctgtgggtcccctggagaaagaggaaaaagcatctctttgcctgggacctgccatctaatcactcctcctctgggacagatcaaggcctgcaaagaaggtaggggaagaggcgagctgagcagggtgtgagagcgggggctgtaactggggaagaaccctgggcccacctcaccatcagagttgggagaaaccctatgctggaatcaggtggtgacagaggagcaaggaaggaaactgggtttcttgtaaataagcacagagaaaccccaaccaacagagcttgcaaaacctttcttttttccctccctcttcctggtttcatctcaaatggagtggctggtagaaagaaaggaataggagaaagagctgacaaaatagcggtgactagggccccttcactgggcatttgcttaagtaggagggttagctcactcattggagtccagccataactggactgaggtttggggttcaagtcctgtggatgggtgaattctgctctgttcaggactacagactggatatagtcctgactctggccttctgtctcttaaatccacgccactggtcacatggtacagcaggcagttccctgcttgatgactattcgcctgaggacgggctgtttttcagtcgagggtacagctgttcctggggtagtttccattttgcttgtggttgtgggggaggggtgttgagggagtgggaaatggcatgaaggaaattgtcacttcctttccagagaattccagaaaggtttcatggaggatgaggtatttcaggagtgagagctggctccaaggggacaaggaaccggagaaggagaattgtgctttgtggcccagctgaccatctggcctccatgtttcctggcatgtgcgaaaatgccacgggtgttaccagcaattctgtgagagccattggctcagctgaaagggtgtagatttaaactcactccacggagactgtggacgtggctttcacattggggctatttcctgtaagggaggcccagatgagtggttgctggacactgcttggtatgtttcagtgacagccccaggaagggtctgtgcatctaaagggggccgagttgtgacacaggagcagcccaaaccacttctattttgcttcggttttgaaatgcagtcagagccacagaggtgtgtatttgcaggccaggaggtcggcgcctttgcctgcacactccctcttaaggtccatacactcagagggcacccaggggcacatactttctcgcaaaggctttgcttttggcccaagtaagacaggcgctgggagtcagagaccctgtagggcctcaaagggtgtgaagggagtggagctcttgccaccctgcgaggggactgtgactggagcaagctgtgagctgtgcaagcatggggcagggtaggggaattcaccaccagttactaagggttcacaggctcctcaattccccgagccaagtgtccgtgtgtgctccctgatttgtctacttgctggggaggcagcatccagggctctaggctactgaagctgcgtcccagccaaagggcccactggagaaagggagcccctggtgggggcctccctggcccacagggcgcacctcctatgatggtggcatctttggtttcgggttcctgggagaaggaggttattttgaaggactgaagggggggttcactcctctgctggggagagtgagtgaacatgcaaatgagcctctctccacctctcactttcaaatcctcaaacatctcaagggggagggggaaactttctggactggacggttagggcggatggtttctcagccttggccaaaagagtaggacagctacttcctccccctccaccccttcaagaccttagcttcaggctcagggtagacgatcaccaggatgagcctcgggtgctgggtatagcttcacaatacctcacaatcccgaggcagcaaagcctgcacccaccaagtcctggattttgctacctcaatatgtggacacagaaaagaatgccctgggaatcgtctctctttgatttcaaacctctctgcattggtgaccaaggattccattcaatgcagtgcagggccctggctgcctccctcccccaccagctccctggcacatggactttgggggtctcatccccgggacccatgggccacatatctagctgggcctggcattctcttcctgagaaccccacccccatcttcagcacagccacttccagccagcattagctcaggtttgtcattctcacgaaggcagctgaggctggcccggaggaggaactgacaactgagcttgcggctttgctggccagaccagggcagccctttgacacacagaggctctcgtgcacacgtctccacgcttgggacacatgcacacaccctgcacacacatatacctacagtgcgcttgcacacccacaaccaacgcaaatagcgcacctgggtaaatgacaatgcaaaaacatacagaggtcaccccagaaggtatgcacattttgctcattctcgtgtaaggcagagtacgtgacacctacccgcatccaccgtatacagataaacgttgcccagaaaacacacctcacagatgctgactgacccataccaccaatctatccatccatccatccatccatccatccatccatccatccagccatccatccagccatccacccacccacccatccacccattcatcccttcattcattccacaaacacaaattgagtgtctgttacatgccatacatgatgcaaggtgctaaggtttcatcaatgtccaacacagttgttgctgccctcaaggaagcccctgtcttatgggggaggtaaggaaggtacataaaagtagcccaggcagacagcaccagcagtgaactcgcaaacatgaaatcctgatctggaaagaagagatgagcaagcccgaagggaagggctacagcgagtgaccttgggggaagggacacacacaggagtttcatgtttagacaaagtgggattaggtgaaagtgatcacctttaatttgattagtatgagaatgtttcctgggggcaggcagaaggcctgtgggagggcgggagctgctgtggaatgcaagccttggggcgcttaggctgggggggcaggggggacagaccttccaagcataaatggccttgggaggcttcacagaccagtggagaatgggtcgcaggcagggtctggtgggggtggggtggtggtgggaggagtgaacctggggcaagggctgcagtttcccaggcgcctcctcccagtactcagcctctcactcgtccaaagggaaattcagacctgagaggttgagttgagcgacttctcccgactttttgttggggtgggtggaaaggtgtgggggtgagggtgagggtgggggtggggcaaaggcacggccagccctgtgggctaacggaaaggaagtaggagaggcctgggtgtctcctgtgggggagagcggtcatcagggaggtcaccgtggtccccctccctttcctcccctttgcccctctctgaagttcctcatttctttccgggccaggataaggtttgcccaccccggcactgccaagggagtgtcaaggaggtggagtgcagtgtgtggcttctgctatggtgcatggacacacccacacgcacatccacacactcagaaccgagcccaggggaccaaagacgtggcgcctggaagtggagaagctccagtgatggggtggaggagcagagctggctggcgaggagggaggtgggagggctggggctgtgggaggcaggcctgggtgtgaccacccacaacacgcagatgaggcgcccgggcactgacagccctgaggagtggcgacagggggaacaaatgcaggcccggacgccatgtgacaccgtgagcgctgagggcacgtggggcgagaggaggtgtgtttgggctgcggcagacacagaagatttcctggaaaaggggcctgagccagccccagaggatggggaaggttccgcctgcccctcctccagtcggggctctcctcaccagttcccagggtgacagttcactcttgaaactgaaagcaaagctaaaccaagaacacaaacccacacacagcacagaggccacgctctctggtgggtggcggcggtagtggtgagaggggggtgctgacgaaaacagggtatgtggcccacctgtcccccagtctccaggctctctggaggcttggctccatctgagagtcccatccctgagagcagggtaaggccactgctggtcctcacacaatacaacccccacagcgaggcaggcatgggtgtgaccacccccacttcttcctctgtagatgtggcccctcaaagctaactggcccccactcccaaggtaagattaggctgacttcacctggagccaggcagagtcagaagagcactacagagtgggtatacagatacccacaggcccccactcagcccctcacacgattcttccccaagccaagggagttacagggattctccatgctgctgcctcgtccacgaggccaggccaggcgccctgactccccctggggattagtcttcagggtggagagagcgcaaagttcctccatctggcagtttctccaggggaaggggaggaggcagggagggaggctgcatatctttgggactagtgcgagatgccgatgctggtgacccagacgggcaccaacactcagccacttcccactggaggccattcagttgacttcctctctccttctttctttccctgacctctttcttctctgtcgcttttcttctctcatcatcctcccgtttcggccactcctctattggcagtctgccttagcatggcagggtccctctggttcataggcagttctggcaacagagctcaaggaaggtgacttactcactgtccccatctctcccttctctctaggtcgctcctgtggttggtccagcccagaatgcagccttgagcctggcttaggccaccacctactccagctctctccaccccctattttactgcagctcagggggtaggctctaggctccaaagtacctgggtattgtcccttcatcaagaaagccccacagctctggagggctctgataatcccgttgtcagctctctgaaaagacagcatggctattaccctacagcccagtgacctgatctttgagttcgcaagcaacgggatggatgatgatatccaccaggtatggccccagagaacagagcacagttagcccctgtggacaatcagatagacacagacagccaggcagacagccagggagccagctggctgcacagctagccaatcagcaaatatccatcaagcacctactatgctcagggcactggccctgcttgccagccagcctgcgtgccagccagtcactcatgaggctggtctggagtcaccgggcagtcatttagggagctggttgcccacatgcaatcattgagccagccaaacatctgctaagtacatcagctgggctgttggttagtcagcaacatggaccaaacgcataaggggtacactgaccatcagatgcatttttcggccacttctcttctctcaaagtgtcacagtgagaaagctgtggggacagccacatagcaagaatgagcactgccagctgaactgtagactggtgtccaggccctgacattttcagagtcgtctttttggccccagcctgaggattcaggacaagctggaaatgaggtcttttggtgggaggaagttggaaaataggacaggattctggtgctcactgaggtccccactgctccataccttccctacactggcacgttttctgtgcacttagatgtatgtacccattgaacggtgtcctggcagactcatcactaccctccattctccttcttccataaaatggagagagaagaggcatccaggcacagtagaaagaatggaagattaggagtcaggagccctgggttccgatcccagtttggccacaatgtcacctgagcaagtcctgtcccttaccctatttttttttttttttttttgaaacgaagtctcactctgtcgcccaggctggagtccagtggcgtgttctcagctcactgcaacctctgcctcccatgttcaagccattctcctgcctcagcctcccaagtagctaggattataggcacttgccaccatccccggctaatttttgtgtattattagtagagaccgggtttcaccatgttggccaggctggtctccaactcctggcctcaagtgatccacccaccttggcatcccaaactgctaggattacaggcgtgagccaccacgcctggacccctatcctatctgactgctgtttccccatcttcaccaagaggcgatccaactggattatctccaaagggcattccagtctaactcagatgctctctattctaaatcctgtgaggatggaaaactgtccaatctctagctgcctaccaaagcctgccccctagtggcctttgagcactttgaactttccgtctacctccttgccttaaagcagctcaattttattgaacatatgtggtgtgcctagcctcgtggaaggcatcagacaaggagaaaggaagaaaaatctaccatacatgagttctcaatgctacttgtcattttccatttgtttctagtccactcagcaactgtttcttttcttcatagaggctgtttttcacagaagcagttcttaccttccaacctatccctccaccctcagcggacagcctctcctccaatccacagagaagctcaaagcccaggacgccctcaatttccctcccttctctctttttatctgtaacatctcctgttcttgtttccttcccactggcccaggagaaagaaatgttacttttccttgcaagggtgactcccaacctctgtacttaatctgttctctcctgcatcccttaagacctcaaaccatccatcacttcctctctcttgtatcttttattttttatttttattttttgagatggagtttcgctcttgtcacccaggttccagcacagtagcacaatctgggttcgctgccacctctgcctcctgggttcaagcgattcttgtgcctcagcctctggagtagctgagattataggcacgcatcaccaagcccagctaatttttgtattttcagtagatacagggtttcaccatgttgggcaggctggtctcgaactcctgaccgcaggtgatccacccgcctcgccctcccaaagtgctgggattacagacgtgagccaccgcgcctggcctcttgtatcttttagacctcagatttctttcctcaactttgaacatcttcaggtgtcccaaccctaaaagaaaacttccctcccttctgcccccaccttcaaaattgcatctttttatacctttttagttcctttcttccccccagggtagtctccacactctgtttttactttattacctgcctttcactcttttttctttccttctttctttttttgacagggtctcactctgtcacccaggatggagtgcagtggcacaatcatggctcactgcagcctcgacctccccaggctcaggtgatcttcccacttcagcctcccaagtagctggggcaacaggcacatgccactgcgcctggctaattgtgtgtgtgtgtgtgtgtgtgtgtgtgtgtgtgtgtgtgtgtgtagagagagagagagttttgctcttgttgctcaggctagagtgcaatggcacgatctcggctcactgcaatctccatctcctgggtttaagcgattctcctgcctcagcctcccaagtagctgggattacaggcgtgcatcaccatgcctggctaattttgtatttttagtagagagggggtttcaccatgttggtcaggctggtctcaaactcctgacctcaagtgatctgtccgccttggcctcccaaagtgttgggattacaggcgtaagccaccatgcccggcctaatttttgtattttttgtagagatgggggtctcacaatgttgcccaggttggtctcagactcctgagctcaagcaatccttctgctctcacgcctcccaagaagtgctgggattacaataggtgtgagccggtcaggctggtggctcacacctgtaatcccagcacttcgggaggccgagacaggcagatcacctgagttcagcagttcgagaccagcctgaccaacatggagtaaacctgtctctactaaaaatacaaaattagctgggcgtggtggcacatgcttgtaatcccagctactcgggaggctgaggcaggagaatcacttgaacccggtagtggaggttgcagtgagccgagatcgagccattgcactccaccctgggcaacaagaggcaaaactctgtctccaaaaaaaaaaaagaaaagaaaaagaaaaacaacaggtgtgaggcaccgcacccagcccctttcactccttttaggaagctacttttattttgaaatacataatacatgcaaaagggtgcataaatcatatttagatgtagacatgtattaaatgaacacccaggccctcaccacccaaattaagaaataaaacattaccagtctcctagaaacctctgatacctaacacttaatgagagcttagtctacgccaggccctgctctgagtgctttatgtgtattgatctgttttaacaatcctagggggtcaatcatgtgatcactctcattttataaatggggaaactgatccacagaaaggttaggtaacttgcccaaggtcacaatgctagtgagcagcagagtttggtctcaagcccaggcactctggctctagatcagcacaatccaacagaattctctggaatgaggccaggtgcggtggctcacgcctgtaatcccagcactttgggaggccaacgcaggcggatcacgaggtcaggaatttgagaccatcctggccaacatggtgaaaccctgtctctactaaaaatacaaaaattagccagcggcggtggcctatgcctgtaatcccagctactcaggaggctgagacgggagaattgcttgagcccaggaggtgaaggttgcagtgagctgagattgtgccattgtactccagcctgggcaagaagagcaaaactccatctcaaaaaaaaaaaaaaaaattctctggaatgctggaaatgttctatgtttgtgctgtccagtatggggccactagtcacacgtggctatagagcacttgaaatgtggctagtgcaattgaagaaataaatttttaagctctccaaagtttttatttacctctaaatttaaatagtcacccgtgactagtggatatcatcatggacagctctagatgctgggaccttaatcactatacccaactgcttacctcagtctgtcctcactgagatccattgcaacttggcctgggaccctagcactgctctgaaactgatctagccagggtgactgaccatggccaaatccaaaggtcttttatccatttttgtttctctggatccctcaggaacactacacagagaggatcattctcattctttttgcatgggaaaaaaaaagaattatcatccacaaaacagatcttgagactaaacaataacaacaaaaagaattaacattcccatgaaagaaaatttggaaaatacaaaaaagtagaaagggggaaaaaaatcattcaaaactccataatgaaaataaaactatggccaggcacagtggcttacgtctgtaatctcagcactttgggaggccaaggtgggtggatcacttgaggtcaggagttcgagaccagcctggcctacatggtgaaaccccatctctactaaaatacaaaaattagccaggtatggtggcaggcgccggtaatcccagctactcgggaaggtgaggcagtagaattgcttgaacctgggaggtggaggttgcagtaagccaagatcgtgccactgcactccagcctgggtgacagagccagactctgtctcagaaaaagaaaagaaaagaaaactatgattaacatcctggcatatttatttatttatagaggttttttctttttaatttttttttaaatagagatagggtcttgctgtgttgcccaggctggtgtgtgaactcctaggctcaagcgatgcacctgcctcagcctcccaaagtgctggcattacaggcatgagccaccacatgcagcctctatatggagtttttttaaaaaaaacacatgcagtcatactgctttttaatttcgctttgcttaatttcaaaacacttctgttctctaggggttgaattctcatctcaattttcttatctactccaagggattgaacgaccaccagctcccttttgaactgttagacacttatttttgactccctgataggcgtctctatttcagatgtcccaaaggtacctcaagctcaccacatccagacattgtagcccttatcttggtccacagcctgctcttcctcctcctgggccctcccttggcatgagcagtatctccatgtccctgttgaatgaagctggaaattgaacccctctcccccatccaggcagtgactgagtcctgacatttctacttctataatgcctctgttctgtcttcattcccactatcattgccacagacggagcccgaagatgtctgagcccctaactctggctgcgaactaggtccccagccctgactctagactgaatccctcttgtcccccgactataggttgagccccttgcccttgccatcagctggtctattcccaatggccttagaatgaatctaatcctcatagactgagccctaacctggccacgggttaaaccataactacaaccagttaaaaatacttgcctggccgggtgcagtggctcacgcctgtaatcccagcactttgggaggccgaggtgggtggatcacgaggtcaggagatcgagaccatcctggctaacacggtgaaactccatctctactaaaaatacaaaaaattagacaggtgtggtggcgggtgcctgtagtcccagctactcgggaggctgaggcaggagaatggcgtgaacccaggaggcggagtttgcagtgagccaagattgcgccactgccctccagcctgggcgacagagtgagactccgtctcaaaaaaaaaaaaaaaagcttgcccttggctgggcatggtggctcacgcctgtaatcccagcactttgggaggctgaggcaggtggatcacctgaggtcaggagttcgagaccagcctggccaacatgatgaaaccttgtctctacaaaaactataaaaattagccaggcatggtggcacacacctgtaatcccaactactggggaagctgaggtaggagaatcgcttgaacccgggaggcggaggttgcagtgagctgagatcatgccactgcactctagcctgggcgacagagcgaggctctatctcaaaaaaaaaaaaatgcttaaagggctggtggtgcagagctaacccatctattcatcaagaacccactcaaagcatcacctaatgaggctggacccagagttatatcatcctatacaaaggacagtccctgatgaacccaagaataaggacttgcacagagggccagattctggtagggagggtttgctggaagagctgggtgggtcttgaatcacatccctgtcttctccatagctggaagacccctctgtgttcccagctgtgatcgtggagcaggtaccctaccctgatttactgcatctgtactcgggactggagttggacgacgttcacaatggcatcataacagacgggaccttgtgcatgacgcaggatcagatcctggaaggcagttttttgctgacaggtctgttcccttcctgggcagagaaggtgtggtagaaaaaggggctgtgtctttagggaacagcagcccacaatggcctctagtaaccccgtgcagaatgggcaagtccaccagccaaaaagttgtgctgcttcacagaggagggaaccatcttagtagattcatggtctgtggaagtggggtgggacaatgaggagtgaagaccagctgagggggtggagagttaggtaaggaggggtgctgggcccttcctggctgtccctcagtacctctggtcagggtcccctgtttctccctcacttagcactcacttcagggtcagcccgaaggatgcttaccaccatcctttcttcgggctggccctgattatagctgtaccccctgccttgtgccctgagggaacttttcttctctcctcccaccatggaacccggaccagatgacaatgaggccacctcgcacaccatgtcaaccgcggaagtcttactcaatatggagtctcccagcgatatcctggatgagaagcagatctgtaagtttgaaccccagtgcctgaactcaaggcaacaaaataattccatttaaaaatatgaaatccatgtattggtttctcaggcatgtgtgcacacaggtatacatgcaccacacccaccgatatacatatgacttttatctttttgtattttggtgatgggtttatttcaattagcacgatgtcctcaaagtccatccatgttgtagcacgtgtcagaatttctttccattttcaggccaggcacggtggctcacgcctgtaatcccagcactttgggaggctgaggcgggtgggtcacctgaggtcaggagttcgagaccagcctgaccaacacggtgaaaccccatctttactaaaaatataaaaacttgctgggcgtggtggcgcaagcctgtaatcccagctactcaggaggctgaggcaggagaatcacttgaacccaggaggcagaggttgcagttagccgagatcgcaccattgcactccagcctgggtgacaagagcgaacctctgtctcaaaaaaataataataatttatttccatttcaggctgaataatattggccagggtgcctttctcaggcccctctgctcttttgcttagctcccaggaagactgagatatgcagcatgtggctcttttagaaataagtgatccaggccgggtgtggtggctcacacctgtaatcccagcactttgggaggctgaggcgggtggaatacgaggtcaggagttcgagactggcctggccaacatggcaaaacctcgtctctactaaaaatacaaaaattagcctggcgtggtggcacatgcctataatcccagctacttgggaggctgaggcaggagaatcgcttgaacccgggaggcagaggttgcaatgagccgagatcacactattgcactccagcctgggcaacaagagcaagactgtctaaataaataaataaataaaataaagaaataagtgatccttgcccatcctaccaggctcctaactccccagagggcccccaaggcaggctcttcccaatgacccctcaggcagatgcacaggagggttcccccagattgccttctcccaaggggtggtgtggtacagtgagggaaggcaagccataaagctgaaatctgagagatttctagtcctgactctcaccagtattcatccaggatccaataatgggtgcctatttgtaccgggcaccaacttgctgtgtgaccttgggcacatgacttcccctctctgggtctgtctcagtttcctcatcaggaaaacacaggaatggggctacatgatctctaaggcccctttgagtcgtaaaatgagccaaggactaaatcaaggtggccctttacctggggtgccgcctagaacttccctaccaccaacagtgggctataaatgtggcagctgtaattggggccagcttgtgcccacagctctgcagatgtttcctctcctcgtggtacaagccacatgaggcattttcaggtgtatcctgtgtctggggctggggggatgagccccccgccctcccttggaacctacccgtctctccagcgctgggagaccccgctccagccctgcctgggccccgcccacctcaggtctttcttcttgcagtcagtacctccgaaatgcttccagactcggaccctgcaccagctgtcactctgcccaactacctgtttcctgcctctgagcccgatgccctgaacagggcgggtgacactagtgaccaggaggggcattctctggaggagaaggcctccagagaggaaagtgccaagaagactgggaaatcaaagaagagaagtaagtgggggagagtgagtgtatgtgtgtctccgaggggatgggcggggcgtgggggggcggtcagggctcatggatgtgttaagaggccagctctctggtgtgacagagatggaccaaaaggcctcccttctgtaaaacctggcctcatccgttagtctgcctgtagcctgacatttcccatgctgcccctgtctgcctgggatctgcataaactctttcagaaacattaatgatctcgatgggttgaatcctaggctgggagtttggacaccaggctcggccccctggccagtccccggacctctggggcctcagcctataaaagaccagtcatgccgggtgcttatctcccttctgcagagcttataaagccgaggccatatatgagagaggactttgggctttcccaagccccggtgttattgatttactcaggcgatggctgcttgatactgccttgtcagcatggcaaccgaacctcagcaccgcacttacctgcacaacactggtgcctttaggctgcctttccgtatcagaagttaggctaggcagattctgttctcacaaaggtgacttatttgcaagcacccggtttctccacattgtagccatgttgcagtgctaccctgggggcctgaaaatgagggtgcaaaggcctgagggctgtggctgtggagagcgatctggggcctccagccctggtgacctgcctcctccttgttggctttgtcacagccaacttggccagctcccgggccctctcttgggagctgctcctcatcctactcacctttccctcatagtccggaagaccaagggcaaccgaagtacctcacctgtcactgaccccagcatccccattaggaagaaatcaaaggatggcaaaggtatggacagctgggactcaggtgaggtggggagggagccccttccctgctgccagggtgccccagctgcccaggctgcccctcacggcctgcccctctgcaggcagcaccatctatctgtgggagttcctcctggctcttctgcaagacagaaacacctgtcccaagtacatcaagtggacccagcgagagaaaggcatcttcaaactggtggactccaaagctgtgtccaagctgtgggggaagcagaaaaacaagcctgacatgaactatgagacaatggggcgggcactaaggtaggagctgttgggatgatgcagaacccctgccctggggatcaccaatccttccttaagtccaaggagtcctcctcgctttcatggagacctgattgatcctaaggaaacgagtctcgtaactttcctcttagcttgctcctatgtctgttccccaggccccctctggcaggaagagcccccctcctcttgtatctgacctggccttttttcttttcctttttctttctttctttctttctttctttctttttttttttttttttttgagatggagtcttgctctgtcacccaggcttgaatgcagtggcgcaatctcggctcactgcaacctgcactgcctgggttcaagcgattctcatgcctcagcctcctgagtagctgggattacaggcgcatgccaccacgctcagctaattttttgtatgttttttttttatttttatttatttatttatttattttgagacggagtcttgctctgtcacccaggctggagtgcagtggcacgatctcggctcactgcaagctctacctcccgggttcacgccattctcctgtgtcagcctcccaagtagctgggactacaggcgcccgccaccacgcccggctaatttttttgtatttttagtagagactgggggtttcaccatgttagccaggatggtttcaatctgctgacctcgtgatctgcccacctcggcctcccaaagcactgggattacaggcgtgagtcacggcgcctggcctcattttttgtatttttaatagagacggggtttcaccatgttggccaggctggtcttgaacttctggcctcaagtaatctgcccaccttggcctcccaaagtgttgggattacaggcgtgagccaccgcgcctggcctcctttttgctttttataatggaagagcagttcagcaccccctcttccccaagaagggctttcttcacatctgcaagccagagacccggggaggtgggcttgagttgtcctagaggtggtctctcaggctgggggattgctgttcccgccatccatcccctcactctcagttctctccttcagtcattccctgtcctctgccccaaagcagggggttggagtggggtgacatctgaaaaccttttgtgatcctttgagttctcagggggaaatctcaggaatgtcataaaagccttccaagtccaggtgttgacatatcctttcccttgcccttgggccctcagctggctccccagccagcctcactcagcctcatgcttgcctagccctcggggaggagcactggggagatggaggtagaaggtctcccacccagctcccggctaactcccaactccctgcccctcttcctctagatactactaccaaagaggcatactggccaaagtggaagggcagaggctggtgtaccagtttaaggagatgcccaaggacctggtggtcattgaagatgaggatgagagcagcgaagccacagcagccccacctcaggcctccacggcctctgtggcctctgccagtaccacccggcgaaccagctccagggtctcatccagatctgccccccagggcaagggcagctcttcttgggagaagccaaaaattcagcatgtcggtctccagccatctgcgagtctggaattgggaccgtcgctagacgaggagatccccactacctccaccatgctcgtctctccagcagagggccaggtcaagctcaccaaagctgtgaggtaagggcacccaggtcagcatgagtcttcacatagtacatcatgttggggttcagttttctttttttttttttttgagatggagtctcgctctgtcacccaggctggagtgcagtggcatgatgtctgctcactgcaacttccgcctctcggattcaagtgattctcctgcctcagcctcccgagtagctgggattacaggtacccaccaccacacccagctactttttgtatttttagtagagacggggtttcaccatgttgaccaggctggtctcaaactcctgatctcaagtgatctgcccgccttggcctcctaaagtgctgggattacagatgtgagccaccgtgcctagcagggctcagttttcaacttcttgccaagctctactctgtcgccaggctcatgggatcctcccagagccatggaaaagccagtagggcacttgttggtcaagagaggggaagtcacttgcctgaggtcacacatccgggggcttacacgagaggggctccccagggagccaccagggcgtccgtgtcctggcccatcctcctaagcctcctccattctagaaaagaagcaacagagaatgttttagagctgcctgctgtgagccccttgggacctccaggcccacccggctagctccaactacttctcatccccactaaggggcctccgattttccctgagaaggttggactttgttgggttatgtgtttggacctcccactacactggcacagtgagacaccctttcgaggagggcaggcagtcactacgctggcgcagtgagacaccctttcgaggagggcaggcagtagagtggaatggtgaggaagatgagctctgggatcacaagacctagttgtgaggccctgctgtagtgcttactatgtatactggctgtgtaatcactagagcggggactcacatcaaggccttgtgagaccccagcatccccacttggaagaaatcaaaggataacataggtatggctggtcttggagcaagttattaatacataacctctctgtgcctcactttcctcaagctgtaaaatcagattgttcttatcccacttgtgggctgttttcaggattgagtgaaatgccacatgtcaatcatttagaatgatccctgacctatatacctattctaagtacttaataaatgtgagctacagctgagcatggtggctcacacctgtaatcccagcactttgggaggccgaggcaggtggatcacctgaggtcaggagttcaagaccagcctggccaacatggtgaaactctgtctctactaaaaatacaaaattagccgggtgtagtggtgctcgcctataatcccagctacttgggaggctgaggcaggagaatcacttgaacctcagaggcagaagttgcagtaagccaagattgcactactgcactccagcctgagtgacagagcaagactccgtctcaaaaaaaaaaataaattaaaaattagctgggtgtggtggcacacacctgtagtcccagctacttgggaggctgagtcaggaggatcgcttgagcccagggcttcaaggctgcagtgagcagtaatcgtgtcactgcactccatcccgggcagcagagtgagaccctgtctctagaaaaagaaaaaaacaacaaacagcaaataaatcgacaaacaccttcagctccattcctctcgtgccctccttcctaaccagctgagggacacttcctgccttaaccaactctgttctctgtttcttctcagtgcatcttcagtgcccagcaacatccacctaggagtggcccccgtggggtcgggctcggccctgaccctgcagacgatcccactgaccacggtgctgaccaatgggcctcctgccagtactactgctcccactcagctcgttctccagagtgttccagcggcctctactttcaaggacaccttcactttgcaggcctctttccccctgaacgccagtttccaagacagccaggtggcagccccaggggctccactgattctcagtggcctcccccaacttctggctggggccaaccgtccgaccaacccggcgccacccacggtcacaggggctggaccagcagggcccagctctcagccccctgggactgtcattgctgccttcatcaggacttctggcactacagcagcccctagggtcaaggaggggccactgaggtcctcctcctatgttcagggtatggtgacgggggcccccatggaggggctgctggttcctgaagagaccctgagggagctcctgagagatcaggctcatcttcagccacttccaacccaggtggtttccaggggttcccacaatccgagccttctgggcaaccagactttgtctcctcccagccgccccactgttgggctgaccccagtggctgaacttgagctctcctcaggctcagggtccctgctgatggctgagcctagtgtgaccacatctgggagccttctgacaagatcccccaccccagcccctttctccccattcaaccctacttccctcattaagatggagccccatgacatataagcaaaggggtcagggcaagtgtgacccaccaggcaaaattgagcagcattttcatagggaccgacttcagtagcacacctgcccctgcatttcagtgggatgtcaatacacttgaccccaagtcccccggccctgcctggtgtcactgtggccaaacagtgcccagcttaagcatccctggcatcagactatggccttcaagagcactagggcatatgcttttggcagcataacgggctgacttggtgatggagggaaaaagccttgagccaggcagaagtttgtggccagggtttgtgcagcagctttgtgagaagagcccttctacctggctctatctcactggctgcattccctacacagggaatttactaccctatatgtgaatatccctgtatgtacttgtgtgtacttgttggtctgtatcttagtttctttggggaggacagggctgtagctgtgaggtcttgtctccaagggtgtgtgtatgtctccgtggatcagccacagggatagggattttgtttttaagggaaagcattctctaattccctttgttcatgccgagattcagttgctctgagactatggggtacaagtttgatcctccgaatctggagatgttgtagagctggaacgagtgcagagtaggaacgctttgatgcgcatgcacattggggaagatgcgctcctcagggacacaaaggccgagtggggtaaaaccacgaagggagggaagggaagtcagctctgggagcagccctcactggctggaccaaggtactcttcctggagtttgccgtgttagcaaccacagtcaccttgcagtcaggctggaatcttgggccaccccaaagtgctttgctgaaggatttagacggggatgaagtgccctccagcctcagagctagccacaaagcccccagagctgaattcattgagtatttgtgcctagggcttgggctgtttgtgtgataccggccccccgccagacaatagcctttgctgacaccccagcctacttccccgatcctgggctccctcttgattactttttgacattttccagctgtcaggcatcactgcggctagtccggcagcgacctagatggggtccacccccattcctgctcaagcatgggcacctaccacatggtttctgctgctcagcctgcctgcaactcacctcgaaggcggaccagcctgcctctgtgatgactgcagcagacctccttgggtgtaccaatgcccctcatctcccactttcacacctaaccctgactccttcaccaagaagacgggagtcggcagccaggagttcccgtggcacctctctctcttcgtggctccctgcttcccccttccctctttccgaggaagggtcaacctattctctctcaaagccaacccctaggccaattgcctggatctcctcccctctcccttctttaaacgagcttgcctccctcctgccaagtttgagggcaaggctaagaaatgtcagccacggaaacaactctattatctggtgactttgggtaatgtgaatcagtgcctgaggacctttgctgtgtccttggtacagaaccatccacttgacctaactacctcccctggccgcgctctcgctcttctcttctttgttaagccaacaactatcaccctctcctactcttcttctccctgccccctggagggcactgtgtttggttgtgcaaatgtatttactatgcgtgtttccagcagttggcattaaagtgcctttttctaataaaatcagtttattatgacagtttcctgatggttgaaagtaagcatcttgataaagggtcaccattaaaaaaaaattttgcataaaggtgctgcatgggttggggtagccccgcccccacctgaaaactggtttctgccacccctactccaactccatggaaactcattgctggaaggtcatcaatgacctcatggtgaaatcaaatgtcttcttcacagttctcgggcccccgtgagcccacactagctgggctctcctgcatcccccatcaccctttccggggctggttcttcacctaccacttccaacgtggctgttcaagaatctcatccattttgggctcattttggctcctcggagatgggtcctaaatctagagctccagtcccaacctttctcttaagctcctggctcacatttccagcaatctgctgaacatttccatgtgggtgcttgtcagctccttaaagatagcccctctatcaacaatgtttttgtttgttcgtttgtttttgagtcagagtcttgctctgtcggctggagtgcagtggtgcaatctcggttcactgcaacctctgcctcccaggctcaagtgattctcctgcctcagcctcctgagtagctgggagtacaggcacatgccaccatgcccagctaatttttgtattttcagtagagccagggtttcaccatttcggccaggctggtctcgaactcctggcctcaggtgatccacccaccttggcctcccaaagtgctgggattacaggcgtgagcaaccacggctggccaacaatggatttttaaattatttccacgctcacaaaaaacctttccaagatgacgggttgatgggtgcagcaaaccaccatggcacatgtatacctatgtaacaaacctgcacgttctgcacatgtatcccagaacttaaagtataataataataataataataataataataataataataaaaatcaagcaaacaaaaaggccgtcacgacttgcctatttctgttaatggtgccactgttttcctgacctcttaaatttgaaatttcagagctgtctgatcgttgccttcacttcacccccatccccctctcccgtctcccgaagtccagcttgtggtttgcaatgtccgtaaaacctcgcctttcttccacattcccagaagcctccaccctagttcaaactacccaagacacacaggggctcccagcgtgatctgtctcaacccctcccatttgccctttgataaaaagccctcactgactcctcctggcctacaggtaggggtgatactcaaaatacttaatctctaatcctttctaaacttagccctttcgttgctgaagccagtccaggggtcctggaatagggatgggggagcacttgggctcagggcagtagctccggaagtattttaagcttagcatcagccctgtcttcaggacaaagccccaagtccttggcctgccatcaagacccttcacctttgggtcttaactgacttccccagtcaactcaccctgctccttctgccaccactcataccccaaggcactgctccagtcaaactgatggatttgctggcctgtgaacatgcctctgtttacaatttccaaactctgtgcttttgctcttattatctactacatatattctaagcattttaaacctggaaaccaagatcctccatttatcttttacctgctctaggcaatacagacaaactcaacattatttacacactcctgtgttttcttaatgaatattcttcccttctatgtatcttttcctttagaaatacaatccattggccatgcgcggtggctcatgcctgtaatccgagcactttgtgaggccgaggcaggcagatcacgaggtcaagagatcgagatcatcctggccaacatggtgaaaccccgtctccactaaaaatacaaaaattagctgggcatggtggtgtgtgcctgtagtcccagctactcgggaggctgaggcaggagaaacacttcaacccgggaggcagaggttgcaatgagccgagatcgcgccactgcactccagcctggcgacagagtgagactccatcttgaaaaaaaaaaaaaaaaaaaaaagaaacgaaaaggaaagaaagaaaatccatccacagccaggcacagtggctcacgcctgtgatcccagcactttgggaagctgaggtgggcggatcacctgaggtcaggagttggagaccaacatggccaatatggcgaaaccccatctctactaaaaatacaaaaattaaccgggcttggtggcacgcacctataatcccagctactggggaggctgaggcagagaatcccttgaacctggaggtggaatttgcagtgagtcgagattgtacctgggtgatcaaagcaagactgtctcaaaaaaaaaaaaaaaaaaaaagaaaagaaaaaaagtacaatccatccttcaagatctgattggttccactcaatcagaatgtccttcctatcctgctagtaccaattaaattgtgtccctccttcaagactcgattcatggactctgcctccccagaccagtctgtcctaagtgagttatttaaaacttattgcaattgccactctttcagcaactgatcatgaacaccctgtgacatctattataatgcaaactgttacttaaatcttcaatgacctgtacctatttagtgtccccaattagcacattacctccttgaggagtgggagggactgtatcaaccacgtaacatggcacagtacaaaggatcaaggtaatggttactgatggagccggtgggagatggggaccaaactttgaggtaggtgacctctgacctcccctctgcacaggcactcaccccaggtgctccactgctctgggcctgccctccctggctcagtgccctcatggtatccccaaccccacccccccatcttagcactcaaaatttgttactattttgaacatcctctacccctaaagcaacttccctgtccagtttctttcctactccaagtgtgaaactagctaaaccaattaacctgtgctgatacagttatgggagagggctagaggagaacctcaggagacaggttcattttaaccagagtcatgtggcagtaagtctctgccttttcttggtttaatggagtcaggagtcaagagatgaccctcatctcccagcagctgatatgttactccctcctctgggttcccacagcactttgttttctttatttttttgagatagagtctccctccgttgcccaggctggagcgcagtggtgcgatcttgggtcactgcagcctctgcctcccgagttcaagcggttctcctgcctcagcctcccaagtagctgtgactacagctgcgtgccaccacgcccggctaatttttgtatttttagtagagaacgggtttcaccatgttagccaggctggtctcgaactcttgacctcaagtgatccgcccacctcagcctcccaaggtgctgggattacagccctgagccacctcacagcactttgtaaatacctcttatggtagcacttagcacagtacagttctttaattacgtgtttatgtagggttccccgccaataggctgtgagctcctcaaggacagggactgtgtgttagtcactgatatatccctagtgcctagcacacagtaggttcttaataaatgcttattgaaagaaggaa

SEQ ID NO: 1153 - DNA, 3979 bp, mus musculus; identical to SEQ ID NO: 176

SEQ ID NO: 1154 - DNA, 3449 bp, mus musculus; identical to SEQ ID NO: 184

SEQ ID NO: 1155 - DNA, 5218 bp, mus musculus; identical to SEQ ID NO: 185

SEQ ID NO: 1156 - DNA, 34060 bp, mus musculus
cccagcaggagggtttgtggctggaagtacatgggcgaacagtcattattaaaatagccatttttgaaaacgtgtgctggagagggacgcatccagcctgtcagctggtctgcaccccatctcatgtggctagacagctcgttggttctctggctccctcacaggcaacagtgccatccactccacaccagcacactccttaacgtgtgcagcaagaaaactgacagaatgacaaggacacacaccaattattaaatgtctgggcttgtgtttttaatgtaggggtgacagtccaaagattgacttggccggcagttcgctatctggcatcctggacaaagatctctcggaccgcagcaatgacattggtgagtaaggacagtgttctcgcttctctttgcagagttagtaaagaacctcagagcctggcttgccttcaaccagcatgatgagaagtaataaagccattgaaatgccaggctggcacccttgcttggctttaggtgttacagttttgtaaagaagggaaatgatggtgctttccacattaaaacacaatgcctgggacctttcccctccctaggagaaattccttacaagatctaatgaaaagaaatgatgaataagcctttttgtaaaaagtgggcattagcccttatgttcacagtttccagtgatttgtgtattttgtgtaaaaaggtggatggatgcaaatgtgagatggcagggttcattgttgatacagcacttttgactgagtttcaaatgagctttggtatggtaattgccacttagttcagaacatgagtgagttttcccaaggtcaggataccaccatgtgataaatgggagggagctacagtctctctgggtaaataaaagtcagaggtccttttggaggtgtacgtgagtgggtgtgaggccaccggtgtgctgttaaggccactagtggtctgacctgggtgacaacccttttaagaagtccagattcagggactaattttttcttattattttattttattttttgacataaaggccatttaatgatagaaatatataaaaataatcatattgtttagcaacaggctatcacatttcttgggaagaggaaaatgacctgctttaagaaaaacttgcaaccatgtgcaagtcttcatttcaacatatttttccccatccacttaagcatttatcctttgagttataaacagtccaattacactattttaaaatatacaattaaattattattgactatagagatgctattgtgctatcaaatagtaggtcttattcattctttctaactatattttttgtacctattaaccatccccaccgcctccccaccccagccctgtactacccttcccagcctctggtaatcatccttctgctctctaccgccatgagttcaattgctttgatttttagatcccacaaataagtgagaacatgcaatgtttctctttctgcacctggtttatttcacttaacataatgatcttcagttccatccatgttgttgcaaatgataggatctcgtttttatggccaaatagtataaattttttttagctttacatcttctgtttgtacctatcaaggtcataagttagcattctctcgtattctacataatatagaaggctgaattttaaaatttactttgttttaattgaactttttattttgaagtcattgtagattcacatgcagtcgtaagaagtaatagaaatctgtgtaccctttactcagtttctccccaatagtaacatcttacagaactatagtacactgtcatgactaagatattgacattgatatgatccaccaatcttactcagattttcacagttttactagtacttctgtgtgtatttcgctctatgcaatatatatatatatattttttttttttttttttttttttttttttttttttttttgagatggagtcttgctctgtcacccaggctggagtgcagtggtacgatctcggctcactgcaacctctgcctcccaggttcaagcgatcctcccaccccagcgtcctgagtagctgggaccacaggtacatgccaccatgcctgactaatttttgtattttttgtaaaggtggggttgcactatgttgcccaggctagtctcgaactcctaggctcaagcgatcctcccaccttagcctcccaaagttccgggattacagctgtgagctaccgcacccagcctgcaattttatcatacatgtaggtttgtgtatctaccaccagtcaagacatagaacatttccatcaccactagatcccttgtgttactcttgttaagccacacccacctttctccagcccacccccttccctaacctctggcaagcactatcagggattgatttgacatggaagatagctttccagcatcatctgcttgggccactcactttagaaacagatgtgcgatggttggcaggccttgtaagagcactagagctctcaacatgagcattctgctctcctgctgctgtccctctgtttgggtgctgttttcctctgaatctgctgatagagttgcatctttgcaactgctgacctgcagtctctggtctgatctcatgcaggcttggggctaggatgtgtgactgtgactgttaatgccaaaagtacttcccctgtttccacaagctcgtttacatcctcagcccttgagaagcccagtcaggaagcataacctgatagcttgggctgatgcaataacagaaactctggcctgctgtagcttttgttctgcttaaagtgcaggcagagcagagcagagcagtaattggctgtgaatgaaaggggattgtcagaatgagcctaagttccggttctaccaccgcagtttcgtatttgggccctgttttaagccagggtggctggttggtgaaggtcatgtgcgacctcaggaggctgtcttgtcacctccctcatgtcaataggaagggaggtattctccctcctccagaatatacaggataatctgtcttgcttgctaagagcattcacctttgacctttgcattctttgggtctggagatgtctatgatcgctatcatgaaaatatgaatcacatgtttttcagtctgatgagctagtgtggaaatattgggggtattgatgggggggcgggttcacctatagaagcttttcatgctgtggaaactaagcacagttgcatatatttgggagcccagaaatagagtactgaggtttggttttctctctctctttgccacagagacattaatcctagaaggctatatcttctcaagttaatggtatttttgttttgagatagtcttgctctgtcacccaggctggagtgcaacagtgcaatcattgctcactgcagcctctaactcctgggctcatgcaatcctcccacctcagcccaggagaatcgcttgaacccgggagacaaaggttgcagtgagccgagatcacaccactgtactccagcctggggaacaagagcaaaactccatcttaaaaaaaaaaaaaaaggtctccaaaacctagtaatcattttgtaatgtaaaacgtccccttagggtgttaaatgtgtgtattgttgtacaccattttaaaaaatcaaggtccacctggactttgatctgtagctgattacaaccctggtgaaacaataatcccaaagcgttagaaaggattaagagtgttttgtaagcatgtttggggtagaacatgcctttataacttttaatcctcgttgaggtacagtgtgagtacaggagctgtgtgtggaatatccttgtgttagaatcattctgctaatatagtggagaacaaaccctcccccttcatctcccctcttccatcgtcctgaggttctagtgttgaaataagagcagtgagagcaagcaagagtaaggaaagaaagaactaatattcactgggtgcccactaaatgttttgtctatttttttctcaccgtccatagccctatgaaggatgtgtaatgactcatgtttttacagtgaaggaacagggaagaaagcaagctggggaaactgagcaagattatctggctagtaagaaattggagttgaaggccaggcgcggtggcttacacctgtaatcccagcgctttgggaggccaaggcgggcagatcacctgaggtcaggagttcgagaccagcctggccaacatggtgaaaccctgtctctactaaaaatacagaaattagctgggtgtggtggtaggcgcctgtaatcccagctacttgggaggctgaggcaggagaatcgcttgaacccgggaggcggaggttgcagtgagccaagattgcaccactgcactccagcctgggggacaagagcgagacttcgcctcaaaaaaaaaaaaaaaaaaaaaaaaaaattggagttgaagccaggtctctctgacccatgagcccaaaccttctaggtccacatcagcatttctcaactgctctccccaaggggacatttggcaatgtctggagacatttttgactgtcacatcataggggtgggggtggagatgctactggcatctagtggatagaggccaaggatgctgctaaccatccaccagtgtgtaggatagcccccacagacaacaaagaatgacccagccccaaatgtcaatagcaccgaggcccagagagcccagtctgtgttaggaacaggaagaggacaggcttcccctgcaagtgcaacttgtgttccctggagtggcctgtctcatttcctgagaatctctataaaacctagtttgaaaatatttcatatacaaaaaagtaattatatttgaagtaattaaacatcaaccaaggacatgactgtgacctttgtgagagagaaagaggaaggggggggagagagagagagaggcgagagaagagaggggagaggggccatcttaaggcttgcagcaagtgaaatgataccatttgagtctgatttcaaatagaaagagtattggatttgtgattagatatttgccaaagatcaactacccagtgtttaaacgggtattacataaaaggacaataacaaatttgatcaatactaagttctaaatctgtactctgtatggtaaagttatacaggagagcaagagagagcaattgtaatagcgaccattaacacaacatttttgtgaatgtgacaccaaatgtctacaaacaagtgattacattcttaccttattttgcaatttctacctttcatgataataaatcacttctaagggtttctcatacaaattttgaggaaaaattcagatctcctgacttggggctattggtttttctgtcctgtttttaaaatacatattttaaacttccccttttggagccagagagccagttattggtccttgcagcatgtcagatcattgagcaattgctcaggttcaataaaacaagatatactgtgtcctgcctgccattaaaaaaaaacaaaaacccatgaatgacacttggagtgttccagattgactactggctgagcgtgtgtgtgaacaacagccgcgccttccagctctctcgggattagttgctcagacatgagaactttcactgaagagccacggctggctcctacagacactgtctccttactggcaaccttcagacacagcctttgggaccaaggacatggttgatgttacctgtgctgaagaacaggagatacggttgctactggtctacagtcaagtctgcatatgacgggctgcggtgcccatgtgtggacgtgtgcagctccggtccctatctagggacacaaatcgtgatcaaacttaaatttttgtcaggagtagctgaaaagcactatacatttctcaagtgtgatgacagaaagcaaaagagattgtgctgagggtcaaacgctttatacaaaggaagtgaaacaggttgcgcttctgattgatgggtttttaacccaggcaatcctctgagcattttgggttccttcctcgaacttacagaggcgtagctaattcagaacagcttctgtggatggccttctccctgcatcgcccttgagccctcccctggttcccagcctctcaggctcacagtggaggtgtgctgctgaggaaacaaggtcaagttggcaaccagcactcatttcgaaaggcatcctccagtcctacaggagatggtccttcagggccctttgaagggcctgatcttgggtgtaaaatgagcatctccacttagactttctcagtcaaagatgttgatcctcaccagaaccgaggtgctcacctctgcctgtgcaccttgcacagggcggtcctgctggcctttggtggtccatcacggtggctgggtttgtgcttagttatgagggtcttcacgaacatcttttaccccataacatcccataagcgcaaactcagtaaacattgaaagtgcctgtaggaaaagcctcacaaatgctatagaaacagggggagattacgtcaaagtggggacatgatggcaaatgttgcagaacctcactgcagcagtgcatttggtggtatgaattattccaatatacagagagcaaattagtactgtcctacccaagtgctctatacccaccagcctgcaaaatagctgacctgagagaggtggagggacatttagggagcatcaattcagatggctgttggcttggagagggtcacagaggctagtagctgtgtggacttgcaggcagccccaaatgctcacctatgtgcagagtcagcatgtcctgcctcccctggtaatgtggtcgcctgcatctctgtggccagcgctctcgttcatcattcagtctgatggcttgagtgcctctatgtttgctacatgctgagaccgtattctagtgccgtattctggaggtactgggtgtacctacagatttaagaatgcaaatctggaggtacacccagtggattcaaagtagtctcatagaacaaagagacttatatagtgacctttgctgcatccacagtatacaccacagaggtctctgaactgaaaatgaatgtggaagcaagggaacaggtgatgttcagctctcagatctcacatggcatttatttggcttgaggtgcccccctccccctgtcccctggctgtgggctcatggattggcagagcccagttatggcttccgttttacttgcaaatatccagaggaatgtacagtctaccagaaaattgtgctcaggcatccctttgtcacattaaaagcattatggacacacgacattttattaagtattttgttctggtatcactttattaagtaaattatcaaaatccttatttagccatggactctcattaaagcatgttctggaaaccttggccaaggttaggagcctgtaaagtttgattcattgcaagagaaaagtgattagcagttggagagtgacattgatgggccccattaaaaggtcattggatgtggtggtggcaagcgaaggttggagttggaggtcagcaggatgccctgatttagaaccaagcttacctttgcataacctatagtgacactctcttcatctccccacgccttagccatgtctccctgaggttcatactgtttggaatttcacaggctcatttatcaaaaaaaaaaaaaaaaggctttcaatttgggagacggcttgatttttcttttattaatgatgcacattcaaaataaacaaatgccatctcctactggaaagggtataatctccaagtgtaaaattgaacaaatttagcttaatgggaaactcacaatgttgacctttttctcagtgcattatgactggtgataaccttggcgcagacacgtgccagttcttttgaaaaccataggtccagctcacatctgcaaagatggaaggtggcgggaaagagaaatgttgggggcaaggaaaaggccctagagagagtcaggcgttgaagcagtggctcaggtaaaaacttaagtgtccagaaatgtacaattagcagattaacttttttttttgatagagataggattacttgtaatttttttcctaagaaaaagtcatggagtgtcagatttttcagagcactttaaatcctttttaccttctcctgatgtttacaaatgagaaatagctcatcaagttacccaggctggtgaatgagagcctgccagccctttctagcagttttgggggactcttgtctctcctagggtagtaaaaagcatactaggctttgagacagaaggtttttcctcctcaaattttgtagtaagtgtaattttggcttccatgtaattctggacattagaatattattgtctcacatatgcattaaaattctatattatgagtatcagactgctcttttttttttttttttttttttagacagggtcttgctctgttgcccaggctggagtgcagtggcacagtcacagctcactgcatgctcaacctcccaggctcaagcagtcctcctacctcagcctcccaagtagcagggaccacaggtgtgcaccaccatgcccagctaattttttattttttgtaaaaatgcatctcactgtgttgcacaggctggtcacaaactgctaggctcaagcaatcctcccacctcgcttcccaaagtgctgggattacaggcatgagtcattgcacctggccctgctcctcttatatctaaataaagtgctgttaaagaagatgaaatgacccatacatcttgctctccaaaaagaaatgtgcactctgctctggctgctcatcccactgaagctgaccatcaagcacaccattgtacctccttggatcttggtttttcatcattaatccaggggcttggatgacatgatcataaataacccaattcaggcagtgcatggggtctcattcctgtaatcccagcactttgggaggcaggagggatcacttgaggccagcagttcgagaccagcctgggcaatatagggaaatactctgtctctacaaaaaatattaaaaagaaaggacccagcgcagtgtcacagtctatgtttctctaaccctgtccatttcttttagctgagttttctagacattgagaaaactgctgttttggtagcctctgaatcctctttgaaatgaagcagcttattctttcctttgtctctttacttcattttctttagttctgtcagttcttttaatctagaattgataatttggccctttataagatctaatctaggggttttttttttggcttaatgattttttgcttttaaatgatttgctggctatatggagatttaagaaattgttaaggggttatgaacataactatttttttttttatttttagtgatggggtgttgctatgttgcccaggctagacttgaactcctgggctcaagtgattctcccaccttagcctcctgagtagctgcgacttataggcatgctactgcacctggctcatgagcatacctttttgtaaagttttaaaaagtactcattcatcttttaaaagaattattttgatttttttaacccaagttattacggggaaatgtaaaagagtaggatgtttgccctcctaaataagtttgagatcctagagaaaaccctgacatagatgcaagttccaggttgcaagttctattttcaaatcagttggttagtaattctttgcttccagtgacattgaaggaggtacccactaagttgtttggtggtagaccattaaaaataataattcctggtgatgctagactacggtctggtttttggtatataatttgcaaggagttcagagaattgagtgacattgataacaaaattatttccgttctggccgggcgcagtggctcacacctgtaatcccagcattttgggaggccgaggcaggtggatcacgaggtcaggagtttgagactagcctggccaatatggtgaaatcccgtctctactaaagatacaaaaaacttttaggtgggtgtggtggcccatgcctgtaatcccagctactctggaggctgagacaggagaatcgcttgaacccgggaggcggaggttgcagtgagccaagatcgtgccactggtgccactgcactccagcctgggtgaaagagtgagactccatctcaaaaagaaaaaaaaaaattgtttccatttaatctactttttttttttttttttttttttttggtgagacagagtctcactctgtcacccagactggagtgcagtgacgccatctcagctcactgcaacctccacctcccgggttcaagcgattctcctgtctcagcctccagagtagctgggattacaggcatgggccaccacacccagctaaatgttttttgtatttttagtagagacggggtttcaccatgttggccaggctgatcttgagctcctgacctcaagtgatccacccgcctcgacctcccaatgtgctgggattacaggcatgagccaccacacccagcctccattccatctacttctatttaagtgaacaaattttcttggcacttacgtctctaaaatgaaaaatagagagttgataccaaaccatctcttcctggtattgagtgataatcatacacacatgaagtgtttgagggaaaagcccaataaaattctgttttgtcatgcttaaaaattatttatcaaaatgtgttctgatcatttgtatactaataataatgtaatgagaactcaatccaaaagaaaaataatttttacacttagagtcttaagatttcaggaaagaaaaaatcttaaacttcaatttctatacatgtttttacaatagaaagatgataaaatagttaacaacagacttgaaaatggattaggataaaattcagcagtaggggttggaaatatgaatttaaggaggaaaaggaaggatgtaaaatttccaactgttaaaatcttatgatattttaaaatggatgatggtggtggttaaattgctgcagtattcaaatatatattggatatatttaagaaatctatgtaagttatattttaaaatctcaatgtttagaatataacagaaattacatcctttgtgagtaaaacttacataaaagtttagatttcaacttgatatgtgtgaggaggatatacaagggtttccaaaattattttagcaagtacactggcttcataaatatatcattttatacttacacaaacatttctatggattaatttctagaagtgacactgatatatctgaaggtgtacacatttacattttgtaataggtattgccaaatggcatacagaaaggttgtgccaatttatgttcctgtggataatagtgtaactactgtttccaatagagaattacattatttatcagatcactttgcatagcaaatttgggcctgtagtgagcaatttttaaaggaatgcaaatgtggagagctacttttccccacttagcattgcttgtcatcaatccaagtgaatcactacctctcctcgaagcaagactacagtaagacgtgtcccccctttctctgatctaaattgggtccccatgctatcattgctaatttcaccttttatcattctttcatagtaactaagagaatttgtaattatccatacaaaagcctgtctccctcagtgggttcttagctccatgtgggcagggaatgtggctattttccacccctgtatccccctttgcctagcccagtgcctagctcatagtgtatgctcagaaaaatagccactgaatgaatgggctgagcgtttaagtgaggggaaatatcaagatgcaggatcataatacacaatcttcattgccactagccatgtgtgactattaaaatttaattaaatagctatacttacccataatctatgcactctgtagccacgtggggctggtggctacgatttgaatagtatagattatagaagatcatcacagcaagttctactggacagtgctgatataggatgattgtacattcattttcaaaactatccctatgcttggcacaaagtaaatacttaagaaatgtttgattgaattaatgagcaaataaacactgtatctccctctcttattcttgagctacacgttttgatgtagaagttgcttgtaccaaatagccaaacattctcttaacttgcctaacacattacatttcttgccacagagtgccttgaagaagccagccccttttcctgcccatttgaaaacacatttgaataaaatagaaaaaaaacaagcaacgttctgtagtggaaagaatcccttggatgtgaatctgtgtgtgggccctgttacttgttggcagtgaccttgggcatgttttctaacctctggccctccatctctttctttgtggattatagtaatgcccacacagcatggggttttgtgtacatgaaatgagggtgtgtgcatgcgaagcatctagtaatggcatggctggcacatggagttcaaaacagtagctcaaaacttgtttatagcaaggcatggtggctcatgtctgtagtcctagcactttgggaagctgaggcaggaggattgcttgaggccaggagtatgagatcagcctgggcaacatagcaagatctcatctctaccaaaaaataagacaaaacaaaaaataactgggtgtggtagctagctaattgggaggctgaggcaggagggttgcttgagcccaggagcttgaagctataataccatgagctatgatcacaccactgcatgcactccagactgggtgacagaacgagaccctgtctctaaaaaaaagaaaaaccaaaaccccctaaaacttatttattctcagcagcttgcgtcctgcaaacttcacacctggattataaatgaaaacacaacagctgatctcctatatccttacacattttggagggcttattttcctgcagaatctaatcattgctaatcatttcagttagtgagtcagctaacacaggtgctcatttgacccctccctaatattgggcccatcttgatagtctgcacagattttccacactagtcaaatgactgaggcatggagcgagacttcctcctcccattcagactacctcatggtgtttctgcaatgcggagaaagtacctgcggccctgtgggtttagagttttctcatcttagaccttggaaaaaaaaaaaaaggtaggggaggggggatttctagccttgctcttagattcttgtttccaaatcccacagctccgttaatggtgtatgaaaacagaattctatctgcatgatttgaaagggttttcacatagtctctcatttacgaaagaataatcttatgaagctgatggctcagataattctctcatttttttcctgctggaaaatctgaagcctagaaaggttgtttgttaatgtatttaataatcattttttgaacactcgctgcaagccaggagtgatcttaagtccagggaaacagagagaaaagccatagcttcttccctggctggtgggggaggcagagaagtcaacaggaaatgtcagtacagggcactaaatgccgagatcacgatgatgggtgagtagggatgcacccaacccaggtcttagggtgcagtctggcttcttggaagacgcctcagttgtggcactgaaggaattagtcaggagaggaagccctgaagggacatactcagatgggggctgtacacctctctggtggcagcatgtgagtggtaaggggcttgaagtgagaaatctattaacagtggttccaggcaagaaattcagcggccttaataatctgagacagggtgtggaggagaagagatggcttccagagatattgggaggtagcgacattgccaggttttagctgtaagcaaacttatatcctaaagctctgtttaaagtgcacagcaacatgctataatgaatgcagagaacaatttaggagctcccaaagaactctgctggtgacagctagcctgacttagccttttgactgtttctcctctgtgctttcagtggatgtgctttacgtcacctgcggtcactggtaccattgctcctatccatggaaaatgaggctacattttctaattgaaccaaatagagtgtgactgaagttcatggaaaatgagcaacttcatgtgccatgaagagtcaaaggccctttccaagccaactccatcgtgcccaacatgaattatccccgtatgtctgcagagagtttgttgtccaagtatcacaaaagcaaagggcctctcgtccttatgaaactaacttcttaaaaataccccagcatttgccagttcaatagttttggactgacttatgggcattaaaacctttttctcttaagaggaaaaattcccagccaggccgagaaagctcatatcaagtttcagcttgattcatttcaaaaccaccatgaaaactgggacattttctccacaccacaatgggttagtcatggaaattctgccttaatcgcagctaccatggccacagccatgaagcatgcgctctgtgcctctgaaaagtgatgtgacagtattggagaatttctccccttcactgtcagaaagcagaaatgcattacagttcatggtctatggaaaaatgccagggtaacctgaggttcccttttcagcaagcaatctcatatttgatacattttttttctgtatggcagtttggtttggtagctgtttccaaaaagtgctctttccaaactaaaactatggaaagttaaacttagcagaaatgtgcattaagctgggtgtagtggctcacgcctgtaatcccagcactttgggaggccgaggtgggtggatcacctgaggtcaggagttcgagaccagcccggccaacatggtgaaaccccgtctctactaaaaatacaaaaattagccaggtgtggtggcgcgtgcctgtaatccaagctcctcgggaggctgaggcaggagaattgcttgaacccgggaggcagaggttgcagtgagccgcgattgtaccactgcactgcagactgagggacagagcaagactctgtctcaaaaaaatatataatatatatcatattttaatatgatatatattatattttaatatgatatataatatattaatatgatatataatattatattttaatatgatgtatattttaatatgatatataatatattttaatatgatatatattttaatatatataatatattttaatatatataatatattttaatatgatatataatattatattttaatatgatatataatattatattttaatatgatatatattatattttaatatgatatataatatattttaatatgatatataatattatattttaatatgatatataatattatattttaatatatataatgtattttaatatatataatatattttaatatatattatatattatattttaatatatattatatattatattttaatatatattatatattatattttaatatatattatatattatattttaatatatattatatattatatattttaatattatatataatattttatatatataatatataatatatattatatattaacatatattttaatatatataatatatatatatgcattaagaggttaagagtggcttcccctgaggtattcggaccttcctcttactcatgagtgacagaaatagagcagtcttctctgccatatgtcctggagactcttgctaagcgtggccaggcttcactgtgcataggtcttcttagtgcaaacctcaaccagtaaaacagaatgggccattctgccttctctgcatccatagcagagaatgcttcttcagcctcgaagctactcacatcccgctaggagccacttctataagctacattcctggtttttttcttgagatagtttgttcatttgttcgcttgttcctttattgacagaggaaccagcatgttttccctaggaacattctagactttgagaacacaaggatgagttcctgccctcctggggctcacagcctaagtgcgggagacagacatcacacttctgggttgttttaaaagtataactcattacagactgccacctcacacattctgaaatcctaaactgccaggtggacttaattcagtgggcccaggagggtcgggggatggcaaagatggaatcctccctggagtcctggcagaagtttcctggtgttaacttgtccacccctgcacacaagtggacttaccaagtccatcctaagaggggcccaaagctgtcccatcccctcccctggctctctgcattcctctcccaccccactgttatgctgggtcacatctcgggcctcttcctggctccagctgcagtgtgtctgacctgtcaccaatcattcgagcctttggccaccattttcgtcaagtgctccagcacctctgtggccctccaaatcgggccagcactcctcagcccagcatgggaggacccactgttagagagcccaggcaggctctctattcactgggccctggaacacccttcagtcacttggtggcctctccactcctccgcttggccaaatcctcactcccttccctcccctcagcccccagcctcctctagagcagtgcttctcagcttttgccgcatgttcacatcccctggggagattgacatctgcttgtgcccaggatgcaccctagatggggtgagtcagttcctgggatgcagtggtgttttgtttttttaaattgtccaggtgattcctccgtgcagctgagttggagaagcagtgttaattagcctttcgttgttctttagtcacttcatcctgttcagtttttgctcctgagcttgttttagtttcctggacagagccataatataggtttgtccagctctgcccctggtagctaccagccaaggccgttggcagctgtctgtttgctggaaactttaacagccccctcttccatctccttcactggctgccagtcagcatctgctccttgggtttttgtcctctctcctcttcccgagccttcctctgcccctcgttatgcctctgtcctccccaaccagcaccccgcccggcccccaacaaacctccctgtcctgggccttatttccttcttccagaacagttggagatctgcacggataagctgctgaactcattatatgtagagtacatgcaaggatatttgtgcggcgctcttccaaaacagtaaaacataggagggggaaatgatttggaaactagctatccaacaaatgggattgattaattgcagtgcaacaacaattaaaatatttacaaagaattgttagagacatggcatatccggttaagggaaataagcagaatgcagtattacatatagtatgagctatactatctacaggaaaagaagcctggaggagaatgtaccaaaatactaacagtgcttgtcttgatgtggtaagattatagctgactttcttttcgttgttacaatttcgtgttttgttttttaaaaattatacgctgatcatgtattacatttatcatcaggggaaagtgatttaaaaagatgaattgggggggtgttcatgtcagatggtggctttttgcatccatccaagtgtgtaatggggaattttcattttagacaacatggactcagtagaggagagtcccagggtagagtctggaggagaaccttttaagaaaataagtttctccagcctgggcaacatgtcaaaaccccgtttctacaaaaattagccaggtgtggtgttgcgtgcctgtagggaggctgagatggaagaatcacctgagtccaggaggttgaggctacagtgagccaagattgtgccactgccctccagcctgggagacagagcaagaccctgtcaaaaaaaaaaaaaagagggagggagggaaagaaaagaaagaaaataataataataataaggttctcttaaagggaaggcccctgagaggggtcagcttagtgagccaggactggagaagcacattctagcagggggaatctttgccctccccctggccagggtcctcctggcaccctgctgagcccagctagagagatgggtgcctttatgagcctcattcaggtactggatgctgatgggctccctcttggcttcagagcgccactgatgttttcctttgtgccatctctgcggatggttaacctttcgttatacctgccttgccctgataagaggagttatcatcaggtgctaggataatgtcacttaatgtaatcccaggtgtaatttaatggcttctcctgaccagtgacttgtgcttgattttgcatattctactaaagaaaatagtttgcagataacacctgcctgttcattaatagaataaagctgtcatacagccagaccacttattataaccatcagcaaaagaattctccccaaaataaagtgaggggaaatgcacatcattttttttaacttctctgtcctggaccagtatagctgcagttatggcagttaggatgtttttagctgcaaataaagaatatctgattaaaactggctgaaataacaggggtttgttaatttcacatggcaagaagtctgggcactagatcatcccagggttgcagcccatcggggttgtcagttaacattttccatttttctgccttgccatcctgtgactagatggccacatggtcaccagatggctgccacagctccagtcatcctgtccttacacagtagcatcccaagcaggaaagaagaggaacagcaacacaaaaggccttctcacttgcctctctctggacagagagagatatgtgtttcccacaggctgtcagtatactgccctatattgctcagtaactcaaattggactacatagctgcctctagaccagtcacaagtgcagaggagcaggactgccatctcttcttgtcttttggaatcaatgaccggcatccactcgcttgtggctgttgtaccttgtaataactgccttttgtgtcgagactgccagagtgttctgtctactaaaatggacttggatttgtggaaaaaagaggattcttcctctaatcctctttatgtagctttttaaagatttatggatatagctgtagaagggaaaaagaaaaatcctgtttctctctcttccatgcaatagcttgttaaactaagaaggacatgattattctattcagtttgaatcctgtttattgaatgaccaaaggacgtaaacagcctttgtaaaagatgaagtgtaatccagacagaaaggattattattgaggaagagaggtgcttatgacatatcataagagtctttgctcctattttggctcttaaaactgttttacttttgttttagacttagaaggttttgactccgtggtatcatctactgagaaactcagtcatccgaccacaagcagaccaaaagctacagggaggcggcctccgtcccagtccctcacatctgtaagtgtctcctcaaactgtatgttcccttacttctctacagcggaaaagcaggacagattagaaactctagctaaggactcttctgcaagcagccgatttgaggacaccctgggagagggaggccatgagatacactgccaaccaaaagtgatttcagtcttcttgacttgagcggcatttctttctatttgttctttgtgtttctgccagcaaggtaggtgctctgtattcccactttccttttctttccttccagactgattcttattttaacctgaaatgaaatgggtaagaaaaaaaatcacgttttatgggtggggagaggagaatgaggctggtttggtgtgtaaacaaaacaaaactttactaaataaagatctgctcctatatagcgccaggcagcagccgaacctttctctctcaaatccccgttgcctgtacccctccacagaataccacgcagaccttcaggagattgttttcaaacatatgaggcacctggtgatgaaggagagactgattggaacactcaggataacccatagaagatttttgtttgggttgttttgaatgactttttattgcaaacctattacacgtttattgtaccaaatttgaactacaaaatgtataaagaagaaagttatctgtaatcctgctccccagtgcaaagaaccgttaactttttgttatacagccttagctttttaaaaaaaaattatttgtatatataaaattatttcttcaccaataggattacgtagtacgcatcgttgtgaaacttgcttttctcctcttctgttgtgtgcctttctccccagtcatgacacattcttccctgacatcacatttcatggctgcccatttttctaacctatgagtatgtgagcgtttagccaatgtatcgttattgggcatttatgttgtttccagttcctcattataaacaacactcaaatgaatgccactgcagaaaaatcttgatgctgctctaaaattattgacttgggtaaaaattttctggaagtgggtcaaaaggaaatgtatggtttgcttttgccacaggttgttctgtcccctccaagctcaccttccacaagttgtgtttgtgtataagttcgatttctctctctctctctctctctttatttccatatagcacattgccttgttccagtgagtctaagtccttataacctctacccagataaaccaaggaattaaccttttgcaggtttcccaggacacttcctattttcatgtcatcactgatcccacctaaggtgtcatcatttagaagaaaaagaatgtcacttccttggaacctcttctctcatatctagagtctggaagtatggtttgagtcatcctatttttcctcttagtatgaaaaacctaactgcattgacacctttttgggtgaaacacttttaaaagtagctgactttttttattgttatacagacgtctctgtcaacaccaccttctttcccttctccctctcacctcttcacaccccaccccaacacccctcttatacccacgacctgtttagttggctcttagtatctctatattttgtttttcaatcctacctcctctatcttctctgtaaatccttcatcatttttgtcttccttccaaattcttcccaacttttcaaggtctagagagccttgtgacttccagaattacagaaaggtttaaattaccatctcttgtcccacctttggtccatacatcccatgcctgagagttcgtatgtatttgggggatgtggtgaggatatatcatcttcactgccttcagactacacagttgttcattcattcaacaactctttatagacatctatcccctatgggctcggcactgtgccaggtaccaaagatacaactggaatgaaaagcacatggtcactgcctgcaggaagcttacggcacaatgacttgaagtttggcattttatatgaagtgatttcatttgcagacttaaaacaaaaggatatatttgtgctttaaagtataaatattatattctcttcattcccattcatccctacttggatgtgtacattgaattcctatttactcttcttcagttagcacctgtggatttttcataggcaagtggaggcttagtggatatgggcgtattcctcaaaggccactgggggaaatgatggaggaaatgcaccagtcatgattccccagcctggggcctctgaccctagctgaagttctttatgtttataggactcaaagagcaagctttgattggcagctcatgaaccctaggttgtaatggagggaactggctttttgaataaaatctcaaaatgaaaggattcaggcatggtatggtggctaagcgttaagcctagattaataagaaggcttggtggtgggggaaacgttattctaggtaattggattttcagattaaatgaagattaacaaataaaacctgttaaattgaaaaatttgcttaaaaattccctaaaatgcattaggtttctgccttaagtaaacagaagaaaacatacgatatttttgggtataatttttctataatgacgccaagtggtgattttaaatgggactgtttttctaccaccagggtagaaagcatagagatgaagctgaagatgagcttgctcaaagagatctgtggaagattcttcattataaaggattccttgctataggaactcttattttaatttgctttgttctaaaatagggaaattctagcccagtgatcatctatgaccaagtgaattccagtgaattggtccagaattttttttttttttccagacagggtcccactcttttgtccaggctggagtgcagtggtgcaatgtcaatggctcactgcaccctcgacctccggggctcaagtgatccttccacctcagcctcccgagtagctgggactccaggtgcacaccaccatgcctggccaatttttgtatttttcgtagagatagagtttcgccatgttgcccaggctggtcccaaattcctgggctcaagagatcctcccgcctcataatccccgtgttgggattacggtcgtgagccactgtgtctggcctcatctggcttttttatctttatagtgatcttcacagtgaggcagaaagaacaggggtgtcgtcctatattttaccaaaagatgctgccattctgtaaatatactatagccatacagactccaaaatgaatgttgactgtcagcaataatgagggcagagatttagcagcaggtaccaaaggagatatgagcttgttgcactagcgagcagggctgtgctctcaagctgaggaaacactggtcactggaccacaagcctggtgagcccttatccctggaaatggttttctctcagacacatcctttagggcacttccgtatgcagcagatttagtgatcatggaaaaggtcaaggaaaaggaagaggagggaatggaggagaggcagattagagcagcctcttgttgacctgtgtgttcttccctggtagactgtcagccctgtgagggcaggcatcctgtgtggcatgtcactaagtctgcagtacaagctcactgcagcttttgcacatggtagcaaatgtttagaggaaggagcaggaaaggatggacgatggatgcttgcaaggatgaagtgattgatggacatcagtggcaagatccctggtttaggaaaccttgcttcttagtcgcagttctgccactaatcagctatgtgacttgagcgcgtgcataacagcacacttttttgcctcacagggttatcgtgagaagacaaaatagcagtgtcgagtgcttttaaagcatacagcattatattaacgaaagtggtgtcagctaaggtgtaattctgacaaaagcattttcttttggctttatcagtcatccctttcaagccctgatatcttcgactccccaagtcccgaagaggataaggaggaacacatttcacttgcgcacagaggagtggacgcgtcaaagaaaacttccaagactgttaccatatcccaagtgagtcaccagccatggcgagggtgtccctgtcatttcatgcatgtgctaatgatgggttataaaccaaacaaagatacacaaacagtgcaggtgtttgtcattcttcagtgacagcgattctgttactcatcaaaatccccaaggcatgttgcagtctccgaaactaggcagaatccctgagatacaagttcagttgtttatttcccatgttgttctcttgtggtttgatctcctcttcataccatcacacacacgttcacaaataccttcacacactaccaccatcaccacaaccagaacaatttaaaaagccgtgagacgtctagagagaagacattaaatatattaaatgctgtgccctctgcccacagatcttgtcttttatgttcaaagctggtcacaaattatagttggaagatcataaatataaataactaatgtggtctcttaaagaaaattgatttggagtcacattctatgataaatttatagtctaaaaacactttaattttattccatgcccagagagtagtatagatactttattagtttatgagaaacaaggaagacatttaacttttagctactgcatgtaacttttgaggagcatcttgtacaaattctctccctgtgaatacgaaccaagattttaaaattccattttctcccactaagaaaaccaagtcaattggaattattttctctgaatattagcaacttctttctgtctaaaagcagaaaactatagtcacttgaagcaggaatagcacaaagaaatcaaaggttaccgtggaattttccttctccatagatttaagaatttacatgtatagattttcttaaaaatctgatacagtaagcaaaacgtgatcctatacaacagatcagttgtaattattcacaaaaccaaagcattctttctttataaaaggattccatctgcagaagttggatttagacccgttttttctggtgaccataggtatagtttcatttgacatccctggggtgtctctacagtgacatctactggtggacagtgggttttcgtggttctgatgtacacagttgtatcccattagcctatttctcttccccggagttgtcatgttgtgctcttcagtgcttctagaaattccacttgaactaatttgatcagggagggtggtggcctatactctgtgagggctttaaaattgctcagtagccgaaatgggccgggagagcgtgtcatataggaaatgccaagagaagcattgattcaagaagtgtctggaagtcagtcagtgcaaaggcactggtgggtcacaggagtatgggaggtccgcaaggatgcaggatgggcaacaggaaaaggcataagcccaggaatagatgacaagcaaaggagaggacaggagagtgcgaatcttcagactcaggcagccacagtcacagtgctggacttgagggatccagttgatagggaattgatcccctgttctgccagttattacctatgagtcttggggaactactcagccacttctctaagcctcagttttctgcttggtaaaatgcttgtgccaaccgatcgttgctcaaattgtctagccggtgtccggcatgtgatcattgctccagaaatgtcagttcctcttccctcttactctgactcctactaatgataaagcacaggctggcggagcgctattcctggcagcagagagcacttttcctcaatggtaacttggcagaaaaaaggcgagcagagaggctgggaatgatggcccatctgcttttggctttctctgcccagtctctccctctagcacagcctgaatccagactctgcctcctcgccatgccagccaagccccttttggctcctgcgctggggtagcctgctgggtacctgctgctggagggagcctcacggccgcgttgccaagcttcaccaccagcctctacttctgccctgctgctcatcgcccccgcctcccaacatcctgtcccactcttttccctcctcgccacctgcctcccagctcccttgttggtgccttctcccccaggggcctactgggcacccctcttctctctcgcccatgactgtccttcttcctcggccctcctggcctcctcaggacacttctccatcaggcctcccccgccagtctcctccaccttcagcctggcccttcactggctctttctctcagcgtatcatgcagcttagggtctccccagtcctggaaagtgaacagaacccttccctgatcccacctccccctgaggcttccgcatgagcatgctccctctctcctgtcttcctgcctcaaccaagtttctggaaagagagtcctaaactttcaggccacaccttcacctcccatccaggtggtcatctgccaggagcagctttctgtctccctggctccaccaagtggactccacccagttttcctctcagcacccttcacccacgcatgcaaccacttcgttccttctggactctcctccaggcctgtcttctgcttcatcccctcttcctcccctctttcccagtcactaagggctcctaaaatccaatgtgtcaaaaacggaaatcattatctgattcttcagtctgctgtttctcccatgaaaggtacaatctcgatgcctggtgtgtgcaccacacccgtggtccctgatctgtccttcctcctccaccctctgcatcctgtccaggaccacatctccctgctcacaaggcgtctgttccatgagggcagggtctccatcctcctggcccactcctgcccccagcactgggaacaatgcctggtgctctatgtcggctgtgcttgccttcgccacatcactcaaagttgtcttgtgtctatcctcctagccactgcctgggtccaaccctgaccgcttctagcttacgttgtgtaagactctcccagcagttctctccagctccagatctgccaaccctttagcctttctgcagccagcatggtcctcagcaccgtgtgccctcctctcaccctttcgcctagccgcttgtacttcccagccttagctctgcccccaaggccctctcttgccccctctgacggtctagcagtacttcccaccaatgcattttgctctgcggtctctagacctttgcctggcgtgttccctcccgctgcagcttctttctctaagtgcccctcctttcctctggctacttcttggtcctcctccaagacgggactgtcagcacctgcttgcgatgcctgcccgtctggatggctggccccttttctgtgtttctggggctctgtatgctcacctccctctgtgcagttgtccccccatctcagtgcgttggtctgtctgtctgtctgcgccccactgggttctgagctccctggagaccaggagaatgcctattaaggcatgtcttgttcacttcagagtttgtggtgcctggcaagtagttgggcatctcaatgtgtatattgaaccagtcggaaactctctgtccagaaagaaggtcacatttaaaatacatagaaggcggcgtgtgagtaagggggaaatgcctgtaccaagcaggcccttggtggcttgtggatgaaggaacaagtgaatggagtgtgtggagagaggcggggacagtggtgttaacggagagtttgactaaccaggacaaagacgcagcacacaaatccccggccctgaaccctccctgccttccctcgtcacaggtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaagtgagtgcctggggactcttgggggccgtcacccaggttgctctctgccaggccagcacctagttctgaaagcatggatcccagcctgccttggagggcgggcctggtctccccgttgatggtggcagcaatggtgggagtgcgtgtagaccccgagagtcttaatttatacctaaattatgctgcatgtttttgctggacttactgtgtgcaggaagggcacaggctggccatggggcatagagggatgagtccattgcagggactgatgctctcagcaggctgctaagaagaaaagcatttaaatcccccataaaatacagtatgtacatgaaccacttcttaaataagctcaacagctagcttttcctcttgcaacagaaaaatggcaatttcttcacttagctgccagatgaagcagttggcctgcattgaggtaccagtaatgtatgaagaagatgtagggaatcttgaagcccaagattttacactcagtaagatgttctcaccatgagactgcagtgggcggggcggggcagtgggggtctttcttcctgcatggctgcacacacactctcgccacatctctaatcctcagggagcactttgttgaggagaaagacctggacacaaaaataagtatcatacatcattatcatccaggatgtggtttgcaatgacaaagcccataggaggattagaagtagagaatgggcatggtggctcatgcctgtaatctcagcactttgggaggccaaggcaggtgaatcacctgaggtcaggagtttgagactagcctggccaacatggcgaaaccctgtctctactaaaaatacaaaaaaattagttgggcgtggtggcgtgcacctgtaatcccagccacttgggaggctgaggcaggagaattgcttgaacccaggaggaggaggttgcagtgagccaagattgtgccactgcactccagcatgagtgacagagcgagactccgtctaaaaaaaaaaaaagtagggaggcactgctctgagtaaactgaggctcgaggagtttagggatcagttagctgtttcttgagagaatcaagggaggcatctcaaagagttatttcccgggtaggattttgaacgatgatttaggattgccaagagcacactactccagcagcgaaaacatcatgttgattcctggccacacggggcagcctggtgaggtcaacacatccccaggtgactggcctccttggattggaggtgcctggggtggtgacaggagatgcagccagagacttacagcgatgaagccctctgccagtctggggtcagcagaagccctgtcacctgcctccctctacgtggcttgagggccctaatgtgttttgtggtcacttttgggggataactcggttaagcaaacttaagttcttttctgaagggctcttcagagccttcgctttgcattgggaggatggagaggatagcatatgcaaggtgtcccacacctgcttaatcacagaaccttttttttccagagcatcctaggatgagggttccatggaattcgctttgagtaatgtggctctaagcgggttctgttccactcaggctgggagggaattgaagcctcttggacttaccccagcctggaagagatccatcagattaatatacaggactgacagatggtacttgagaaggaatcctggggccagccaggctacctctaaccccttaaagtccccagctcctatctggctctggaggttactcatttaggtacccaaaggccccatccacgtccaggtgacctgtgtccctttcctagacaggacatcacagaggccccaggataccccagagcattggttcttgccttctgaacaggaccatcatggcatcagactggcttgaattcagggctttagctgtttggaccctatgagaggtgcctgcaacatctgaaatgccctgtgcttccgggctgccacaccatgtttctcccccactgtgaagcctgcaaatagttggtgggaattgtctttccccggccaacatctcttgagtcaacaccccacagtggcctctcttccaaggcctgccttttgctgcctacgtcagtctggccttcgtgcccagggtcagtgggtccctactagtctcttgtattagtccttcatgtcagtttcctgttagccttcaactcaagtccacaccagctctccttatccccaaataagctggttctcacctccctgcttttctctggcttttctctgtcaattcccctgtgtttcttcctcctcatagacttacgctcattttcatttcactagttcaagacttagtgactttctttggactgctttccccaattaactccccacagctggactgcttgaggctttgcctgccagtctcctggggttggagcatttgcttggagtctcaccttcttccttcctaatccctaagtagtacccactgagatatgggtgcatgatgtgcgcttaaataaatacagtaatgaatcacaactggttcatattcgttgtgatataaacccagtatgttgacagcagagctgggacactgccccagagaatagggaccatcatcgtgctcatccgaagtgagaaaatgcaatataacttccaccttattttactgtggtgtctcaggcatctttgtttcttgattttccaatccagtctgtaaaaatatgcatgtaaaatggagtgttggatacctgaaaatggaggacagctctctgcccagtgtttggatgcttgcagtgtcctaagtatagagccctaactttgtgggatggttagtgctgtgcacttcattatttttaatgttggaaagggcattaggccgtggatcctaagtcatgccagtttctctaagacatgattgccataccattactccaattattttacccccaagtttttgggacttactgtgtaggattttatgagaatccatgaaaacgtaccagtaacctttcagcaattaaaaaccctattgaaaataaaggaaataggccaggtgcggtggcttacgcctgtaatcctagcactttgggaggctgaggtgggctgatcacctgaggtgaggggttcgggaccagcctggccaacatggtgaaaccccgtctctactaaaaatacaaaaattagccaggcatggtggtgtgtgcctgtaatcccagctcctcgggaggctgaggcaggagaatcgcttgaacccaggaggcggaggttgcagtgaaccgagatcaccccactgaactccagcctgggcaacagagtgggactccatctcaaaaaataataataataaaaataaataaataaataaataaaataaaggaaatatatatggagtggtaaaaacatctgcaataaaaattacaagaagagccaggcttagtggttcatgtctgtaatcctagcactttgggaggccaaggcaggaggattgctagagcccaggagttcaagaccagcctgggcaacatagtgagacccccatctctacaaaaataattttaaaaattggcctggcatggtggtgtgcgcttgtagtcctagctactcaggaggctgaggcaggaggatcgcttgagtttgggaggttgaggctgcagtgacccatgatcgtgccactgcacttcagcctgaacaatagagcaagcccttgtctcaaaaagaaaattgtaataagtacatttaaagcccagtgattttgtaataaaggaatggttatggggaagatgacagaatatgaacctgtcatattctgacaggttacgtgaagtctagtaattgggcaagtcaggccaccacgctgggcctctgtttccccatcttatccttttgagagaagtttggactaagggatttcagaggtcacttccgcacccaccagttgctggctacatattttaggggccccagaataatggtgagccttactgtctgaaacaaattttaagcagtaacaatgcaaagaaaataatgatgtgttgtccacagtttctttgtaaaaaaggatcagatggattttgtagtcataataagagatttctgatctctgatgaaggaagtctgggattttggttaatttcattgccatttgcttttcagacgagagattaaacagttattgtctgagttggatgaagagaagaaaatccggcttcggttgcaggtgcgtccctttgggttctgctgcccgtgagtcctaggctcagtggggcaggacattgtgagggcttttatttcaaaaataaatgattgtcacctctctgcagatctggatacatttcctgtgaccatcttcttagaatcgtatgggcttactacatatcgtttccccaggaagtcttggggaagggaaacattaggaaatgtgccccaaattgggtttctcatttggaatttatctttttttttttttttttctttttgagacggagtctcgctctgtgacccaggctggagtgcactggcgccatcttggctcactgcaacctccgcctcccgggttcaagcgattctcctgcctcagactcccgattagctgggactacaggcatgtgccaccacacctggctaattttttgtatttttagtagagacggggtttcactgtgttagccaggatggtctcgatctcctgacctcaggtgatcctcctgcctcagcctcccaaagtgctgggattacaggtgtgagccacggcacccagcctggaatttatcttaaacatctctgcgaaaagcccctctcccacctccatttccaagaggcctcattatatgtggtcactatggctccaggggccacagctgtccatgttcgggggcatttgctcttgatttctcagtgatggccatttctgtcctgccagggcgttagagctctgtcccctgtagcctctgattcaacactgctgttaccaaatggcagagaatgcgtgggagttctgattgaccgaaggtagactttcagctttcatccagttggcgcccttgtggtgatggggacccatgctgcttaacaaaggataggtagctgcttgccatcattttgggggtgctgacagacacccccttgagccaaccacagctgccttccaacactgccagatggccccgcctgttaggaccgcctgctctaccctctggctaagaaactggaattattgctgcttttgacaaactttgcagcctggcagcctgagaatcaaaatgtgcaccatttcctagtgcctcgtgtctgtgtgcctgttctgtgttgatgtcacttctggcattgctgttgattgtctattcagatgtcatgtcacctttaaaattgtcagattgattgttttctttcagtcgaccgggttgataatctttcagcttctataaaaccagccgattcattatgactttgttccattcttatttttctctttctagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatg

SEQ ID NO: 1157 - DNA, 261 bp, mus musculus; identical to SEQ ID NO: 186

SEQ ID NO: 1158 - DNA, 261 bp, mus musculus; identical to SEQ ID NO: 186

SEQ ID NO: 1159 - DNA, 17766 bp, mus musculus
tacccggcccctcccaccggccccccgtttccgcccgcttgctagctgcctagctcgcggtccgtagtcggcttcgtccctggggtccctgcttgggggcggagaagatggctggaggacgtctgctgttggggggcgacttcctgtcgcgccgccgctgccccccctcccgccgccgccgctgccgcccctcccgccgcccccgcccgagccagtgctggagcagtggcgctatagccacgaaagtgactggcagtgggctctgcggcgcagcttcatctgtcggcacctgcacagctatcccggggctgccctcgaccagctcctcgcgctctccgccgcctggaccaaccacgtcttcctgggctgcaggtgaggaaggtgtgggtgtcgggttagggacgggggtgagagatcggtgatgggggatcgggttagggacggcgctggagggatcgatgatggtggttgggatagggacgggggcgggatgcggaggataggttggaggctggagatttggaggtgctggagggcactagagggatcactattggcctgggggtggggtggccgactgtggtggctgggcatgacataacagctaggagggtgcagagatcgcggaagcggcctctccaggaccagggatggagatgaagcagcgcctagaagaggattattgagaggtggtcattgtagttggtggcggtattagaggacgtggggaatgatgaatagcagcatctcggacctgcgtagggccttccaaggatgcagtatccgcagagaatatattcgacagttggagttgtgggggaagggcgaggggaccccactgttctagtctcctcctgaccactctctttttccattcctcttaaatacccccctctacttgcagccccctagcagggtcttactgtcttctcctggggaggcggtacgtatcagctctctgagccgcagcagcgtcagccttgcttgtagatttgcgcataatgtgtctggactcaaacaaagaaatggatatatctactgtaaaaatggattgccctctttttaccctaaatgggatcagaaggattaacatttggctctgagtgaggttttaggtgtgtgtgtctgtggtgggggtgggggtgtgtgtgtgtttgtttttcccccctttcctagaacctggtgacgttttgaacaggcctctttgaaagctctttgcattcaatggagactgcagtatggttccaacgcagcgtgttttgtttgttttttttttttgaagaggctacttggacctctgtccttcagaacccctaaatcggccctatactagactattcattctttgatagattgggagacgacttcttttgacattcctgcaatcatagttttttgtttttgtttttgtttttgtttttttttaaatcaggaagggtgagagattctggaatatgatcatgtcaattttggccagttcagttccaggagtgactgtaacagatgcagaaaaataggattgtctcctcctgcccttaattattgaacatggcattcagtgtgatatactttgctctcatcacagacattacttttctgtcttctcaaggttagcataatttctacctccagagataatgattaggaggaactggttacaactgaagaagccttagttattgaacaagtcagataaatctacttgacctttgcctaacagtgttgttcttgagttcaaaagttacctttatcctataatcgtaagtctccataatatcacagaaggctgtcggaaatctgaatccttaaaataaaaacaaaaacttaaatgaggataactatcctttgtgttaataataaatcttaccttcccactagaatggaagctcccttaaggatagggattttgctttcttgtttacacctttatcctcagtgcctagaagattgcctgctaaataatagctgctcaataaatgtgtgtggagtgagtggatgtatacagctttatgatgtacaacacattttaaatatttattatttcatttcctacaacaactttggggattaggtggcatctcatttttactgctaaatcagtggaggccaagaagttaagtgacgtttccaaggtcttacagctggggctaggacctaggtcttctgatacccagactgatgctctttccactgagccacagctgccatatttgggaaggatggatcatgagtgaaagcaagtaactgaacataagccacatcattatatctcaggatttaattccaagaacaacacccttgtacataaccagggcattaaaaacacaaagtaggccaatggtagttggtgttaaaggctcaagaattgcaggctgttgtgtgtgcacacaggtgcatctgtggatactatgtatgctacattgtacatactatgtatgtacaccatgttacattgtagctaagtcagtttagttaatacaagaattgccattacattatcaaatagcttaactgaaaagtaatgtttgcattatatctgatagcttccatatagaagaaagggaagggccaatgaagactcttggaagctagggaccaagtgcagtctttagatgggctttatgttacctctcatcttcaggtgggtaaaacttgtgttccaatacttgttgatgttaatgtagattttggcagagttcttgttttctgtggcagaatactcttctctcaagtgaattgtagaatacatggtgaaatagctctttctaaacttaaattgttaatttttttttttttttttttgagacagagtctgctctgtcacccaggcaggagtgcggtggcacgattttggctcactgcaacctccacctcctgggttcaagcaattctcatgtctcagcctcccgagtagctgggattgcaggcatgcaccaccacacccggctcatttttgtatttttggtagagacggggtttcgccattttggccaggctggtctcgtaccccggggctcaagtgatccgccagcctcagcttcccaaagtgctaggattacaggagtgagtcactgcacctggccttaaattgttgatttgttgctcgaggtttatcacttgacttttggaacaggctgtgaagaatagcacaaaggaatttccttgctcttttttccctctggcaaaatgttttgtattccattttacttggagctgaaataaacttctaggtcaaagaaatctttgaaaattccttcatcataagaccaagccaggaggaactcaaatgtgcagggaaacagaccttatttcattccttttggtgatggtggcaatttccacagaacaaatttgaatatcttcttgactctgtaactggggagttcaaacttaagtacacgtcaaaatcacctgttaggcttgttaaaacagattgctgggtcccagccccagggtgtctgactcggtaggtctgaggtggggcctcagattttgtatttttgataagttcccaggtgatgctgatgttgctgatccagagatcagcactctcagaaccactgctttgtaggataaaataaaaatgtttctattctgttttttaatcattttctccctaattgtccaggcaaccagaaagctcaaatggctaaaattgtttcacttcattttttcatttgtctgtttcgtccaagtaaacaacttaaccaagaatttttttctgcaggcaatttctgagatatgtcttgtggctagtgaaaaattagttcagttttctgaccaactacatctacagcacttaaataattgtacatatgaatgcctagagaactgtgtgatttttacttaaaattgtagatagtgtctttatatttaataaagcagtttgattaactggggcatttagttttccagtcattgttgatcaataagattagaaggagaattctggcctactatttacctttgatgagacattaattaatagataaaatataccttaaaatgaaaccagctttgctcccttatttgtcttttcctggttgatacaagactggtgtttggaaggtagatagatgttggctgggctcatgttgcaaaactgtgcacatagtagggagagtgcataaatcactagctaatgaaatgggtgtgagagcttttgaaagattatcaataatctgggtgtatgttattaacttatatcaggagtcttatcaattgttgttgttgttgttttaatagagatggggtttccctctgtggctcaggctgatcttgaactcctgagctcaagtgatccactcgccttggcctcccaaagtgctgggattacaagggtgagccaccgcgcctggcccgagtccttttttctttttcttttttctttttttttttttgtgtgacaatgtttcgctcttgtttcccaggctggagtgcaatggcgcgatcttggctcaccgcaacctccgcctcccgggttcaagcgattctcctgcctcaacctccctagtagctgggattacaggtgtgcaaccaccatgcccgactaattttgtatttttagtggaggcagggtttctccatgttggtcaggctggtctcgaactcctgacctcagatgatccgcccgcctcggcctcccaaagtgctgagattacaggcatgagccactgctcccagctttttcttcttcttcttcttcttcttttttttttttttgagagaaccttgctctgtcacccaggctgaagtgcaatggtgcgatctcagctcagtgcagcctccacctcctgagtgcaagtgattctcctgcctccaccttccgagtagctgggattacaggcgtgcaccaccacgcccagctaattttgtttgtattttcagtagagacggggtttcaccacgttggccatgctggtcctgacctcaggtgagccgtccacctgggcctcccgaagtgctgggattacaggcatcagccattttgccaggctccggcccgtcttatgaaaagttttttttttttttaattagttttccttatgaatagttttgaataaacaattttacacttggaaaccttaatctttgcttaattttcaaatctcagcttttttatttgaacttagtagaacagtttaatatacttttttaaagttttgtaaaacggccgtggccggtggcccatgcctgtaatcccagcactttgggagcccgaggcgggcagatcacgtgaggtcaggagtttgagaccagcctggccaacgtggtaaaactcaggcgtggtgatgggtgcttgtagtcccagctactcgggaggctgaggcgggagaattgcttgaacctgggaagcaggggttgcggtgagccgagatcgcgtcattgcgcttcagcttgggtgccagagtgagagtccatctcaaaaaaaaaaaaagttttgtaagcatctattactgaatatttattaaatttcagctgccattgtatgttatagtggtttacgttattcataagtatgcatatatatgcacctgtcttgtgtccagagatgtaaaacttatgaagacagatgtttttgttcattagaaatcatctttttatgtgctagatatggtgggatagttgagtcacatcctggtttccaaaagcttggtataatatcagctacttttgagaaccataagacctcagaattttggggttctttttttttctttctcttttgagacagtcttgctctgtcgccaaggctggagtgcagcctgtgatctccgctcactgcaacctctgcctcccgggttcaagcgattctcctgcctcagtctcccgagtagctgggtctacaggtgcatgccaccatgactggctaatttttgtatttttaatagagacagggtttcaccatgttgtccaggctggtcttgaactcctagcctcaagtgatccgcctgcctcggcctcccaattgctgggattacaggcatgagccaccacgcctggcctggttttcttttttaagcatttataatctaaagggtaacttagcagacttaaaaatatagtatgcgtgcatcttaaaaaattactatattagacttgccttaatgatatcttacattttattcaataatataaatactgtatagccattaaaactcatgtggtaatgatgtggagaaaaggcttatgatacagtaaattaaaaacaaaaaaccccaccagatttgaaatcaacatagatgacttgatagtgatggggagttatggaaaacacagaaaaagcattaaaaaataaacccctacatggccagacacggtggctcacgcctgtaattccagcactttggggggctgaggcaggcagatcacgaggtcaggagttcaagaccaacatggccaacatggtgaaaccctgtctctactaaaaatacaaaaattagccggacatgatggtgcactcctgtaatcccagctacttgggaggctgagacaggagaatcacttgaactgaggaggcagaggctgcagtgagccgagatcatgccattgcactccagcctgggcaatagagtgagactcagtctcaaaaaaaaaaattaattaaaacccaacatgttgatgaagttatcagtggttggggttattataactatttttgagacaggttcctctgtcacccaggctggagtgcagtggtgtgatcacagctcactgtagcctcaacttcctaggctcaagtgatttgagtagctgggattacaggtgtatgccaccatgcccagctttttttttttttttttctttgtagagacagggtcttgccatgttgcccaggctgatcttgaattcctgggcttaagtgatcctcttgccttggtctcccagagtgttaggattacaggtgtgagccactgctcccggccagtggttgggaatgtaggtgcttttcttggtggattttctaaaatgcctggtgttaaaggtgttactttaaaacacactattaaaaaatagactctggagaaagtgaataataaaagctttactgccttggcttactttaaatatgtggcaccacttctttatctttggaaagctactctggattgtagaagcctcgtggtcttactaaacactctagattcgtatttacattgttctttgaatagtgaagtgtttgttaggtactatacggtctttttcattattgttcatactggctgggcttcttcagtattatgacttcatagcaaaggacagagaactgtatcagcaacctatgtaaagacttatttttatggcctatgggtgaagttgaattttgtggcagatgtaatgaatagggtatagtaagtaggtagaataattactaatgctggaagaaacctgagaaaagtgagcatgaatgagtgagccctaagtgcatcacaccgtaagacatatatgccatttgcagttgtatactgtacttggaatcgggctctaactgaaggtctggagaatattgactggaattcaaggtaagttgcctggttgtagggccacttttggtaacaggcgtgggattagtagtttaagatttatagactcatctcattttcatagactttttttttttttttttttttttttgagatggagtttcactcttgttgcccaggctggaaggcaatggtgcgatctcggctcactaaaacctctgcctcccaggttcaagcgattctcctgtctcagcctcccaagtagctgggattacaggcatgcgccatcacacccggctaatttttgtatttttagtagagacaggtttctctatgttggtcaggctggtctcgaattcccgacctcaggtgatctgcctgccttggcctcccaaagtgttgggattacaggcgtgagccacacgcgcccggcttttgtttttatctcatactttggaaatatgtactcccaaatttgaatggaagtgatatgtagaatgtattgtgtttattttattttattttattattatttttgagacagagtctcgctcttgtcgtccaggctggagtgcagtggtgcaatctcagctcactgcaacctccgcctcccgggttcaagcaattctcctgcctcagcctcctgagtagctgggattacaggcgcctgctaccacacccagctaatttttgtatttttagtagagacggggttttaccatgttgggtaagctggtcttgaactcctgacctcaggtgatctgcccacctcagcctcccaaaatgttgggattacaggtgtgagccaccccgcccagccatattgtgttttagactgtgctttctgatgttcagataagagtcaatgaaaataaaattactcttggtatttaaatactcgtgctagctttagcagcaacagttgtcagtgggaagtacaggttacaacagagctagcttccagcagtctgtcggggaggccaccgtgccttgacttctgctttgcgtggaatgatacgtgatgggtgtgcaacctgttctactgaaaatggaaaatgttaccctccttctggttcagaactgattcatgtaaaggtatgatagttactcattttcagaacttcttcccaaatgctaccaggaatctcttttttggtcctaggctggggaaggctctgaaggtaggaagggagagcaggtaaccgtcataaccaacacttcacttgagctcctgtttctgtttctctgtagtaaaatgttattctatcaagcagccaatcttcataaggagccttttttttttttttttttaagagaccgtctcagccgggtgcagttgctcacacctgtaatcctagcactttgggaggctgaggcaggtggattacctgaggtcaggagttcaaggtcagcctggccaacatggcaaaaccctgtctctactaaaaaatacaaaaattagccaggcgtggtggcgcatgcctgtaatcccagctacttgggaggctgaggcaggagaagtgcttgaacccgggaggtggaggttgcagtgagctgatattgtgccactgcactccagcctgggagacagagcaagactccctctcaaaaaaaaaaaaaaaaaaaaaaaagagacagggtctcactctgtcacccaggctggagtgcagtggtgtgatcacagctcactgcagccttgaccttcccagctcaagtgatcctcccacctcagcctcccaagtagctgggactacaggcatgggtcaccatgcctggctacgttttctgtttgtttgttatttttattttttgtaatgatggtgtttcgccatgttgcccaggctggtcttgaattcctggcttcaagtgatctgcccacctccacctctcaatgtgctgggattacaggcatgaaccactgtgctcagccaggagccattttttaaattgtatattttaaagctttgccttaaaatttcaagcacacaaaagtagaaaagagtttaatgaatcccatgtacccatcactcagcaatcatcagcagtctgccatgctacccttcttcatctattctgccctaggtttttgtgggcaatagtctggagtatattttataaaatcctgacatcatttcacctgtacattcttcagtacacatctgtatcagataagaatttttaaaaatagtcaccataccattattcatattcaacaaaatttacagtgatttcttaaaaatcacccaatgcctattgcatgttcagttttcttcatttgtctcaaatgtctttttacagctcgtttgattcattcatgatacaaagtctatacaatgtatttgattgatccatctcctttaacctataaccactccctcttccttttattttcattctacagtatttatttgatgaggaaactgggctgtcacatactgttccctcattctggagttggatagttccattcttgtggtgtttcacatgtttctgggagtcaggaacttgattagtttcaggttcaattctctggagagccataacgctttctagatagtgccgtgatatcctattgtatcacatcgtggggtacatgttcggttgtcccacttttagtgatattaagatgataaagtccccgatcagctttttaaactgaaatttttcttgagataattatagattgacatgcaactgtaagaaataatacaaagagatggccgggtgcggtggctcatgcctgtaatcccagcactttggaaggctgaggcctgcggagaggtcaggaatttgacaccagcctggtcaacatgatgaccttgtcttactaaaaatacaaaaattagccccgcatggtggtgcatgcttatagtcccagctacttgggagactgaggcaggagaatcacttgaatccaggaggcggaggttgcggtgagccgagatcgcgccattgcattccagcatgggtgacagagtgagactgtttaaaaaaaaaaaaaaagttcctttttgtcccaagtagtgttccatagtgtgtgtgtaccagaatctaactattcacctgttgaaggacatctgggctgattgtagttttgggctgttacaaataaagctgctatgaacattcgtgtacaggtttttgtgtgaacataagttctcatttctctggaataaatgtccaagagtataattgcaatcgctggatcaagtggtaactgattttttttttttttttttggaggcagtgtttcattcttgttgcccaggctggagtgcaatcgtgcgatcttggctcactgcaacgtccacctcctgggttcaagcgattctcctgcctcagcctccagagtagctgggattacaggcatgcaccaccacgcccggctaattttgtctttttagtagagacgaggtttctccatgttggtcaggctggtctcgaactcccgacctcaggtgatccgcccaccttggcctcccaaagtgctggtattacaagcgtgagccaccgcacccggcctgatgtttggttttataagaaactaccaaactgttttccagagtgactgtatcattttacattcccagcagcaatgtctgagtgatccagtttctcctcatttttgccagcatttggtattgtcacttttttttttttttttttttttttttttttgagatggagtcttgctctgtcactcaggctgaagtgcagtggcacaatctcggctcactgcaacctctgcctcccaggttcaagcgattctcctgcctcagcctcctgagaagctgggattacaggcgcatgccaccatgccaggctaatctttgtatttttagtagagacagggtttcaccatgttggtcaggctgatctcgaactcctgacctcgtgatctacccccctcggcctcccaaagtgcggggattacaggcgtgagctactgtgcccagccattgtcacttattttggccattctaataagtgtatagtgatacctcattgtgattttaaattgcatttccctggtggctagtgatgaacatcttttcatgtgcttatttgcaatctgtctatcctctttggtgaagtatttcgtttatgtcttttgttcattttttaatttgatttttttttctattgagttttaggtactactagtcttctgtcaagcgtgtggtttacagatattttctcccagtctgcagcttgacctttcatcctcttcacagtctttcaagagcaaaactttttactctttttttttttttgagacggagtctcgctctgtcacccagacctagactggagtgtagtggcacaatctcggctcactgcaacctccacctcccgggtttgagtgattctcctgcctcagtcttacaagtagcttggactacaggtgtgtaccaccatgtccagcaatttttttttttctatttttgtagagatgggggtttgccatgttggccagactggtcttgaattcctgacctcaagtgatccgcccacctcggcttcccaaagtgctgggattacaggagtgagccaccacacccagccaaaactttttaatttcaatgacgtccattttatcaccagtttctttatggatcatgcttggtatcaagcctaagaactgtttgcctaaccctagatcccacagattttctcctgtgttttttttttcagtaaaagtttcataattttacatttaggtttatgatgtattttgagttagttttgtataaggtgtgaagtttaggtgtagagttgttttttttttgtttttgtttttgtttttgcctatggatgcctactagttccggcgccatttgttgagaaggctatccttcctccattgaattgccttggcacctttgtcaataatcagttgagaatatttgcttgggtctgactgtgagttcttcccccattagcttttcacctaataggtttagcagccattgataatttcttttcttttttcttttttttttttttttgagatggagtctagctctgtcgcccaggctggagtgcagtggcgtgatctcggctcgctgcagcctctgcctcccaggttcaagcagttttcctgcctccgcctcctgagtagctggtattacaggtgtccaccaccatgcccgggtaatttttgtatttttagtagagatggagtttcaccatgttggccaggctgttctcgaactcctgacctcaagtgatccacccgcttaggccttccaaagtgctgagattacaggtgtgagccaccatgcccgcctgatgatcattttttattataggttacaaaatggtagtagtccattccttcatttattagctggaatgcttctctaaaagacattttcctcatcatctctttggttgctctaagtacaatttatacaggagaatacaggataaatgtttgctttcttcctttcatatttacctgtttgcagaataatgacatggttccttccatcctccaaaggtgaccaataatagtttgtaagtatcattatgaactaatgaattttcaacatatttgatatatttcaatccattgccatcattgttcttatcgatatttgagttggctcactttgccagtaagagtctattcaaattggcttctgagtccatttgacacaacacctttgatctttgacagtttccttggttttaggtgctagatgatttctcaggctcaccttagacatttcctgccacagacttagaatcagccatttctctaaggaccctgattccatttcatgagaaatgatagagaccacaatcaaaacaagtcatgaatttatactgatattttcaattcaaattaaagatgaggtttttgctaaatttttttgagtttatatttgtatgtcttatgctgaaaaatcttgtttcctaattagtaacataattattcatttgatgggtaaatattttagggccgattctttggttttatagccaagataccctgttgataaagtcttgtgggagcaattataagactggcttattttgaagctttttaaaaaagacatccttacctgttttaactgtagattatattaacttaaataggtacagcccacgcttgatggaaaaaattctccaaatggctgaaggtattgatattggggagatgccttcatatgatctggtgctgtccaaaccttccaaaggtcaaaaacgccacctctcaacatgtgatggtgagtatacttgtttctgaaaggtgggatttgaagaaacaacatggctttaaaaaaatgatatgagtgtggtataagatttcaaataacattggtaacattagttcttacgggtaaaagagttttagcttttaattatatacaattttttgaggatgctaaatagaattgaaaactaagaatattgaaatcatgttattatgcagtccttgaaatttatgtcatggaaccgccctctaaataaaatcttatactgtgatcacttgagcatctaagtcactaaatcctcttggatgggtccaggatggacgagctttctactgagcagtgttacagggaggaagctctagtgtctagtatagcttcatcagagttcttccatagctttaaatttggcatctcacataaatcattagtttccagctgttgtttgttctagaaagaaaatagagcaaacacccttttgtgatgaatgggtcagagctgaggttttgaagttgaaaactttctgaatcttttgataattctttttctttgatttttagtcacaactatgtaaagcaccatcacagagtcactcacctctgatacaaaagagaaaggctttgtaactgcctctgctcattatctgtcttgcattagagccatctgttccattttcaatccttaagtgagcttttcagcatgggtggtatgagattgtactggaacaatcttccagtccacttcaccttccagcacaagtgaagagtatacttcacctgtgctttagctcatttgatgcaaaagcagctaccagtcatgtgtggtggtgacctgtatacttgacttaatggtatattttctatcaagggtcttcccttacatgtggaaagacagggagcatccctccttatgctggaatcttacattgataattgagtctcttcacccaaatggcgtgaagtttttgtgatggaagtatctcgtaccaacaatgcagcttgcaaataatatggttggtactattttcctgcttggttcttttgaaatattcccattttaatgaattgtaaatttcactcattctataggtcaaaatcctcctaaaaagcaagccggttccaaattccatgcgagacctcgttttgagcctgtacattttgtagctagtagttcaaaagatgaaagacaggaagatccttatggccctcaaacaaaagaggtaaatgaacaaacacattttgccagcatgccaagagacatctaccaagattatactcaagactctttcagtatacaagatgggaattctcagtattgtgattcatcaggattcattctcacaaaagaccagcctgtaacagccaacatgtattttgacagtgggaaccctgccccaagcaccacatcacagcaggcaaactctcagtcaactcctgagccttcaccatcacagacatttcccgagtctgtggtagccgagaagcagtattttattgaaaaattaacggcgacaatctggaagaacctttctaatccagaaatgacttctggatctgataaaattaattatacatatatgttaactcgttgtattcaggcgtgtaagacaaatcctgagtatatatatgctcctttaaaggaaattcctcctgccgacatccccaaaaataaaaaacttctaactgatggctatgcttgtgaagttagatgccaaaatatctacttaactacaggttatgctggcagcaagaatgggtccagggatcgagctacagagctagctgtaaaactcttgcagaaacgtattgaagttagagttgtccggcggaaattcaagcatacatttggagaggacctcgtggtgtgtcagattggcatgtcctcctatgaatttcctccagctctgaagccaccagaagacctggtggtgctgggtaaagatgcttccgggcagccaatttttaatgcttctgccaaacactggaccaattttgtcattacagaaaatgcaaatgatgcaattggtatccttaacaattctgcctcattcaacaagatgtcaattgaatacaaatatgagatgatgccaaatcgcacatggcgttgtcgagtgtttttacaagatcactgcttagctgaaggttatggaaccaagaaaacaagtaaacatgcagctgccgacgaggctttgaaaattcttcaaaaaacacagcccacttatccatctgtcaaaagttcacaatgccatacaggctcttcacccagaggatctggaaagaagaaagatataaaggatcttgtagtttatgagaattcttcaaatcccgtgtgcacgctgaacgacacagctcagtttaaccgaatgacagttgagtatgtctatgaaaggatgacaggcctccgctggaaatgcaaagtgattctagagagtgaagtaattgcagaagcagttggggtgaagaaaactgtcaaatatgaagctgctggggaagctgtgaaaaccctcaaaaagacccagccaactgtcattaacaacttgaagaaaggagctgttgaagatgtgatttcaagaaatgaaattcagggccgctcagcagaggaggcttacaaacagcaaatcaaagaagataatattggaaatcagctgctgagaaagatgggttggactggtggtggtttaggtaaatctggtgagggcatacgggagcctatctcagtgaaagagcagcataagcgggaagggcttggtctggatgtagagagggtgaataaaattgccaagagagatattgaacagatcatcagaaactacgcccgctccgagagccacacagatttgactttctctagagagctgactaatgatgaacggaagcaaatacatcagattgcccagaagtatggtcttaagagtaagtctcatggggtgggccatgataggtacctagtggtaggtagaaaaagacggaaggaagacctactagatcagctcaaacaggaaggccaagtgggccattacgagcttgttatgcctcaagcaaattgagatcttactaatttattttgtaaatgcctaatgaggcagatttttgaattaaagaaatgctacatgttccggttgcagagtatattcataagatgtctcaccttgttcatttcacatagtggtttattagatattggaacctaaagaattctgtccacttgtattagcttaatccagcagatgatattgtgcagttactgtttgtgtctttgatattgctgtgtccctcagattttagtagtttgacaagcaagaacacatatccaaatggaattttaccctgagaaattatcattttaaagggcatagcacagcaatctgcaacaatatgtaaagttgatattgactacaataaaaatccagtcttaattccagatttactgaaaatgtcagatcattttgtattaatctattttcatctttgtgtgaagccagttatagaatgtttgacaataaattgtgctgtacacgtaaatgtccttaccaactaaatgatgtaaaactttcttaaagtaattttagtgttcatttatttataacttctaccatgtgatttccagactattggaagtgatttactgtatcttgtgatatatgggttttaacaaattctagtcttcacgctgagagagcactacttgagagagcagttgaaagtttcaaaaactttggttcaatctgaagaaaggaagcttgaactgtttgttcttggtgccttgcagagagactcacagcaactctccattatagctttcacacggtttggatgtgcagcacatccaaggcaaccacagctgtggtagagcttggtaaaagactgaagatacattggtgctttgatgaaaaggtcagttggctggtccctctctcaaaaagcttattaagcctgaaaagccaactttgtaacatatttaaaactgctattttcgcttatttctggaatgtaaaaaaaaaaaatgtataaaaagaattagtgtatgcttcctgaataaaaaggagccaaagttgatcagaa

SEQ ID NO: 1160 - DNA, 220984 bp, mus musculus
ccattgctccgttttcttgtccattacgcgctatccctccgcctctccttctttcttttcttttctttttttcccttctccttttcccccctctctccccctttctccagctccgtgtcatttcctccttgcgctcgctcgctgcctgagcgtctccagccgggagagtaggcggagcagggcggtgcggggtggcgtagagctggagggcgatggtggcggagctgctgggggcggaggcaacgtagccccctcggaaaaggagcccggcggcgcctgagcccagccgaggatggagaaccggcctgggtccttccagtacgtccctgtgcagctgcaagggggggcaccctggggcttcacccttaaggggggtctggaacactgtgagccgctcacagtgtctaaggtaagaactggcggctgatgtcctaacggcgcctaactttgaatggacaagcgggtgcgaaggctgccgctggacggggccctcaggccaactttgaaacttagggctgggagcgaaagaccctctgagcggcacggaggggtcttgccaccagtccaggtgcagacatcccctaagggtggctggaacacgagctgggagcacaactggcccccggctagaaccttgcgcgcagacacactcgcgagggcgctggggcagcccttgctgccccacgtcggggcggctacttccctcagtttgggccgaaggaagtggaggctgttggggatttctccttggaggcctctgcgtccctgcgggacagtgaaggactgaagggacagtcatcgcggcttggcagctctcttggcagcgttgtcccctctatcgaccggcgggccgtccctcccaggcaggttgcagggctaggggctggtgtgggaacggagatgaggccattggtggcttttgccagccacacttcccacggccggacgcgcacacatccattcagctcttggggcgttgttgccgccggttcggctcggcctctccctccctccagagtcctgccccagcgccggcgagatttcctgcacgttgagaagtgtggaggaaacttgcgccatggagcgcagctgtgctggagctactgctgttgctgctgccgctgccgccgccgccgccgccgccgccgccactgccgccgccgccgccgccgccagggtttgtttgttttaggagtctgtgatctgctggaagccaagttgcagctgaggacaggagagaggagctctcctgagtgctccagaacccccaaagcgagcctcccccgtaggggtgagggcgaggggtaggggcagctggagctgttaccaggaagagtgacttgtgggacgactcaccttgaggtgccagattgccaagtgaacggactttacgaactttattccacttttttgttgtttctcttaaatcctcaaatccgaaaagccctcccgcttccaacccgcttaaatggcagttgaagttgtagatgtgggttcaggctggagatagaaagatgtgtcttttcagcagggagcaaatatcactttttttttgcgggggggtggggttcaacattggtcacatctcagcagagggttcagcaaacgtccaccgcaacacacacccacaataacctgtgcggcattcgccttgcattggagcctgtggttgacttccagtgtatgggatccttcaggccttggggcccacactcttagcaaccctggagtgttgccatgggtgtaccaatcagattgaggagtctgaggtatgctgaggcaacattttgaggggctggcagggacccctctgatcattagcctccccaaactagcccagatcttcatccagcaccctttcccccatacttgtcatgtactttaaccagcctgagatgcgtttgtcatccactgtcacaacccctcctgaggcagtctccctccagtgttctctggagaaagttatatgctttttttttttttttttttttttaacaaaaacactcaactcctttggtgaggggaatcctggccttcaggaatttcttctaatcaagctcctcctctccccactctttccaccaaggtcacaatgggatatgcagccctccatgatctggcagttcctccctttctttttctcctcacaccgcccacagaatttccacagtctgcctagacaacctgccttggagaggtcatttttcagctctgcccagagctgacccatcttgagaagcaccccagagagtgcttgctgctgtggtcccggattattttgtgagccagtgagagcatggcagggggtgttactaagtatggggcagccagcaatttgtggtctggctgggggattatttgagagggtagatgagggtttccttggccaagctgtagaggaagtgcttcgtgtgttgagaggcagggtgccttttaatgattccctttccactgaatgtacagttgacccctattatatgaaggctcattatgacatgcatttagatatgcaagggataaaattatttctcccattcctcccaaatagcctagttcttaacagtaaaagtcagttataactgggttggcttcaacggtatataaagggaccatagtatttttttaagcacaatgattgcctgtattgtgtttttcttgacaagacactgttttggcatatttcattaattccctcttcatttttcaaccttgattttatttccttttatgattcagaacaatacagctttctccttgaaaacagccttcttagtctgtacacactggttgggatgggtggaaggtaatagaaagataattgggttggcagattaaaaacttgggttctaatcctttttctgccactctctagttctggaatcctaggtatatcacttgccctacctgggtctaggcatccccatatctaaaatgacattcaagtgggtggtctttaaatgatactatgacaatctagtagccatgtttttgtttgtttgtttttgagacagggtctcactctgttgctcaggctggagtacagtggtgccagctcggctcactgcatcctgtgcctcccaggctcaagcaaccctcccacctcagcctcccaagtagctgggactacaggcacacgctaccatgcttggctgattttttgtatttttgtatttttgtatttcaccatgttgcccaaactggtctccaactccttcaaacaatctgcctgcctcagcctcccaaagtgctgggattacaggcgtgagccaccactcctggccaaatagctaatcttttatgctagctctggctctcttctcagaagtgttgctgcagagtgaggaaaatgaagctttgcttcatttgcatacagtgttactatttacaatgtgcttcctcatcctttatttcattactctcttgcagctacactgtgaggcagtcaggaaagattgtggagaaactgatggaaaacccgagactgatgtattcagtggcttacctatgtctatcatactgagagtcaatggcagtcctactaagagagtttctgattcttctgttagtactgtggtttgtgaaggagcacagggcaataactttcagggatgtatctagtcttattagcctcctaatgcagtgtccctttccatgccagcctgtaattccatacttggtgacggactgggttgtaggtacactctgatggagtctgggctcagagtaggaaaggactattttgatgaccccaaatcacttgtgatgatctcaggtcagggagagacagaggtaaggtgcaggaagcatggtggaaaatggcagagaacctcctttgtggaaaaaaaaccagaagcggtttgcatcagggatggtgtggcatacatgctcagagatatcttgtggcacaagtggagatatctggggagtgggggaatttgaaaaagtagtgattagtgggggaagagggtatgcagtgtgaaagtctagttcatagttgtcatgggagaccctttggaccaggaaatgatcaagttggggaaatcatcaattcctgctggttcctatgatttccctgaatatggggaattcaactgcctgatttatggacacttgtatagtaccccccgacagtcaagtggcaaagaaagagaaaattttttaatactattgctggatgcggtgtcttgcacctgtagtcccagctactcaggaggcttaggtaagaggaatccctagagcccaggaattccaggctgcagtgtaccatgattgggcaacatagtgtgaccccacctccaaaaaataaaatacgattgattatcctaaataataagggatagtttatgatgtttccctatattgtggtgtttcgagtgagatcatggtaacaagtaaaagatacatgacccataaaggaatagggcccatgacattggcattattgattcctttggttaacatgttacgctacctcattgactcagaagtactgtctggatggaatggggattctcttctaatcagatgtgtctgatgatatgtaggctcatgctaacatattttcccttttcttggctcgtttatggtagatgtttctatctggcatagtgaagcaagtggggctagttactgccctggaacaaaacagagtggggtaggggagtaacctggaggagaaagaagctttactcccatccacttgatgtgctctgatattgctatataattttacactctccagacccaagtctctatttgcagagtggggcctaggcataactgccccatctctattatcacagatgatgagacaatgaattaggcaaactctaatagtgtttgccatccttagcctaggacagtggcagggcatgctcatcaagttgttttagtctgtattccattcctagtctgaccttatttctagaagcacacagagaggcagttgagacttcaagaggatctggataaactcagatagaggttgtcttgtggctggaagtaaatttggctgtgattttgaattcttattgggtgcagaggtggtattatgtgaacaatgagagttcctgtgaaatcttttgagctgtgttacagaccagtgcctggcactcacaaagggaccttcgtggggtgtgcatctttggagcttagtccagcctggttacctacatgaatcccctcctcatttctgcctctagaatcaccaaagatgtccactacctcagtttcccacctgctgccctatcccagaaagtagagggcattttgaggcatggattagaaatccatcagagagatacaaagaaggttggagggaggtggagcaagaagggtgggtggtatggctggtaacccttggctgagctttgagtcgatactacttttggccctgctgggttttcataatacacctggtaccccattgagagccacatgtatgcttgctgaagttaaaaaaggtcaagcctattagaggattttccctctccaaaacttcacacaaagaaaataattcaactccattgtcccttaaaaaaattaaaatgatttccccccttgccttccccaaccccctccccaggaatttctttaaagaaaaaagagagactcagacttgagattggaggttatggatgattatctggagggaacatcatggcttttatagttagacttctttagaactaagggaaaaaagatgctgacccatctgagaaaagttaatgaagaacagcagggattatgggaagggctgctctcactgcctgcccctctacccctcaagcaccaaggggcagacttaactcagtgctcccagagtaattctgttcttggtagagacctagaatcaaagaatctcagagtaaagagagccttttagaagtcacctagtctaatcttaaccatttcatgagcctcctgtgcagtgtccctgagcttgttctacagtagtcacaggggagctcattcccttctaagcctatccattctgttgctggaaagttttgactgtggacagcttttcctttgttaagctgcaatcgttttccttttagcgatcatccatgggtcctagctgtatcctctggatagcatcacacagaacaagggtgcttcctctgtcttgggacagcccttgggatatctgaaggcaaatattatatcatcttgtttcacttttctagcagagccctagctctttcagctgttccttatgggatgtagattccagcctctcctcctgtttcctcctcccactcatgatgcacttcagcttgtccatgttcctcttaagttatggatcccacagctgaatactgtaactgaggagaatctgaccacagttgagtatgaacattctttaaaaaaatacagctgaagatcactttggctctttctggcggccatgtcataccaaggccctgtgtcaaaatcttttaatggaagtagctgtgctgctattaagccatacctgcctaaggcctctatgaaggcatctgggacagccacataatagatttgggagggacacatttcatctcctactatttatttagaattgcctctgcccctagccctggccagccttggtaaatgcatcgtaggggagatgagagagaagatataagccctgacttcaaggaacatgtatgtttaaacaaagagattattaagttacagagaaggaatttgtataatagaagaaggaaatggcatttaatgaatagtgtcaaagtcagaattccagatcttttttatttcctttttacctctctgaacttaattttttccccttctggaaagaatagttgtctccaagattgaagatgctaaccatatgtgccatacactcttcaatttacagagcccctatgtaggaatatagagacagcagtctctgtccctatccactgtcagatatatatttccctgcatacctccactgacactgattggaaaagcccctgctgttgctgccatccttcagctctgggttcttctgtctgtacctggaatacacacaagagtgactcctgctggaggtcttgcatccacagcctctttctccccatctccccacatttaccagttgtcatctgagctggaaaaatatctttcgttactactaaagcctcgatcagggagtggattggagtggggcttaatctatattattactgaagggtaaggggtctgaggaagagagtgtagaggtctaggaaacgtgtcttcactgacacaatgttatttataatggttacattcagaacagttctggagaagcctatttaatccatagtgtatcattgattaaattacacaacctaaccatcatttataatgtcctatctacaggaaacagaattcaaagctccaagctgcttatttatagaagatattcttgggaaacaatgcattcataagttaggaacaaaaagtgctctagatagctctgttacacagttctgggggagtttgggattctgctaccattagtgcccaaggtgttcatacctttgatgctgggaccagatgtgtgtgcatggttacatttccctctgaaacggaattccaggtttccctgagagttatcttgtaatcagcaagtaacgtttttatattggttatgtcggtatcaagatcactttcactcagcttccatggagccaaaattttgtctcctggtgctccctgagatatactcccttcacacataattcaataaaatcattaatgaataagttgagttactattttttatggctaaagattgggttccaaggactgggaaggggtagaggtttgtctccttatacctctttgccctatccagtgtaaataggccaagtggaaaaattgtcttacgcattagtgttgcaacggatgatccattcttcctcacatcacactggcatgtttgcttggtcagatagccatcctggccacgcactgaagttgcaaaagtcaagatgacttgatctttcaaagtgagctctaacctctcccctttgacttcacatccacatcctcctctttcactgtgaatctatgactgtaccatatcgcaacacaagtactgcctagtagcaacagagacacattttccatgcatctaggctgtccttctttcatgtcaagtctttagttcccatcccccacccaagagcaccagttgcttgaggcctacattttggaccgtctcattcaagtgccattgcccctttgttcattcattgactgccctgccctctgtccaaaacccaacttttttttcttttttggtcacagtgagcccttctagtctgctgtaccagctttgtccctcttggctcagccatgcttccagtggtggcggggaggggtggtgggtagggaggagggagagagaagctcacagagttgaggttgataggtttgaaaacaatcagcaaatcataacagaatcagagggaaatttcctcacactgcatctctctctatcctgtttcagtgatggacagaatctctgttcttatattcttttatcaacttgctgaataatcatggcatgctactttggctctccacaccctcctgtttcttctcataccctccatgggacaagttcttgctttactgaagggttgctaaggacccttacttggtctaggctgtggaagtgtgaaggctgactgacagcaggcagctcttggagtgcattgcttttctccacactcctacttcctatctttctagaagtggctgtttcctggtatgttctcagggaggacatggtctgttaactttcactcaactcttttaatgttacatctgtgaggaatgcgggaggtgggactaatttgacaggatcaagggttaagcccagttacgaacagcccctttgtggtgtcttctgtcccccaccctaatgccactcaacagtttcctagctgtatgatcttctctcttttttcctgagcctctggcagggaagttttcaatggttctcctatactgcctttcacggtccataagaaactgatttttcgtttcggggagggggttggaggtgagatgaggtagagctagaagtaaagctggtttgactagttattctggaaaggagttagagtcttatggctgtagccccatctttacttatgagaggatgacaagctaaagccttgtctttgttgggctgccttgctgttttccatttctttttgtttgtgtttgatataagtaaaagccaccctgaaaaattctacaggtaggcagctttggatggcatcttactctgactgagagtgtgagtgatgacatcttgaagcttcagggggtaagtatcaggcttgactctcacattctgtagaggatttgacaagagtttggagctctgtattaacttaaattggcgatcaggaaggatcaagacaacaagcaaaagtagaccaggcaaggatttggatacttcagttgtgtggctgtgcctcattgagttcagtaacctcttgaacccaaaggtggtcaaagcctagacatggtgggatcggagaggtagtggaccgctgtatagcaaatactgctattttctaggtgttttacatgtattttcatttaacttttacagtaactctttgaggccagatattaatgtctccattgtgcagatgaagaaccgagactcaggagaagttaagtgaaagactctaagtcatatagtaagtgggacaactgacattcaaatttacttctgtccaacttcaaatcccatgctctttctaaaatagtgtgtttacacaggtgaaagacagagaaatagaagagaactagataagaatgagaggttgggggacagacggagggagggaaatgagggaaatgaaatttgatgcagaaactgataatattatgagtatctattcctcagaggtcagggtcaaaggaaggtctttgttttgttttaaatctcaaatcaaggtaaggggactgggtcggtattcagaaagcctaaagtttagtcccaactctgccactcttcatttgtgtgaccctgggaagtcattttcatctctctatctcaattgccctatttgcaaaatgagagtaatacaacctgcgctgttgtccagtagggagagagattcattttatcatttatttcatattattattagcagtatatgtgatgtaagaaagcaagcaagcgcattccacaggtgtcccttattaaacaggaattctcttaagaaaattttgagcctaaaaattgaagtgtatgaagttacctaatcattgggaattatgtgaaatggcagggcagctttcgtgtaatgtctgctactgcaaaaagttggaagaccagccatgatttctgctaatgtctgaacagccagcactttgaaaggctaacatcttaagagctctcagttaggcctccaatcaatcaatcaatcaatcaatcaactgatcaactaaccaaccaaccagtcaacacagatttgttgagcactttgtaaagtgcctaaccctaaactagagaatacaagagttagccaccatagaagacctggtttctggattctcaaaagagatgacagttttgttgaagagctgcattactataagcccaggaaacaaaaagctttaagtactgaaactgtggggtaggatctaagagcaacatttattcagtgggaagagatttcattgtgggctgatgtagctgggtgttttgtgaaaaaaggaagaattggagctaggccttgagggataatacaggatttaggtaggtaggcctgggaggaagaaggacgttgattccagttactacaagcactgcatgtcctaaagacacagacagaagactgagaccagtttgttcactccacagtgtgttgactaacagcataagggcagagcatgtagtgtttgttcatttatccacttattaattcattcattaaattttattgagtgcctgttctaggagctgagctattcttcctatggccaatgaaaccagcacagagctccatagatgtcacttttatttgttttctaacaaatactttatagtgcatattctgggcactagttttctaacttaacacatattagctcttttattttattttttgagacggagtctctctctgttgccaggctggagtgcagtggcgtgatctcggctcactgcaacctccgcctcccgggttcaagcgattctcctacctcagcctcccgagtagctgggactacaggcgtgtgccaccacacctggctaatttttgtatttttagtagagatggggtttcaccatgttagctaatttattaactccattttacacatgaggaaattgaagaaagattaggtgacttgcccaatgtcatattgcttgtgtggatggctacataagtgagtcagtggagatcttcttgattcttgcagactagtgggatataaaggtgaatggatttgagccaggtattctggataccccagaaaactgggctatagaatggatgcaagttggaagtaggtagccattttgtggtttggataatcagtgtattaagaataaggcacctagtctatggtcataccaccctgaacctgtccgatctcatctgatctcaagaataaagcacctagcacagtaccagtcacataattgcttccatgaggaaagacctgaactgaacaatagataggtaaggtcattttgaaggaatcagcccatcttggcaatttgctgacttgtcatacattagtgagttgccagaagttagtgataatgcataccattgaagaaatgaagaagaggtaggagtcagggattaatctaatatgtaaaatctagaaggctctgagagattatgggaattgggaagaccaaccaggtttagttcagttttggatcttctgagactgaagtgtctgtaggccaatcaaaaagtccctaggcagttggggagcatgtttatttaaagccactgatcagttaaaacaacaaagcattattttaggaacataatgatcaacacagacaatttactaatctactggttgttgtggaaacgagttaattgccagacaatcttatgccccaaagatagtagaacagacctgcattgttatttaatgggctttcctggccatagctttgtcttgctatctcctccaatctgtgggatgctttgtcaactgaggtgttactggctaaagttcattttgtataacttagaacttgaagtgataggaatcacttcttggaatgcctttccgttgccacttttgtgcaacatcacccgattttctacatggtgaagaactgaaaatccgaatgttgtaaagatgcttatgccatgcaacctggtctaaattaactccttccctaccttcttgtagactaaagtcacttcttgctaaaaggctaatgaccacatgggttcctttacctagctcctctctctaacaacatgaaatagcttgtaatttatatttgaaattgatttgaatctgtagctgctggggagatttttgtgtaaaagattgcccaagtgctctgatttttacaagcgcctgcttgctaacttccctctgttgcgtgagccctggtgggaggctgatactctccttttctggaggtaaggggctcaagatgtaatttgcgtgtttttcccatgcctttggctgaagaaaagtgcagtgttctgaaacctgcccagaccttgcacatactgtatctgcttaaagagggttttggctcttagcccttctcagctgcattagggttcaggttacatccctctccccatctagccactaataaaagccaaaataattaaggatcagggagagttaattcccactgctaagacccaggtggggcccttccatctcccatcccctagcttggagccctaatttaaggctgaactttagtctaagtctataagtgacagtgatctggaacaggccccagaaaagcacttgacaatcaggttttgccccatgctggcagtacgtgttctctctctctctctctctctctctctctcctctttctctctctctccttccctccctccttctccctctccccttccctcctttccctaccacgttggcatcttagaggagaccagtgaccccagggatcaagccaactgattctgttgcagcaatggaaataatgtatcatacttccctttcatctaaactgggagattcagatgaagcttctgttttttttcaagcccttgacccaacttcagtacaacattaggagcctcattcagaataagaaacatcattgatatatctctcaactcaaaagagttgcatagtaatgagctcttagtgagctcagatgggaaagggcagctttgaaggaggatcttgcaagagctgggacaggcaggaagaagcctcattctggaacaactacactactgtagtggcctcctcaatggtttctttccctttgatcatcccctcctccctcccttaaaattatttaatggttccctgctgcctgtagaatagagcccaaactacttttgcctggtattacagaccattctccatctggctccagtcttagcaatccttccaggccccaggttttcaggcagaacggttacctctctgttccccaaacccacctgggaaattctggcctccgattttctcaccatgatgttctttccagtggctagacttcacactgcatccttggaaggacttctcacttctctggccctctccataggacctaaccttcaagccctacctctaagcctctagggcatcatctttgattgctcctggtggaagcaatcagaacctcccctctgaaatgccggagttctgattttccagtagctgtctttgggtactttggctgtcttgtgtttggtttgctggatcaagatcttctagacgacaatggctgtatcttctatatattttccatagtcagcacagagtagactctccatcatggtttgctggtttagataatatgtaagaagagtcaagcaaaaattttttactccgtgattggtaatctttcccctttccacttccaagcctaaattagagaatatgactagatgatctggatatactggccaagtttcccaaactttgtgtgacaccccacctaagtggggtgagccttgaatgacacacacatgggaactagaggcagagggaacacttagaagaaaataatgttggggacagaagttgagaaggatcccagaggcaacccaggatgagaaggagcagtagaggatggggttggctacctgcttgtccccaggctgcctgaagtttggtttataacagttgaatttcatgctgctgctggagttcctgtgtgtaagctgtgttccgaggtttgcatgtgggagaggccggctggctgatgattgcagcatttcctatggtgttgggacgcgttgctgtgagactcttaaaacaacagccatcccacttgttgctatgtgtttaaggtgggtgtagtgtgtgtcttcagtgaaactcaagtgtttcactgctttagctgagaggcagtagctttgggtgaacacactctgtgtgtgtatgtgtgaatgtatatgcatgtgttttcactttttcttaagcaagctctgacatgttgtgtctgactggccttggatgtgagtcactgtctggtatttatacccagtgtcttaagtgtccttattatttgaccatgatattgctattctccctattttactcaaagctgagaatgctgagaagggccaaagggaactcactctgtcttccttccaaatggggtctaatctcattggtggttaactgtctctgtggcagtcaattaggttatgtaagggcactaaagggaacaggttgaaattcacagtagtagtactgtgacagtttaaaagacacactatagggcttctcttagtttgttcctgtccaggatactgttggagagttcacccactggaatgactttaggaacaggcctcgaaagggccttagcacaatcacaataagtatgaaaggagtacaaacaaactgagaaagccttagagaggagatgatccagcctttgcaggcattggtgagagaagcagagaatgttagcttcctccttactgttgtttgtattaagtccttccaagattgaaaattttgtcttagaagcaggctcatagagtgtgggaatggtaaaccccatcagaggcactgttgttatcaaagggacagagcctcagataggaaggacatggctgctagcatggtcatttggaggccaggcagccagtaaatcatttgagaatgagttaaaggttcaaagggcaggagggaattctttgggtgacctcataggtgcttgaaaaatcaaagggatagctcgtgtgcttttatgttttcaggcctggttcggagggtcaagggaatggaaatgcacagtagaaaattggcattgctgtttttatgtgcttgggaaccctaactccgggctggtgatcgtcagagttaccattaattagatgcatattttgttctgggaattttatatgcatactctctaatcttctcatctctacttactgtaaattaagtagtagtattcctattttacagatgaaaataatgaggttcagaggggcaaagtaatgttctccaagtaaccaagccagtaagtggtagagctgtgatttgaactcaactctacctgaccccaaatcctatgcttgtcctactataccttaaaattttacttcagccccaaagcccctttctgtgtttcatattgtctttttaataccactgttaactatgatgactatattctgtgtttcatagcattggaaaacgtgggtttcacagatcagtcagtttacaactttgctgggaagcttgttaaaaaacacagattagactctgaggatgaaataatataatgcacgaagaggtacttagtagtgtccctattccaagatgcagaaattgaggctaagagggaagtaactttccagaattcattggaccagtaactggcagggctggtattcaaaatccagtttatctgattttagagtgcctgttctttcccatgctcttgttgcctcccaaactagaaggggagtaagcaataaacaaaaaaccagacttgaccctctcggcccctacaaacctacccttcttactgccctctctgtcaataaattttttttaagtgaggggtggcctccctctctccctctcccctccttccttctcttctagcacaatttatttatttaaatgtttattttggggatagatgataaatgttcatggaacaaaatttttaaaactatataaatgggtacatctttcttcattcatgtccctaaaccacctaatttcccttcccagtggcaatcactgttaccaattccttgtgtactcttccaaagacacccttccaaagatacattatatgtaggcatgttgtatatgctcatatacgtgcatgctcagtgtctctgtttcctcactgcctgtcttcctgaatcctctccaatctggcttccaatgaggtcttcctgagggccaaatatactggccttctcactgttttcatcatccttgttttctctatacaattattgtttttcaataatttgttgaataggtaatgtagttatgtggtttaaaaggtagttagtatgaaaaggcggagaatagtttcccagtcatccttgtctctcatctgtccagtttcaccactacctcccactgtgcttagatatttctgtgtgtcttttcagagcctctctatacatacacaagcaaatgtcaatatagattctttattttgccttttatacaaaaggtagcatactaaaacaatcttttgcacttcgcttttttcacttacatatcctagagatctttccctatcaagcatacagaaggttatctctattttttaacagccacattgtatttaattatttaaacagttcttagtattgctagtcattggcattgtttccaaaccattcagactcgaccttctccaaactctgctgccagtatagctcctgtaatactgaactctcctgtttctgcatcttctcttgctgtttctccattctcctctgtaaatcgactgcctctcttatctctatcctgtggatattcctcaaggctcagcactcagtccctccccccgcactcttttctctgtttcttctttccctattctccctccccccatcctttccccctctcctcttttcctcaagaaagcaacgatgagatctcataactcctgaatctctagtcttaatcttttccactgtctgatagtattcactggaatatttcttttttacctcataccccagtatgtctaaaatggaacttatcttccccttgtaaaatgggctctttccttggcttccccactcagctagcattaaaatcatggagtcattgcttactcatcccatatcccacattctgtcagtcttgcttcctttacaatagccctcatatccacctgcttcttttcaattcctgctactcctaccctcttccaagctcttattactttatgtctggtttctggattcctggctggcttccctgcttctaagatcactcctgttaaatttatcttataagacacttcttctatccaagaattttagtttccctttctatacaatgaggaagctggactgactggttcatctcagaggtgggttaaaatcctagccctaccattccttccacctccgacattctagaccagaactccatcctttccacctctaacattctagaccagaaatcttcccagtgtctccccacctcccaccatttccactctctgtactgttctctttcacttgaattgttgctatggctccatgctcccagcagtgccttgaaaaaatctttcttccatattggtcctagagtctttatcctaaattaacttacagttgaaaggaatcttagaggcaggccatccaagctgaccaacactaacctgctgcctgagtgccattaataacacccttgaatttggttggtcagactgttcttttgaatgcttccattgatggagaacattatctcataagccagccctttgtattgtcagatagcaagagttgttctatatctcctaccacaaactgacaccaactgatctgcctttatgatactctattattaaaaacttgcttcatcttgatttaagttcaaacccctcaggtctggcatccgaagttctccagaaatatggctcctatcttcccctgtaggctgaaatcatggatacttcctttgcacttcatccacattttaaaaaatagctaatatttattcagcacttattggatgccactgttctaagtgattttacatgtattatttaatccacatggcaactatatatgtttctattattcttccccattttatagagaaagaaaatgaggcatatggaaatccaaatggtttacccagagtctcacagttagtaaatggtagagctaggattttaacccagaaaggctatctccagagcacatacccataatcactgccatacacagtcagcctcaaatgtgacaataattttctgaatatgcccagtgacttgttatcatggtttcttaaaatgcatttctagtcccagctacctgactaaatcttacctgttccttgaagcccatcagaaattacccttccttctggtcccattctaccccatcttccatctggtgctcaccatgttctttctaatgagctgggcatgcttgttttatatacttcatgggatatgctccttgagggcagggcccacagacataaactgctggattaggcttttaaccccaaatctgttccatagagcatttaacaagtagagctaggctttaggaacttctgaaagacttgagatttcttctttttgagtttgtatgaatctcctctttctaaatctggctctaaattctttctttcttaggctattaattcatttctgtttattgcccaatagttttgcacatttgttcccaggtactctcagggccagaaaacaagtgttgttatccatggttttatatatatatatatcatatatatatatatatatatcatatatatatatatatatcatatatatatatcatatatatatatcatatatatatatcatatatatatatcatatatatatatcatatatatatcatatatatatgagatatatatgatatatataaagatatatataaagatgttgttatccaacatatatcatgtatgagatatatatatatgcacacacctatatttatatatatttatagacacatacacatatatatatatatatatacacatttatacacatattcatacatatatatactgggagccaaatgaggaacaatattaaaaagaaatttcattacatcccttatctgtgatctgacttccttaatatttataacttctgatctcctctcttccttgtccttaacatgtattactatgctaggtagataaataggtaggtaggtacctcaccacacaatctagagattgtgaatctagagactgtgaattttagtgtgtgtgtgtgtgtgtgtgtatgtgtgtgtgtttgtgtgtgtcagagagagaatgatggagggtggttgggtagttggagggacagttttttgagtgcaaagcttccttgtcttctgtgctaagaaagtctctttaaaatgctgcgtcctgcagaacatccctcccccaacctcctccttctcttctatttcttctcttaatttcatagtgattgtagtttcccatgtgtattttgtaaatgagttctgtctaaaatttgccaagctctctgttcgagtgagatatgctcatctagcatgttagacaacaacatgatttactacccagacaggctaattcagcgggtaacacatcattctctgaaggatcacggtactgttaattcaatgtgtaccaatttaattatatttcagaagttaaaaaaagttaaatagctccagttgcagtgttctagttcactaagcattgactataaatcattagtggttactttacaaatttatgttgatgcactggctggtattttacataagtataagccacctacctcagggtgtctaacttggttttgtaaagtacaaaatgtgctcttgatttctctctctggccccataatatcttcatcaacccccaccccaacccatacaactttcacagggcccctttttttctcccttcacatatttcatcagactctttaaggaagtcatagactggttgtgattattactgaaccatatgggaaccacacatctttttttttccttctactttcttgtataatggttatgacttcttaaatgaattaaaaagccccaagattagtttttaactattgaaagacttaaggccaggtagccctgctttaatttcatcattcaaaaaagccaaagttagtaacccctcttttttcttttcttttagatatcacctgaaatctgttctccagaagggtgatactagttactgcaatatacattagcgtgcagcattcatgaccctttattgtttttactaaaatcttcaggattagaagggtctgggagtcattagatagtctcctcttccaaaatgggttgtgcctactagataaaatttgactaaaaagcaatgatactgatttttttctccagtctttacttttgtattttcgatgtcagaaagtatattcatatgtcttgttaaaattttacattcatctaacttactttttattgtagtgagaacatttaacatgagagctacaattttaacaggattttaagttcacaataccacactgttaaccataggcacaatgttgtacagcagatttgtagaacatcttcatcttgtattactgaaactttataccccttgaatagcaactccccatttccctctccccctggctcctggcaaccaacattctactctctgcttctgagtttggctattttaggtacgtcatataagcaaaattatgcaatatttgtccttctgtgaccagcttatttcatttagcataatgtcctccagacttatctatgttgttgcatattggaagatttcctctggaatgatatttcattgtgtcttatgccacattttctttattctttcatccatggacatttaggttgattctacatcttggttattataaacaatgctccaatgaacatggggttttaaatatgttttcaagatcctgatttcttttagatgaatacccagaaatgggaatgctggatctagtatgtagttctagtattaattttttgaggaacctccatactgttttccatagcagtggcaccattttacattcctacccatggtgtacaagtgttccagtttctccgtatccaacacttatcttttctcaaaaaaaatggccatcctaataggtgtcaggtgatatctcattgtggttttgacttgcatttccttaatgattagtgatgttgagcatcttttcatggtcctgttggctgtttatgtgtcttatttggagaaatgtttactcaagtcctttgcccatttttaactggattttgttattatgctgttgagttgtataagttccttatatgttttggatattaaccctttatcagataaatgctttgcaaatattttcttccattccataggctgccttttcttttttttttttcctgagagagagtcttgctctgtcacccagactggagtgcagtggcatgatctcagctcactgtaacctctgctgcccgggttcaagcgattctcctgcctcagcctcccaaatagctgggattacaggtgttcaccaccacacttggctaattttctttttttgtatttttagtagagatggggtttcaccatgttggccagactggtctcgaactcctgacctcgggtgatccaccagcctcggcctcccaaagtgctggaattacaggcgtgagccaccatgcccagcctaccttttcactgtgttaaaagattcgttagttgtgcagaagccttttagtttgatgttgtcccacttgtttatttttgcttttgttgcctgtgcttttagtatcatattcaagaacccatggccaagactaatgtcaagagccttttccctcacattttcttctacaagttttgcagtttcaggtcttatgtgtatgcatatggtgtaagaaagtggtttgatatccagttttcccataccattcattgaagagactatactttccccattttgtagtcttgatacccttctcaaagatcacttggtcgtatatgggtgggtttattttggggctgtctcttctgtgcccttgctctatatgtacatactgttgattactataactttgcaatatcaattgaaatcagggaatccagctttttcttttataagattgttttggctatttgaagttctttgcaattccctctgaattgtagagatttttttttcctatttctgtaaaaaatgccactagggtcccagcacttttggagattgaggcaagaggattgcttgaacctaggattccaagaccagcctggacaacatagtgagaccttgtttctacaaaaaaaaaaaaaaaaaaaaaaaaaaagtcaggcatggtagcacatgcctgtagtcccagctactcaggaggctgaggtgggaggattacttgagcctgggcaatcaaggctgcagtgagccttgatcatgctactgtactccagtctgggtaaaagagtgagaccctgtctcaaaaaaaaaatgccattaagattttgatagggattacattgattctagatcactttgggtagtatggacattttaacaataagtcttgcattcattagcatgaatgtcttatttatttgtgtctttgatttctttcatcaatgttttatagttttcagtatacaagtcttttgccttcttagttacatttattcctaagtattttattattttaggtgctatagtaaatgggattgttttcttatttttttgaggtagtacattgttagtgtatagaaacactgttgatttttgcatgttgattttgtatcctgtaactttactggatttattagttctaacagtttttttatggagtgtctaggattttctccgtataagatcatgttatctgacaacatacaagatcatgttacctggtaagtaaaaaataattttacttgtttctttcttattttgatgcctttacttattttttcttgcctaattatgctgggtaagaattccagcactatgttgaacagaagtggcaagagtgggcatttttgccttgttcctgatcttagaggaaaaactcagcttttcaccattgagtatgacattagctgtggggttttcttatatggcctttattttgttgaggtaatttcattctatttctagtttgttgagagctttttatgaaaggctgttgaatttgtcaaatgctttttttgtatctcaaaatgatcatgtgctttttatcccttattctgctaatatgttgtatcacatttattgatctgcatatgttaaaccatctttgcataccagacataaatcccacttggtcacagagtatcatccttttcctgtgccattgaattcagttttctggtattttgttgaggattttcgcatcagttttcattggggatattggcctttagttttctttttttgtagtgtccttatctgtatcaggtataatgctggcctcataaaatgagtttggaaatgttcccttctcttcaatttttgggagcgtttgagaaggattggcattaattctttttcaaatatttgataaaattcaccagtaaagtaatctgttcctgggtttttctttattgggagatttttaatttactaattcagtctccttactagttacaggtctgttcagatttttttctatttctttgtgacagtcttggtcagtcatatgtttctaaaaatttatccatttcttctaagttttccagtttgttggcatatacagtcatgcatctcataatgatgtttcaatcaatgacagaccacttatgtgacagtggtcccataagattgtaataccatatttttactatactttttctatgtttagctatatttagattcacaaatgcttaccattgtggtataattgcataaaatattcaatacagtaagatactgtataggtttgtagactaggagcaataggctctatcatatagcctaggtgtaataggctataccatctaggtttgtgtaagtacactctgtgatgtcacacagtgatgaaatcaccttatgacacatttttcagaacataatcctgtcgttaggtgatgcatgattgtaattgtggtatcagttgtaatgtcttctctttcattgatgatttaatttatttgtatctttctctttttccttggcctagccaaaggtttgtcaattttgttgatcttttcaaaaaattaacacttcattttgttgatcttttctattatttttctattctgtattgtttatttatgttctaatctttattatttctttccttcaagtaactttgggattagctttttttccttatttttctagtttcttgaggtgtaaagttgggttatttgagatttttcttttttaatgtaggcatttgtcactataattttcctcttggtactgattttgctgcattccatcggttttgtacattctattttgtttttcatttatctcaaaatattttctaatttcccttttgatttttttgtttcacccattggttatttaggagtgtattgtttaatttccacatatttttgaatttgccagttttttttctgatattgatttctagtttcattccattgtggtcagaaaatatacatggtatgatttcaatcttcttcagtttgttttgtgacctagcatgtgatctattctggagaatgttctgtgtgtacttgaaaagaatgtatattttgttgctttgggtggaatgttctatgtttctgttaggtccatttgatctatagtgttgttcaagttcactgtttccttttgatcatctgtctggatgttccatccactattgaaagtagaatattgaagtctcctactattatagtattgctatctatttctccctttagttctgtcaatgtttgctttatatatttcggtggtttaatgttgtgtacatatatattcacaattcttatatcatcctgtgaattggccttttttcattgcacattgtcctttgtctcttgtgacagtttttggcctattttgtctgatataagtgtagccaccttgctgttttttggttagcatttgtatggaatgtctttgtccattcctttactttcagcctgtgtgtccttaaaacttaagtgaatctcttatagacagcatatagttggatcttgttttttgatccattcactcactctatatctctcaatttgggagtcaacccatttatatttaaagtagttattaatagagaagaacttagtattgccaattttgcttattattttctgtcttataattttttttttttttttttgagacggagtctcgctttgtcacccaagctggagtgcagtggctcgacctcggctcactgcaagctccgcctcccgggttcatgccattctcctgcctcagcctctccgagtagctggggctacaggcgcccgccaccacgcccggctaattttttgtattttttagtagagacggggtttcaccgtggtctcgtctgtcttataattcttttttcttgttttgtaatgtcttcttttgtgttttgatttctgtattgagtgatttctctttttcttttgtgtatattttcaataggtatgttctttgtagttagaagagtttacattaaaatatcttatagttattgtaggctattttaagctgattaacaacctaacttcgatcacatacaaaaactacagtttccccttcacacactttatgctattaatgtcacaatttacctatcgttttatttttatcattaacattaacatattttatatttacagtctaacacttttgccttttaaattttatactagaattaaaaatgttttacctaccactatcacagcattacatcattctgtatttgtttatatatttaactttgccagtgaatttcacacttgtctgtattttttgtattattattttatgttctttcatttcaacacaaagaactccctttaactctttatcatttcttgtaaggcaagtctggtggtgatgaactctctcgggtttttttgtttgtctgtttggtctggcaaaagcttaatctcttcatctttttgaaggatagttttgacaggtatagtattcttagttgctggtgggttttttttttttcttttagcgctttgaatatatcatcttctggtctgcaaggtttcagctgagaaatccactgatagtcttttggaggtttcttttatatgacaggttatttttcttttgctactttcaaacttctcttttcatctttgcctatggacaatttgattataatgtgtcttagtatggatttctttgagtttatcttatttgccatctattgagcctgatggatctggatgttcatttcctttcctagatttgcaaagtattttgcaactatttatttgaataagctttttggaactctttctctttttactctccttctggaacttccataatgcatatattggtctacttgatcatggcctttaagtccctttagctttcttcactctctgtaattcttttcctcctctgactgtataattaccaacgacttgtcttcaactttgctgatcctttcttttgcttgagtctcatgttgaacccctctagtgaattttttggttcagttattatattcttcagctccaagatttctgtttttttttttttcttttttgagacatggtcttgctctgttgcccaaactggtgtgcagtggcaaaatcatagctcactgttgactcaaaatcctgggctcacgtgatctcccatctcagcctcccatgtagctgggactacaggcgagtgccaccacgcaaggctaactttttaaattttttctgtagagacaaggtcttactatgttgccgaggctggtctcaaactcctagcctcaagcaatcctcctgcctcagcctcccaaagtgctgggattacaggcatgagccaccatgcccagcctgaatttttaatatatatattttatatctcttttttgaaatttttactttgttcatgtgttgttcttctgacctccttgaacatctttatgttagttttggctgtcaggtaaatcatatatctccaatttatgataccaggacatttattttgtccctttgtttgggatatatttccctgtttcttcatgtcccttggctctttgtgtgagtatctgttcattaaataaatggctacctatcccagtcttcatggcctagccttatacaggagaagaccctcatcagtcaggccagctagagatttagggggccttttaaagctttatgctattccaccctactttctttgttcttagcagggtaactgcaaggccaaaccgccatctctgatcacactggtcctgaaacagagtgtgctgggtcctgtcagtacttcaatacaaacaagacataaaccagtcctttgtgcatcccccacaaaaaaggttggagcacgggacacgtggtccaactcctttcctcaccagagagaagataggagctagggattttcatctgctggctctgtgctaagctgggaagaggggttatagcaactgctagcctaacatactgtctctcatctctggttccaaggtggctaggtgctaggtcccatcatcactctgagacaggcaaaactgaagccaatcttctggacagctcctggaaaagttggggcactggacatgtggtctaactccttcccttcctagggagaatttggaatctggtgagggggtcttcccaattgtatggctctgtacagggggaagttattatgctgacagggtctctcagatttccctgctggctttaatgtggtagtctcatcgtacaggagtctcttatgtagtttctggatttttcaaaaagggaatttgtctatattttgttgttgaatttgtttgttcatgtggttaggagagttgagggttttctattccatcttgctgatgtcactcaggatactgatttttatttgtttggaaaattagtcttattttattaatatattcactatgatattcaggcaaattgacttaattttacattttattgagatatatttgatgtacaataagatatacatggatatacatgtataaatacgtatataaattgatgagttttgaaatgtgtgtgaaactattaccataattaagataataagcatgttcatcacacccaaaagtttccttgtgcccctttgtaatccagctccacaacccccaggcaaccattgatgtgctttctatcactacagtagcttgcattttctagaattttatgccaatcgaattatacagtgtgtatttttctttgccttcttttactcagcataattatacttatatctgtctatgttgttgcatatatcagcagtttgttctttaatattgctgagtaatattcaattgcatagatatatcatagtttgtttattcattcacctggtgaacatttgcattatttctggctattatgaatagtttttcatagctattatgaatagttattcatagctattatgaataaagctgctatgaacagtcacatataagtctgtgtgaacatatactttcatttttctttgttaaatctatgaatagaatggctcatcatggttaaatctatgagtagaatggctgggtcatatggtaggtatatcattatcattttttaaagctgtcaaatcattttctcaagtgattgtaaacatcttaagtcaatactgtaggagggttccattcctccacattctcaccaacacttattatggtaagttttatttttttaatttagccagtctaatagatatgtattggaatttctttgtagttttaatgtatatttttctaatggctaatgatgttgagcatcttttcatctgtgtatttgccatatgtatatcatctttagtgaagtgtctatttaaatcttttgtacatttttattgcttgtaatactaatattgagttgtaagagttattttttattcaagatataagtcctttgttggatatgagatttgccaatattttctcccagtctgtggcttgcctttccatttcttaatagtgacttttgaaaagtaaaatgttttaattttgaattttcataaagtccagtttaatgattttttcttttataatttctgcatttgtgtcctatttaagaaatttttgccttaaccgatgtaactatgatttttcttttatattttcttctagaagttatataactttagctcttgcacttgggtttaggatccattttgggttaatgtatgttttgtgaagtaagagctaagggatttttgggttttgtttgtttttgcatatggacgtctagttattccaacactatttgttgcatatgaacatccaattgttccagcactatttgattaaaagattatccttttccaggccaggtgcattgactgacacctgtattcccagcactttgggaggctgaggcaggaggattgcttgaggccaggagtttgagactagcctatgcaacatagcaagaccccatctctacaaaaaaacaaaaacaaaaacaaaataaaaccactttttaaaaattagctgggtgtagtagtgcctacctgtagtcctgctatgcaggaggctgagatgagaggatagcttgagcttaggactttaaggctgcagtgagctagaatcacaccactacacctcagtctgggcaacagagagagaccccatctctaaacaaaacaaaacacaaagattatcctttttctacttaattgctttggtacctttgtcaaaaatcaattgaccttttacatatggatctatttttggcgacgccgttgtgtaacattaacccatatgtttatctttatgccaaaaccacactgtcttgattactgtagctttataatatgttttgaaatcaagtcgtataagtcctccaactttgttctttttaaaggtgttttggctattccttgtttgaatttttatataaagtttagaatctggccgggcacggtgtctcacacctgtaatcccagcactttgggtggctgaggcgggtggatcacctgaggtcaggagttcaagaccagactggccaacatggcaaaaccccatctctactaaaaatacaaaaattggctgtgcatggtggtacatgcctgtagtcccagctacttgggaggctgaggcaggagaatcacttgaacctgggaggtggaggttgcagtgagctgagatcacgccactgcactccaggctgggtgacagagcaagactctgtcttaaaaaaaaaaaaaaattagaatcgacttgtcaatttctatttaaaatggctgctggcattatgattgggtttgtgctgtatttatagatcagtttggaggagaattaatgcctgagcagtactgatttttctaatctaggaacaatgtatatctctccatttatttaaatcttatttggtttatctcagccatgttttgtagtttcactctaggtcatgtacatcttttgccaaatttatctctaagtactttcatatttttgatgttattagaaatggtttatattttaaaatttcaccttctgatggttgactgctactatgtagaaatatgtttgatttatatacattagttttatgtcctgcaaccttaccaatctcacttattagttctagtaaactttttctagattccttaaaattttctgcctgcctgatcatatcatctacaaataaagatgatttcacttcctttgcaatctgtatccaaacctcattttaaccagctgtacgtgacttggatgttatataacttctcattttattttattattttattagtccttattgtggtaagaacatttaatgtgagatctattcacttaacagatttttaaatgtacaatatagtattgttatttatgggcacaatgttgaacagcagaactctagaactcattcatcttgcataactgaaattttattcctgttgattagcaactccccatttccccttcttcccagcccctgacagtcaccattctattctttgcttccatgagtttgactattttagatattccatataagtagaatcatgtagtatttgtccttctgtgactgacttatttcacttagcataatttacttaagattcatccacattgttgcatattgcaagatttccttcctttttaagggtgaatactatcccattgtgtgtatcgattgtatgtatacatcactttttgttttccactcattcatctattgtaggatatttacattgttttcactatgtaacttctcttaaacctgagtttccttatcaataatatggagattgtaacagtacatactcagagggttattgtgaggattaaatgagataatgtggataatgtttctagtacaggacctggcagaattatagcccctatatgtttctcttttgggccctcctcctatttcacaaagtcaacatccataagtaatggttgtcctcctgacattaatttcctttttagtgtctctcatcagctaatttatccaaaccttaaaaaaaatggtttatatagtcaagctgttttaaaccatgggagtgatgtgctttctgtttactaattgtatacagttggacttaattttattagattttttttttttgagatgtattctcactctgtcacccaggctggagtgcagtggcgtgatctcagctcactacaacctctgcctccaagttcaagctattctcccaacttagccttccaagtagctaggattacaggcaagtgccaccacaccaggctaatttttgtatttttagtaaagatggggtttcaccatgttggccaggctggtctcgaactcctgacctcaagtgatctgcccgccttggcctcccaaagtgctgggattacaggtatgagccgctacgctcggcccattttatttgttttaaattgaccatttttaagcctttcatatgaagatctccagcttgatgctattgtccctgagatgtggtaaccagacctgtacacaatatcccaggtgagagcaaaccatgaagagggaatttaggggcaggatgaggtgagggagtgagggaagagagtattttctgtctttatttttttttctttctgtttctgatctaactagaccgataattgttttggctgaaatagcaatttgggctggtgtgttcaggaaacagtctacagtgactttcatatctctttccttgttcggagctgatagcttggagcccatattcctagagacagaatctgcatcccccccactccccatccttaaaaaaaatggcattaattatcttataattgtccctgctaagcctctgagtctgtatctggaatagctgggaggcctcttggtctcagcatatatgcgtaagtagtcagggtcagacaaaagcctccctggaagtgtcctgtggaccctttcagccttaaaacttctggttccaacatttgttttcccttcgtgagtgtaatatggagcttaacaaattatgttggatggtggttatgatgtttaattttgtgtcaacttgactgggctaagggatgcccagatagctggtaagacattatttctgggtgtgtctgtgagggtgtttctggaagagactagcatttgaatcagtagactgaataaagaagatcaccctcaccaatatgggcaatcatcatgggatctgtaggggtcccatccaaataggaaaaaaataaggcagaggaagggcaaattctctctctctcttctttagctgggcatccatcttctcctgcccttggaccattggtgcttttacttctcaggccttcagactcagactgggacttacacctttggctgtcctagttctcagtcctttggcttggactggaaccacaacactggctttccccccagcttacagagggcatatgatggaactttttagcctctataatcagtgagccaatccctcataatatctcccttcctatatttatctttatatccttttagttctgtttctctggaaaactctgattaaccaaagaccataactctgttgggagttttggattttaggttatcaagtgaaactcttatatccagctataaatacttgaaaagagatcgagtgagttagaaatgaaagatgaaatatctggatctatttggggccaaaagtttaatgtttgtctctacagtcctagtttttatcaatatgaaatcccctgaagacatagactacagggttgctactaacccatatagtgcttttgtgccaattacagaaagactgtcttttctgcaggtggattcagccctgttttgaggcatgagacttggcaggtggagcttaggttctcatttactccctcagcctcgggactttatgcactgtttacatgccatgtgatttcattaatagcacttttcatgatttccttttcagatagaactcacctttgtttctccaactccttaaatttgaattttccaattgtatcttatcactgccatcactgactcattttcagctgcagcatcctttgaggttgcaatgcaattttcctttttccctactttcttaccctttgcttggtataccatattgttgattctagatgccatgaactctgcctactacttagttggcttttaaaaattatcttattaatttaggtggctaaaatatctcatctgtatgcatagataattcagtgtctatttctcttcctttcttgtaataaatgggactgactgactcaagactcttttgcatacttttttacccaagggatttattacctaacagccacacaaagaggttctcactgatacgccaaacaccatgctgggagcttcagctgtgcctctggcccctgggcctattctctccactagatgctgccaccgcttgctatgaatttggaagaatcccaaaggccaccactccccacattccccttccaggaatgtccttccaggaagaggactattttcctagctctggccctaatcccaagcattatccccctctgacttctcttaacagcagtgtgtgttttgcagatggtgactgggtgaattcccagggcaggaaggaagaaccagagatagcaatgtccaggagaggagtgttggaggcacattgcgagactctcttcttcttcctgcatgttccagattccctgattctagcttaggaatatctgtacatacttcctgtacaggggcagtctatgtagctggggatgtagacaggtttccattaaccatttattggcctgaaatcctgatggagaaaatcccagagacccagatgattatccttggcttgctctttacaaactgttcacttcatgtttaagtcactgaatgcaatatccacagtactattttaattatttgtatcactaagcttgtgagttcttacaatgctaatccttcttttctgaaatctgggcacccaaaatagtcaaaccatcaacttttacctcattctatattacatcttcgaatcaactgtttcttttctctgttgtctataaagccctcttcttataaggaacatggactctgaaatccctcagacctgaagtcaagtcaagctgtgtaaactttgccttctgtaaaataagattaccattaatcttgctgaggagttgtgagaattcaataagagtatgcagacaccagagacttaaatttcaggcacgcagtctgtcatggaacaattctatatttatgattattagtggcctaagttttgaaatacttattataattaccttctaaaaacatttaatacctaaaacttatacagtggtaactcggccagatgctgttctaagagtttcccatctctctactcatttaactcttacaacaaccttgatgtggatattattagtatcttcatttcacggatgaggcaattgaggcacatataggccaagtaatgtgcctaaggtcatgtagctgggaagtgtcggaaagtgattcttgatctcaggctggcaagctccagattccctttattaaaaccactatgctataataaataagttttatggttacttttaaatatggtctttaaaactatttttacttgatgagcacttattgagggcatggatggtagaagttgagacaaaggaagaggaagatttaagttaatactttttaatgatcttacatctaagaaaggggatgaataaacatatgtgaaagacacaaggacagtttggaatgagtcaataaatctgtgaaaaagctgtgaacactttgctccatctgccaactttagggccttctagactagtgtttctcaaatattactgtgtatacaaatcacctagggaacactctttgattcagtaggtctgggtggagtcagagataatgtctgtctaagaaactcccaggtgagtctgatgatactggtccagagatcacacttcgagtaggaaggtgccacattgccacttaccaatagataacttgcaatgagggtctactacgtaatgcagtgctttctagttaagcaaaacatgttgaacacttttagctgattatatgggaacttgggtgataattgaagaatgtcatagaataattggctaaaaaattagtgtgatatgtgaagggtactcaagagtctgcagtagtctgagcaaaggattaacatggtcagaaagctgattcttgatacattgtggagggtggatagaggagaccagaagactggggtatgtccagctggaagactggtatggaagttcaggcaatgggagggtaaaggcctgaagtgtgatgatggcagtagaaatgggcaggaagccctggctttaagaaagattgattactacagaacaccaaaaaaatcagcacatgtaggatttcctcagcaatatagctcagaagtgactagcactctaatgtttgaaaaagaaatcacttccacatccatcatcttatttcatcaacacagaaactgtgggagattagtaattactttcacacccattttacaaatgaaagcagcaacttcaaccatttatgagaaaaagcgaacctaattgtaagagcaaaaacactgtggaaagggtcagaattattaatcttggtttttataaaattgactttttttcattaacagagtaatatattttgattataaaagtaatatatatttgagatcacactcctggtcatattgtctgtatccttccctccagttcttccacttaatttattatggttcttttcccttgtcattatgattgttttgaaaatttaattttaaattactgcataataataacccatgatatgaatgcattatagtttaatttattagctccatgtaattgcccatttaggttttcattttttgctattataaataacattgtagaaaacatctttgtatatacatcctcatttaaacatctgataatttacttaaaaacttaccaactctttaaaaagtcttcttatctatttacagccatctgatttaatgcttgataaaggatcatgtcagtctccagcttgaggtgattacctaagcatctcattgtcccagattatacagtgaactcccactgggctcccgggctcaggaagtaatgtcttggaaaattctcctgcattctagtgtcatcactgatcttgggtctcctcattctggtccatcagcaacaggtgtgactacccattggggtaaaacagtgaggggaaactaaataaatgcctagttcttgccttatcagctctttggggaaagagctgtgggattatgaaggaacaggtcaaatcaaaacactagtttatgtagcttgaaagtctatagagaggccggtgcggtggctcacacctgtaatcctagcactttgggaggccgaggcaggaggatcaattgagcccaggagtttgagacagcctgggcaatatagtaaaccccgtcactacgaaaaaattcaaaaattagccaggtgtggtggtgtgcacctgtagtctcagctgcttgggagcttggggtgggaggatggcttgagcccaggaggttgaggctgcagtgagccatgatcatgccactgcactccagtctgggtgacagagccagaccctgtctcaaaaaaaaataaaaaaaaagaaaaaaagtctttagagaatagcagatatgtaaatgatattgtggatgcttttgttttcttctttctgctaatttatatttttgtggtatctatatcaaagaggtaggaaggcagtgtagcatggatctggaggcagacagagttaaatggaaattctgtcatttattttccatgcgaccctgtgcaagttattcaccctcattcttcatctgtgaattgcagatagtgttatttatatgtagattttctgatgtgaatagatgatctaagccactaagcatttggtgctgtgtctggcacacagtaatgctcaatactaccttgtattattattattagatattgtctaaataaaaggttaaaatatacgtatatatatgtataaaatgtgtatatatgttatatttagaaataacacaataggtaggattttaacaaagcctagaaagccaattttgattggccctacttcaggaaagcagcttttctctggtactaggctgccaggggaaaggtgctgctgcccctcgccccagtgttgggggcctggtttcttagttacatagggctggctctgtttagcagccattgaattggaagactacaagatttggagccacagacatctggctcaaaggctggaagtgctctttcctagtcagttgcccctcagcaatttcagggaagcaactccctgtatctcagtttcctcacatgtcataacggcaatcatacttaagtcccaggattgttgtaaggagaattaaatgaaatgatgccagtatttggcttacggttgagtgcaaattcttttcttactggaatttcctcctggcttttgccataccacaccttccactgcttctctagctttggttaagcaccagttccctcatatgtcacacctgggtgagactttggctcttaacagtatccccttttacttgtcacccaagtcagatgttgggctcataacatgagtatgtaaaaatgtccttttcatcaggctattcagaattttacttcccagactctgtttcttcaacatcccccttacctgcccttgtgagcatgccatttctttctctttgcttgcctcagagtgccccacctcttggtcacttgggtgggcgttaagggctttccatatcgaagccaaacattctttccagcctgtaattcttaccccagtactcttcctggaagctggactgtctactggttaacccttcccccagacctccctctttgtattcatgcctaggattcttcgctcctgagtatgatctttgatccaaactgagcctgactctgacctcgcttgctgggtgctgattatttttgtacctctgatccattaggcatatgagctgtagtggaaagagccctttagataccattgactgtcctacccagagcccaatatcagccatttctaagaagctaggctgctagttaaggtagttgacactaacatggccctaaaaatattctgggcccaaactggtatctgctgtctaaactcagcattttggaggtcccaaccaagtatccagaaacttggaacagatccaaagcagcagcatcaggagggtgttggcaccacttgctcacaggcccttcatcaggagtactgggaagcaagtgaggaaaaacaaaaggattgttcacatggggagggtaattcaagacatgagtgtcaatttaaggaatgattatatgacaaaagtatattctggcaaaataatgtcagaaatatcagtttttgtgtttttaaagtttttttccttttatagtttgcatgtagaatccagtgctcataaatagtttgcctcctgataaattagcttgtttccttttatcagattaaggttctgaaacctatagtgtttgcctttgtgtcttggctgctgggaagctcagatcaaatttgaacattcgatgaacatatatgtaaacaaaaggtttcctttttaaataaaataacctcattttctgttttttttttttttctaaatctttcttttaattttatgaccctgtgacatcagaatttttttgtaaggtgcttcaaatctttttggatataaatggccacctggtgggtgaggattataatccttaatttttggccatcctgagaagtaagcaaaagtatttgagaaactccccagtctcccttgaacaggacaacatgccctttggggagaagtacctctgcaagcttagtttaagtgggatagagggaactgttcgtggtccttggcattttgcttttcaagagatgtattctcaagtcccaaggtgtttttttctgagattagatgtaggtggtttaagtgaaaaatagcacattttggacatgtcaacaagagtgttgttgttgcctaataccatactgagaccctagaaaggctggagtgtcttcttcagtgtgaactctgtaaccaatacatttgtacatctgatgaaagggaaccaggccctagcttcctttatcaactccaaaaatgtagccctaaagtcctcagtttgggaattcaaggggacaagtgatgttcatgtggatgccttagcaccttggagacctccaccgcaaaagtggcttattttgtaggctagcccttcttgcctgtattcaacctcaaaagagagatgacattgcctcagggaaaaggtgtcaccatcatcaggttaatttttccaaagcccatgtttgataatgtcatttttctgttcatcactcttctttggatctgccttcatgttcatctcctctgatctatctcaccgatggtaccctggtcattgcttttagctcaaacataattcatttgccaaaaagaaagtgcctttcataaagctgtgcaagaagcataggctttagtgtcagtcagacatagtttaaaccttggctttttcacactgaagcaatgggggacaaacctctgtgaacttgtttccttacctgtacaatgggtatttctctgatatgattattgttgagattagtatattaaggcatcatttataatttactggtcatatgctatttatagcatcattattatctcatgtattctctaagtcatgtactaaaattagcacataagacaaaaatcatgaatcgttgaaactcttcctggaaatcttttgtattgcagtacagtactgtatctgttgtgcatagaagtctatacagtaattctctaagtttgttaacctgtgagctgaactagagaaatgaacaaatgggaagtatttatgtaggtgtctgaatattcaaaccattctagctctaagatgacctcatggtgaataagggaacagtggagaattctagatgctttgtttgttgatttgtttcattttgatttcatattaggtaggcctcaaccttaagccatgttaataggtttgtggtcgtgaaaacttacattgtatgtaaagcacttagcctggtttctgtcactaccagtgaggatttaataaaatgttagttgttatttttcgtaatggtagtatgaatagtagtaatagtagtactcataagatatgtgacagcacctaacacagagcctggtacatagtcattgctcaataatgtttgctagatttggttaattggatctatatgtttactttccatattctttgtaagtgtagtaaagaagaatttggcaacctgttttctgtcttcccaagtttcctgctgtggccccttggtcattggtcacatttcaacttggagtttgttctcaagtaagcctctcaggtgaatgggcctgtgatgcactaaggatcagattgcacattatctgaaggcagggagtctgccttattcatctttgtatgcccacagttcctagcatatgataggtattcaatgaaggaatggatggatggatggaggaagaaaacgtttgaatcaaacaaagactgtctttgcatttgtgagatttaagggatgaaggttcaatttgagctattgctgattttggtcacctgggttttggcatcaggctctaatagtgctgcttccttgaaaccttgctctgagctagaaacagttatgctcttaatggggtctttctggcgtaagtaatcaaaagtataataactggctttgatacattgttttgagcacttcaagggagaaagggccctagaagaggaaggtggtagagcatcaaataagagaatgagatttggagtcaacagaaacctcagtttacatcctagttttgtcactttctagctgtgtgtccttgggaagtcccttaaactctctaagcttcagtgttttctcatctctaatatggggacagtattacatacctcataagtactgttatgagatcaaaatataagtgtacttaaaaccaaggtacatagtaactgctcagtaaatgttagctactattattgttgttaccacatgttttctctcctttccaaaatgaccgtagctttattgttttccacatcatcaaaagcaataatgtttgttgatttaatattaacttagaaaatacacagaagtttaaagaagaaaattaaaattagccacattcctacctcctagaggtaacaggcattgatatttaggtgtatgcatatctcacacttcattcttccatgtttatacacacacacacacacacacacacacacacataaaaaacaaggtcatattatatgtaatgttttctagcctatgtttttacaactaacaatacgttgcagaaatcttttcagatctacagaatcactttaatggtatcactgtattacactttatgactatataaatactacaggtattttcaccagtaccatattaattgacatttaatttgctcctaacattttgctaatataaacagtgcaacagtggccatttgtgtacgtacacctttgcacacttatctgattattttactaagagatatttatagaaaaagcagaattgttaggtcaaagggaattagtcacaccacataatggattaatctttattaaatggcataatgaatgggaggatgctgtgtaaactgtcaagtgctatgtaagtatgagttattgcattgcaactgttattgcaggaggcgtggcagaccaatgaccttatgggctagaagaaggcagaaggcttaatttctcccagatttccatgaatacacctagatgaacagatacacacaaatggatggttactgtttattctaatggatctacatttccactccctctcccaaactgccaaaatgaagaaaggttcttgcaatcttgaaattaaacaattgtttttaaacatggctgcttccagccaaatgttcagatctgttttttgccaaccacacagtttaggaaagcactcgaatagagaagcacaaggtctcccaagctgcttctgcctgagttgttctgctgcgctctagagaaccaagactgaaggcctggctactttctttgtgtgtgaagggagggtggggaaggcagatttggggagaaatacctttttactaagacaggggtggttggtcagttccagcttaaagataccttggtcacaccttcagtggaggcattcagctttctagtgagcctgacattccacagagttcaggccagtctagagagcctaactgacctacccactcctctggcttcctgtttttctagcagccagagtgcctcttgagcgtaactttattgtaagcattgttgagtagggggaagtgtgtgttgagaagtcttgaatctggatctcctcatctaacagcctgcattctctctgacttcaaaggctgggcattcatccaagaatgatgctcttggcctctgctagaaggtggggccaggtgtgggaatgcaaacagactgggggcctgtatgagggtggaaggcagcaggagactatgtgaccatggagaggagcagacgcctggtacttggccaggctccaccttacaaagggtgctccttgcaggaatgttttcaatgatgtctgtcagggagctagggctatttgaacctctaagtctgaattgggtgatgtttgccataagcagtaataagcatggaaataatttactctgggaccttgactgcattagtatgaaatcactggcatactgatggggcctattgatcctcaaactgtttcctgaattctctctgcaaatccattctttcctgtcccagcaaaccagttgtcactgctgactgtgtatgtatgctgctgccttgaaacacagtatgttggacttattcattcacctttctatccaggtcttcagctcactgagctgtgaaatttccccctcccaatctgtttacttttcttctgactttgtttgtaagcaaacctgtgtacataccttttcatgtgtttacatgtatttcttggaatgcatgctggctccccgaggctatttgtaagtctgtggctcttttatataaagggatgtatctcctctgagtgtacctagtcaggcacttcaattgagtgcagtgggggtagtccttggggcaggggagttgctgtgctggaagagtgattgacccttctcttggacaggaaggctttggtaagaccttaattgaattatgactctggagaacagggaagcttatccaccatcattgggaaaaagatggaagcttacactgactctggaagtaaacatcttctttttattccccccgagaacatgtggaatgaactcagatgactaatgcagtgtctagattcaaaagggcccttctgttcaggaaagtccagggcttgagatatgcaagtgggcttaagcagaggttttgaatggttcttatgttccccaccctaaccctagactctaagcccttcaagagtacgttgttatttttgcatttcctcactgggccttgtacaacacagacacttaataattggtgagtggattattaaggcagaagggtagactggttggcctactgagactattgatggccctacagactcccacagaactccacaggaaggaaggcttaagcccaggaggtcttgtttccagagcaggccttagacaaaggtcccgcccaaccctactcatgaagtaattggcagaatggctagaacaagtgaatgattgtgccataattagtttatgacctgagggcatgccagtttgtagccctgccagtctgctagctgccaccagcacagatatgcctcataaaagctcaagcaacaaagctgtggtcctattgggcctgcgacgcctaatgattcaggcctatgaactgagagaaactgagccagtgtgttaacatttcctgaactgaccttttctattttcattttatgcaaaagtaacctttatatttattacagctgttaattcttgctttaattgtaatgcttttctttttccctttctttcctttttttccttctttccttcctccctccctccttcccctttcttccctccctccctttcttcactccttcattcccttcctcctctccccttcctttcctctttttttcccctccttcctttcctctttgttttggagctgggagaatagttagaatagggcaagagggagcatctggcccattgtgtgacaataattgaaatcatttccttcggatctgctcaggaaatggctcagccaacatctccttcaagtctcaccctcctggcctgctgctggcatgattgttttccaaatattctcttctagtttcctgagagttcaagaaacccaaccttggtaatgagaaatctatcaacctgccaacctaattcctataaatgtatacaagactgttgatgccagacctcagcagatctggattctgaaactaggttttgcttctgaggttccatgagttcctctttcctttcctgcctatcaacctgcattatatttttactttagatgctcagcatatgtaatctttggacccattaaagttgaattaataatgtatacactatttgttgctgacaaaagcactaagcagctcacgttcataggtgggggaaaagatttacagattcctgaatacaggttttacatataagaaataaagcaatttacagaatgaccaaactcgaaggatggctcccatttagtgatttctttcagaactataaggattattgtttccaacatcatacaagcagacttaacgcccttagccccatccagggaatagacctaaggtgggaaattcttcactttttatatcttcttctcatcacagccaagttttcaaagcttaaatttcttctgagtgttttgttttgttggttgtgtggctcaaaatgaaggtatccttctcttttaacattgccagcaatcgctttacccacccagaatgttcttatttctatttattttgaaatgcttttaatgtgtccactgacttctttggtaggaatggtatccaagtctttcacaaaaaggctctaatatgtttatattagcctctatatctggggactactttgatttcatttttgaaggctaatcatgtatggccttaagtaaaacctccaacttagaaccaacattttgtttttaaaaagtaagtttgagattgagtccttgatgagaattatgactgtgtaattttcacatatttgtgagattcaagcacattattattatgaagcagtaataagctgtaatgaaccaaaaagacctcagttttaagaaatgtattttagttgacagtaggcatattaccatgactctaatagatgtatttgttattacttgtccccagatttctttttaatcacaacatggccaattctattcacagaacttataatttataaagtttaaggctatctttcttgatcaaaggtgtttccatgtttccatatgaaaatatttctattatggactagaggagttttgctcaatacatagcgttcatgaaaggcaaacagttttactaagagcctgtaattaaagcaaaaccattttttttagcaataccccacttatcctgaagctcagagaacagcctggactctggtaataagtttaaaaagaaaaaagaagcctttgagatttttcaaacagctgccagaaagcccatggtgcaggagaagaggccctcatgtcttgacctcagagagacccactggtccttaatttaatgggagcctgatatttcctcagttacagcagcaaattagaatttggggcggcaggatgggtgggtttgaggaggtagtttactctagaaatagacacagtgacagctaagtaacagacacccaggatggagaaatcataaaagcaaagacctggcaatgtggaataggcagatacccttacacatgaaaatataagattgtgtggtattgacatgccagattttgcttagccattctattattggagatttaagttattttaaaatttttactcttataaaaagtgatgctgtgaatggttctgcacaaattgcatttcttctgtttagagttattgctttctggtatcttaccaaatgtgtaataacgaggccaaaaggtatgagctgttttatagctgctgttacatgttgccagattgtactcccaaaagattaaactgcataagtgtgcctgttttcacagatccctgcagcactgaatgttatcatttttaacctttttgctagtttagtaggtatataagtatactatccatttgttttaattttatttaatgaggcttttcattttttagtgtcataatttgctgtttcctcgttcatcttctttcaccacttctcaagtaaaatctgggtaatgaccttatatatttttatccattctctatattttggatagtcagcttcatcatttatatttgtcacatatttttccaattttattgctttcatttttatgtatgctttatcatatttcactatgcaaaactattcctttttacatttatatattcaaatccatccatcctgtctctaatgtttctttcatttttcaatattcagaaatttaccactcctcaacagctgggacaaatatgtgattctgtcttccccactcccccagggtgtttttttcttttttgtgtttaatttttgggcccatctggaatttattcaagtgtatggtatgaggtatggatctaaagtaaaatctccatactgatatccaaatgtttcagcaattcaatttggcaaatatttcttgaactcctcctatgtctcctatgtgataagcattgtgttaagttccacaagaaagttttttttttaaatgaggcaaagttcatgctctttaagactgtgatcctgtgtgtgtgtgtgtctttctgtctcttgttcgccctctttctctgaagagggaaaaagtagtggtggcaggaataatgtaggtatttaaataattataacaaagcacaagggaaactatgataggtatcattaaaaaggttagaagcaagaagctgtgggaatttcaacaggtgagagacttgacccatttgagaccaggaaaagcgccaaggtggaggtgacatttaagggttcagatggttcagatggcagaaattcattcattaaaaaaatgtactgaatattctgacaggccttgtggtgggtcctaggggcagagatggacaaaacacaatcccttccgttaaggaactttcagactagcaagacagggtgatgacggtgaaggaaacataccaggtgaaggtagtagaaagggaaataaatgtggttggagaaagttacaaattggggaacagtggagattgagtctggaaagaaaggttagggctagtttaaagtagactttaaatgttaggaggcattggttctttcattgtttgggcctgcagaaagtttaagggtataacagtgccatgatcagcatagatttctcggccagttcatgtcatttggaaggctgttgtttatctgtttgccagacagtttacggaaatgtgaatgaggtagatgtgtgcaccatttgatatttgggatccttggcagtatcaattatactctttacagtgtctatcaatgtgtctgactgatctctataattggcaaagtttgtgatgtctttcatatattgtacctgcttcctttttagcaatccttcattctccctttcaagtagttagaatcacctgcctttgtgtaagttactaaggagatattttagagtgagtccaccaacatgactaaaatgaaatgtctggtacttgatggaataaagtttgggtatcttggatattcagttatgggaaaacaactcatttttactttctgctggaaaatgaggaggctatatgcatgagaccgaaaattaacttgaatgtagtcactcatatgagcatacacctaatgaatttgtgaaatattttctttcttgttgtgggcattgtgtttgttggtctatatacataaagcctacactacagaaattaaaccattggtaagcagaaccaactcatctgcaaatctaaaaatggattgtgatatggtctggctgtgtccccacccaaatctcatcttaaattgtagctcccataattgccatgtgtcatgggagggacctagtgggaggtagttgaatcatgggagctgatttttcctgtgctgttctcgtgacagtgaataagtctcatgaggatctgatggttttataaagggaagttcccttgcacatgctctattgcctgctgccatgtaagtcatgcctttgcttctccttcgccttctgccatgatcgtggggcctccccagccatgtggaattgtgagtccattaaacctttttttcttataaattacccagtctcatgtatttcttcatagcagtatgaaaatggactaatacaagttggtttccaaaagccaagaaaagcataataaaaggcttaaaaatcagtggtttaggagcaggacttccagaatggctgtgtgaggagctaaacatattctctccccattgaagcaaccacttaactggtgaaaattattgaaaacaactatttaaagtctctggaaattgacctcagggaattcagtatattgagatgaattaattcaagaaaatctactaggtctcaataagaataaaggaagtccagctagctgtcatcacctctccccaacccagctctttgtcgtggaagctatactttgggcaggtatagccaagaagatggggcatcctttatgccaagctcctagtcataagactacagtttcacctgaagagagacaggctgctctttttccccccactcgcagtgtctttttccccccactctcagcttcatgttttagaagctctattttgggttggcgtagtcaagaagactgaggttccttccccaccccagatcccacttgtagggtagaagttccataccaggaggtacagatcaaaaagatggggctaccatccccatcctccagctcctgcttatagggtgatatcacttaggtagaatcagactactaccatatcttcattccagtaaggaacgacaaaaattctgctcagggtgttaggaaagactggaagactggcaggtcagcagcgctgttgagggctgactttatttggaacagagaatggaaaaactcactcctaaaaggtgttttcaaaaacggtagagatctttatgttgaacaactagtaggaagctaatagttcatgtaactagaagcaacgaattaaatggcagaccagccagaagtttaacagacagaatcaaggggagagacagctaaaaagagtcctgttaagatcactgggggtcaggatggcatgcacatgtgctacactgcattgactcaaaagcaaccagaaagtgtacttgagagctactagtcactgcttgaacatggagccaatttataagtattccccaagccacacagaaatccatcatcaaagttctatatcattaaggcttaaggggcataagcacaattctgaccaatcactaggtaaatattaagttatactgacccaggagctactctgaggtaacaaagaaacaaaccaaggagaaaaaactgagcagtaacattggagatttcacagtgcagggaaattagacttcacaagattagtccaggcaaaccaccaaacagcaagccccatggtagtggtgggaaagctaatcagaatctagatttgttacagtatatcatctaaaatgcccagttctcaaacaattatgaaacatgcaaagaaacagaatagtgtgaccattgtacaaaaaaaagcaggcaatataaacaacgtgtgaggttgtaggggtagataatatatcagacagacacaaacacttcaaaataactattataagtatgttcaaagaactaaaggaaccagcctaaaatgagaaaataacaagtcaaagagataataaagagagaaattatagaagaaaaatcaaatgaaaattctggagttgtaaattacaacaatggaaaggaacaatttactggaggggctctgcagtaaataaggctggaagaagaaagaatgaatttgaagatagataattagagattatacactctgaagaacagaagaaaagaataaaggaaatgaacagagctccagaaatctgagacaccattaagtgcttcaacatacacatgataaaagtactgcaaggagaagagtataaatggggcaggaaaaaaatgaatgcataatagctgaaaatttccaaaacatgatgaaaaatgttaatctacatatggaaaatcctcaagaaattccaagaaggataaaggcataaagatatacacctaagtatattacagttaaaatgtcagaagccaaagacaaaaggaaaagtcataagagcagcaagaaaataaatgactcataatgtacaagtgaactccaaaaagatgaatagctgacttctcatcagaaagaaaatggagaccagaaggcaaagggatgacataatcaaagtgcttgaaggataaagatatcaaccaagaatcctgtatctggcaaaactacctttcagaactataggcaaaataaagacattctcagataaacaaagacggagataatttgtcgatgtcagacttcccttacaagaaatatcgaaggaagttattcaggctgaaaggaagtgatgtcacacagtaattcatatccacatgaaaaaaaactaagagtgctgataaatgtaattatgtagtaactataaaagacagcataattacatattcttatcttcccttaattgatttaaaaacaatagcacaaaacaatagcagtataattgaattgggggcctgtaacatatagagagatacttaacaatgacagcacagagtaggctgaagggaaggaagttgcagtggagcaagacaatgacatcaggtagtctctcaaatgcacaggaagaaataaagagtaccagaaatcataaataagaagctcaacataaaactttataagtatagttttatttcttttttgttccttcaaacagcataagattatttaaagcaacaattataacactgcactgttgagtttgtactgtatatagacaaaatatatatgaaaataaaaacacaaaggaagaaggaggaaatggagctatagtagagcaaatttgtaaatatcttactgtaattaagttagtataaaactgaagtagaatataagatgtatattgtaattcctagagcaataaataagaatataactttaaaaatagagtttaaacaactccattaaaaaggaggcaaaggacatgagcagatacttttgaaaagaagacatacatgtgggccaggcgcagtggctcacgcttgtaatcccagcactttgggaggccaaggcaggtggattatctgaggtcaggagttcgagactagcctggccaacatggtgaaaccccgtctctactaaaaatacaaaaaagccaggcgtggtggtgcaggcctgtagtcctagctactcgggaggttgaggcaggagaatcgcttgaacccaggaggtgaaggttgcagtaagccgaggtcatgccactgcactccagcttgggtgacagagcgagactccgtctcaaaaaaaaagaagatatacatgtggccaacaagcaagcagatgaatgaaaagctcaatatcactgagcattagaaaaatgcaaatcaaaaccacaatgagataccatcttaaccagtcagaatggctattattaaaaagtaaaaaaataacagatactggaaaggttgtagagaaaaggggacacctatacactgttggtgggagtgtgaattagtatcatagcttttgaggaaacatagatggagctggaggctattatccttaggaaactaacgcaggaacagaaaaccaaatactgcatgttctcacttgtaagtgggaggtgaatgatgggaactcatgaacacaagggaacaacagatactggggtctgcttgaggatggagggtgagaggagggaaagaaaaagaaaaaataactattgggtactaggcttaatacctgagtaatgaaataatctgtataacaaacccccatggcatgagtttacctatataacaaaccttcacatgtatccctgaacctaaaataaaagttaaaaaaatagggtttaaaatttaataaagaaattaaaatgctacattggaaaatacctatttcatacaaaacaaggcggtaaagaagggacagaaaatattttgtaaaatacgacatatggaaaactaatagcaaatggcagatattaattcaactgtattaataataatgtgaatgtgaatggagtaaataacctgataaaaagaaagaaattctcagactggataaaaaaactgaggtctaactgtatgctgtcaaaaagagatgtaccttcaattcaaagatacaaataggttaaaactaaaataacagagaaagatataccatgtaaactgcaaccatcggacagctggagtagctgttagtgttatcacacaaaatacgtattaaaacaaaaaaaaatgttgtcaggtgtgcttgttcatgtctgtaatcccagctacttggaaggctgaggcaggaggattgcttgaggccaggagttcaagaccggtctgagcaatatagtaagatcccatccctaaagaaagatagaaaattagctagacatggtgatgggtacctgtagtcccagctacttgtgaggctgatgtaggaggattgcttgggcccaggagtttgaggctgcagtgagctatgattgtaccactacactccatgcactctagcctgggtgacagagacctgtctcttaaaaaaaaaaaaaaaaagttactagagataaaaaataaatattttataatgataaaagggtcaattaatcaggaaaatataacaaacatattaaatatttatatacttaacaacaggtcccaaaaatacatgaagcaaaaattaacagaattgaagataaaatagacaattcaacaataatagttggagatttcaatactcattttcaataatggataaaatgattagaagatcaacaagaaaatagaggacttgaacaacacaataatttaaatagacctaacagatatttgcagaccactccacccaaccacagaagaatatacattcttctcaagtgtatgtggaacaatctccaggatagacccatatgctaggccataaaacaagtctcaacaaacttaaaagaatagaaatcatatgcagtaaatttgcagatcacaatataattaaattagaagtcaacaacagatggaaatttgggaaattcacaaatatgtgggaattaaacaatatactcctaaataaccagtgggtcaaagaataaatcactgaagaaataagaaaataagattaatgaaaatgaaaacacaacacatcaaaacttacagactgcaggaaaaatagtagtcacagggaaatttgaagctgtaaatgcctatattaaaaagaagaaaaaatgtaaaaccaatgacctaatctgccttaagaaactaggagattcagaaggaattttgcaatgtaaatgcaaaaccagtggaaggaaaccaataatatgataattactagagttgaaataaatgaaatagcagaaaaacagcatagaaaatcgatgagaccaaaagttggttgtctgaaaatatcaacaaaattgatcgtttgctagcactgccataacaaattaccacagacttggtggcttaaataacagaaatcaattttctcacatttctggagactgaaagtataagatcaaggtgtcagtaagtttggtttctcctgaggcctctctttttggattgcaggtggctcaccttttcaatatgttttcacctggtctttcctttctgcatgtgcatgtgtctagtgtctcaatatgtgtcgtaattttctgttcttataaagatacctttcaaattggagtagagcccactttaacagcctcattttaacgtaactatctctttaaaggatttatctccaaattcattcatgttctgagatactgttgagttagggcttcaacctacgaagtttggatggacagttcatcccataacaatcaacaaaatatattgacaaagagaagactcaaattacagatttcaagaattgaggagggaacatcacttcagaacttacagaaaaattaattaaaaagtataaaggagcactccaaacaactgtatgcaaacaaattagataacttagataaaatggatacattcctggaaaatgcaaattatgaaaactgctcaagaaataatagaaaacctgaacagacaagtatgaagattgaattagtagtttaaaaatcttcccataaagaaaagcccaggtccaaagagttttactaataaattctaccaaacattaaaagaagagttaataccaatacttcacaaactctcccagaaaatagaggaaataagcgtcaactcattctacaagaaaagaaaactatagaccagtattccttatgaaaatagatgcaaaaatctagaacaaaatacttgcaaactgaatctaacaatatgtaaaaataattatacgccatgaccaagtggaatttaccttaggaatgcaaggctgttttaacatgcaaaaaatcaatgaatgtaaacattgcattagtagaataaagtacaaaaacaacatgataaactgcatacatgcagaagaataatttgacacaatccatcaccttttcatgacaaaaaccctcaacaagttaggaatagaagggaatttccttaagctgataaagggcatatacaaaaaccttacaggtagcatcatacttaatagagaaagactgaattcttttgctttaagatgggaacaagacaaatatgtctacacttaccagttttattcaacattgcattacagattctatccaaggcaattagacaaaaaaagctaatttgtctttattcatagataatattatattttatacagtaaaacataatttttcatcatgtctgtaggatatgacatcaacataaaaaatcaattctatgtctttatagtaataatctgaaaatgaaattaagaaaacattttcattcacaatagcatcaaaaaatggaataattaagaatacatttgacaaaaaagtattttgtacactgaaaactataagacaccagtgaaagaaaagaaagacttaaataagtagaaagatatcccatgtttgtgaattagaagatataatattattaaaatggctgtacttcccagatggatctacaaattcaatacaatccctagaaaaatctcagatgactttttttttttttttgagatggagtcttgctctgtcacccaggctggagtgcagtggcgtgaccttggctcactgcaacctccacctcccgggttcaagcgattctcttgcctcagcctcccgagtagctgggactgcaggactgtgccaccacgcctggctaatttttgtatttttagtagagactgggtttcaccatgttggccaggctgatctcgatatcctgacctcaagtgatccacccaccttggcctcccaaagtgctgggattacaggcatgagccactgcacctggcctcagatgagatgacttttttgtttcagaaaattacaagctgattctaaaatacacagagaaatgcaagaaacccagagtagccaaaacagtctttaaaaagatcaaacttggaggacctacagtggccaatttcaaaatttatgacaaggccacaatagtcaagtcagtgtgctactggcttaaggaaagacatatagataatggcaatcagttgagatcccagaaataagcctttacatgtgtgatcaactgattttgggcaaacttgccaagaaaattcaaagggaaagaaatagttttttcaacaattggtgttcaggcggtagaatattcacatgcaaaataatgaatttgatctttgacttcacaccatacacaccaattaactcaaaagtgtaccatatacctaagtataagagcttaaactataaaactcttagaagaaaacataggagtaaatctctgtgatcttgagttacacaaagatttctaagatacaacaacaaaaccacaagtcataaaaacatgataagctggatgtaagctggacttaaaatttaaaaccttcacactttaaagataccatccagaaagtgaaataacacctcaaagactgagagactatacctataaatcatatatcatacaaagtctttagattcagaaaatataaagcctcttacaactcagtaataagacagattatacattaaaaagcaggataagaatttgaatagacatttatccaaagaatatatataaatggcaaataaacatgtgaacagatactcaacatcattagtcattaggaaaatgaaaatcaaaaccatgatgagattacatttctcatccactggaatggctatctattagacaaaaataagtgttgtcaaggatgtggcatatcagaacactctcatacattgctgatacgaatgcaaaatggtgtagttctttggaaaacagtttagcagtttctaaaaatgttaaacatagagctatcgtatgactcagaactttcactcataggtgtatacacaagataaatgaaaacatatgtctgcacaaaaagttgtacctgaatgttcatatcatagcatcatgactcacacaagccaaaaggcagaaacaccccaaacatcctcaacttctgagtggataaataatatgtggtataatcatacaatagaatattgttcggcagtgaaaagaaatgaagcagtattatatgctactatatgaatgaacctcaaaaacatgctcagtggaagaagacacataaggccacatattgtatgattccatttattgtatatgaaatgttcaaaaaagacaaatctttggaggcagaaagtgattagtggttgcttggggctgggtgttaggaatggggactgaatataaattgcacaaggtttctgtttaggataatggacatattctaaaattagattgtggtgatggttgcacagctctgtaaatgctaaaattcattatattttatgctttagatgggtgaattttatcatatgtaaattatatatttaagttgttaaagtgcagtggtttaagaagataaaaattttgataattttataaagaacatctccaccaaaacattataaaattccttcccagataaagtatagctcatgaatttctatttctatttcaggaccttgttccatttgtcagtttcccccatgtacctctcctgtaccctactaccatggacctatttctctggattctgtgttccaactttcccttgccttgagcctgttcacccttccagaactttctcattcagcattctggcttgtgcgttcacctctatcctaaagttcttttctcctgagtctcatttcattttttcaaaccactgcttctatttcattgatgaaaagtggcaaataatttatcctgggcttgtttatgtatttgacagatgtttactgagcacctactgtgaacttggccctgtgatgatacttgtcgtgtcttatgttgctggtttttatattcagggggcaataagtatgtttaatgtgccacatgaaagattctgtagagaaggaccgagtagctatatttcatggcaatttttgcccagtctgtagaagggtctctgtttcaaaatgacaagtgtgtaattgccttatctttgtccctgagttgtccatgtgtcttgcggtttaagctagtggagtgctggcaaaccagctctccagaaaaacagtaaataagtaaaacctaatttgtagcacttgtggtttctatagcggatatactcccaccatggccagtttcaagttgctaaaatgatattactgaatacttcactggaaagctagccagtgtgagccctccactaagaggcaattgcttagtcctaatccatacaagaatagctttcatgctgtttctaaaataccacccaacttggaaggaatgtgggaagaaaactaatgcttctggaatactaactgtgccaggcactgtgcctgttagatattcattcccataatcctgtgaggaagatagccttttcacaggacagcagatgaaggaatggagagttaaaatgatctgcctgaagtcacagtgcactgcagagctaggatttgaatcctggtcattttggtgccaaagcccatgctactttcattgcaccatgatacctcctgggacaaaactggtagtggagacagtgagataatgtacttttctggtggtagtgctgtggatattgtttgcttcctgagggtttggcacgtcacttgtagcccatttgacatactagaggatagtgggttaatctctttgtggcaggtaagagatcagtgaagactgatgcatggtatgtggagggagcctacaaaccttttgattgatttgagcctaaggaggggactgcattgattggctagtaattcttgactattctggggagtggcagagatgctggaacaacacataccttacaggctttaggtgagacctagaatgaccatttgagaggtcagtgctgtctatggagaaagtggtttctgaatcaagttccgaatataaatgattggagcgagcttttgaaaacaaatctatgacttatttttaccagaaagaaaagtctataagggcaggaatctttgcctgttttgtttattgttatattcccattgtctatagaacagtgcttgagactcaataaattaagtgttgaatgattggatagatgaataaatgggagaatgaattctttgcctccagttctgtagctccttcctaagcctggctactgcttaaaaccaagcatcatctcagagatccatgaggaaccaacactgaggcttctcacatttttctcagctaaggatctcattagcagttatgtaaagaaaaatgatgttacctggatggtaagatgtataacatttctttgggaagcgcttttcactatctttgggcagaatacctgtcaattgttgagtttttactaagtgccaggtacagagtacagagataagcgttatgtatgcattagcccattaaatccttatgaaattaataacgttatgaaatagacaattagccccatttggcctggagagcttaagtaggtttcccaaagctgcacagctagcttttcttgggagcatctcaaataccgaaagcaaaaggaaaaactttaggagttaggtatgacaaaattcataaacataaaacaatataacaatacgtatatgcccttttaaattttcaagtaatcacattaaaaaggtaaaaagaaacaagggagacaaatgttaataacatattttagttaactactcaatatatctaaaatattaacatttcaacatggaatcagtataaaagttactaatgagatattttgtgttcttttttaatattaagtctttgaaatctggtgtgatattaaacttgacaagtgtgtgtcaatttacaccagtcacatttaagtgctcattagtcacacgtggctagtggatggctactgtactggacagctcagtgctaggccttgctcccaggtatactgaaatgtattagaaacctttctgtgaagtgatgaggaaaggcacataaactgcagtgagcccaataacaatttgttttgcagaaagctgttctttaaattattacccatataggttacaaattatgagattaaaacccgatgtaacattaacagtccttcaagctccttcagagtctcctccactggatttgggagagtaactctcttaaagcaggacatcattttgattctgcaaatattctccaaggcaaggaggttacatatctctgcagagtgtctgtgaactgaggcctgaagcaatttaaggtagggacttcagggtcatcaaagaagaagcacatgccactcaagtcctttacgtaatctagaggaaagaccaacaaagaactagctaatagtctgggaattatttctcgtttccctgttctctgcccttcttcaccatgcagtctattctcccaagacactccatctctcagaggttcccaatctctctctatagtctaggggatgtataactatataagtgagggtatgtgaccctatgtgagattaggtgtgtgctgtcatgggtcagctatgtaaagtatggagagtgagttggcagccccaaaagcatagctatgaataatcaagtaaaaagattctccccatttcatgtcctctcagaagaaggagacataaattaatggggcctgtaggcactgagctgacctgacaatttccatcacagagtttccctgtagttgcaggggctgtctggcataaatgaggattccaacctggaatttgatttttctcctttagagcacaatatttgaaatccatttactcacataaagggcttttaaagttgtcttaggctttaggtagacttccttgattagagacttagaaatatgtttcaaagagggtccttgtagaaggtaagtttctttttttaaccttttagggtggaaaggaaaagagagatggtagagtagtatttttcatgaagaacccctcagcccttaagctgtatcaggcataccctcagtctgactgtaatggcaatctgactaatggaattaatcatctgaaaagtaaggcaggtggccatctcaaattgtgttgtctgctttccccagagatatgtgactctaagctagtgtatcaaaaaagaagaaaataggcacattccttaagattaagatgtgggtgaaacttaacctgtcttctctgtcagaataggaagtgcttatggaccaaatttgccagaggacttagtcttctgttgaagaaccatgtgcagtcaggaatgactaaacctggctttaaagctggagggagatcaggacagggaatccctataatattgggcacaaaaagcatggactaaaatgttttttctctgtgtttagtcaagatttggtgaacacctgatcagaaaatcctgtattgtattatcagatgcagatatggtacagaggaaaggggaaagtaactttcatttacagaaatgtgccaggcacgttacatattcttagggccatcctgtaggtcaagatagcatcttacccactttatagatgaggggactaaaactcacagaacttatgtgacttacatagctagctcgggagtggggttcaaacttggaaatgtcttactccaaagtgtattcttcccactgccctatactactgtcttagatcttactgtttagctagaaacacatgacttgtactctcaagtaacaaagaaataactgtattaattataattaaacactgctaatatgaagtcaggacagaatgtattttgcatgatcaggaacagttctaaggtcagagcagatcttgtatttccctgatggtgttggtcagtgtcatgatggatagtaagaaatgtagacaaggagctgtcaacaacacagccccatgttgcaaaataccattattatagaaaccttccccacaaaggacgaaatatctgacagtgagccccagatcttcctgacgtacagaatgtcattagctccttagctaatatttttttgccctagtgatagagaaacaccattttgacaaggctatgtctgagttctactggtaggtgaagaaatactagttctctgttgttcccccaggagctatagctgaggattcaatgccttgatagttctggaagataaagcttccattgttttgttgttttattgtcacatcaccctaggagcaataatttcacagttgaccaaagtggtagtatcacatgggttcatctacattgtggactctctttggcatagactccatgagttcgattagagtggtaggattctatcattgtttcatagctcttgacaaaactaactgtcctaacaaaaaagaataaagataggtgtaagttaatactgcttttaaaaatgcattttctatatgtatgtctttatgaaaccttgagttaaagatggtgaaggcaagccttgtaatttcatcccatttttactgagcaagacaaactcctattgttgaatatggagtgacatattaagtgatacgttaatgttttgtcaaatcttaatggccagcatcttctagtggcccattttaggacaaccttaatcaagctatggttagagaacttttattaaatgcccagcactgtactactttctagcatttcccactctgatcgtttgcttgaggatgatgaaggatgataaatattataaataagattgcttcccatataggtcttaaaatcagctgaggtcaatgcagatctactgctagaaatgatttggaattttggctgcttcaggagaagcatagcagcagaaacaggagatcattgaacattttaagaaggaggctacccgcaaattcagaagttcatccctttaggaagggtctgtcataatagtaggaagggaccaggcacagtggctcacgcctgtaatcccagcactttgggaggccgaggcgagtggatcacctgaggtcaggagttcgagagcagcccggccaacatggtgaaaccccatctctactaaaaatacaaaaattagccaggtgtggtggcagtcgcctgtaatcccagctactcgggggaggctgaggcatgagaatcacttgaacccaggcggcgaaggttgcagtgagctgagattgcgccacagcactccagcctgggcaacagagtgagactccgtatcaaaaaaataataggagtaaggattcctgactgaagccctttggacacttcctgctggaaacgcatgggcctttagtaactgatgttggccaggtgagctggcacatatggcattcttttgtggtctcaggatttcatggtaagaagatctgggcatagcttatagcaaagacctctatatcaatcattccattcctagaagtgccacctggaagaggccaagataatgagatgtctgtcctcttgtgttggtggctatggtcaagttgaggtcctcaagaagcttccctgttgtccaattccagttcactgtggctttggtaaccctcaagagagagatagtagatggaggtcttctaaaaaccagatttctagtggcaagcgcacagcccagtctgcggtcatcagtggaagccagttcagggtatcagcagttggtaagcttgctgaacatgccattttagagagaatctctccatagcaagaatatgaagaaattgattcaccactttctcatacatcttatgccctagccaacccatacctgacaaactatctttcttaaatatcccaagatcttccctacctctttttctttgcacatgttgtaccctttgctagaatgtacccttcctctttctacatggtgaactctcatctattttttaaggtctagctcaaatgatatattctctgtataacctttccttcattccatccctactacttctgtggttctacagcctgttgtatagatctctatcctcccattgctctatacagggagtaaattatctatgaagatatctctctactactaaactgtgacccttttaaaggtggtaattgtttctaacttctctctgttatctccattagtcagaacaaagcccggcatataataagatgaaccagggaaatgctgatgagtgagtgactgacttatttattctgatatggctagggttagattctttagattccatcatcattaggctttatttggtatcatattttataagtgtgtatttcagtggcctcttctctttttatttgtattgttttttgacacaggatctcactgtggcacccacgctgaagtgcaatggtgtgatcacggctcactgcagcctccatctcctgggctcaagcaatcctcccacctcagcctccccagtagttgggactacaggtgtgcaccaccatactcagctatttttttggattttttgtagaggtggggtttcaccatgttgcccgggctggtcttgaactgcagagctcaagcaatccaccagccttggcctcccaaagtgctgggattacaggtgtgagccactgggcccagcatctttaatgaaatggctaaactttttgactatgtttatttgtttctttgaataaaaggtacatttgtagtctttaattggtccaatatacagattccagtggaacagcaatggctccctcttgtgaggcagtctcagaatttctcctataatttctttggagatgtgtggataaggtcctcttaggagagttaattctaatggtctgaatactttggctcctaagtatgggggaccaactagttctttcttggaaagttttaagaacatcacttgacaagagtaaagaagccatcccgggagtcttaatcagcacaaaatctgaacttcctggagttggaagggttcctggaggtcatctttacaactgaatctcacacagcaactcatgtcagttttgagttgctctctctctcttagagttttatgttttttagtagattattccttttaagaaactaaaatctccctccagctgatctaggtcctagcctttggaaccacacaaaacagtatgtaccttcttgataactaattgccctttaggtagttaaaagacaatgttaggtttctcatgatattttctacattcagtttttccaacatgtatgaacacctccctagtgccaggcatcctggtctaatcttctccaagtctctcaactgttccccatatgtcagttttccaatcctctgaaccacttcttgtagatcatttccaccttgtcactggctctgaagtttataatttttacatgttatctttgttaaatgttttccattgttccagccagcctcgatctttcaggatactatcatatatgggacctactctatcctaggagagtctcctctttcagttcatcagtataagcttccagttttgacactttagaataaagcagtacttttcaggcaacagcatggaatagttgaactagatggcaccagatctgcgttcaattcatttaacctctttgaggctaaaatggtgctaataatccttcctttatagggtaatacccatgattcatgagatactgtctgtaaagcattaagcactgtatctgagcacttagtgggtacaccacagaaattaatgttccccccttctcctcctgccagtcttgccctgcccaccactgccctctactgaggagagtcagtaactgctttaaacttgaattctttcttgtttgagccaagtagccctattccatttaatctctttgtagccttttaatgaatgacaaacctgcatgagatgcagcacaaactggaagatggcatactggcctcaattttgtaagatagcccttgtaaaaatattgcagtaagcatcttcgccaatttctgacacagcataactgagttagagttctacattccatggatagctatttgtcagaacttttttttaatattacaagattccaaggtgctaaacacagatgcttggaatgtaatccagcatttgtggttcgctgtcatgtaaacagtcaaagtcacagcctgattctgaattcattcatgggttttctggatatttcccatgctctttttgaagaggggcatttatgtgaattagcacttttaattcgtctgacagagtgatataggcttgtataaaagcaataaaaatacagggtcccaggtggcatttattgccacacagatgaaaagccatatagttggaattctcctcttatgagaggcttttgggatgtggagggaaatccctaagcttagcaatctgacattatagtacagtggatagagggtaacctaagtgtcagatctgagtttcagtttctcctgtgctagtcactatgaatatgatctgggacaagtcctttcacctccttttacctcagctttcccttgtgtacaatgggaaaaaattgtaccaactttgtggattggttgtattataaatgagattaacaattctataccacctagcccagtgcttgatatatggtaggcaagcaataaatcattgctcttaggatcagttctagttgataacagctaagcctgctggagttgccatatcattttcctcttgaagagtgaaagaagtaatagcatgtgtatagtttggggattcaattcctgggtctctgtagaaactggaccaccctgagtccctcagactgtgctgggagtttataatcattcatgtgaaggacaatgggaaaacattgggttgcttaatagcccttgctggtacctaagcaaagacagtgagaagaaccctggtgacttctcaacccttctccactgtaagggaagaatcctaaggcttttcttacactgtagcctataactccttaaatgcaaggacttgaatttaccaactcaaacaggagtgaaatgctgttgccttttttggaggtctggaaacatatacttgggaatctggtgagctggttactaaaactccctttgcagagatggcggtggctggattctttgttttctcttgagtaattttgacctagaggcaaaaagaaaatctctaaaaatgttctgctcataagaaaagagcaattgggctgagggtggtcccctggtaaaagagaaacttcaccaccaatcagctttgtaaattaaaaacaggtgcaaaaactaatctatagtgacagaagctaattaatggttaccagagggagggggacagagaaaactgggtggcaatacaaagggcacaagaaatcttttgggattaatgggtaagttcaccatcttgattatagtaatagaaggtacatatgtcaaagataatcaaattgtatactttaaatatgtgcagtttaatgtatatcaactatacattaataaatctgttaattcaaacaaatccagtgtatataacacctagtacatagtaggtgtgtgctaaacatgtgttgaattaacaattgtgacagaccaacttctagtgtgaagagctcaacaaaccctctcaccagtaaaacaaccattaaaatggtagaagatgatgtaaaacaaccattcaaagtatctggaaactggctcaaggtcatgcaacaaattgagaatcacttatttaagaaaaatctatggaaccttggtaagaacaattggcatttgagcaaggaactgcttccattcctcctcccaactttatgttgcagaagatttattccaggtgagtacaaccgagaaaacagggggtctctttcttaccagctgttgattatagagctatagtttcattccagaatgatcaggctgctagtgactctcattcttccatctccagttctctgttgtacaagatttattcttggccacaaaaaacaagaagattgggggttcccattccgtgctcagttcccactcttaagatgaaggcactaccctagacagttgcagcaaactgtgaatggcagttggagaagaccagggctcctatttccccactcccaagtcgagggcccagttttttttttgtttttttgtttttgtcagacaaggacttcagggggctcatagagcagagatgtcactgtagaagaagcaggctgccatatcattctctcctcatccagctccaaatagtaacatagcctatggggactgactgactttagaacagagcatgaaggaattcatgcctaaagttattgttgaaaacagcagagattatagtagtgaatattagagaattacatattagtagcagctagaagaaaaaagaccagccagacatttcagagagagacctgtggaaagagtttaaaaatgccctgctaagatcacatttgtctattggtctggaaggctgtacacacacactaggctaaacctgtgtgggagctaccagagatatgatatttatgagctgctaaaccctatttgaatgcaggataaaattaaagacttcctgaagtatgaaagcattccccaatccatacaaagatacattggcaaaagatagaagctttactggatctaggaacttaagaaaaacctgtgaccttttgatataagatgactcctagaaagccagacttaaaagtaaaacaagaagagaaatgaacatgacatcagagactgtacactacagatgaaatagacttcagagagaattagtccaggcaagacactgaagagaaatagagaaaaagcagaaacaaaaacaaagcccaggttatgggggtgggataggtaaacagaattcagagttactacaatacattatttaaaatgtcaaattttcaacaaaaattatgagcattgccaaaaaataagttaagtgtgaccatggacaggaaataggcaatataaatcacctttgagggagctcagatgttgtacgtgacagacaaggactttaaagcagctattataaatatatccaaaaaactaaagaaaactgtgttttatgaactaaaggaaagtgtgatgataacaactcatcaaataaagaatatcaatgaagtgatagaacttattttttaaaaagaaccacatgcaaattctggacttgaaaataaaataagcaaaacaaaaattcttaaggccaacaatattttatatcatggcagaagaggcagaagagagattactgaagcagaagacagattaatagagaaagaaaaacagaaggaagaaaaatgaacagagcttcatatatgtgtgggaaacaaacatatcaacatatatgtaatgagagtaccagaaggggagaagagaaaaaggcagaaatgtagtcacagaaattatggcttaaaatccccaaatatgatgaaagacattaatctaaacatcaaagaagatcagtgagctccaagtaagataaactcaaacagatccatacctagacatatcatagtcaaaatgctgaaattcaaagccaaagggaaaatcctgaaagcagccagaggaaaatgacttatcacatacaaaggaatcacagtaatttcaacagctgacttctcatcagaaaaagtgggtaacaggagacaaggggaggacatactcgaagtcgtaaagaaaaaaaatcaaccaatatgtctgtatctggaaaaactaatcgtcaaaaatgtaggcgaaataaagatgtttccagataaacaaagattaggagaatgtgttgctagcacctgccttatgagaaaaacggaaagaaatatttcaggcagtctgggggcagtaactcgtgcctgtaatcccagcactttgggaggccaaggcaagaagatcgcttgagcccaggagttccagaccagcctgggcaacatagtgggccccatctctacaaaaaattttaaaattagcggggtgtagtggcacgtgcctatagtctgagctactcaggaagctgaggtggggtgtgggggtcgcttgagcccgggttaaggctgcagtgagccatgatcacaccactgcactctagcctgggtgatagagtgaggccctgtctcaaaaacataaataaataaaaagaaatccttcaagctgaaagaaagtgacaacagacaataatttgaatccataaagagccctggtaaaggtaattgtgtagtgattaagacagtgtaattacatattccttctccctcttctcttagttgatttgaaaaacaaaaccatactgaagcagcagtgaacacaactagtgcccagaacttggattctaataccatttttcaatgaaaggaaccagggatccttgaaaaaatggctggttctaggactggatcaggaactacatgagtctggagaatctcgtagtgccaggaagtaaggaagtactaaagtgcacacacacacacacacacacacacacactactgaatgggttatgtcaaaaggacactggagtcaattgaaagaggtcccaatggccaaagctggaacaacttgagaaaaaaagtaaatcaataaagtactaatagattataatccaagatatttattttatgtccatgagtccatatgggttaaataaataaatggggagaaccatacaaacattttatgcagaagaattccaaatgatttatgttactactctgtcctcaaggacatagagcataacttctcactgtttaagtggggcctgtgcatagtgacttccttgaaagaatacagtatggaaaggaaaaaattgtaatttaagtgaagaaagctggcaaacactaccttagccagaaaaccaaggttaacatcaatgagataagtcatgttggtagtgtgttccttgatatgctgtgatgaaaatggtatttcacttctgtgattgcccccccccccgaaaaattcataaccccactccaattatgaagaaaccagcagagaaatactaatcgaggattattctacaaaatacctgaccagtactactggaaactgacatggtcatcaaaaacaaggaaagtcaaaaactgtcactgcaaagaagagcctaaagagatatgccaactaaatgtaatgtcatatgctggttgggatcctggaaccaaagaaaaagaacatgaggaaaaaactaaggaaaattgaatgaagtatggagtttggttaatgatataagtgtatcggtattagttaattattacaaatgtaccatactaatataagttgttaataacatatagggcattgtgtgtgaggtggatggtaaatctctatagtatcttagaaatttgtcttaaatctaaaactatttgaaaatataagcatatatttaaaaagcaacagcataaaacagtataatattgacaataatagcacaaagcaggggggaagtgaaaggaggtataatagagtaaggaaatgaaaccagagagtaatttcatacacaaaaagaatattagaagtggcaaataagattgtttataattacatacatttttcttaaaaattataatatgtatttttctcccatcttttagctttttctaaagacactagattagaaagcaaccattataaaactatattagcatataaaatatgtttataacatataaataggattgaaagtttggtttaacacttaaaaattaataaatgtaacacattaatggaataaaaggcaaaaacatgatcatttcactagatgaagtaatataaaaaacctgggaaacactcaggtaacaacctacaacaaattagggagataagaaaatttctttgacgtgataaagagcatctattaaaatcccacagctagcatcctaccaaaaatgttatacaaatgaccaaaagcacatgaaaaggtgctcaatatcattagtcattagggaaatgcaagtcgaaaccacagtgagatactatttcacactctaagaatgcccttaatttttatttatttttaaattaatatttttaatgacaaatcataattgtatacacttatgggatataatgtgatgttttcatatatgtggaatgattaaataaaacaaattaacatatatatcacctcatttacctattatttttatcatgagatatttgaaatttactcttagttattttgaaatatataatatgattattgactctagtcaccctgctgtgcatagctctcaaaacttacttctatcttaaactttgtattatttgttggacaacaccccattgcccctttccccgctcttcccttccccttctcagcctctagtaaccaccattctactctctatttctatgaattcaagtttttagattccacatataagtgagagccggtattataaagtgattataatcaaaacagcatggtactggcataaaaacagacacatggaccaactgtagggacataaagcccagaaatacacccatacatttacaatcaattgattttcaacaaaggcatcaaggacatacaatgaagaaaggacagtttcttcaataaatgatgttgggaaaactggttgtccacatacagaagaatgaaattggatacttatgtcccaccatctacagaaatcaactcaaaatagattaaagacttaaatataagacctgaaaccataaaatatagggggaaagctgtacaacactggtctgggtaacacttttttggatatgaccccaaaagagcagacaatagaagtaaaaagtgtatttaattttgtatatttgcatgttttcaaatggctttgttattttctcatttaatttcattgttgatatcacacatttctataatttcaattgttttacattttttgagactattttataccctaacatatggcctatcttagtgatgttccatgtgtgctttggaggaatgtattctacagttctaggctaaggtgctctatacatgtctgtcaggtctgattggtataagtcaagactgttgttcaagtaacctacatctttgttagttttctgcctggttattctgtcttttattgaaagtggagcattagagtcccctgctatcattgttgagttgcctatacttccttttaattttgtcagtttttgcttcatatcttttgtggctttttgtttggatgttcatgtaattgttttatcttcccaattgattgacccttttatcattataaaatatgcttatttatctctcataacagtttttttaaattatactttaagttctagggtacatgtgcacaacgtgcaggtttgttacatatgtacacatgtgccatgttggtgtgctgcacccattaactcatttagcattaggtatatctcctaatgctatccctcccctctcccccgaccccacaacagtccccagtgtgtgatgttccccttcctgtgtccatgtgttctcattgttcaattcccacctatgagtgagaacatgcggtgtttggttttttgtccttgcgatagtttgctgagaatgaaggtttccagcttcatccatgtccctacaaaggacatgaactcatcattttttatggctgcatagtattccatggtgtatatgtgccacattttcttaatccagtctatcattgttggacatttggcttggttccaagtctttgctattgtgaatagtgctgcaataaacatacatgtgcatgtgtctttatagcagcatgatttctaatcctttgggtatatacccagtaatgggatggctgggtcaaatggtatttctagttctagatccctgaggaatcgccacactgacttccacaatggttgaacgagtttccagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcatgttttcatgtgttttttggctgcataaatgtcttcttttcagaaatgtctgttcatatccttcacccactttttgatggggttgtttgcttttttcttgtaaatttgtttgagttcattgtagattctggatattagccctttgtcagatgagtagattgcaaaaattttctcccattctgtaggctgcctgttcactctgatggtagtttcttttgctgtgcagaagctctttagtttaattagatcccatttgtcaattttagcttttgttgccattgcttttggtgttttagacatggagtccttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcatttccccatttcttgtttttgtcagctttgtcaaagatcagatagttgtagatgtgtggtattatttctgagggctctgttctgttccattggtctatatctctgttttggtagcagtaccacgctgttttggttactgtagccttgcagtatggtttgaagtcaggtagcgtgatgcctccagctttgttcttttggcttaggattgacttggcaatgtgggctcttttttggttccatatgaactttaaagtagtttttttccaattctgtgaaaaaagtcaatggtagcttgatggggatggcattgaatctataaattaccttgggcagtacggccattttcacgatattgattcttcctatccatgagcatggaatgttcttccatttgtttgtgtcctcttttatttcattgagcagtggtttgtagttctccttgaagaggtccttcacatcccttgtgagttggattcctaggtattttattctctttgaagcaattgtgaatgggagttcactcatgatttggctctctgtttgtctgttattgttgtataagaatgcttgtgatttttgcacattgattttgtatcctgagactttgctgaagttgcttatcagtttaaggagatttggggctgagacgatggggttttctaaatatagaatcatgtcatctgtaaacaaggacaatttgacttcctgttttcctaattgaataccctttatttctttctcctgcgtgattgcccgggccagaacttccaacactatgttgaataggagtgatgagagagggcatccctgtcttgtgccagttttcaaagggaatgcttctagtttttgcccattcagtatgatattggctgtgggtttgtcataaatagctcttattattttgagatacgtcccatcaatatttaatttattgagaatttttagcatgaagggctgttgaattttgtcaaaggccttttctgcatctattaagataatcatgtggtttttgtctttggttctgtttatatgctggattacgtttattgatttgtgtatactgaaccagccttgcatcccagggatgatgcccacttgatcatggtggataagctttttgatgtgctgctggattcggtttgccagtattttattgaggatttttgcattgatgttcatcagggatattggtctaaaattctctttttttgttgtgtttcagtaaggctttggtatcaggacgatcctggcctcataaaatgagttagggaggattccctctttttctattgattggaatagtttcagaaggaatggtaccagctcctccttgtacctctggtagaattcggctgtgaatccgtctggtcctggactttttttggttggtaagctattaattattgcctcaatttcagagcctgttattggtctattcagggattcaacttcttcctggtttagtcttgggagggtgtactctcataacagtttttgtcataaagtccattttgtctaatattagtatagccacttcaactctcttatggttactctgcgtggtacatctttctccattttttaaacttccaatctgtttgtatttaaatatataaatatgtgtcttgtagatagcatgcagttatatcttgttttcttatccaatctgacagtctatgccttttgactgggttatttaatccacttaaatttaatgtcattgatttggtggaatttattttgttggtttttttctgtatgtgtcatgactactttgttcctttgtacctcctttactatccccttttgtatttaatgaatattttctagtgtaccgttttaatttttcaatgattttcaactattttcaagttattctcattgtggttgttttggcacttatgatatacatcataagttatcagaatatacttcatatttatagtaagttaattcttataatatattttacatttacttttatatagttccattcatttccctgttgtctattattttatacgtattatgtttacatatggtgcaaacacaacaaaatattcttttgaaaatccaagatgcaactttagtacatatttcattctacagaatacttatacacttaatcattttccaaagtacattttgcaagacatactggtcttcaccagtaactactgttacttcctctttttaaaacagatttattgcttttatactgttggcgggaatgtaaactaattcaaccattgtggaagacagtgtggcaattcctcaaagacctaaaagcagaagtaccatttgacccagcaatcccactactgggtatatacccaaaggaatgtaaatcattctactatagagacatgcaaatgaatgtttattgcagcactattcataatagcgaagacatagaatcaacctaaatgcccatcagcgatagactggataaagaaaatgtggtaggaatactgtgcagccataaaaagaaatgatatcatgtcctttgcagggacatggatggagctgaaagccattatcctcagcaaactaatgcaggaacagaaatccaaacactgcatgttttcacttataagtgggagctgaacaatgagaacacatggacacagggaggagaacaacacatattggggcttgttggggggtatgctggggagatggagagcgttaggaaaaacagctaatgcacgctgggcttaatacctaggtgatgggttgataggtgcagcaaaccaccatggcacacgtttacctatgtaagaaacctgcatatcctgcacatgaaccccagaacttaaaataaaaataaaaattagactgctttccacagtggctggattattttacattcctagcacctagcatgtatgaagatatggagaaataaaaaccctgtgtgtgagggtttttatttatccatatcttcactaatgcttgttgttacctgattctttgattctagccatgaagtggtatctcattgtggttttgataagcattttcccccgatggctaattatgtcaaccatcttttctctcttccttttttttttttttgaaacagtctcgttctgtcacccaggctggagtgcagtggcgcggtctcggctcactgcaccctccatctcctgggttcaagctattctcctgcctcagcctcccaagtatccgggactgtaggcgcacaccaccacgcccagctaatttttgtattttttagtggagacagggtttcactatattggccaggctggtctcaaactcctgacctcgtgatccgcccacctcagcctcccaaagtgttgggattacaggcgtgagccactgcgcccagccacgttaatcatcttttcatgtgtttgttggccatttatatatattgtttggataaatgtctactcatatcctttgtctgtttttttttcattgacttgtttttctctttatcattgagttctaattttctttacatatccagatactatcccttatcagatatatggttttaaaataaattctcctgttctgtgggttgccttttcactttatagtgtcttttgaagctcaaaacttttacattttatgcagtccaattgatctattttttcttttgctactcatgcttttggtatcatacctaagaatcctgtaccaaatcaaaagtcattaaggtttacctgctttttcttctagtagttttattgttcacatttaagtctttgataattttgagtgaatttttgtatacagtgtgacatagggatccagtttaagtctttttgcatatgggtatcctattgtccctgcaacatttgtttaaaagatgattcattttctattgaattgtcttggcacccttgtcaaacatcagttaaacataggtttatcggtctatttctgaactctcaatgccattccattgctctgtgtgtctatccttgtgccattacaagactgtcttgctttctgttgtttttaaataagttttaaattgggaagtgtactagtctgttctcagctgctaataaaaacatactcgagactgggtaacttataaaggaaggaggtttaattgactcagtttcacatagctggggaggcctcacaatcatggcagaagatgaaggaagagcaaagggactccttacctggcggcgggggtgggcaagagagaatgagagccaagcaaaacaggaaacctcctataaaaccattagatttcatgagacttattcactaccacgagaacagtatgggggaaactgcccccatgattcagttatctcccatggggtccctcccacaacacatgggaattatgggagctacaattcaagatgagactggggccgggcacagcagctcatgcctgtaatcccagcactttgggaggctgaggcaggcagatcacttgaggtcaggagttccagaccagcctggccaatatggtgaaaccccgtttgtactaaaaattacaaaaattagccaggcgtggtggtgggtacctgtagtcccagctactcgggaggctgaggcaagagaatcacttgaacccaggaggcagaggttgcagtgagccgagattgcaccactgcactccagcctgggtgacagagcaagactccatctcaaaataaataaataagaaaaaagaaaaagaaagatgagactgggtggggacacagccaaaccatatcaagaagtgtgagccctcgtactttattcttctttttctggattgttttcagtattctgggtcccttgtaattctgggtcccatatgaatttttgaatcagcttgtcaatttgtacaaacaagtcagctgagattctagtaggaattgcttcaaatgtatagctcagtttgggaagtactgccatcttaaaaatgttaggtctttgaatttatgaatgtagtgtagtttttcatttatttagacctttaatttctttcaacaatatttagtagttttcagagtgtaagttttgtacttcgtttttaaaaatttattccaaagtatgttattctttttatggtattggaaatagaattgttatgctcaatgtcattttcagattgtttattgcaagcagataaaaatacaactcatttcagtatattgatcttataccttgcaaactttttgaccttatttattattttagtagatttttagtggattccttaggattttctatatataagatcatgccattcttgaaaagagaaagttttatttcttcctttccaatttggatgtcttaaatttccttttcttggctaatttctctggctagaatatctagtacaatgttgagtggatttgacgaaagtggacattcttatcatttttctaatcttaaaaggaaagcttgtagtctttcattatatgtatcatagccagttttgtgtgagtataacagaatagcagagactagctaatttataataaacagaaatttattggctcacagtttttgaggctgggaagttcaagattgaggggcagcatctggtgagggctttcttgctgtatcattccatggtggaagggcaaagagagggcatgcatgagagacagcaagagttggatgaactcatttttttataaggaactcaatctagtgataacagcattaatttattcataagggcaatgccctcatgacctaatcacttccttttaggccccacatctgaacaccttgcattgggattaagtttccaaaatgtaatgctctgggggtacacatttaaatgatggcagtgtggatttgtcatagaagcccttatcaaattgaggaagttctcttctattccatgttattcagggttttatcatgaagaagtattggattttgtcaaatgctctttctgtgttgattaaggtggtcattgattgtttggtttttattctattgatatgatgtattacattaattgattttcagatgttcagccaactctgcatctctcagataaataccacttgccatgttttataattctttgtatatgttgctacattcagtttgctagaattttcttgaaggtttttgcatccatataaataagacattgttgtataggtttcttgtgatatctttgtctagctttggagtcagggtaatattggcctcatgaaatgatttggaaagtatttcttcctcatctgctttttctcttgaagagttttttaagaatttatattaattcctctttgaatgtttagtagaattcagcagtgaagatatctgggcctaggcttatctttgtggatagtctttttattacttattcagtctcttcacttgttaaggttatctgttacttcttgggtctgtgttggtagtttctgtcttcctagaaatttgtccatttcatctaagttatctaatctgttggcatataattgtccttagtattcctttataagctttttagttctgtaaagtcagtagtaattctcccttcaatttttgattctagtaattgagtcttgctttttttctggtcaaactagccaaagagttgtcagttttctgatcttttcaaagaactaccttttggttttattgattttttctattgtttttccattctctgttttattaatttctgttctgatttttattatttccttccttctacttgatttgagtttagtgtactcttgttttctggtaccaactctggatactagcccttcccttctggagcttgttattgttatttgcttatctgtttagtaattggctggattattttagtgaagtttacccctccagcacacacgcagtcttaaatctttgatgttgcccctcatttaggcacaactttgggtgtgcccacaatcaccctggaatgactgtggtggtactggcagggctgttatcctctttccttggccacacccagctgttaagttctaccaattgaaggccaattattctgttgtttacaacaactccctaggacaagaattcttctacaaatttatctaatctgagtgtggctcttttcaggaaatagtttctgaggtcagtgtttgatacttttttcggaccacaggaaggctcctaccagctgtcttattctccaattctctcctgcaaactagccagcctatagtcttggctgtatcttcattagattcatgagtctactcccaattttctttatcataacctccaattttttttagagtgtttttaggtttacacttatccatgctctcttgcaaatgaagtcagcctctctgaaaagagattagtagctatccatttttataggctgcttctccccttaggtaaaatctctgggctctggtagggacaatggcaattgtaggagctgacttgactttgtgcatgactttcacaactgtaggagctgagtgctaggtggagaggtgtcactagcctgaggtcctcttggtttgccttttctggtgtggaactacaatctcagaactgagagaagggctattggagctctggtgttcataacacaccatgaccatggtagatcctctcttccatgagtggggattggatggaagacaggatccccatctcttgacctcagtcacctggaacttattctcagccacagacagcttagggacaaatgagaaatgctgaagtcctgttcccttcagaagaaagcctgctggctgggagctgaggggagaaggagttctgtgttcttagctgcagcagtgtggagtggagtccccagatcactaggctgggtggaagaaggagagagggaaagaggggatagagggggcagtttttgttcagataccacagacttgcttttttttttttaaaccaaatttctatggattttcttcaataaatatttcttcattttctgttttgcccttaggaccatttccagaggctttaaatggttcacctgttttaatgcgacagagtcaacagagcacctcatattgtaatgccagaactcaatctcccaataatatattttataattatcattttatataaccttatatcttttaaagaagagaggaaaagagaacataaatatctttatggcttttaaaaaataaccttctcatttaccattttttattctcaccatttctttctgtgtacttgagttaccattgggtatcgttttcttactccaatacagcttcattctgacgcccctcctatgtggtgttattgtcatatgtattaaatttctatatgttataggcccaacaataaattttgtagttaatgttattttttttttttttctttttctgagacggagtcttgctttatcacccaggctggagtgcagtggtgcgatctcggctcactgcaacctctgcctcctgggttcaagcaattctcctgcctcagcctccagagtggctgggactacaggtgtgcaccaccaagcctggctaatttttgtatttttgtagagatggagttttgccatgttggccaggctgttcttgaactcctgacctcaggtgatctgcccaccttggcctcccaaaatgctgggattacaggcttgagccactgtgccaggcctgtagttaatgttctgtgcaattgctttttatttttttatttgatttattttattattatttttttgagatggagttttgctcttgttgcccaggctggagtgtaatggggcgatctcagctcactgcaacttccacctcctgggttcaagcaattctcctgcctcagcctcccgagtagctgggattacaggcatgtgacatcactcccggctaactttgtatttttagtagagatggggtttctccatgttggtcatgctggtctcgaactcccaacctcaggtgatccgcccgcctcggcctcccaaagtgctgagattataggtgtgaaccactgcacccagcctgcaattgctttttaaatcagttaagagataaaaggtaaagaaatatattccttgtcactacctacacaattaacctttaacacaatgctttgtttttcatgaaaattcaaattactctctggtgtcactttgatttagcctgaagaatttcctttagattttcttgtaagtcaggtctattagcaatgaattctttcaggtttttattatatgggaacatcattattttgccttcatttttgaaagatagttactgagtatatgatacttggttgatgtatttttttttcattcagcactttaaatttgttatcccactaattttgttctccatatttttctattgagaagttcactgttagtcttattggggtttcctttagatatgattagtagtgttttgcttgatgctctcaagattttttctttatctttagttttaatattttaaatatgatgcatctgggtgtggatcattgagtttcttctactggagtttgttgaaccttttggatttgtaagttagccttgtccatcaaatatgagaaggttattgtcattatttttctaatttttctgagtctctttatttcctctccttatggtacttgtaatatatgtatgtttgtgtgcttaatggtgtaccatatttctctgacgctctgtttctctttatttttttctgttcattttgtataatctctattcatctgtattcaagtttattgattctttcttctgccaacttaaatctctagtgaatatttcatttggattattctattttcaactccagaatgctatcttgtttataatttctgtctctttttctattctctatttgatgaatttttatcatacttttctttcattcttcaagcatgctttctttcagttgtttaaacatatttataatagctgctttatagtcttgggtaagtccaacatttggactctgtcaaaagcagtttcttttgcctgcttttcttcctatgtatgggctgtgctttcctctttgtttcatatattgtaatttcttttgaaaactggacatttaaaataatatgtgatctcttttccacatcaatgatatgtgtagcagctttaagtaatgaccatctcccacccccacccccaatttttgggacttgctgttatttgtttggttgtctgtttattttttgacttgatagtctatttccagtagtgtatgcagcctctaatatccattccccaattttttttctttgttcttattttttatcctgtcttcttaggggtcacccttgggtgcacatgaaccatttaatcaccaaaggttatgattactccccttagtcagttagactctttacttttgcatgtatttgtagctttgagtttgttttcacagttgagggtgtttatgatttttttttacatttagccagatgttctctctctggtcttttctatgagggtgcagccttgggcatgcacacaatgtaccagaccactagggattagttttactttgtttttagacctgaattcctagaagcagcccttgggtcagaatagcctattgttcagccagtgtttcatcaggagttgtgcaaaagccccttgatctaatggatctgtgtgtggcttggagaatactttcaagtctgccttccttctaactctgattgcttctgattaggtgtagcctagcttatgcacacaggctttcagatgtccagtgatgttggtgaccccaggagggctctgcttggctatttcttttttttctttttctttttttgagatggagtcttgctctgttgcccaggctggagtgcagtggtgcaatctcggctcactgcaagctccacctcccaggtttacaccattctcctgcctcagcctcctgagtagctgggactacaggtgcccgccaccatgcctggctaattttttgtatttttagtagagacggggtttcaccgtgttagccaggatggtctccatctcctgacttcgtgaaccgcccacctcagcctcccaaagtgctgggatttgggctatttctatggctctgtcttttaaacttctgatcagtttgcatttcactagtatcacagagctaccagccttcttgaaattgctcaccaagatctccattgatttaataacattgtcagacataaacttctccatattctgttccaaataaagtcaatcccctcaggcagaactgctaaagccttctgtttttattacctgcctctccctctgggcagaagctgtggatcattgcactggagctgaatgtagcaagagcggcctgtttcttctagattgacacccctattatatgagcaagtcctggtatagggtatattcattttcacactgctataaagaactacctgagactgtgtaatttatgaagaaaaaaggttgaattgactcacagtttcccatggctggggaggcctcaggaaacttacaatcatctagaaggtgaagggaaagcaaggaacatcttacgtggcagcagaagagagagagaaagtgaggaagtgctacactttaaaaccatgagctcttgtgagaactcactcactatcatgagaaaagcatgggggaaactgccaccatgattcagtcacctcccaccaggtccctcccttgacacatggggattacaattcaagatgagatttgggtgggacacagagccaaaccatatcattctgccccagcccctcccaaatctcatgtccttttcacatttcaaaaccaatcatgccttcctaacaattccccaaagtcttaactcattccagcattaactcaaaagcccaattccaaagtcccatctgagaccaggcaagttccctctgcctatgagcctgtaaaatcaaaaacaagctagttactcttaagatacaatgggggtatgggcattgggtaaatgttcccattccaaataagagaaattggccaaaacaaaggggccataggcccaatgcaaatctgaaacccagaagggtattcattaaatcttaaagctccaaaacaatctcctttgactccatgtctcacatccagggcatagtgatgcaggaggggctccgaaggccttgggcagctccacccctgtggctctgtagggtacagcccccatggctgctttcatgggctggcattgaatgcctgtggcttttccaggttgtacagtgcaagctgtcagtggatctaccattctggggtctggatgatggtggccctcttctcacagctccaataggcagtgccccaatggggactctgtgtgggatctctgacctcacgtttcccttccaaactgccctagtagaggttctccattaggcctctgccctgcagcagaattctgcctggacatccaggcatttccatacctcctctgaaatctaggcagaggttcctaaacctcagctcttatctgctgtgcacaggctcaacatcatgtgataagccaccaaggtttgaggcttgcaccctctgaagcaatggcctgagctgtacgtttttcccttttagccatggctggagctggagtggctgggatgcagggcaccatgtcctgaggctgcacaatgcagtggggccttgggcccggcccaagccatttttccctcctaggcctccagcttgtgatgggaggggctgccatgaagatctttgaaatgccttggagatgttttccccattgtcttggtgattagcatttggctcctcgttacttatgcaaatttctatagcaggcttgaatttctccccagaaaatgggtttttctcttctactgcatgctcaggctacaaattttccaaacttttatgctctacttcccttttaaacataagttccaatttcaaatcatctttttgtgaatgcatatactgtacgcttttagaaaaagccaggtcacttctttaacactttgctgctcagaagtttcttctgccagatatactaaatcatctcttaagttcaaagttccacagacctctagggcaggggcaatgccaccagtctcttcgctaaagcatagcaagagtgacctttgctccagttcccaataagttcttcattctatctgagaccaccgcagcgtggacttcattgtccataacaccatcaatcagcatgttggtcaaaacaattcaacaagtctctaggaagttccaaacttccccacatcttcctgtctcttctgagccctccaaactgttccaacctctgcctgttacccagttccaaagtcacttccacattttcaggttatctttatagcagtgccccactcccaataccaattttctatattagtctgttttcacactgctataaagaactacctgagactgggtaatttatgaagaagaaaggtttaattgactcacagttccacatggctgggtaggcctcaggaaacttacaattatggcagaaggtgaaggaaaagcaaggcacatcttacatagcagcaggaaagagagagcggaagtgccccactttaaaactgtcagctcttgtgagaactcactcactatcacaagaacagcatgggagagactgccgtcatggtccagttacctcccaccaggtccctcccttaacacgtggggattacaatttgagatgggatttgggtgggaacacagagccaaaccatatcagagggagatatggccctgatactctctgcttgcgcctcccaccgtggaacctatgccctatgagcaagttgtggtgaggtgattggggccttagtattcttggcctgctttgccagagcagagcccttggcttatgagtggagcgaggtgggggaaagagacccagtccacttagctgcagcttcctagagcagcattttcataacaagggcctactgaggataagaggtgccagtggatttccccttctggggtgaaatcctagaataaccttagcctgggtcttagtcttgactatgagctggggataaagggagccttcctcttttcttagccacatctgccttgtatccataaaactgggatagagatgggttaggaacaggtcatgtatcaaatgccactgactcctattgttcttaccaaaattcactaagtttacttgaataaacatttcttcactttccataagccattaggacaatttccagagactttaaatgggagaggatccaccgagctcctcatatccctattctggaagttctatcagcaacgatttcttatatacaataccaaagacataagtgatgaaaagatggataaagattggacttaatcaaaattagaaacttttgttctttaaaagacactgtctagaaactgaaagggggccgggcacggtggctcatgcctgtaacccccgccctttgggaggctgaggcaggcggatcacctgaggtcaggagttcgagaccagcctgaccaatgtggagaaaccccgtctctactaaaaatacaaaaaataaaataaaataaaataagccaggtgtggtggcgcatgcctgtcatcccagctactcgggaggctgaagcaggagaatcacttgaacccaggaggcggaggttgcagtgagccaagatcgtgccattgcactccagctgggcaacaagagcgaaactctgtctagaaaaaaagaaagaaagaaagaaactgaaaggacaatttatattagttttctactgctgttataggaaattaccacaaacttagtagcttaaaaaatacaaatttatcattttacagttctgtacattagaaatatgacatgagtctcactgggctaaaaccaacatgtcagcagggctcatttttttctggaggctcaaggagagaacttccttgccttttttagcttctagaggttgcccatattccttggctcatggctctcttcttctgtcttcaaggagagtttataggctttaaaaggccatgctgtaacaggcaagtgataacaggctttagtgctgtgggatgggatattggcgttgagcggggtaagggtgattaggttttaatgggatcgtaaggggtgcatcatccatcaccaaggagggagtagaggtgtcctacacttgtggattaaggtggggagatacaaggagaggatgtgaaggaggctttgaactgggggaaaaggtggcaatgaggtgtggctgtgcagggaagcagataatttagttaaaatgtctcgacctaataagggaactaggcaggtggggataactaaaaaggagtgcataaaagaatgttgtccaatttggcaccagagctggggagttttaagaggtttagaagcctggccgtcaatacccacaacagttacggagggaagggatacaggcccttgaaaagaagataatgtggagttggtagcctctgtattgattaagaaggggacggacttaccctccactgtaagagttaccatgggctcagaggcctgaaaggaacatggactgactgtatatgagctcaaagctctgatcatcagcacctgctgtagccccagcataccctcaaggtgtggactctcccctctaaccaaggaaattaaagcatcagaatgaaccaaaagcatttaatgggtaaaggcagccatcagtacactcataggaagcccacactcctaaagaacaggagggtcttgcaaaaacctcccaggcttgtttgtttctccctctgtttctctctctctctctctctctctctctccctcccttgctccctccctccctccctccttccttccctccctgcccctctccccctcctccccctccctccccccctccccccaccacatttctgaaatagagcccagatgagaaacctgctcatgtgtatgtctgtcccatttaagaatagtagattctgactcatgggcaatttcattcctgaaattccaattgcagaaaaaagattagcagaacaggttttatttcattttctatccccctccctttccatcatttcccttgacatcacatatgtcaataagtagcatgtacggaagcactgatcatttcttaattaatacctttacagtttctttttgaggacaatggaaatgttctaaaattagattgtggtgatggttgtacaactctttaaatatactaaacaatcattgcatttcgcttaaatggatgaattttatggtatggtaattttattgtgtgtaaattatatctcaataaagctataaattaagaaacaatcagtgcttccctacatgctacttattgatgtatgctatctcaagggaaatgatggaaagggaggatagaaaataaaataaaacctgctctcctaatcttttttctgcaattgagatttccggaatgaaattgcccatgagtcagaatctactgttcttagatgggacagacatacacatgaacaggtttttcatctgggttctatttcagaaattcatggagagagagagagagagagagatgaaaggaaggatggacggaaggaagcaggcctggaaggcttttgcaagaccctcctgttatttaggagtgtgggattcccgtgagtgtattgctggctgcctttacccattaaatgcttttggttcattttaatgctttaatttccttggttaaagggagagtccacaccttagggctgcgctggggtttagcaggtactgatgaccagaggaaaatctactgagtgctaaatgcaaacaagtcaaggactgaagctggcctgagagtcagggaccccttcccttaggtaggttttagcctaacttctatacatttgctgtaactgaagccccacccccagcagctacattccctggccttcccagaacattgctgtgggcccccatactagatttccctccttcctctggacatctctagaaacatcttttctgcattgctgcaaactttcattttaactccctctctgctattacttaactcaaggacagaggaaatagctgcagtccagaaacagaataaaacaaagaagaaagaaagagaagaagccccaaactcctcccaaatctttaagaaaacaatcctgtaggatttggttgggaattgccatgcaatgtggggaatgtgaaacatgtgctaatcatggccctttctgcttggatcctacctgacttctctccaccacccccagccagctgggctaggctaggcccaggggagccacaaagctgccagcttagaaaatggagacaaatgaggaggccccagaggacaaagcaagacttgttactagttttgaggccaaagcaacacatacagtatttaagggctatgggggtagatgctgcaaagcctggaatcctagctttgagcttaaagattcaggctaatttgcagtgactgactgtgtcagaggtgtttgaaccagagcaactccatcttgaatagaagctgggtaaaatgaggctgagacctgctgggctgcattcccaggaggttaaggcattcttagtcacaggatgaggcaggaggtcggcacaagatacaggtcctaaagaccttgctgatacaacaggttgcactaaagaagccagctaaaacccaccaaaaccaagatggcgaccagagtgacctctggttatcctcactgttacactccatccagcaccatgacagtttacaaatgccatggcaacatcaggacattatcctgtatggtctaaaaaggggaggcatgaataatccacccgttgttgagcatatcatcaagaaataaccataaaaatgggcaaccagcagccctcagggctgctctgcctacagattagccattccttattcctttacttccttaataaacttgctttaactttacagactcactctgaattctttcttgtgcaagatccaagaaccctctcttggggtctgaatccagacccctttctggtaacaactgttctggagtcagtagtttctgagctaggcctcacttggttcaccatcttgactcttgccttgattattgccagactttcctggctcggtgtccctgcatgcagtcagtgccacagtgatcttttcaaaacagagatcagagatctgatatcagtactccctctcttccagtctatctcatctccaggagaaaacccacattccctaacatggcatatgaaatgaaaccctttataatctggccttagttgctctcgcttcatattctatcacctgtcctcaccctcaggtgatcccacaaaactatttatactttcttgaacattttttttttcttccccacatcagtgcctttccatctgctattccttcagccaggaatgaatgcgctttccatctttttctccattaggttataatcccactcttcatttaagactaagtgcctctgtgaaaccttaggcttgctagggaggggttttcagctttcttcttgttgccagatctcactgaacataccttgggaaggcagagttgtgcaatggaaagaacctacatgatagagtcagacacactatgggatggtgagtaaaagactttatctctcagtttcttcatctgtaaaatgggagtatgaatcactacaaggcaaaaaggtttatattggtaagtgccaagcacagtacttaatacatagtaggtacttgggcaatattgtatgttgtagaagaaatagaaaaatgattcctttactctcagttggggactctaaggaggagtttctgagcagacaaccaagtggatggtgttctctggggcctgtttacctgtcttcttggggttcacctgcctttggccaccctcatgtctaaatgatattttgcaattatcctgccttgttgggagcagccatcagctgctttcccattcatgtcccttaaaaatctgtgtgggcaatcataagaggagagggaagaaattttcacatccccttcttttcttccccatgtccttgtcttgcccccaagcctcagattgtctagcagtcacttcatgtcggccttaccccttcctgcaaacatgctccccctagtcttttttctgcaattgagatttcagaaacaaaattgcctatgagtgggaatctactgttctcagattggaatggacatacacattagctggtttctcatctggactctatttcagaaatgtacacaagatgtcaaaaatataccatttggaaccagagcaatatttattttgaaaaaattagggagaaaagtttccttgcttcaattcctactggaatgtaaaataactatgtgctgatgctgcattttgacagcattgagttagttaccctcagggtcactagatgagtggtgcacagacacacacgcacacacatgtgtgcacacacacaaacacatatattcagagtgctttgttgttgactggaaattgcaggcagtctgatgccagagttaggctttaatggatcaagccatacattaacaacactttagtaagtgttcccttatgtgccaaatcttgtgctaggcggggagaagaaaaggacaagtcacagatggagtaatctgaacacaacaagagagcataaagcactaacacattaatactgagagtaaatatttaaagaagaaggggttgaggttactgaactatagttaccagggaaaatttcctggagggaatggtgagacctgagcaaggacttggaggataaaattggcgactctgatttatccacagaattctcttagaaatgactattagaatagatagaatgaatattagtttgcaggaggtggaaacaaaaatgacctgaaattgtatctgaaggaggttatatggaaaagattgagaggaacatgggaccaagaagtagaaggcatcttagtcgtagagtcactactgactcattgtgaatgaccttaggcaagtcctttctctttgaaggacttttcccgtctctacattggagctaaataatatcagccttactgacctcctaggactattgttaagagaacaaatgagataattgtgtgactgtgcttggaaaaatagagaagactatccaaaaatatagtttgggtttatgaaggcagagtttatactgtagccactctcttgcagctgggaataggatgacctcagtatttgaatgaatttttcttggcaggcctcttgcctgccataattacagcctgccagccactagttgagtatacatactgaagcaggatctgcacacaagcatgcatgtgtgtgtgtaagtttgcattgggctaggagattgtagccaagagaataaaaagacgggagaattcttaggaaccaaggagatctatagaaatggagatttatgtaatcatctttgggcctgccacttcagtaattcaggacatcatccatcttccttggtatattacaaagccttcctacttatctgcctgacttcatggtgccccaatctagcccatcttccacactgctgctaaagtgtgtttccaacccaatgacattttggggctcctggatgaccacaaggtagcactcatgctcattcacatgacatagaagcagggctgtatttaactagtattcactgatatgaccacacttcttgttaaaattatgggatcctttgagaggctctttgagcctcttcaagacccctcctgctgccccagctgcccctcccaactcttggacccagccactaaagggttagtgcccagcacagcaagggacctggaggacattgttccatgcactgacctgcatctattctgctttgttggtgctgctgctgctatattggtttttatatatgtttaggattacttttgcattcatgattcatctcatcccagtgcatgtttccagcttatctctcacaacttttccacacagatatcagcaaattgaaattatcatattccgcatctggatttatatgcctgtctctaccacaatactgggaaccctttgagagtagggacaagtggcttcctcaccaatgtagccccaaagccaagctctggacccagcacacagtggacactcagtatatgtttgttgcttatcatagaggatgttggtagatggagccattctgtttgtaatcctctaaaaaccttcaggatctaggcctgaacctggtgcagggcactttcttggtcttcttgcagacctcatgaatgttattcacatttccagtgtccttggaagggagggaaagagcaagtattatttccattctattactggggaaatggaagtattccaagagtacatctcagccacacaatgaatgtttaatggaactgagacataaagtcatctctctggaaattttccttacccacagtgctggaaagccttttgagatttggggtgaaaactgctgccctaatgtgagtaattgaagactgctgccttctggggagatgctggcttggagtctttttaagtgggctgaaggactatctggtggaagtgatgtaaatgttcttgtcccttctgtcccagcactgccaagagagacactggtgtgtggggttgaggtggagaatacattaaatctcttctgatttggttgcttggcttctgctgcaaccaattaacatggcttcaagccaggtatggtggttcacccctgtaatcccagcactttgggatgccgaggtgggcagatcacgaggtcaagagatagatcgagaccatcctggccaacatggtaaaaccccgtctctactaaaaatacaaaaatttagctgggtgtggtggcggtcgcctgtagtcccagctactggggaggctgaggtaggagaatcgcttgaacccgggaggcggagcttgcagtgagctgagatcgcaccaatgcactgcagcctggtgatggagcaagactctgtctcaaacaaacaaacaaaaaaaccatggctttacaactggtggtcccttcagcaacaagttaactttcatttcaggaaatcctctggcaccctttctctgagatggatcccccttacccctacaagaatagtcccttgtagtgagccagcctggaagtgctgtagagaaggccagactgggagaatgactggagccctatctttaagaaatttagtcttcctgggaagcaggcatcgtacgtcaggtacgacttaggctgcaagtaactgaaacccaaactctaactggcttaaacaattaggaaatgtattatctcacataacaagaattctagggaagaggcaggctttaagattggttgattcagctgttcataatgactgtcagcgggtatcaaggtaaatcattactttgttctccagttgaagtgagaggaacctaacaagtaagtctgggaaaccatataggtgtcaaagtttctcagttctatctttataaaaaggagagaaacatgggcactggaaaacaatagggtagattcaaagtatccactgagttcatattagctgtgtggccttggacactcagttaattgctccaagccaattcccttatgtgtcaaatggcagttgttaaaatatttgacttgcttctaaacaggctgctggtaggggtcatgtgaaataatgtgaagacatttggtaagtcacataaggtgccatatacctttgaaacctttgtaaaaaaattatttttaattgacataaaaattatatatatttatggtgtacaacaggatgtattgaaatatgtaaacactgtggaatggctaaattgagcgaattaaaatatacattacctcacatacctgtcatttttgtggtgagaacacttaaaatctctgtgattttcaagaatatgatacattgttctaactatagtcactatgttgtacatctcttgaacttattcctcctgtctaactgaaattttgtatcctttgaccaatatcttccccaaacccccttccccctacttatctgcccccacccctggcaaacaccattctaccctttgattctaatagttctaataagctctcacatgagtgaaatcaggcagtatttgtctttctgtgcctggcttatttcacctaacgtaatgtcctccaggttcatctatgttgccacaaatgatgggatttccttcatttttaaggttgcatagtgtttcattgtatatatctaccacattttctttatccattcatccattaatggacatttagtatcttggctattgtgaataatgctaccatgaacatggttgtgcagatatctcttcaagatactgatttccttttttttttttttggaatatatacccagaagtaggatgactggatgatagggtagttttattttaattttttgaggaaccttgataccgtttttcataatggctgtactaatttacattcccaccaccgctgtgcaagcctcaccacagcacctaaccaccacctttcctccacagcctcaccaacacttcactcttgtttttttgatagtagccatcctaacaggcatgaagtgatatctcgttgtgattttgatttgtatttccctgatgattggtgatgttgagcatatttttatatgcctgctggccatttgccatgtcttcttttgaggaatgttttggcagatcttttgcccattttttaatcaggttatttgttttctgaggccttttaaaaattactatcatcagacataacacctactgtgtaaaaggcactgttagattgaaagtttaaaataaaacctaggtactaaccttaagtttccccaaacagtgcaacacacatctactgagcacccataggtgctggggacacaggtatgagagagaccccctgcccagtagagcaggggacacagacttatgaacagacaacttcagtacaacttggtaagtgaacacaagagtagaggtgtgtgcagagtgctctgggagtgcacaggccttactaacctaaccaggcttcacagggaaggggtaggcagaatgtcaggagcgtatcaagcaataagagggatatgaaaaaatctgtataacatagaaacatatataagcaaagccctcaaacagccttcttattttgtattttagggacacactaaggggtagagtctatagaaaacaatgagtaaacaacagtgtaatgaacttttttctccctcctctccatctgttgtggttaactggcacatgttccctagagcttctaatcaacagtctgaaaactaagcctctctatgtaacagggtctcaaaatgtctctgaacatggaccttcattggcagaacagtattctctgaagcttcatgatcttctgtagcatatcctctgggaattgcagaagattgagcctctaataactggttgggcaggtgtatcaactttttcaggaaggattatttgactacagagtttcacatatcctatcattaaaagttgcactctcctatactgtgttgctatcttaacatactgtaaattaaagttataatttaaaagtgttgaagtgcattttaaaaacagtaaatattatttaaatataaaggaatctcccaccccattgtccagttttttcctttttttcttttattgatacataatattctacatatttaagaggtacatgtgaatatttgttacatgcatataatgtgtaatgttcaagtcagtgtatttggggtatccataccttaagtatttattatttctgtgttggtaacatctcaagatactttcttctagatactttgaaatatacaatatattgtccattgttggatgaatagtttgcaaatatttttcacagaattggaaaaaataatcctaaagtttgtatgaaagcaaaaaagagcccaaatagctaaaacaatgcttagcaaaaagagcaaagctgcacgcatcaccttctgacttcaaaatatattacaaggctatattacaaaacagcatgctgtcggtatgaaaacagacacataggccaatggaaaagaatagagaacccagaaataaagccatgtaaataaataaataaagccaacagatttttgacaaaggcaccaacagcatacagtggggaaaggacacccttttcaataaatggtgctgggaaaactcaataagcatatgcagaagaatgaaatgatttttgtatctctcaccatataaaaaaatcaaatcaagatgaattaaagatttaaacataagacctgaaactataaaataactggagaaaaacctagggaaaactcttcaggacattggtctgggcaaagattttatggctgagacctcaaaagtacaggcaacaaaaacaacaatagacaaatgggaccatgctaaatttaaaagcttctgcacaacaaaggaagcaataaacagtgaagagacaacacgttgaatggaagaaaataaagcaatcttttcattttttcaagtgctagtttaatcagtcccatcagtactgtgggtggcactgtgaggacagggtgaaccttagggttatttttaaatttatttttacttttgttttttgagacaagtcacccaggtgggagtacagtggtgcaatcatggcttactgcagcttcaacctcctaggtaggttcaagcaatcctcccacctcagcctcctgagtagctgggaccataggcacatgacaccatgcccagctaattaaaaaaaaaattttagagacagggcctccctatgttgcccaggctggtctcaaattcctgggctcaagcaatccccccacctaggcctcccaaagtgctgtgattacaggcatgagctactgtgcctgccccgaatctttgggctagatgttgagtcccagtgacaaataattgcttgacatcactctcttgtgtagacatcattgctgccaaagactttttgcctcctaaaatgccttaattatagcctgattaggtctgaccactataaagtctgctgcactttgggtgcatgatttcctgtgctacatagagctctgctgttaaacaggctcgtaaagaaccctcccggacagcttctcaggcccaggtttcttttctgctgtgctttattatctcctggggtggatacccgcctgcctgctctcgagttgcttccccagacccagagtttggcagtgctttcctggcagaacagtcaaccttcctgttacctcaaaccaggtaggggactcagagaagccagacgcaaccccttgcagaggagcatacacctacccttgaaaagcagactgtttcacctctctcataccaattagtgaatgatgggatacgcatcaaggggaagagtgctgagagaatcctctcaggaagtgaactgaaaaggaaaccaacaagggttgagcatgttttccaaatgacaggattctgttttgtggggagtcatcccagagctggaaaagatgtcagaactatgagagaaggtaagcaagagagtgagtcaagtgttttcaccatgggttcaaatggatgtaggcagaactaccttagaccacactccagctttaatctcttgcttaaattttgctttatactcctttcagaaagtttctatttttaattaattttggggtacgtaataggtgtttatgtgttacatgagatgttttgatacaggcatgcaatgtgaaataatcacatcatggagaatggggtagctatcctttcaagcatttatcctttgagttacaaataatccagttacactcttttagttattttaacatttacaatgaaattactatttactatagtctccgtgttgtagaaggatggttaccagaggctgtgaagggtaatctttctaatttttcttgtttgcaaaggggagtttgaaaaccaaaactcaattgaatgtcagggagtcagttgaaacatatgaacactatatacccaccataatataaggtcgtggcccaggctgcaattttcaagaaacaaaaagtgctcagcaatcaagctgaagctgacacaaaagaatttccatagttgagatcccctacagatcccacaggggagaggaacaagtagcacttaattgagagttccctactcaatatagctctcattaggtggtcagcaattgaagtgtaatttcaacaataaccaccctgggaggtaggtgttattattctcaccattaaacaaataaggaaacaggtttcagagaggtgaagtgacttgcccaaggtcacactgtcactaaatggcagaaccaggatttgatctagtgccttgcacatagtacgatttcagttcatgcatattggaatgcatacatcaatgaaaggtctgtgggacaataaaaatccaaattttttacttgtttttgtgtgtttctgacgttttataacagaatgttttaaatttacagaaaagctgaattttacattaaacacttatatatacccatcacctagattctactaatctattcctgctatacttgtttcatatctattcatgtattgattttctctattcactcatcaatattattttctgatacatttccaagtaaattgaggacatcagtgcaggtccccctaaaatttcagcacgtgtattatttactagagttcaatgtttgtttacaggtgttcttttccttttgaggtaaaatttacagacaatgaaatacaaaatctgacgtgggtgagttttgacatcccatgcacttgtgtatccaaaatctctattaatgtatagaacactaccatcaccccagaaattcccctcatgtgtgttggttttaaccatgctgtgtaacttccttacctgaaccagaatctctgttggtggttagaagtcattgattctaactgggaggctgtgttgagatctcttttctttccttgactgatgctttgggagaaaaccaggtggcatacaataagatttggtcctcagtgcacttcactttgataagtttcacctggaagcatttcttttccttttcagcaaatgtttgtgaaaggttgcccattgattgcagcagttaactttgtcggtttaaactgaggtgaaacaatgactatttgttgtaatttattttaatttaatgttactaaggtataagggctagcattaagtggtggttctttacagcagggactctttcatctgtgtttgtttaaaattaaaaataaggctggtaaacataaaatgttcctggcttggtcctagagtgagctctagtcagttccttgagacttagatcaaggctaagggcgaaaacagtcacagaatactcagaggagtgtgtgtgcctgagtaggatttagatgaaaaacccaaagggactttggcttatttgaaagaatcttatcaaagcagacaggctgagttacctttgaaacccaggcttcaaggaattgggtgtgtagtaagattcagactattccatgacccaggaattgtgagatattttttatttattttttatatgtgtatacatttttaaaaataatttcaactttttagattcaggaggtacatgtgcaggtttgttacgtgggtgtatttcgtgatgctgacgttcagggtacaattgatcccgtcacctaggtactaagcatagtacccaatagttagtttttcaaccctcgtccctctccctctcccctctggtagtccccagtgtttattactgccatttttatgtccatgagtacctattgtttagctcccacttataagtgagaatatgtggtatttggttttctgttcctgcattaatttgcttaggataatgacttccagctgcatccatgttgctacaaaggacatgatctcattctttttgtggctgcgtagtattccatggtatatatgtatcaccttttctttatctgacccaccactgatggacacttaggtggtttccatgtcgtagctattgtgaatagtgctgcaatgaacatacaagtgtgtctttttggtagatcaatttattttcttttggatactcagtagtaggatttctgggtcgaatggtagttttaagttgtttgagaaatctgtgagagttattataggctaaattagcagagatactgatgggctagtgcctgcccctaccaaacatgcctgtgactttgattcttttggttaatattattgttgctggttggcaatgtgagcatcaccaggaggacttctaattcagagatttttacactgtagcattcgtcagcatcacctggagggattaaaacacagattactggcctcacccacagagtctgtgattcatttgacctagggtgagtcctgaatttctaacaagctcccaggagatgctgatgctactggtccaggtaccacactttgagaaccactgctctgagtactgaatgaatgaatgtataaataggatcccttgtgccagacacatttcttcccctctataaatatggcattatttatgattcagtgaggacaggcatgccccttagctccagctgcattttagagtgaagagattctaggaaagacacatagactactccttttctccaacctgcacagcaggaatttcagtttgtactggacttattatgaccctatcttttcacagtcctaactgatcttgctgcatacagggaaagaatctaggcccccaaccacatggcatagttttaattaactcccttctgtgttgggaccctcagaagagataatatgtggctatggagaccatacacccagatttcctgggacagctctgatttcatatattctatccttttgtcctcataaatataattgtcagaccatgttctgcttttgggttcagaaaatattgttcccatatgcatggcctaggggccctgtggagccaaaagcaagtcttcgcttgctttcttgggattgtgggggccagggcaaaagcttggctcattgtgagggatagaaagttggggagaatctaaatgtttaagatcaccagcaagcttctcgttgcttctttcttttcaagtgtcccagtgaccgtgttacagatcccggaatgttgcaaataagagattctgagtgctgaaagggactaaattggacctctggctgcctctctttcctccgtcccccacccctctggaaggaccacacagaaatagcagagaagagccactctaaagaaggaaattccacaaccttcattgactgaccactcagtctaacatttacctattttgcctggcaggaagttcttcctccttgcttatatcagtccttctcgttgcaatgtcagtttcttttcctttgctctgctttcaatcaaaattgagaacagctggtccttccctctaaattttttttatgtgcttagaagtcatattaaaccattcttcctgggtccaggtttaaccatccttggagctcctttatccttcccgcatgtatctgacttgccaaccatttcatcattttgccataggaaagcagcttaggcagcctgggcgaacagtacagcaaagcctaaagctttatggcttgtgctaatgggcgtgctaaatgtttagtagagactatttttgagcacgcaattgtgaacaatttaaagtggaccgtacatggaacccatttcctctcctggctcccccaacagggcctccccttagcagctgaaatgagttagtggcaatcagcgcaaagtaggaatcctgtggtttctgcccttccctcctgctgcttctatggcagctagtctcttaaaatgagcattctctctagaatagccagtaaatgtgacattggaatcagttggacaaagggtctaggagtcactttagctaaatagcaggaggtgctagtgctgaagcaccactggaggttttaggagaggttgaggggacagggttgaacagcgattgatgaaagagtttggacccagaatatttgctatccacagaacggttgtacctcagagttgtacatgccttttttgcaagtttgtagaggacgtttctggcctttgttcacttggcctttgtccactgtctcaactatgctaaagtgatgccaggaatctgtggcagaatcccagcttcagggccagttgggttcctaaaagagaggagggtaacttgccatgcatgggattcttctgtcaggcaggctacctgcctttgatgggatatgttctttgattactcaagtgatttgggagggctgctgccttaagttggcctgcagggtgggtccagggcccatgttagggtgaattggatatatctgatggcactgcagagaaaagggatattgtcctgttctcatcttctgactgttggctcctctgttttaatcaaaccttaaaagctcttctctttataagcaccagccaggcagtttgtctcagcagagctacaggagcacttaatatatgcagccataaagaagaaggaagaaaaagagacggagaaaaaaaaaacctttggcatttgtatgagagtgtcactgaaggcttcatcacagatacactcaagacttagaaactgaaattgtcttggggtgggggtggggagagcagtttgattgaagcgttagctgccttggccctgagccaaggcaaattgccagagaaccattaaactctgtgtaattccatataactcacagcagccacaggtaatctgaatcagacctgacaaaacttcactatcacttattgtccattagcactgaatgcatgctacagatattaaactttttaaagccatatcatggtggccatattttctaaatcccaatcagaaaacctggcttgacaaaggatttattttctgacttgtgaatttgtttatatgaaaagcctcacaaaaggtataatcactaactcacagaggtataaaatactaaacccactgaacaaatggtttttaaggaaagaactatagttgcatgaaattgggtcagggcaaactcatttggacattgatgagggttccccccaccccacacatactttttgggggtctgagggcactggttaacgaagcactaaatcaaattagaatctggtttatgcccatcatctggatttgctcttaaatttttcagggatggtgaactgaaagagcctgttgtaatgtctgtacacacgaaggtggagtcgatgttactttgaattcccagatggtgggagtagttaaatatcccactgttcatggtctgtttgtgagggcttgtgtgtgttttaaattaacttcctaaggcagagaatgttaaaaactgaggagaatcatatctggatacaagttattattgccatacacctcagtttccttaaaggctccattccttccactaaattgagagtctaacattcaccctggggcacctcgtgacaaatgggatatttagctcaaaggataattattctggattattctgagccaataataatgctttttacaaagtttaaagtgtctctttagcaagaactcttagtattgctagttaaggatcatgaatagcaatatacccgtgaaatccaaaaggttttgtcacaaccttgcagaagaaagtatcttaaacctaatagatgctctatcccgggcaagtcatataatatccctgaacctcagttatatgaaaaacaaagtgaaaatattgttacttctccagaatcagtcaaatgaatagggtgatatcctgagatcccttttaattctaatttcaacaaatatttgttgagcaactacaatgtgttcaatacagacatttattttcctaggtgccagtgacagagctgtataaaggcattgactatctcccacactataatgtatcttgacagcaagtaaacatacatagaaataagtgagatcatgtaagatggtggtaaattctatgaagacaataagacaggtaatgtgatagagagtgatgagatgtgggtagagaagagaaggaacattctttatgtggttggtcaggaaaggcctctctgaggaggcaagatctgagctgacacctgaatgataaaaggaggtatgtaggatctagaagaagaatgttctcaacagatagaatagtaagtacaaagatcttgagatagggatgggcttgacctctctgaagaacagaaagtttggtatgacgtgtgtgtgtgtgtgtgtgtgtgtgtgtgtgtgtgtgtgtgtgtgtgtagaggatgagaggttgtgggaaataaggtcaaaaaggcatgcatggccagatcatgtagagcttctgatctgctgctgtttacattgtaaaaatcattctttggtctgtctgatttaattaatgaatgttagtaccagatgttaatgacaggagggcttgaagtttgcccataggaaacccaaggagagggtctgggtgtggagtaggggggcagaaggggaagatgaagtagaaaaggcgagctcaaatgccttgttggcagggcagggagaggtgggagtggaaaagataatgtgtagggagggttggaaaaagtttgagggaggaggaaaagcaccagagtgacctcggctgtgaggaacaccgtcagtgccaaggttgtggagtctgctatcagagggggtcaacctttataggagaagggacaggactgtactcttgtttaaagttagaagagtgagaatgagcaggaactgaagctaaaaatctggtcctctctttttatccagccttaacttaaaaagcaggtctgatgtcagagagaatggcgttcacattgcttgccttatttattttccaggtcttgaactcaaatgcctatcacttcctcctgcattttcttctcaacttaatcctgtcattgcaaaaggaaataatctctgatgcaagagtcccttcccgccactaacacataagcaattgagtgcattttttttcttttttttcagttgtggaaactcagttttgttttatgttatttggcacgttttgttgagtaggaaagagatggtgtgtcatttctcagtcatgatgtgaacaggacagtagcttggaacagactgtgtgatggctcacttattcccagatttgtagcactatgtgaaagcagcagcaagtgtgctgatttaatataaaatgggatctgtcctaggctcagtaaaggatgttattattattgcttttgcaacatacatgtatgccttggtaggttatttatttgggagctgtttgctttggtagcagttattcataagggtaagaggaagttaaatctcttttctcctcctccacctcccactggtcagaggtctaagtggagaccagagattaaaattactgccaaggaaagggggcctgggcagggtcaaataatgttctgggagtggcatgcaggtgcccacctccgggaaatagaaaacaaaccccctctcccttcgtccacatctgctggagggtatacaggctcctagtaagctggacaagtggttttcaggcagcaaagcaggcctagtagtttccagaggcagccttttgtccctaccccgaagggtgtttagtccctgggtccttttccagtcagaaatgactaatgttggctatgtgtactctttagaaactgtctttggctttttgcataatggattataaataaatggctttagagaaccagcagtgagttattgagtgaacctggctttgggatggttcagattccagatagttaatcacatcctcttgggctggaagactgtatccaactcactcacattcagtaggcaagttaaaaaggcatttttgatcaacttgaaaaatagttttcacatcaacaatggcttgttactgaagaaataaagattatattaatccaagtagaattattcccatcactctctaacagtctggtggaatttaacacacctcttgttttaatttggccatttcttacaagtattaatgcacagtttgaaaatgacaatgaattgatatgtcctctttatagtgtttttatattaggcggtaggtaaaagactgttggtcttttcagcctcctaaggctcacctgctagatttgtacacagtgctctcttaatgctggaggacattatggactttctggtttgtcctagactattttaatgctatacaagggtaaactctgttgctgacaactgcttctggaaatcaggagcaaattcacttgcactctaccatattcattcctccggtttgttccactctggttctccctgaactctctccaccacatcagctttgcaaggttctctgatcatttgtatcactgaaagtcatatcttattagacagtcaagaaacataggcaatctaacaaagagactgcattagtccattctcacactgctataaagatactacctgagactgggtaatgtataaacaaaaaaggtttaattgactcacagttccacatggctggctggggaggcctcaggaaacttacaatcatggcagaaggtgaagtggaagcaaggcacgtcttacatggcatcaggtgagagagagcgtgaagaagtgccacacttaaaaccatcagctctcatgagaattccctcactatcacaagaacagcattggggaaactgcccccataatccaatcacctcccaccaggtcactccctccacatgtggggattacaattcaacatgagatttgggtgggaacacagagcctaaccatatcagggacagtaatggtgcctgaggaaaggctagttgcctgtgtgacaacagcctgatgaagttcagcttctaggagtaggtgtcacgaactctggggaccgtaagaaagaaacatatctgagattgacatgaactctggggaccataagaaagaaacatatctgatattgacaagaggagtagcagtagatggctccaacattggatgaggaattgattctatttttataatatgtcaagacaaaaattggctggagattaaaaatggaatcaaatcattaagacttttcacctttacctgtcaactggtaaaataaagtgttgttctttattttcattttttactgaaatcctctaccttctaagaggtagggaggatgaatactatctcaaagcagacaggaacagtgggtagattaatagattatagccctattgtgaaggctaacgttttaagagaaatgttttgccttgattaaaactatgagtatgtgaaaatgatgctggagtcttggtgcctacctcagaaatataagctgaatagtctagaattaaagactaaagaataaagaataaaccatcaggtctcgtgagaattccctcactatcacaagaacagcattggggaaactgcccccataatctaccctctttttccttgttggtatctcttagaatctgatctaattattcttttaattctttcttaaattaaggaataatttacatatagtaaaatgcacaaatcttaatgaatgtttagttatgtatattcccatatgatctgcagccagataactatgtagaacatttctagcaccccccaaaaattatgctcatctgcctttacaatcagtagtacagagttaaccattttttcaaattatcacctctcttctttaccttcatataaaatgaaatcatacagtatgtgttgtttttgtctggtctctttcatgcaacataatcttttagacattcattttattacatatattgcttttttttgactgctgtatagcatgtcattttttgtatgtgtatgttttgaaggacatttgggttgttcctactttctattattaataaagctgctgtgaacaatcaaatctttttatggacacgtgcacttatttctcttcggagtctctaagtatggaattgctggatctgagagtaggcatacagatttccaaaatggttgtacagctttatactcctgccagcaacgtagagagatcaaattgctgtacattctcaccaatacttaagtctttttaattctggccattctggtggatatgtagtgacactttactataattttaaatcacatttccctaatgaagaattatattgagcaccttttcagatgcttattgggtatttggctatctcttttagtgaagtgcttgttcaagccttgccaattgttaattggctatttgcctttttcttattgatttgtagttcttttaatattctggatataagtcatttgtcaggtaatatgtattatgaatattttcccagtctgtggcttgtcttttcccttttttagagctgaagattttttttattttgatgaactccaatgtatcactctttcctttatgattactaccttttgcatcctgcttaaaaaatttttgcccacctcaaggtcacaaagatatgctccatgtttttctctaaaagccttatgattttagtcctctcattgggtctgtaatccagctaacatttttagtaaaaatgtacatcagtaaaaatgttttgagtatgtgtccccagtatacacaattttatttatggatgatctaatttattatcaccaatattaaatattaataaagcttgatttttaaatttttgtagatatataaacagaagttccagtggatcaccttgtacacagcctgggatatatgtaccccattctgaacactattgttctataccaccaaagactaacatttgccacaaacactgatagcattaatgtcagaagaacacttcagtgtaaacaaatggctagaggtgacagagccccagtgagcatatctgctagcaatgtaagaaaccctcagtttactcttgtgccgtcacgtttgtctccccttaccagacttatagagacagcaggacgatctgacttggcaggagcaaagacaaatttgcctttggttgctgacataggggacagtgctcttgagtcttcttcccctgtcctcaccaccaaattcctagagctggtggcactgggctgagttttggcaaagatgcttagaatttgactggagctaatccccagggaaatttaatgatttggagcttagacggcctttgttgtgaggattagtaaactagatggtgattaagcagctggggaggaagaagctgtctgttgggctaggtcatgctgtggggcacagcgcatagttccgttggctcaaggtcaggggagcccttgggcctgattcacagagctttatactctggggcagctccttgtaggatttgggcatctgcttattagctggtagagggaaagaatggcttctcccttggtgtacacctcttccctctatccacatatagggattactcctttgaatcaggtctacttacatctttttaattggttattgtttttcaattctcattgaaaagtttttgttgtctgttttgccttttggaaaactggtgtaaagtacggaagatgaaattaggaacagagtttcttggttttctaatctagactgcttcggaaatttgagagcggtttttaagggaagaagttgctgaaagagacaagttaggtattgaaagccatggcaagaagactgccgaggtttgaaagcctgtatctcccatgtccagggaaccctgattaatttctcctagcatgatcagattctaagagataccaacaaggaaaaagagggtagattagaaacagcccccaacctgtggtttgcttaagatttcaaactaagtttcagaatgagcaagcactttattcattctttgatgctcctacttcttaatagttaaacttcccaaagccagcttaaccctagctctacatttttctattcgtttcccagaaaaggccaaattgatgaacggatgcctggagtgttagtaaaaacttgaaaatctttctaagatgctaaaaagatattcggaaggtatattctttctttaaataactggactacagtattctgagtggatcttttctgtctatttgcaaaaacaataaaacaaaaacaaaaaaacaaacacatcaatttaaacaattatgttgtttgccttctttagatgatagacaagctggtggaggtagcagtatgggctggtaatttggccagaagctcttggaactgaccaagaaagtttcagttgatgcccattttttccaataaatttcctgtagcaggcagaggtattcacaatcatgtcactgatttttaatgctgctcttacactattgtaataggtgttcagtacctgtcagttattgctgcagatggtgtttctcctctgaatgcatttttaaattataaacctgatttaataattcttctattccctttttcatctcctaaatgtattcaaagacccaagcaagtatctgttagtatctgactaaataaaagctactagaaagccagcaagtgctgttaagtcaattgttgtttgcctttactctcaaggggccaacttgtcactttgttgacagctatcagagtacttcatgcttcattgaagacccatcaaaaatttccaaattgctagctcattagcacaaaatagggcttcaggaatctctttctctcagtgtcctgactgggccttattaagtgttccaaccttggtggaccactctgaaacagtggataaagaccaggggaattgagagatggatgttaattagtcaattttgaaggagtaaaacatgggtgaaggcagagtacaatgggacaaaaagctgagattatctgtgtcagcagaaggataatgcatgactttgctaactgttcacaggtcactgaatgtcagagctgaaaaggcccagagctgtcagagccccaggagatcatctggtcagtccctcttacacattttaccagtaagagaagagaggctgcaagaagggaaagggacttgtccaaagtcaatcagctcttcctagctttccaggcaccacctggcttttggttatatgacctctatgtaatcaattttcaattacttgggccactcactgctagcccagcaatcacttgggtaatccaaaatgacacataagttaaccatcgtttacattgagctttgtgatgtgtgtttataccgacattccaatgcatctgggtctaatctgagaattcacaacacttcaactgaaacaagaaagccaccctgaaggtctgattcaggaagagctggaaagcttactgaatggatagcatcatatattgttatacagcccctcaaacaaggtatgttaatttcaacaagtttgttgattcacacctttccagggccccagccagagttaggaggaggaaggtgggaaggggaaaacaaaaccttttacggaagaatatgcatatcatctttcgcccctccatcccccttcacccttcctctcattcatttttccttccttccttcctttcctttttttattgatagaaacatgaacatctgctttgtcttccatataaacaaatatgtggctgagacattgacctatagaactggctgtaaggaggccagacaataaatagaagacgtgctagacctcagaaatctagaggtagagtggggaggagaaagaccagtgagcagtaatttaaaaaggaccaacaagtctggaagagtatagagtccattgcacagctcagtaaataccctgggtctggaaaagggctagtctgggatatagttgaagggatcttcaaccaaatggagtcttacttcctgatctggacccttctgaactcttggattatgctggggacccaaaatttgctggctttttgtctgagcatcttcagacttgcactaaagtaggattatttcacttaacatatctcttaaggaggaggatgctggtgactgagaaggggcatggaacagaaaaaaggggtatgaacagttggcctgatgctgtagtccaagaaggagtctgtgcaaggactcagatagtggcagctgaaggagcagtaaggaatgccaaatgcctgagcttttgctacagcaataattaagcattttagtttaaaaggttttccccttttatcttttggtctagaataaacagagatcttgctgctgtaacagagtgtttaattaacgaaagatggtacttaatacatattgaggggaagacttgctatgggtaacagtaatatggataattaagttgtatgaattaaaaacaatgggtagagtgaattaagactaatgtacatcaacagggaaaatctattagcattcattagttagacttctgtttgtggttctttgttagcctcgggaaactctttcaaatggctgatccctgttgaaagttctgactggtgctaagggccttctatggatgccaaagtaatgagtcattcaaatagaacttctgaaattcaagtacagcactttccttttctctctctctttttttcttggcggtaggcagcagtgactgtgaagtaataatgataatgacaatggaaataagagtgtaatcctgtttaatttgcttagagttgttccccatttaccaatattggcttgtttggtgttgagtgtggcccgggtaccggaacaaaggcatatatattcaatgtcacttggctaacctatgatttgtcagacaaaggttaatttttttaaaaaaaagttggattagcagcaataaatgtaataacattctgtgatttaactcagaagttcaattaattcgatggagtttaaaaaatcctgaacttaattttttctctgcactcaggaggtctcatctgccaaatttgcacatgagctggccaacctaaagctcaacaatattataacttccatggtgtggggatagatggaggagacattataaaagactgagagagagattggaacaagagtagaagtgtaaaaatacctccagtgaataccagcccttaattgccccatttagaatctgccatcccctaaggactatacaatttaattatccttacgttccctttccctggaaacaaacaaaaacaactcctgattatatcagtgagttggagccttttttacctgaccgtcttagttgataaacaagctgtagacaactaatttctgcccctgaggctagaaattaggagccttgttcatttttatatctctagcatgtagcatgttgtcctgtacataatagaaatgtgattcaatacttaaggaatgattaatggatggatgagatgactcctttcatggattatcatggatggaattgatgttctaataggtggaaatcaccttcatggtaaaaggaatgtaataaaaatgaatgtataaaattagccataagcaaggacccccagagacattctgctttgctttgctttgcttttgcctgccccagtggctattatttctgcctttgctttcaatacccctcagtctgacaatcttcttccccagattgccctggttagtggaaattctataggctgtgttggaacagtaaatacccatatttccagctttctctgaatgctcactgtgtgtcagacactagaagcactgtgctgggcacatgttgaagagacatagataaagaagcagctacattgtacctacttgtatcttttgaatttgccattctactcacagaatgttgaactgtaagccactttccaggtcttcagagtcaactcccttgttataataatcagagctcatgttaattgaggacttactgttctcagatatatactatactaacaactctgtgaggtagctagtcttgttatctacatgtcacgtaggagggaattgagacacagatgttaagtaacttcctaagggtcacacagctaggaagtagcagagccaggattcaaacttacgtttgtcagacttcaaagcctgcccaaagataggaaagagcttaccaaaggtcattttgatggagcctagctcttctggctctaatttgtctgcacgttttggtaggccacgctgctgctttagccacatagtagggttcattccaagcatcagtttcgtatttagaagttctagtcttcccagttggactgctcattcctccagtcagggattgcattatttccatgttgcctccttcctcaaaggtttgcccaagctttgccttcagtaaataatgacctgtgatcagctcctgagctactcccaggagctgcctggagccattccccagtactacttgtggctccagggttggaagaaacaagtagaattttggggagaaagtcatctcactacctgctttctgttttgttctctgcaacacagattgaagatggaggcaaggcagctttgtcccagaagatgaggactggtgatgagctggtgaatatcaatggcactccattatatggctcccgccaagaggccctcattctcatcaaaggctccttccggattctcaagctgattgtcaggaggtaaggtacagggagattctccgtaaggtgcagaggccactgaaacttggttggtaataaagctcaatagagtcatgtctctatcaatattataaaggaaagaggtgtttcacttgaatagaattttgcagacaactgaagcagaatagcacaggagaaagagcctttggttcaaatcctggcactgccacatagacacataatcttggatatatttattagtcctctgcaagactgtttccttatttgctataaagaggactaaattactcattatataccaaagggctacctaatccagtgtttttcaatctccttctttataatacactatcattcctgaaccacatatcaatggagacttaaagagcccctactacagccatggaggctgtagcaaactcttagaaaccctttccttgaggattgcacagtctagcaggggacaaaatatacacatgtgactaagtagcagtatatttttaaagaaggcaataaagccttgtgtgtgattatcaaatggattgttcagacaaaaattgctgttagagaaagagatcactgcagaaggtattgatagggtaagacttcatagaggaagtggaatttaagctaaagggtgagtataatttgaaaaataaaccatcagaagaggaagacattgcaggtaagtgcagtggcataagcagaaggaagggaaggacatatttgggcacagtcattctgctaccaccaaaagcatctgcctattggtgaactttccacatggcttttctttcattttgctgctgcgcctttgctttgtattattggagctcagccttctccctttctattgtttttttttttctttatcgtatatacacacctaagtttttccatcttgcatcttcccacaatctcacttctccctctggctcctgccccgtctttctccttttgttcatactcagtctcaaaggaagagtctatagtcactatctccacttctccacctgccatttagctttccaccctctgcagccagaatttgaccctcagaactccactgaaactactctgtcaaaagctacaaattattgcctaattgtcaaagtcaatgggttatttttcatattcatcatatatggcatttaacattatagctctagattttgcccccaccttcctttatgaaactcaataccaaaaatctcacacagcaactcaatagcaaaaaaaaaaaaaaaaaaaaaaaaaaaatccaacttaaaaatgggcaaagacctgaatagacatttcttaaaagaagacacacaaatggccaacaggcatatgaaaaaatgctcaacatcactaatcttcagggaaattaaaaaccacaatgagatattatctcactccagttaaaatggtttttattaaaaaaaaaaaaacagatgctggtaaggatgtgggaaaatggggaatcctggtacactgttggtaggagtgtgaaatagtacagccaccatagaaaacagtatggaggtttagcaaaaaactgaaaatagaattatcatatgacctagcagtcccctgctgggtacatattcagaagaaaggaaatcatataaaagagatatctgcacccccatgtttattgcagcactattcacaataaacaagatatggaatcaacctaatccatcagtagatgaatggataaggaaaatggggaatatatatacaatggaatacgattcagccataaaaagaatgaaatcctgtcatttacagcaacgcagatgtaactggaggtcattaagtaaaataaggcaggcccagaaagacaaatattacatgttctcactcatatgtaaaggctgaaaagagggatctcatggagatagagagtagactggtggttgctagaggctgggaagtggggaggttgaagagaggttgatgatgggtataaaaatacagttagatagaatgaataagatctagtgttcaatagtttggtagggtaactatagttaacaatctattgtatatttcaaaatagctagtagagaagaattcatatgttctcaacataaagaaaagataaatgtttgaagtgatggatatcccaattttcctaatttcattattacacattatatgtatgtatcagaatgatacatgtacccccaaaatatgtataactgttacgtgttaataaaaaaaaaaaaagctcttactttttttttttttgaaatggagttttgctctgtcgcccaggctggagtgcagtggcatgatctcggctaactgcaacctccgcctcccaggttcaaacaattcccctgcctcagcctgctgagtaactggattacaggcatgtaccaccatgcctggctaatttttgtatttttagtagagacggagtttcaccatgttggccaggctggttgcgaacttcggacctcaagtgatccccctgccgcagcctcccaaagtgctgggattacaggcataaggcactgcgcccggccaaacctcttactttcaagatagtcagtttccttgttattttcctacatccctgtccattttttaaaaaccaggctctttactacctgctcttcctctgaccattccttaaatgttggtgtttcccatagttccaccatttttaacttaatgtaccctggaaaatctcacccagccctatagcttcaatttattttctatatctcctatgctccagaccatataaccaacttcctattagacatttatacttaaatgtgtcagagatattgcaaacacaacatgccccaaacctaacacatcatcatcttctcccaagatcgctatctatgaccaggaccactatgtatgtactcagccaaccaagtcagaaacacagaagccatctttaattattccattatcctcatgttctatatccaaatgatttatcctgaagagagaatatttaaggagaaaggctttggacctaggaagaatgaggttatgtaggatcccactgacttctattacctgctggtacctaagattaatccatacctgcccatgtacatggataggaggtgacatgttaagtaatgccttatataatagatacattatcactgattaaatcttggattggtcaagatttaggtcttaaataaggcttcttggaggggtaatttggtgaatttggaagcgtttttgttttggagttagatattcccatgtttgcaacttcctaggtctcttatatgacaaataataattcctatataatggcattattgtgatgattaaataagataatttatgtaaaatgactgtcacataatgggttgtcagtgaatttcattcccatttgtttccttagggtctaaaagaagcataattggaataaacaaacattgttaaattgggagagcatcagaatggtggtgtgctttgcagcctaacctgcagagaatgatgtgctaaggaatcattaggggtggcaatgatctgaataagaaataaaggcccctgtgagatgctggttgtacagagacaccagcaacttagagggagtgtgaacactatctagagtgtcttctgagccagtcacaagaatgagagtgttcaggtgtttcacccactcatctcgccagggtgagttccatgtcctctttcctcatactgtagcaacatctgccactatcagtcacttaggagtggctataattatgggcttggactagcagggccctttggttttcatggtgtggcaggtcctatggctcccggaacctgtattttctacccttttagcctccccatctcagcccctattggtgaaggcttacaatgacataatttattaggtgatgctgccctcttgtggaaaacttaaccttcacatgtggactaccttgggcacggtataggaaattaattccctctcgttcagtccaaatttttcgtcaactttatgaaagagctcttaacacgtaaaagaagtgtgattaccctaaaatttgtgaatattcagcctagtgttttatacaggtagaaagactttggtttgagtaaacaatcagctgacaaagatccaacacttagctttaggtctgggcttgagtccttttgggatgaatataaacagaaggaactttagaacatggccaattctgaaaagccaacccagctcttcttcctatattgctgtctagataatggtcagctaaatcagaaatgtaggtgtcaccctcaactcctctctcacccaattcaattaattccaagtctacatagacctcttggttgcctttgtcttaatccagccactcatgatttctcacctggactattctaagagccttcccactggcttctcagctttcagtctcactttttcctaatcaatccattctccaaataggtatttgagcatgtcacttctctattaggaaaaaaaaatcaggaacaatgaccacacaaccatgttgatcccaagatattcattttatattgattgatgatacaaaccgtattgaagatattatatttatgaaccattttttttttgcaaaaaacatggcatccaaatatataaagaaaaaactgtcagctatacaaaaagtgatagaaacttctgtatgggagagtttaacataatttaattgacaataaagtagaccaaaataaagtacttagaagatttgaaaaacaattcattagatccaattaatacattttgaaaattgtttatagactgcatattgtctcttcaaatattgagataatatttttaaatgatcatatgtatgtcacaaagaaaagctttgcaaactctttttttgagatagagtcttgctttgttgcccaggctagagtgcagtggcacgatcttggctcactataacctccgcctcctgggttcaagcaattctcctgcctcagcctcccaagtagctgggactacaggcgtgcaccaccacacccagataatttttgcatttttagtagagacagggcttcaccatgttggccaggctggtcttgaactcctgacctcaagtgatctgcccgccttggcctcccaaagtgctgggattacaggcatgagccaccaagcccagcctacacacgcttaagagtagaaatatctgatgataatgtacaatgtttacaatttaaaaacaaattttaaagtcttcaattacttgaatattttagatcacatttatatgtgaatattagcacaaagaaacactagcagactaacaaacaataataaaaatgagatcatgacttaccaaaactttgagaatattcagaagtaaattcataaccttaaatattttattattaaaaatgaagaatgaaattaaatgactaataattcaatataatatgaaaccaaggactaggtttcttttcagagggatgaattaaatagataagcctttagcaaatttaatcaagaaaacaaagatgaattaccaataaaatttaaatgacaaatggaatacaacaacaaagaaagattttttaaattaaaggcgcactactataattgtaccttaatatatttgaaaatctcagagaacttaaaaatatctaataaaatattaaatgccagaaattattgagaagttgaaaactaaatggacatgtaacagtagaaacttcgaaaacaattatcaaagagaaacttccaaaaatactttagggacatctaaaaatactttagggctttaagggacagatatttttatctgtgaattccttcaaattttctagaaatagccacgtttaattctataagtatgttatagtattgaaaatgttgcagaattattcacattgtttttgaagctagcattactctgataccaaaacctgacagactgctctaagaaagaatattctatccaatttgtgaatttagatgcaaaatatatacatggaattctatgaaatctaattcaatagtataggacagtaacaattcattacaagtattaaaataatttttaaaaggcaaaattttgattcttacgtagacaaaaaatgaacatgttaaagattgtatttcactcattaatgaggaaaacgtaaagtgttacaaccagttcaaaggagaagtcaaagagtaacaaatttaaaggtaacaatagaccacagtaatcaattagaagctatatggagaaatttatgtcattcgtaatgggaacaaactcataagcaatcaggaatgcccttaagaaatatgcatgaaagaaagaggttgtgtatggaggaaattacaaaaatgtacagacagagaaaatgaacacaagtaatttttgatgatgtgggtaaagtcttagggtactgtattactttttcttacaaaaaggcaagatacaattgaatgtacagtatattgacatattctggtttagccatgctctccatagacaacttccgaaccatcattcctccaccctcatgtaagattcccttcatttttgaagctcagacaagcagggattatcactctcatttccttaccaatgtcatttatcagcctccaggttattctttcacttccattttttaatttattttaactgatacatagtacgtatttatggggtacatagtggttttccaatgtgcaatgtatagtgatcagatcacagtaattagcatatctattatctcaaacatttatcatttctttatgttgggaacattcaatatcctttcttctagttatttgaaaatatataatacattaatcttaatgctggtccaggatctagataccaggttcatataataaaaactagattttttgctttttgatcagtgtacccaaaattgatcagttatttaaaaacagtctttcaaatatccataatcataataaactgaatggaatgtcatatgccaatttaagtgaccacgaaaaatataactatcaagaaaaccagttactcatagttcctacttccctacatgaggatgtgtaaaaaaaaaaactcctgagtccttcctatgtgtcatagagtgtactaggtgctgagaacgcaacaatgaacaagcagcccctgtcctcatggttctagtctaagggtcattttttttcctctatagagccaaataaatattttaggctttttgtgtcacacagtctgccacaactcaattttgccattttgtattatttaacaaatctctgtatatccctcccttccccctaccttctcaccctctagtaacctctgttctactctttacttctatgagatcaatatttttagcttccacatatgagtgagaacatgtggtgttcaactttctgttcctggcttatttcacttaacataacgtcctccatgttgctgcaaatgacaggatttcattctttttatggctgaataacactccattgtgtatatataccacattttctttatccattcatctgtttttgaacacttagattgattttatatctcagctggatactgctgcaatagatatggggtatagatatctctttgatatatatatacacacatacatacatatatgtatatattttaaatggttggtggaaaaaagaatcgtatttcatgatatgtgaaattatatgaaactcaaatgtaagtgtccataaataaagttttattggaacctattgatttatgtactatctatgcttctttcatactaaaatggcaaaattgagttgtggcagactgtgtgacacaaaaagcctaaaatatttatttggctctatagaggaaaaaaaaatgacccttagactagaaccatgaggacaggggctgcttgttcattgttgcgttctcagcacctagtacactctatgacacataggaaggactcaggagttttttttttttacacatccttatgtagggaagtaggaactatgagtaactggttttcttgatagttatatttctcgtggtcacttaaattggcatatgacattccattcagtttattatgattatggatatttgaaagactgtttttaaataactgatcaattttgggtacactgatcaaaaagcaaaaaatctagtttttattatatgaacctggtatctagatcctggaccagcattaagattatgaaaaggaactgccatatctttgagccttgtctaggccacctgccagcctccctagctgtcctgtctttgttgttgtcataatactcctgccatctataattaaatggaaggggttacaactgttgaaacttgttaaaactgaagttgtcctaccatgtattaatataccagggataggaagatgtttacagttggcacagtgttagagaagtcctggaaaggcaagagagagaaaaattaaaataataatataaaacagaggtggggtaaactatggtctgtggccaaatctggcctgctaactagttttccaattaacattttattggaataaaagcaactggagcaggcatgctgatctatctatgtgttgtctatagctgtttttaaaaaaaaaaaaaaaagacaccaaaatggcaaagttgaatagttgcaacagacactatatagtctacaaaacctaaaatatttactacctggcccttcacagactaagtttgctggcccctggtataaagcattctccaaaaagaagaccttgaggctctctctaaagcttaaaaagactgaaagagaaccatcgtagtctacaagtgagaatgaataaaaaaatcacagaatatttaagccaacaaacatggtaggcaaactgctggattcttgagattcaattattcttttgaatttgggcaatgatgtggttggtacagggtaaaatgaatggtatatgggttcacacaagtgtgtgtttgcttgcctgcttccttctgttcacaagatatttattaaatgctacttccatctagatacggagttagctgttggggataccatggagaataacatagacacattccctgcccacatggagcttataaatctgttgtgtttgactctggcacgacccctacaggttgtgtgactttgagtaagtttatataacctcttttagtcattcttttcccatccgtatgataagaacactaatgtctcttttgcaagtttgttataatgatcaaatgacattatatacacacacatataaaatatgtgtatatataaaatatatacatatatttttcaagtcattcaaacaatattgaaaactatgtgctaagcactattttaggtattagtgatatatcagttaataaaacagatttaaaagaaaatcttgccttcatgtaaattaccttttaggtaaatatatgaaagtacctgaaacagagtagccatttggtaactgctcttttctttttcctaagtaaaaggaaggcagtacttatccttcagtactgattttagcaggcagtacaatactggttaaaacttcatccggccaggcgcggggactcacgcctgtaatcccagcactttgggaggccgaggcgggcggatcacgagatcaggagatcgcgaccatcctggctaacacggtgaaaccccatctctactaaaaatacaaaaaaaaaattagccaggcatggtggtgggcgcctgtagtcccagctacttcggaggctgagacgcaggagaatggcgtgaacccgggaggcggagcttgcagtgagccgagatctcacgccactgcactccagcctggaagacagagccagactctgtctcaaaacaaacaaacaaacaaaaaaacttcattacacaactcatagaccaggtgttattatcaatcacatagtaccctaataattgtcaatcagaatgatcattaggttggatagctcaagttgtgaaaatgactagttctgaattcattcatttctcttttcttaaatgtgcctctttgccattgtatactatttcttgatctagaaagttatctacctctcttgccaaaacaaaggccaaagtcaagcttcaatcaaaggaaaatgtactgctagagctaaaagaggtttctgtaatcaccgtattcagtgacctcattttataggtgagaagattgaggattagaatgagaaaggactttcctaaggccacacagcgacagaggtagactagactagaaccagcagcttcttcttaccagtcaaggtttctttccactgtttctgggatgtttcacatttgctacctcctctaggaagcctttctatacttgggggaaatgtctcctttctgtacctaaagtaagtttgtgattctatcctttgccttaactttttcctctgccaattcatcttttatgaatttatccacttccaaaggtttcacctctctcctggatataggagactgccagatctctcttcccagctttcccttcttcctgagctccagacttccattccaaggtgtacattaacccttacccaaccaaccccctccagtgtcctaatatctctatttcagtctatggcatctttcccatccttgtcaatcaagctcacaatagtagaatccacttaaattccctcttttattcccagcagtcaccaagtcctttctgagctccctgtgcagtgtttctaatatccatctcatctatttccttttccttcgtcctgctactgccagggactcattacctcttgtctggatgccctccaacccattctctgcacttctgccaaattaatcttcctaaagtacatctctgtatttatttcaatcagcagtaattgtgctttgggtaaatctcatgagttatgaggtctctattgtgcttagcctggctcatgtcatttcctttctcaaaaaagctccaactgcctgcagaaataagtctaaatacttcatcccagcatttaagaccctgtatagatgaatctacgtgacttttttctatccttatctttctgaaacccaaaggggtatatcttaaaagagtttacctcctcacttggacatacccaattttttcacaggtgtcctggacctcattctcctccactttttaaagaaatcttgctcctttaatttccactctccctttttcaggcattttcaacctgttacccttctcttgtcctagttttttcccctaagtctacaaaccagctcaagtctcccattttgaaaacacctttcccagacctatagtcatctttaggtattgtgctcttttttcctttcacaggtaaactattttgaaaagcaatgaactccttttggttcctgtgttacttcacctctgtattagtgtcctagggatgtcacaacaaagtgacacagactgggtaccttaaaatagcagagattacatagttcaggatactggaagtctgaaatccaagtgtcggtagggccatgctctctctgaaggctctaagggagggtccttccttgattcttcctagcttctggtgtttaccagcaaccctaggcattccttggcttgtagacatagcactccaacctctgcctccatcttcacatggccctttcccctgtgtctctgtgtgtctgtgtctatgtggccttcttgtaaggtcaccagtcattggatttaggtcctaccttagtccagtatgatttcataataactaattacatctgcaaaggctctgtctccaaacagggttgcattcaaaggttctgggtaaacatgaattttgcaggggcaccattcaactcagtacaacttctcatcagcacttaacattgttgaacattattgtcttctaaaaattttatcttcctttggctccagaaacactatgcttcccctggtttttctttgctttctcttgtctattccttttttatggttcctcttcctctacttgccccttatgtattaatattctctgaagttctgcacaagtttctctactcttctaacactgtacattctgggtgatttaattcattccatgatttaatttagcaaataagacttctaaatctctcactccatcccatacctcactcccatttataccacttctttctaggtatcttcatttttataccccacacgtatctccaaaactctatatgttaaagtcattaacttctacctccaaaccctgataaaatctgcttctcctcctgtgtgcctctataaaggtaaataattcacagtgaacccagttttttcagctccttattgctatatctaattgagcaagtcttggccattttatatatgctgaaaatttctcaaacttcttctctcttgtttgctcactgcaagtctctcaatttgtttacctacctctagttttaccatgctccctacctcctgaatttattctccacagtgcaaccagagtcatcttttaaaatgcaaatctcatcatgaaatctttactcaccaaaacccttcaaagttccctattgtgttcaggttaaaatccaaactccttaatttggtgaacaggccccttgaaatagaacgcctgtttatctctgccatctccacacaagcctgcactttatgttatggccacattcaactgcttatatttctccaatgtattcgtcagagttctctagagggacagaactaataggatatatatatgcacacacacatatatataaaggggagcttattaagtattaacttacatgatcacaaggtctcacaataggccatctgcaagctgaggagcaaggagagccagtctgagtcccaaagctgaagaaattggagtctgatgttcgagggcaggaagcatccagcatggcagaaagatgtaggctgggaggctaggccagtctctgcttctcacatttttctgcctgctttatatttgctggcagctgattagattgtgcccaccagatgaagggtggttctgccttccccagcccactgactcaaatgttaatttcttttggcaacacccacacagacacacccaggatcaatactttgtatccttcaatccaatcaagttgacactcagtattaaccatcacatccagctacaacatattctctcatatctctgtgccttttcacattctgctccttcttcccaaaatgatgactgctccttcctcttctttgtttagctaactcttattcaacactcaagacttgacctaagctttatcacttctaagaagtgttagggttgatatccccagactgtattaagcttcctcccataaacaacaccctttaatttcctctatctagaatcgtaacagcctgtttacttgtctatttcccccctgtaaattttgggcagtgtccatgtgttgtttttcctcctatcttaagtatagtgatcatagtgcttagcagggttacatgctcgatactcattgaatagctaattgaatggaatgaatgtatgccaggcaagggcagtaagggttattgcagtgaggattagaggctgagacttttaggggtattgggttgtcaggcatccaaatacttgaaagctgagatagtggattcagcaaaggaaagagatagagtcaaagatgagtgcaaggtttcttgccaaattggattgagttaaaagatactagttacaaatgctatttataagaactagcatttattgagtgcctcttagacactgagcatttgactaggtactttatatgctttatatcaaaaagaaacaaaataatgagctagttttagacatgtggaatttgaagcatctgtaagacgtccaaatataaaggacgagtagacagttgtaactatggttcttgggtacacaaagaaaaaaatgactcaataattaaattgaaagttatttgggtcgatagtaattgaagccattgggatggatgggatcttccagaaacagtaatgtagggaggaaaagaagacgatcagggaccagattctgggggacatatgtgagctaaatgcaaagaggggaaccattcattcattcatctaacaaatatttactagagccatggtctgtgtcgggtactattttaggaactgggggtatatcagtgaacaaaatagccttttccctcatggagctgatattctaacaggaatgggagaagtagacaataatcacaaatacgcaaacatgttatatccattactggtaagtgctataaaggaaaataaagcaatgcaaaggcatataaaatgactaaatgtgggtgtggtaggagcagcaggggcaggggagactttagctcattcagggaagaccactatgaagatatttgaaccaagagttaaatgataagaaagaggcagccatataaagatctggggagaagagcattccagccagaagaatatcaagtacaagagctcttaaatggaaaaatacatgatgtattcaagggtcagaaagaaagctttaaaactggagtgtggtaagcaaaggaagcatgaaaggagaggaagccaggcatataatcacacagggccttgtaggctctggtaagaagttcaaatgtgtacaaatgtattctatttgcagaaggaagctgttagagagttctaagcagaacagtggtatgattagttttggattgatagatgatcaccgtggctgctgtatgggaaacagactgtagggggcagagaggaagcaggaaaacttgttaggaggctacttggaataattcaagcaagagatggtaatgagtcggatttggattttagtgatggagatggtaaaaagttgttagatttaggatttgttttggaggacttgctgatggatcaagtgtgaattgggcagggctgtggtagggaatgggtaggcaaggactaaatgcttccttgggttttgacctgaataactgggtggtaccatttactgaggcgagaaagactggaggagaaacaagttttatgggtaacgggaagaagtaggaaagaagtagcttggttttatacacattaactttgtaaatgtaatgacatgtctattggacagctacatgctaatgttaactaagaaattaggtagaagagtctagaattgagaaaataggtcaaggttaaatatttaaattttggagtcaccctctgataaagctttgacaccaggtgagaacattaatgggttaagtatattataaaatggtattaatataaaaattcctgaatttgataatagtactgtaattgtataagataatttctctccttaggaaagacaaactgaagtatttagaggtaaaggggcatgaggtctgaaactctctctgaaatagatgagtaaatacatacatgcatattaatttatatgtctagagagagagggagtgaaaaagcaaatgtgacaaaatgtaatcagttggtgaatctagataaaggctacacaggaattccttgtactgttcttacaactctatcatacattttaaattatttcaaggtaaaaaatatttttaagcctaagttggaccagttgaggaggcagcctctaattttggcaggagctaaaaccatggacattaaaaggaaattaaatcttgataaaataaagttacctttaatttttttaagtgtaggcagcaaagaggagaggtccttgtattgagccctgggatactccgatatttaaagatagggcagatgaagaaaaacccaaagaataatctgaggagaagtggccagtgaggtaggagaaaaaccaaatgagagtggtatcccacaatgcaagtgaagaaactgattcaagaaagagggagtactcagctgtgtcaaatgttgatgagacattgattctgagaattgactattgattttggcaacatgaaagtcattggcaacccagagacaaaagcctgaatggattgtttcataaaagaatggacagtgaagaagtgaaggtagtaagtctttctatgagtttagttgtaaaaggagtatagaaaaataagagtgttagctagagaggcaattgggataaatatatggtgatttttgtcggttaataaaattaatttttaaaagaaaggaataagttccagtgtctgatagcacagtagggtgactatagttatcagtaacttattgtatatttcaaaatagctttaagagaagatttggaatattcttaacatgaagaaatgataaatgtttgggtgatggatattccaattactctgatttgatcattatgtattatttgcatgtatcacaatatcacgtacccccaaagtatgtacaattattatgtatctataaaaatacatgcacacaaaacaatatatatgttaaagggacacattcaataaaagtatattaaacataaggggaaattttaaaatcacaaatattaaatatctgactgctaatggaaataattcagtagcaagggagaaattgatggtatagaaaagaaatggacagcatagacaaatataattgcagcagcaaggtccttgggaagatcagagcagaagtgcggagttgaactttgttaaggataaggataattcacccatattaagaggagataaggcaaggtaggttggtgatgcagcggtggaaagaagaggaagttcttttctcaatgcttatctttttaaatcaactataaggagaagctgtctgctgagaggaaagggagaaagtggtgtaaaggagagaaagaaagggcactcagaaatgtaggaggagacgtgggagagtggtgtcatggaaaccaaggacagggagaggatttcaagaaaaagcagtccaacaatcaatagtgctgaatattcttgcattttagttggatgaatattgaaaaaagactattgagtttgctaattcagaggttactggttgactttggcagaaaaggctttattaaaacattatgagcagaggcccaatttcagtgaagagtgaatgggagatgaggaattgtattttctttagaaaaggagggtggcagggggtaaattggggagagggacctatttatctcctgtattagactgtgaattccttgagagagaacatgtcagattcactagggtatgacactgctagttttcaacaaaagttgagtgtgagagtgaaggaataagttctgcacccagatagattcaacaaaatcttctaagatgttcttctgaattggatctgttctgccagaccctcaaaacatgtggttagaaaaaaatcactgaggaagtacttctgtaccctagagaagtagaagagtggaggtgacaggatgtcattgaaatgcaatttgtggtctctggacacctgccccactgcccaatgtataggaagagacctggaaggtctgacctcagaactgcaagaaattagttggtgttttctgcatagggtaggaaatactgagatggctagaagttatggtggggttgcagttttgtctgctgagtttagcttaagattaggtcagccatggtggagaggggagagaatttgttatgataggcatatagctatatttgaaggatataaatacagcagcaaaagaggaattgcatagaatgagatcagggtagatcagagcttaattagatgaaatcaggacaagggctgtttaggctgactatcagagaaaccatcttgatgctaaaaattactggagcgtgggctaacctttgagaggaaatggtggaaactttgccactgagtcatttataattatttacaattatacaggacaattttgttgaaaaataatgtagcataatacaaggagtggttttgctctgttcccaggatggaatggatgtgacttaataactttttcctacgctaatttggttgattgtgtcagagaaaagataggttggtcattttgtttttccccttttgaatgactcatacttgagttgatcacagccatacaaccaaaagaatacccactgattaggcagataacagaatgtagaatgggaagtcaataggttgacttagaactcagacttacctaaaacttggagaattggtcaggaaccaataagtttccataaagctaggccttgtgtttttcaccattaatctccaggacgtggcttcagagcctggaatacagtatttgatgaataaacaaatagtcaatgaatgaatgcatgaatgtcactttgggaagaacacctaggaccaccagtataagattagcagtggactgataagttggacgtctgccttaatatctctgggtccattttctcacctctttttcactgatttctactgaggatgaaatgagagcatgcagatacttagaatttagcatctttagaagtattagctgtcttttcccctttatttttctagactcaatctcaccagtcaaatcaaactttatgttttaccacattaggaagagagaaaattatgccttttgtctattaaaaatcctagatatcggtgttgagatatcttagattgacattaaccaaaaccactggcaattgtagaacaatttttaaaaacaataaacagctaaggcactaccaggtatgatactccttcactttgccttttatcagctcatcccaaatcttaatttaaattcaaataaaatgaaaatgttctctagaagcatgttttcatccttgggcctcccttagtatccaaaatactcaagtctgccattctcagggattaactataattcatactgtgttggccattgatatgttcccctagccttgactattggagctaactagtgggaaactccaactttacctgttcaacatctttgctttcagatttccttccaccattctttgtccttccacaccagacagaatttatagaaaagggaatagcttcattaaggaagtgatgccactatgtatgtaaaaatcccgtttctctctttctttaagcaggaaatattttctatttttatcctttgcattacttttcttccttccactttgctgcttttcaagctggaattaagagacaccagtttaatttggatacaataactggacttgattaatattccggtacagctcacttcctttaacaacagggcctgacactttttttttctctgaaatgtttttttcaagggcttatatcccttgcacagaacagaatgttttgaacaatatttaaacgcagtttttgatcagagagttaaagtgatcctatcataatagctaaagatgggtacaaagaatttggtgagcaatcaaggaagtgatataaaataattaatggatagaaaagtcattcaagtgaaggctttgtgaaagaatcaagattattcaacccagagaagataaaattttcaagcccttagaaatagccacttgccatggatggtttcaaacacaaaaacaaaacaaaaccaaagcaaaattgccgacttaactcatttcacagccaatttaatgtccataggggagttttgccttgcaaaataaataagctgtgtatttgattcttcatatatttgttttgtaagacaagaagaagtgatttaataactgctttcaaggactagaaaaaaaaaaaactacttttctagaataccaggaattgaatcccataatcttatccacatctttttccctgtcaaccctagggcctcccatcagccactttatttgtcttgaaaaatctacttccccatgctgtccagactggaaaacataattccatgatacacacaatagggtatctaactgtcttctttttccattaagacagcacatgaagaaacagtatcatttgtagcaggaaggattttagctaggtcttctagagaactaaatcactttctgcagtcagtaataaatcaccaaagaaagctatggaattttctttactgacttcagcagatccttacctccccagagatgctatgtggagatagaagagaagggagttggcagcaatggctgagaaatggcagccttttcatctctttgtcttattcaagccagagttctctaaatgttaatgcattgaggggaatctaaactagttttgtgaagaccgaatggcaaatagtcaaaaaggaacattggactttgctctatcaatttttttttgtctctcagacacccagcttctcagtgtgccctttcagtatgtaacataatttactactatagcatcaactatttgaatactgatgcctcacacatttacatctctagtccagaactattttctcaatactaacttcatatttccagttgtctggaggacatttttgccaagaaacacaggtacctcaaactcaatatgttttaatactttccccccatccagaaacaagaatgccctctcctcctttcctgttcctgatcacatttaatggtcctagtcctttaaagtaggaattcaagaagcatcttgatcccctcttctctcagctacccacttcacctttatcaaatcagttaccaaatcctgttggttctacctcagatatgtattcattcaaatctcatttttcaaaacttttattgtaagttcaggggtacaagtgaaggtttgttacataggtaaagagttaataggtaaacttgtgtcatgggggtttgttatacagattatttcatcacctagatattaagcctagtactcattagttatttttgttgatctctccctcctcccaccctccaccttccaaaaggccccagtgtgtgttgttcccctctctaaatgatgacaacgtatggacaaatctcatacatttagcctccttgaacatattaaccgttccctgaatacagtgtcctctcatgtctctgcctttgcagatactgttctctttgcttagaatagtgtcccactcctttacctgctaagtctctgctcattgttaaaggtttctgctatgtattacaaactgttcctcatccctacaggagagctccgtcctctgtgcacttaaccacatctcatcataactgttagtttagatattgcttttctctactaaactatgatttccttgaagacaggggctgcattttaattatctgtaaagtctcagtatccacaacatgatagtctatgttaacaattaatgaaggaatgaatgatgtaactcaaatccaatttatcggtttttcctttgatgaattaatatatacttttggtgtcaagtctaaaaactattttcaatgtcctagatcccaaattttttctcctatttttttctaaaatatttatagttttacatttacattacctctacattaagtctatgatccattctgaggttttgtgtgcatgtttaagtatcagacttaggtcgaggtttgtttttaggcctgttgttgtctcattgttacagcaccatatgttgaaaaggctatctttttttccattgaattgcttttgcaactttgtcaaaaataagtttggcatatttgtgtgggcctatttctgtgttttctattcgattccattgatatatgtgtctgaccctctaccaataccatacagtcttgactgctatagttatcaaagtcttgaaattgggtatattgattcttactttattcttctttttcacaattgctttatcctagttgctctgcctttctggaacaattgtgtctatatcaagaaaatatcttgatgagattttgataggaactgcattaaatatgtataaacatttagagaggattaacatgtttactatattgcgtcttctaatccatgaacacagtgtgtcttcctattcatttggatttttttcttttttcagcattatgtggtttttagcatgcataccctatacatgttctgttagatttacatctaagcatttcatttttttgcagcaactgtaaatggtattgttttttatttgttttcacatgtctattatttgtatacagaaatgtgattgcttttggtatgttgatcttgtatgcttcgtacttgctgaacttgttttgtttgtttgactgattgattttgttagttttagattctttgggattttcaacatatgttatctccaaaaagcgacagttttattttatcctttccaaatctgaatgccatttatttctttggttgcttactttatctgctattaatatagccattctctctttcctttcattcacatctacatagtatattttttgtctttgtactttcaacctgcttatattatttgaagtgaattactgttgacagcatatagttgaatcatgtgtttttatgcactctgccagtctctgtcttttcattgatgtgtttagaccacttacatttcacatacttattaatatgttagggcttaaatcttgttttgttttctctttgttctcttttttactttctttactttcttttttctctgccttacagtaggttacttaaacattaattagaatcccattttgatttatctttagagattttgagtatatctcttcatattgattttttagtggttgctataggtattagatatacatcatgtatcacagtttattgatattgtcattttaccagtttgaagtatagtaactttacctttctttacatctctttatgcttctctttttacaataaaattatcttaaatatttcctttacatacatttagaaccacatcagacaatgttataatttttgctttcaccatcaaacataacttagataattcaagagaaaaaggaaatctattttatttacccatatacatacatacatattttctatgtcatttcttctttcctaatattccaggaatccttcttttgtcatttcctttccatttacagaacttcctttagccgtacttttaaaataggtccaccagtggtgaatgctgttagttttgcctcatctgagaatgtcctgatgactccttcattcctgaaggatattttctcttgacataggattctggattgaaagttcttttctttcagtagttgaaaaaaatattgtgccacttcctctggctccattgatttctgatgagaaatatgatgtcattcaaattatttttcacatatcagtaatgtgtcacttctttctctctgctttcaagatttttttgtttgtctttagctttcagacttttgactaagatgtgtcttggtatgaatttctttgggtttatcctgttgggattttcttaccttcttgaatcttcaggtttatgtcttttgccaaatttggggaagttttaggtattatttgttcaagtatatttttagtcttgctctgcttctctccttctagtacttcagtactatgaatgttagatcttttggcatggtcccaaagatccctgaggctctgtttattttttcagtctattttctttctgttgttcgtattgggtaatttatatttttctatcttcaactgtactgattcttttgtcttctccattctactgttgagattacaggcatacctcattttattgcactttgctttattgcactttgcagataattatggtttttacaaattgaaggtttgtggcaacctgtgtcaagcaagtctattggcaccatttttccaatagcatgttctcacttcatgtctctgtgtcacatgtaattctcacaatatttcaaactttttcattactatcatatttgttatgatggtctgtaatcaatgattttttgatggtactattgtaattgtttggggcaccacaaactgtgcccatataagatggcaaactgaattgatgtcaaactgtcaaattgatggcaaactgaattgataaatgtcgtgtgtaccgacaggccattcctctatcactctccctctcctcagacctccctattccctgagacacaacattgaaattataccaattaataaccctacaatgccctctgagtcttcaagtgaaaggaagtgtcacatagctctccctttaaataaaaagttagaaatgcttaagcttagtgaggaaggcatgtgaaaagccaagatgggctgaaagccaggcctcttgcaccgaacagccaagttgtgaatgcaaaggaaagttcttaaaggaaattaaaagtgctactccagtgaacacatgaattataaaaaaagtgaaacagccttattgctgatatagagaaagtttcagtggtctgcatagaagagcaaaccagccacaacattcccttagccaaaccctaattcagaaaaaggcttgaactttcttcaattccatgaaggctgagaatgctgaggaagctgcagaagaaaagtttgaagctagcagaggttggttcatgaggcttaaggaaagaagctgtctctataacataaaagtgcaaggggaagcaccaagtgctgatgtagaagctgcagcaaattatccagaagatctagctaagatcattgacgaaggtggctacactgaacaacagatttttaatgtagaccaaacagccttatattggaagaagatgccatctaggactttcatagctaaaaacgagaattcagtgcctcaatttaaaacttcatgggataggctgactctcttgttaggggctaatgcagctgatgacttttaagttgaagtcattgatcatttaccattccaaaaatcctagggcccttaagaattatactaaatctactctgtctgtgctctataaatggaaccaaacctggatgacagcacatctgtttacagcagggttactgaatattttaagcccattgttgataattactgctcagaaaattcctttcaaatattactgctcattaacaatgcacctgatcacccaagcaccctgatggatatgtacaaggaggttcatgttattttcatgcctgctaactcatccattctgcagcccatagattggggagtaattttgactttcaagtcttattatttatcaaaaagtgggcgaaagatatcaacagacactcctcaaaagaagacatttatgtggccaaaaaacatatgaagaaaagctcaccatcactggtcattagagaaaggcaaatcaaaaccacaatgagatgccatctcatgctagttcaaatggcaatcattaaaaagtcaggaaacaacagatgctggagaggatgtggagaaataggaatgcttttacactgttggtgggagtgtaaattagttcaaccattgtggaagacagtgtggcaattccttaaggatctagaaccagaaatagcatttgacccagtgatctgattactgggtatatacccaaaggattataaatcattctgctacaaagacacatgtacacgtatgtttattgcagcactgttcacaatagcaaagacttggaaccaacccaaatgcctatcaatgatagactggataaagaaaatgtggcacatatacaccattgaatactatgcagccataaaaatggatgagttcatgtcctttgcagggacatggatgaagctggaaaccatcattctcagaaaactaacacaagaacagaaaacaaaacaccatatgttctcactcacaagtgagagttgaacaatgagaacacatggacacagggaggggaacatcacacacaggggcctgtcagagggtggggggctaggggagggatagcatcaggagaaatacctaatgtagatgacaggttgatggatgcagcaaaccaccatggctcatgtgtacctatgtaacaaacctgcacattctgcacatgtaccccagaacttaaagtataataataataaaaaaagaaaaaaaaagaaatgcattttgtaaggctatagctgccatagacaatcctctgatgaatgtggccaaagtaaattgaaaatcttatggaagggattcaccgttttgatgtcattaaaatattcatgattcaagggaggagatcaaaatatccatattagcaggagtttggaagaacttcattctacccctcataaatgactttgaggggttcaagacttctgtggaagaagtaactgcaaaggtggtaggaatagcaagagtactagaattagaagtggaacctgaagatgtgactgaattgctgccatctcataaaaccttaacagacaaggagttgcttcttatgtgtgagcaaagaaagtggtttcttgagatggaatctactcctggtgaagatactgtgaacaatgttgaaatgacaacaagggatttaggatattcaacaaacttagttgataaaatagtggcagggtttgagaggattgactccaattttgaaagaagtcaggccaggcacggtggctcacgcctgtaatcccagcactttgggaggccaaggcatgtggattgcttgatcccaggagttcaagatcagcctgggaaacatagtgaaaccccaactctacaaaaaaaaaatttagttgggtgtggtggcatgtctgaagtcccagctactcaagagactgaggtgggaggattgcttgagcccagggaggtagagaccgcagtaagctgtgatcacgccactgcactccagcctgggtgacagagcaattctctgaaagagaagagaggagagaggagagggaaatcctactgtcggtaaatgctgtcaaacagcatggcatactacagagaaatctctcagggaaggaagggtcaattgatgcagcaaactttgttgttgtcttattttatgaaattgccacacctactccaatcttcagcaaccatcaccctgagaagccagtagccatcaacatcaaggcaagaccttccaccagcaaaaagattatgactcactgaagacgcagatgatcattaacattttttagcaataaagtattctttcatcaaggtttgtacattgtttttaggcatgatgctattctacacttaatagactacagtgtagtgtaaacataacttttatatgcatggagaaaccaaaacaattcatgttactcactttatttcagtatttgctttattgcagtggtctggaatcaaagcaatatctccaaggtatgcctgtattcattttgtttttttattttgaatattgtatttttaagttctaagatttccagttggttcttctttatatattctacatctttgccaagacttgctaattctttgtaagtctttctgttttttcatttgtttcatgcatgtctgtcattactcattgaagcatttttataatgggtgctttatcatatcattctaacatttctgtgatcttgtggtgtctcatgattatctctctttcattcagtttgagatcttcctggttccagcatgatgaatgattttttcattgaaatctggatatttaggatattatgttttgagactctgaatcatatttaagcttgttttagctggcttcctctgacaccactctggcaagtgatgggggttgctgccatattactgccatgtggaggtagaaagtccaggctctccacttggcctctattgacacctgaggagggaggctgcttgtttctgctaggctttcactgatatctcccttgctgggagtgcctctgacaccacagagaaggggagtggcttgcttactgctgggcagtggtggaggttctaacaccccactaggccgcctctgaacaccacctcagctgggaggaggggctccttgttaccgccaagcggggagcggatgcctatgctccccatgtgttctccattaacatcatgagtaggagacttgttatcacctggcatggatgaaagtcctgtctctgtatttggtctttcctaccaacacctggaggaggagatttgcgacaccttattaatagcctagtcagagtggaagtctaggctccccactcagccttcattggcatgagggtggctggggccacagttttcctgtgctgtttgactggagtagagcagttattatctaaaagttttatgtcttggtgtctacccctctcccagtcctctggatagtgagagcaggctcttattggggcttatatttggtccgtgcccacaagtatttccaggttgttgcttctcagctccaaatctgggctatagaaggtaaaaagaaaagccagagaccttatcactgtgtcattccttggaactcaaggtccctcactggtttgccttcttaatgtaatagaaatcattttcattacattaacacccttctaactagattttttttactcctaagttttgaaatttcttttcatgttctagatactagtcctttgtcagaaatgtgttttgcaaatattttctcctaatgaatggtatcagaggcagtcagctgagagtcatcttatgtttgttttatacataatgtccaagggttctagttatattagtgaaaggaatgggagaaagttcatctccattttcccagaagcagaagtctcaataaataatgtttttgcccccaatcctaagatttataagtattacctccccatatctttaataaattttaaagttaaataaatatatttatttaaaacccaatatctttagtaaaacagctaaatgaagcaaaccttaagtacctaagctgtttgtttcagctgatgaaataaacgtgtgaattttgaagatgttgaatatgcctcaccagtctattacttaacaacttcaagcctcagtcttaaacttgggttctgataagcatgccaactctggatcttagcgcaaatgtcaagatcccttctggggattagtctctgaactgccgactttttggacatcaggccagtttctatcctgagtgagagctccaatctaacaagagtgcattgattgctttccagctaatcaaagggaaagcatgggttggctgttctggcacccttgttcagctaaaaatgattgtctctggctcctaatgcagagatatattcttccttttttctgtgatgaaggtgtagaatatccctcaattttgttaagtataaagttaatgaatgcctttgaatagtctttgagaagttatacatggtagttttttttttcctctgggggaaagagtagaacatcacctgcccttctctcagtcataaaaaaaggcttgatttaaatttacacacattgaaggttacttacctgaggttttccctctttgcacttcagaaagatatttcttaaagtacccatggcccttccaaaagaatggaatattttgaacaaaaattaaaaacttgttttggtgtatgcattttgtatgagattaagaaatgtttctcttgttatattcctgcctccccacctcctctctctctcagtatgtgtacctgtgtatgattcttttctactttctatttcctgggaaaggcctggagttgagtaaaggaaaagtttaaggatgagtaggagaggctgctcatgaagtgatgaagagtatggctggtctataatatgtgattcagaatcactattatgatgaatttcctagaacaagaagaattgctagaggcccctttcacgccacagtaagttatcaccataaaaataatttcttttcccctccccataactcatcagggtaaaagcttgcaatgaccattggtttgtcccagctagactgggaaagtagctctgtgttgcctgtgtgttgtatcccaggatctgagtagcttgcttggcctgagacctcatgccatcatggaatacaatagtgatagcaaaccaaggctcaaatggacatgtcagttgtctaagaccacaaagctagtaagtgtcagagctggaactcaaattcagtctctgtgtttgactccagatcccatctattttccctgtataaacggggctgagttttggagaattccattcattaggagtatcgtaattctacagctcactgtgatagtgccatatcagtccttggcccaacagttggtctgaaaatattaagaccaggaaaagataaacaaaattatccttagggatttcaatccagaatgaagagttcttccatgatgccttcccacctaacttagaggcttggccagaaccatgattactttcagatttaatagacactccgtaaatgttagttctgtccctctatcccagcacatacggtgggtgaaatacagtgctagcagctaacaaatgcatcatgtcatttaattggcacagctctcttatgaggtgtagggataaatacatccccacattacagataaggagactgaggtacgaagaaatgaagtaactgacatgtccactgtctcacagccagatctatctgacttcatatctagtttgctcatatctagtttgctctctgtagcacctcaattggttcctactgatgtacctacctacctctgtctcagcggtattttcagaggctttaaatgaaatattttgactgggttcttcagaaatccttatttgagtttaaaaatcaagttgtgcatgctttctcccttgcctcaccctgtgttatcctcagtagtaaccttgacaccccagtaaagcccagagaaaaagaaattgtaaattgatctgagaggataattgaggatttctaagttacccaggctttaactttgcctcgacctgagatgctcaccagtcttcacagaagaataaactgagttaattagctctttgattggatgagggttaaggttctaggtgtgggtctgcttgcaactaaagtgatgattgttggctcctaacgttaagacattagtagccatctgttgggtgaaggcatcctcttttctgatttgaagctaggtctcagtcagtggaaaaatgtcatttgtattctgcattcctcctgtttccttggggtatgctatgtttaataatgtatgcattaggagatgctgaaaagtgtcttttcagtatgtctttttaatctagtctttttctcccaataggtttaaattgtccccaaagtgtgtgtgtgtgtgtgtgtgtgtgtctgtgtggtgtgtgtggtgtggtgtgttgtgtgttttagaccaagtattgctggagaacacctcattatgtgtaggttattgcatttgtggagcaaaatctcccttaagtaatatatctactatgtgtcattaaaaatgtattcactttatatgtgcatgttttcaattcaggcatctttaatagggaaatatattctagtagattaatttacagttgtttctaaatagtaaatcataaacaccaataaaagaaaacatgcaaaatgtgcatatttgagagtcgattatatgttgattaaccttatgtgcttttgctataattcttactattgtcatttcccttgctgtcaaacaacaattcatttctggaacatatgatgcataattatgaatgttaatgcaacacccagctgcatctcatctccctttgcattatggtacaagtttactttggggacacaaaggtactttctctcattagtgacagaaactgtaattagacactaaacctgagataaaaatatactcattatttacctattttcttaattagaattttcatatcaaaagtacagaaaaataatctttttaattcaagtaagaacaatatgatcctgtttaaaaaataaaaatgaaagaaaaaatctgtgttgtggagaatagagcaatggacttgggggttttgaatgcaggctgtgagtactctgtagaagtagtagaaatactgggcaagtctttaaacatgtcatagtcttctctttatggtttcagagtaataaccttcacccgacagggatctggtaagaattaaataggtacttcaagagaaagtacctgatactgggtacatagtcagtgaatgtgtattgttgttcttaatatggcatttgagagttttttaaaaaggcattttccaaaattaattcaccaatgatctcttcaaatggcaaggtctcatgatacaatttcattgatttaacaaatatttttgagtgctgagcatgtatgttaagcaatgtggtggtgatcatagaaggagtatgctctagccctgtactctagttgagagagataagacatacataggcaaaatgcttgagcagggaagtacgtggttatcaaaatgagtgatgccagcagcaagtgattttgaagattagaggaagaaaacataacactatgcttgcaaacaagagggggagctttgcttaattcctaaatagttcataggaatgcataaaaaagggatggaaagaaacgtagttttgggaaacataaaggaggtccatccaacttaagatttatataggggatcagtgagagataaatgtgaacaatctatagaaggcccagaaaaagcaagctttacttagtaggccatggggaaccactgcaggattgcaagcagatgaataagtatgagattggaatttgtggaaaattggtgtgggttggattggatgtaaggagctcatgctacacaattgcttatgtagtacagggagcagtgacagtaggaatagacaggacaagttaataggtgaagatatttcaaagccagcacttggtgactaattcagtataaaggctgaagaagaggaggagtacacaatgattaccaggtttgagccagtcagacctttaaggatttaaaatgaacaaacaaaacaaaaatagaaagagctaggcttggcatcaatttttgtttggtttttgttgtttttagtttggggtgatagaagatatagaaagccagtgggcagttgtagggagtaggtagaactggtgtggtatttaagtgagaggtcaggactagagattgtcctggagccttagaatgaaatttctaatctaaattaatctaaattctacataaatatttgcaggtggtctcttcatcctaaaaacataatctgcccttaacctttaccctcatccaactaccaatttcttttccttcacagccaaacatcttagacattggctctattttctcacctcccatttcctcactacagtctgccttctactcctaccactactatgccactgtcctctgtatggttccaaggtgaattaatgtcttccagattgaaaaaaaatccaaggagcgtagtttcttctccttttctaatgtgcaatttttcagtaagtttttaagccattattatatggtagaactggtgtcaaatcacatataagctagatgacctttggtaagttacttaatcacagtttccttttctgtaaaatggggataatgatatttactttattacatgagtaaatgagctgatatacataagccctttggaaatagtagttgcttaataaatattattttgtttcatcattgcagctttgggcactgttgagcactttctagaaatttgttttcttttattatcataacacttttttttttttgagatggagtctcacactgtcacctaggctggagtgcaatggtgcgatctccactcactgcaacctctgcctcccaggttcacgtgattctcctgcctcagcctcccaagtagctgggattacaggcacaccccaccacacctggctaatttttttatatttttagcagagacgggctttcactatgttggccagactggtctcgaactcctgacctcatgatccgcccaccttggcctcccaaagtgctgggattacaggtgtgagccaccacgcctgacgcataacacttctttttccttgttttcctactactagttatcttgagctctttttccttaatttgtcttatccacagatataccctagaacagtagttctcagatttgaacatacgttaaatttccctggagagtttatattaaagaacatactgctcctcccctgtctccagagtttctgatctagtaggagctcaagaagttctcagataatgctgatgctgcgggtgtggggactgaattttgagaaccactaacctagagttctatctcagcctcattttcttattctatgaacttttattgaggggcttcaggtaccactgatgactcccagatttctatatctagggaagaacacatgcccagattccagattatcattttcaactgcatgttaaatttctacacacggagttgtcctccagacgcattacaatccaacatgcccaaactgattctgaagtacatatgtaagactagtcaggaaaggtctgaataaaagaggaataaaagacaaagcagctagtcctgttaaaacatattataaaattacagtaattaaaatactttggtactaagcacatgaatagactgatcagtaaaccgtaatgaagtctaaccatgattcaaagacaattgtttagtatataacttttagtatatgatcttatctttaaataagaaaagtctttctaagcaaaacacaaaacctgggtgctggccgggtgcggtggctcatgcctgtattcccagcactttgggaggccgaggcgggcagattacccgagctcaggaattcgagaccagcctaggcaacatggcaaaaccccgtctctacaaaaaatacaaaaattagccaggcgtggtgttggacgcctgtaatcccatgagaatcacttgaatcctggaggcagaggttgcagtgagtggagatcgcaccactgcactccagcctgggcgatagaatgagaccctgtctcaaacaaaaacaaaaacaaaaaacaaccaaccaaacaaaaaaacctggaagccataaaagagaaaattgttaaatctgacaacacgaaagttgaaatttaaagcacccgaaaaatacaaaaataaaatccaaagaaaaaaactggggaaaaggttttgcatctgatatggcaagaggctggttcccttaatatataatatataaagagctcttgagaataacaggaaaatgccaacaaaccattcaaaaaaggaaaaaagaacctgaacaggcagttcagacaaaaagaaagtgggcttataaaaacaaatgaaagatactctgttggcacagtgtctcatgcctgtaattccaacattttgggtagccaaagcaggaggattgcttgtgaccaggagttcaagacaagcctgagaaacatagtgagaccctgtcttgacaaaaagtctaaaaattagccaggtatggtggtgcacgccctgtagtcccagctactcagagaaggctgaggcgagagcatcacttgagccagagtttaagtctgcagtgagccgtgatcacgcccctgcactccagcctgggcaacagtgcaagaccctaactcagagatggagaggggaagagggagagagagagggagagagagggagggagggaggaagggagggagggagggagggagggagagagagggagggagggagggagggagagagagagagagagagaagctcaacacttacaattaaagcagtatagattaatttaagcaataagatgtaactttcacctatcagaatgggaaaaatcagagcgtttaatgtacattttttggggggcaggcatgtggagaaatacatgtgctcttataccttgctactcaaagtgtggtccttggatcagcagcatctgcatcaactgagagctttttagaaattcagctccaccccagatctactaaatcagaatctgcctgttaatcagatccccaggtgacttgtaggtatatgaaacttcgtaaagcactgctctgacacactgttggaagtataaattagcataacctctttggatcttagtatattttatcacaattaaacattgatgtactttttgacctatagttccacttgtaggactttatataaaatatataatcatgtatgtgtgtgaagacatgtaaaaaggtattaatcacaacattatttgtcttagcaaaagcaacttcagtattcattacttgagtaaaggctaaataaactataaaaagttcacttggtgaaatactattcagttatttaaaatttatttaagaaaagtatatgtggatacggaattatctccagtatatatcgttaagcacaaacggcaaggttccaagcagtattataacctgccttttctgtgtcccattattataattcccattttagagataatgtaagtgaggcagagaggttaaataactagcccaaggacatacagctggaaatggtagattcaaatacagacagtcttgttctagagcttatgttcttcacactctgccatattgctgctcagggataaacaacaaactgttaaaagtggtttcccctggagtatggggcactcctttttcattgtatatgcctttgtactatgtgaatggttttccttctacaagtattgctttaaataatttaaaaatacttaaaaactgcaatttttctaaaaccgaactaattctcctccccactcttctgctgatgctagcgacaggctgaatcataaactagagtgaaaaatctaatagacactgtatactccctcttatttatccctcacatctgtctcatcagctaccaagactaactgattttacctcctagaccagacatttctcaaacttgcccctctactctatccctgcattatacatcacttggactatagtgttcatttcctctctgatccacctgcatcttttctccctacaaaatgccaatggacacatctttccaaaatgtgaatctgattttactattctccatgttctggcccagtttgcctgtctggccttactgttcaccacttctcttcctcatatatcctaccctcaggacaccattgttcccctttcatttccatgattttaatatgctattccttctctagaagtacctttcatctgagtgaatttctacccttccttgacaaccagatctcaatttggatttccccctggatgcagactgttagtagacattatatattctgtattatgcatgtcagaatacctcaagtttcatgctccttcagtgttccataagaaatgtccccagcatcaaagcattcctgcctgaatgctgtgcattcacattccttgtagactcctctgctccccaacatggatgcagtatcctgcggactgcttctccagatctccccatggctaattcatggtttttctttgtcctaagttctctcctggccctcagcactcttcttggtcatgaaggatttctgggaggctttcccttttattatcaatttcaggttcatcatcttcccttcctatccctctacctgtacctgtagaggagggaggttagaatagtggttaagaacaaggaaggtctaggctgccaagctaatgaatttggacttttcccataagtactaggaagccagtgaagaattttaagcatgagagtggcaggaccagatttgcactctgaaaagatgtattcattggcattttgcagggagaaaagaggcaggtcaaccagttacaaaatgaatgctatagttaaagtgattcagggatagagtggaggggcagatttgagaattatatagtctaggaggtagaatcaataagtcttggtgcctgattagacagatttgaggggtaaataagaggagggagtccagagtatctaccagatttctcaccttagtaaatgtcacctgtcaccagcaccagcagaagagtgggaaggtgtcttagttcgtttatgctaccacaacaaaataccttagagtgggtaatttataaggaacagaaatttgtttctcacagttctagaggctgggaaatcaagaccaaggcaccagcagattcagtatccagtgagggctattctttgcttcaaaggtggtgccttgttgctgtgtcctcacatagaaggaaagcaaaggggaaaaatgctgtgtcctcacatagcagaagaagtagaagggcaaaagaggcaaactcttcctcaaacccttttataagggcactaataccatccctgagggcagagccctcaatgcctaatcccctcccaaggggccttatctcttaataccatcaccttgggagataagtcccaatatgaattctgaagggacatacatatttaaaccatagcaaaaaagaattagtttggttttgtaaaagttgatttttaagtgtttcttttttttttcccaaagcaatacttgcagaaggaaaaccattcaaatagtacaaaggcatatacaatgaaaaatgagtcctctacacttcaggggaacattgttaacataccataatgctatattattttccttctgaggaacatagattcacctacccccaccttcgcaacccattccccactgaatttccttatttccttactgcaaagatagttcaacatacacaaatcaataaatgtgatataccacattagcagaaggataaaagtcttatgatcatctcaatagatacaaaaaaagaatttcacaaagtgcaacatgctttcatgataaaaaaaaaaaactgtccaaaaattaggtgtagaaggaatgtgcctcaacacaataaggctatatatgagaagcccacagctaacattatattccatggtggaaagctgaaagcttttcctttaaaatagggaacaagacaagggcacccattttccccacttctactaaacatagtactgaaagtcctaccagagcaattaggcaagaaaaagaaataaaagccatatcaattgaaaaggaagaagttaaattgtctttatttgtaggtgacatgatcttatacagaaaaccctagaagtccaccaaaaggctcttagaaataataaaagaattcagtaaagttgcaggatacaaagttaccctgtaaaaatcaataatgtttctatacactaacaacaaacttagaaattttaaaaatgatcccatttacaatagcatcaaaataaatctaaaatacttaggaataaatttaatcaatgaggtaaaaatctgtatactaaaaactataaaatattgatgaaataaattaaagaggacacaataaataagacaaataaataaaaaataaagatattccatgttcatgggttagaagaattactatcattaaaatgtccatactgctgaaaacaatctacagattgaatgcaatctctatcaaaattccaactacattttttcacaggaataaaaaattctaaaatttgtaaggaaccacaaaagaccccaaatagctaatgaaatattgaggaaaaaaaaaaagctggaggcatcatactacctgatcccaaatatactacaaaactatagtaatcaaaacagtatggtactggcataaaaacggaaataccattcaatggaacagaagagagagcccaaaaataaatccacacatttacagtcaactggtcttcaacaaaggtgtcaagaacacataatggggaaagcacagtctcttcagtaaatggtgtcatgaaaactggatattcacatgcggaatgaaattggactcttatcctacatcatatataaaaaccaattcaaaattgattaaagacttaaacataagaccttaaactctaaaactactacaaggaaacatatggaaaagctttttgacatttggctttggcaaagattttttggctatggccctaaaagcacaggcaacaaaagcaaaaataggttggattgcatcaaattaaaaagcttctgtacagccaaggaaacaatccacagagtaaagagacaacctgcaggattggagaaaatatttgcaaatcatatttgataaggagttaatatccaaaacatataaggaaatcaaacaagtcaatagtaagaaaacaaataacttgattacaaaatgggccaaagatctgaagagacatttctcaaaagaagatatataaatggtcaacaggtatatttaaaaaaatgtttgacgtcactaatcatcagtgaaatgcaaatcaaaaccacagtgacatatcacctcacatatgttagaatgtctataatcaaaaagacaagtgttggtgagggtgtgaagaaaaaggaacccttatacactattggtagaaatgtaaattagtatagccattatggaaaacagtaggggggcttctcaaaaaactaaaaatagaactataatataagccagcagtcctacttctgggtatatatctaaagcaaatgaaatcagtatgttaaagagatgtttgcactcccatgtttattacagtactattcacaatagccaagatatggaataaatctaagtgtccaacaacacttgaatgaatgtgttataaatgaatgaataaagaatgaatttattctttatgatgaataaagatgatgaataaagaaaatatgttatataatatatatttcatatataaaaatatatgttatatataatatatatttcatatataaaaaatatatgaaatatatatatacacacacacatatacaatgaaatactatacagccataaaaaagaaggaaatcctgtcatttgtacaacatggatgatactgaaggacattatgctaaggaaataaaccaggcacagaaggacaaataccacatgatctcatatgtgaaatgtaaaaaagctgaactcttacagagcaatcccattacttggtatatacacaaaagaaaataaatgtttctaccaaaaagacacctgcacttgtttgttcattgcagcactattcacaatagcaaagacatggaatcaacctaggtgcccatcaatggtgaattggataaataaaatgtggtatatatacactatggaatactatgcagccataaaaaagaatgaaatcacgtcctttgcagcaacatacacagagctggaggtcattgtcctaagcaaattaatgtaggaacagaaagccaaataccacatgtttagctcccacttataagtaagaacaatgggtactcatggacctaaagatggcaacaatggacactgggacctactagataggggagggaaggacagagggggacaaggactggaaaactattgggtactgtggttagtacccaggtgttgggatcattcataccccaaacttcagaatcacacaatatacccatgtaacaaacctgcacatgcaccccctgaatctcacatagaggttgaaattatattaaaaataataattataatagtaaaacatcaaactcatagaagcagagggtagaatggtggtcaccaggaatggggcgggtggggcaggaaatgagctgttgatcaaaggctataaagcttcagttgaacaagaggagtacgttctggaaatctaatatacagaatagtaactgtagttaataataatgtattgtatacttaaattgctaagagagtagatcttagatgttctcaccacaaaaaatgataagtatttgaggttatggatatgtaaattagctttatttaatcatttcacaatgtttacatgtatgaaaaaatatattgtatattataaatgtgtacaattttatttgtcaactaaaccttaataaagctatgcaaaatgaaatgaacagcttgatgaacttgaggtttgtgaatgtaaatacctcagaaagagaaatttcccaagggcttatgtgaacattgtggaaccagacaaaagccttaatgaaaagaagccttaccagggaagtacatatatggcaactgctcaccagcacttatctccccctgacaagggcagctgtgattcaagaattgccctcttggtcctgggagcttcctcaccctaaagaagaacattcctgtccctggaacctaaatactttttaagcagctgccctctattatacacatagcactgatagctaaaggtaggcttccagcctaccttggaaagcagcaccccacaagagccaaaatagcagcagcccgtatttagaagtcacttgaaaatctgttttaaaatgtatgctacagtaatggttctcaaacttatgagcgtgcattagaatcatctagaggatccaccacgatcaagtcggcttcatccctgggatgcaaggctgactcagcaaatgcaaatcaataaatgtaatccatcacataaacataaccaatgacaaaaaccacataattatctccatagatgcagaaaaggccttcgataaagctcaacacccttcatgctaaaaactctcaataagctaggtattgatgaaacatctcaaaatagtaagagctatatatgacaaacccacagccagtatcatactgaatggacagaagctggagacattccctttgaaaacccacacaagacaaggatggcctctctcaccactcctattcaacatagtattggaagttctggccagggcagtcaggcaagagaaggaaataaagggtattcaaatagaaagagaggaagtcaaattgtctctgtttgctgatgacatgattgtatatttagaaaacccaatcatctcagcccaaaatctccttaagctgataagcaacttcagcaaagtctcaggatacaaaatcaatgtgcaaaattcacaagcattcctatataccaataatagacaaacagagagccaaatcatgagtgaactcccattcacaattgctacaaagagaataaaatacctaggaatacaacttacaagggatgcgaaggacctcaaggagaactacaaaccactgctcaaggaaataagagaggacacaaacaaatggaaaaacattccatgctcatggataggaagaatcaatatcgtgaaaatggtcatactgcccaaagtaatttatagattcagtgctctccccatcaagttaccattgactttcttcacagaattagaaaaacgtactttaaatttcatatggaaccaaaaaaagagcctggatagccaagacaatcctaagcaaaaagaacaaagctggaggcatcatgctacctgacttcaaactatactacaaggctacagtagccaaaacaacatggtactggtaccaaaacagatatatagaccaatggaatagaacagaggcctcagaaataatgccacacctctacaacaatctgatctttgacaaacctgacaaaaacaagcaatggggaaaggattccctatttaataaatggtattgggaaaactggctagccatatgcagaaaactgaaactggaccccttccttacaccttatacaaaaattacgatggattaaagacttaaatgttagacctaaaaccataaaaaccctagaagaaaacctaggcaataccattcaggacatagccatgggcaaagacttcatgtctaaaacaccaaaagcaatggcaacagaagccaaaattgacaaacaggatctaattaaactaaagagcttctgcacagcaaaagaaactatcatcagagtgaacaggcaacctacagaatggaagaaaatttttgcaatctatccatctgacaaagggctaatatccagaatctacaaggaacttaaacaaatttacaagaaaaaaaacccatcaaaaaataggtgaaggatatgaacagacacttctcaaaagaagacatttatgtggccaaacatgaaaaaaagcttatcgtcattggccattagagaaatgcaaatcaaaaccacaatgagataccatctcactccagttagaatggcaatcattaaaaagtcaggaaacaacagatgctagagaggatttggagaaataggaatgcttttacgctgttggtgggaatgtaaattagttgaaccattgtggaagatagtgtggcgattcctcaaggatctggaaccagaaataccgtttgatctagcaatcccattactggatatatacccaaaggattataagtcactctactgtaaagacacatgtacacgtatgtttattgtagcactactgacaatagcaaagacttggaaccaacccaaatgcccatcaatgataaactggataaagaaaatatggcacatatacaccatggaatactatgcagccataaaaatggatgagttcatgtcctttgcagggacatggatgaagctggaaaccatcattctaggtaaactaacacaggaacagaaaaccaaacaccacatgttctcactcataagtgaaagttgaacaatgagaacacatggacactgggaggggaatgtcacacactggggcatgtcgggggttaaggggctaggggagggatagcattaggagaaatacctaatgtagatgatgggttgatgggtgcatcaaaccaccatgacacgtgtataccaatgtaacaaacctgcacgttctgcacatgtattccagaaagtaaagtataaaaacaaaaccaaaattcatattgctgggccccacccccagagtttctgatccaaaaggtcgaggatgggtccccagaattttctttcctacaagttctcaggtgatgctgatgctggtctatagaacaactttgaaaaacactatttgggggttgggggacatagaaatttggatgcaaaaaacttgtgttcaagccttatgtgatttatttcacctccctaagcctgagtttcttcttttctgaggtggacttagtaaggttatgagaatgaaatggaatggtgtatatgaaagttctttatgaactgtaaatgttgcataaaaatattagcagttagatggctttacaaatggtacttgctgccacacctccaccaccaccactaaattttcttgtacttttgttccctctctagccaactttgtcccaccaagtctatcaggcagctggaaaagaactaaacccaggaaggccctgagtagtgtttttttgttggtttgtttgtttgtttcaacacactgggcatggccttgatactgaccttgacttgacttctcttttcctttgcctggcctcctctcaaacttgctcctggttcttccagccctggtctactctcacagcaaagaatagctcccagtgctaatattaagggtaaaaaactgtcagatggaatttttaaaaaatagtaagacaaaagaatccactgccaagcagcaaaattatgtggaaaaaaagcattttgctaggttggtgggctctaggctgatttccctgagggaaaaatctagatctttgaaatagttaagtgaaatcaccagtataattgcagattcctaatttaagaatatgtcagacagttatatcagacagttgcctgggtaaatgatatgtccatgtagaatggtgacatttttctttagaaacctctttttatggctggttgcggtggctcacgcctataatcccagcactttgggagatcgaggtgggcggatcacgaggtcaggagatggagaccatcctagccaacatggtgaaaccccatctctactaaaatacaaaaaaaaaaaaaaattagccaggcgtggtggcacgtgcctgcagtcccggctactcgggaggctgaggcagggccatctcttgaacctgggaggcggaggttgcagtgagccaagatcacaccactgcactccagtctggcaacagagcaagactccatctcaaaaaaagaaacctctttttatttaaaaggtaatacatgtgtggtgtataaaatctagaaatgatttaaaagtatgaaaaataaaaataacccttaattccaccacacaaagataaatacccactgatacaatattagtacatttacatccagcctttcaatatttgcatatctgtataagaatatgtatatatgcatatatagttcttgaattgaacttgtaatatgttcaggtttatatacaatttttaaatttaccattacattgtgagcctttttcaggatcattaagtagtcttcaaaaacatggtttgtaatgacaaactattattcctccatgtaaatgcacaatatgttctaactcttcctaaatgttggacagctaggatattccaaattttaccattatgaataaccctgcagtggaagacacttcaagtacataaataaatgtgtacatctttaatggctttcttaggataaaatcctaggagtggaaaaactggatcaaaggatatgaaatttcttaaatataattcacataccataaaattcactatttcaagtgtgtaattcagtgggttttagtacattcacaaggttgtgaaaccattaccactaattgcagtaaaaatacagagcatttcacaaatttgtgcattatccttgtgcaggaaccatgctaatctctgtatcattgcaattttagttatgtcagccaaagcaagcacagtagaaacattttaagtcttctgataacatatgccaaaattcccttaagcaagtgtgtacccatttccattcccacccaccaatgtatatctatttccccacaactttgtcagcacttacctttagaaagtattgccaatatgactgaaaatggcatttcattgttttgtctctattaccagctcttcttcctcttctcactgaactatagctctgcagagatctatcatcccccgtctcctttgcatacattcaccgtgggcagtcacatccacggcaacagcctcggctgcctcctctggatagtgaccacatgtccataccgtgccccaacctctttctagcactgcagtccacacatcaagctgctcgctgggcacacctacctacagaatttgctagcataacaaactaatatctgaaatcaaactcatgtttcctaaagctggttcttgcctatgactttgctatttagattactgatatcagccttctaggtgcttcacagtcatctgttctctctgcttatgtaattagcagtccaacgctgttgattctctgtcacattcttcctttctgctccatccccactgccattgctctgattttaccttttattgtgtctattccattagcttactcacttctctatgcttccagtatctatccacataatttatcctacacatggctaccataataactttcctataataccgctcgtaccatattgctctcctactctggaacttccaagggctctctcttgcttattggattatgtgaagtaaaggctttaacttgactcttaaggcccaccatgctcttgaatcattctaatttcacttcctctgtgccttataaaaactgtgttttcttccttcatggtattcctgtgcttctcacttctgttcatgcaaatctggcatggcctctctcccagtcatcttcagtggtgattgtattgactcttccaaaatcagctcagaggctctgtgatgccattcttgattcaggcagcagtgctctctccttcttttgactctcattttgttagcatttcctttctgatacttctgacattccatcctttttaatggttttctaggtatttttcatccaccctctaccacacttaattccttgagcacagggattacttcttcttcattttggcatgttgcctagtacctctccaaacaccttaaatgtagatagaggagctctgtaaatgcttggacaaaacaatagtgaagactgccaattttctttttagagcccctaatgactcagtttcaggaatgaatactgtgctaagaaggtacagatgccaggtgactcaagtatcatagctcattcttttttcctcattctccatattcagtccatcaacaaatactgtcagccctacctcttcaaaatacctctaatcaaatctcttgttcttgtcccaactgctactttcctagaacaaaccaccattatctcttacctataatagcccctttaaatggttctctggcttctactgttgacccccacacacacaaatccatcagccaagtcaaacctttataaaacttacatcatgttagtcccctgcttaacaacctctaacagcttcccatttcactgagaataaaattcaaactgtttcagcctttggaaactccatgatctggcctatgcacctccccagtatcatctcccactgcagtccaccttgctcactgtgctccagctctgctgggtcttggctcctcctgattgtcaagttgtatcaaagcagagtgactgggtgttcttgtttctattggggtcctaactgttgttggttattgtcctagggctccatgtctttagtagtagagatgacctggggagtggccagaagtagttctgaggattttgagacttgactctggggaaaacctttatggattccatcagacctctgaaaagtggtaggtcgaacagtgagtttgaactgaaagggataatgggctttaaggaggaagaaaagaaaactggtattattcctacagcctctttcccaagggacgctataaatgttactgatagaaaccagagctggaggacaaacatcctccaccttctttatcgctttgggtgttggtttaggaaactgggcatcatggcaaaacctttaaggctatctgttgagtcagatggtgcactgtgaacttgatgccattttccctatgtgctcctctgaagtctcccttagccctctggtgttgcacccttaacttctgtacatagaagggagagggaaaaaaactctttcattattcagattctggacttgctccccttgctcctagaagcttcgaaatattcactatccacctctttgcctttaggatcattgataagatcagccagctttttccctcttctgtcagttaaacaagtctatgactggtatgttttatcacactatatatagaaaaactagaaatttctctctagcccattctgaaagagaatcccgagtactgcatttctaaagtactaagcattttcctacccgctgctatgtgcagagctttcccgagtcatctgtatggttacttcctgccaaccttctttggaaaaagaggtgtccccctgtgtcttaaagatttcaatgtgaaaatggagaaatggaagcagagggtcaaatgtaatgccctagccagatgaagttatcactccctatgcagaaagacaaagagcacccctgacacacaccacagcatttgtggggagtctttatttccactcgaacattcccttcttttcttattccctaccctgggtttctttgtagccagggatggattctgaggtggagggtggagagggggacccagcagatttacatggaagaacttgaactggctattcagaggaggtggggagaggaggggaggcagggaggcagagctgggtaccaaaagccccttctccagagagtattcatctctcagatgacccagattatagctttcccagactgatgagaaagccattgtcctgaaagttctctttcaaattacacacacacacacacacacacacacacacacacacacacacacacacactcttccccccttggttgggtctataataaggaagggtttcctgattaccaggctgcaaggaccccagccaacagtgggtgggggtgggccttcagagctctgtgtccctccatggtgaccaggcagcttttcccctcttctgtcaaataaacaagccatgcattgttctgtcctccggcttgtctgtgggcttcccttcctgctgagcctgccagaatgagcttgggcttcttcgtgtggggcaggtggaatgtgctgtttggagggaggctggaagagccacagaaaataaacagagctaatcaaggacgttattttgtgcttctatttatataaatactttaaaaagaggaaagtacccacactctgttatggtccaggcctcaggttgagcacaaccacaagcaacaggggttacattttcctttttcccctaagttagagcagagtcatggttctctttctgctcatcttctcccaagtatctcttcaggggtctgctgggagccaggctcaaagacagatggtgctatcggaagatactggggtgacagctgactagcgcagctggagactgactcctttcagaattggtccacctccacccctcacctctcacaagagcctttataaggcctctcctgggagccagcttctggcttttctgctgcatgtgcccaccctcctgtgcccccatgccaagttcacgtctcctgagtacttggaaaagaagcagtcatctttaccgtcccctgagcacaggaggtcatacttgatcatgttatctggaactcagctccgctaaatgggagcatatgcccttttccctccaccacctctcccaacctcttccccaaatcccaaactggctaaaccgctcaagtttctctctcatcttccctcaacgaaggatttcttgagtatacactatttgtgcccacctgcctactcctcatctgatgacatcccaactctcatcttcgcaccctttctccctacctcagccagctccatgaacatgcttgcacctctagtcacaatttcttcagcctcacctggccactggcagggtcacactgataacaaaccagttgctctttattttgttaggaagtggggattggcaaacttcttcaggcaagcgtttgcatgggctgggccactgagcaaaaggagaaagacatttggcgaccagaagagcaagggcggccggacacccaggcctgaggaatgaaatgaaaagagattttaacctgatgcattttttggaccagattatgtcctggtatattgccactcagaatgtggttatcacaccaggagcatcagtatcactctggagcttattaaaagtcagaacctgggcctcgctgaatcaaaatctgcattttaacaagatccccaggtaattagtatgcccactacaatttgagagtgctgttccagagtgtactgggtttggcatttgagccttctcttaactagtcctttctcttttatcttcatttggattgaagaaatcagttttcttattgctaatggtacctcgctcattattattttgcatacgggtaatattaaaaacagatagcatttattgagtgccttttacatgccaggcatgttttatagatgaggaaaccaaggttctgtgacatgcccaaggccaaacaactagtgaatggtagagctgagactgtaagccagatccatatgctcctcaaagctcccaaactttcccctatacagttgataaaagtcaacccagactctcctgtgagatacagagggaagaaaggggaaggggcctccaggcatgatttccccagagaggaaaggccctagcatacatacttcatgtcctaagggagtttgcataagccctctcaggagccagaaattactggaattgaggccagaggccaagggaaactggagtagggaattgggagtgttaatgaaaggaaaaccctgactctaattccccaagataaattaaatcctggtgcctgagcctgggcttagggggtgcaacaaatccacatagggctgctctggattctggctactgcgctaatcacttagggcatcatttggaacctcagcctggggcctaggactactacatcatagcatgctagagtgggaagggtcatttgtgacgattgaattcaatgttttattttacagggaggaaacagaagcccagagagtgggagtaagttgccagaggtcagagtgaattcatggcaaatccagggacactgaccccaaacaccacatttccagcattgctaatgggcaccttttctggagttgaagtctctggtgtaaaattgggttttctttggatctgctcaagtccgcacaggaagtgcagacccctgtaaatacatccgaaaatgtttgtgagccttcgtatctcaccaggaccttcaccttggaaaatctctcagtcacttgcccccagctatataaaatcagctggagtgctactcctctggacctggaggctgctagtcctggcttatctgtacttttctggggcccagaggacctgcagagatggctgggtggggtcaactcagtccaggaagcacaggaattcttttaagtgtatgtgtctggggtatttttctctctcacttacgtgtatttttaaaaattctttttagacacccgctttatctttcccaaacatcatttccttgctcctttcctgagttctagcagtggctgggggcccagcttccttattggcctctgagctgccgagggggtgggccagggctcagaggaggttggagtagggagcaggggggctgtttatgctgctggaagtgcctttcatccttccctttgccaccagggtgctggctggttcctggagcagcgtcttcactcctatccagctcttgacactggctttcgttccctaaggctgtggccatatctaggtccatccaggctgatggtcataccttgccttcagtgctactccttcctgttcttagaactggaacctgactgtgcctgagccccttggatcacactcagcatcttgggctgatggtccctcgccccagaaggtcttaactggagggcagatgggtcccagctaagggaggacgctggctggagggtttgtcaacgagagtctgagctagccggataccccgctctctcccaagccatctctccaccctgggcaacttccatggtaggtacagccagtagccatggctgctgccactcttccccctcttgctttctttcttcaatatctctttctttttgcttcctaagaaaagcattttggagtaatgaaggatgggatgaggtgtgtgcttattgatagtgcctgagccagccttaggagaaaggcaagcactggggtcactgccttcacatcttggcctagagctgcatggttggtcgtaggcattttcttacttttctgtttgtttctcctcctctctctccccactgcctatggagggaatggtttcagctctaggactaatgagacctccctttgctgactgcttcttgagggaattgctatgggaaacctcaggaatacaggctttttcagatagactcttccttggagaggaggggtcgtgtggtatcctaggaaaaaactggaggatctgagtttcattcccaattctgctggttattagctatgtgctcttggcgaatcacttaagctttatgcatctctggttctccatttgtaaagtggggataataacttaccagctggacatggtggctcatgcctgtaatcccagcactttgggaggctcaggcaggaagattgcttgaggccaggagttcaagaccagcctggccaacatggtgaaaccccatctctacaaaaaatacaaaaaaattagccgggcacggtagcatgcacctgtagcctgtagtcctagctactcaggaggctgagacagaaggatagcttatgcccaggagtctgaggttgcagttagctatgagtgtaccattgcactccaacctgggcaacagagccagagaggccctgtcttaataataataacaataataaaactgtttcacataaggttagagagatgattaaatcagttaatgcatgtgaaatgcttagtgcctggcacatcttcagtgttcaataagtggtcctgctgtgtgttttctttaagtttatacagtatgtcaggcactatgctggttgatttcacacatgggactgcatttaatccaaaacataactcatgaaaaacagatggtcatcttccccattttgcagataaaaaatctgcaactcgcagaagtgacttgcccatggccacacaactacagtttgaatgcaagtgtagactgacttcaagtctagggctattccgagctaataataggccaaatagtagaccatatagatagtttattctcctgtcccaaactagggttagaaggctctagctctggctccagctccctctgtttggatttttcttcttccagtctttagttttctctgtgtcctaaaagcccccacttccctcttctgtctactttgggattggttcctactcctggagaaaccctagaaagagtaaggggccagccaggcgcagtggctcacgcttgtaatcccagcactttgggaggccgaagcgggtggatcacctgaggtcaggagttcaagatgaacctggccaacctggtgaaaccccatctctactaaaaatacaaaattagctgggcatggtggcacatgcctgtaatcctagctactcaggaggctgaggcaggagaattgcttgaaccagggaggcggaggttgcagtcagccaagattgtgccattgcactccaggcttggcgacaagaatgagacttcgtctcaaaaaaaaaaaaaaaatagtaagagtctttgtaaggtatgtttcacagtgtggcaaggtagtggtacagtagaacctcaacagtggatggtaccctaggtgtgggtactcttgagccatcaaaaggtacaagtctgagctaataaccattattatagtacctgctacttactgaccacttgctgtgcatcaggctgtgtcccagatgctttgagaatactatctctaatccccacagtcacctagccagataggaattattgtttcctttctcagataagaaaactaaatttcagatgggttaagcaacttacagatacacacatctaaagtggcagaggggatctgaacctacatctgtctcactcatttttcacccattgcctactggcttggtatagttggtgagatgagactgacacacatgaaatgatgatgggcaatatcaaatatcatattattatggacccaattgtgagggctagattaccctgaacaagcttcctggaggagatggtacttgagcagtaccttgaagaacaggtaggatttaggttaacaaaaggagagggggcattccaggcagagggaacagtcatagtcataactatgattggtcgaggccttgccaggcctgattcaaagcacttgcattgtctcatttgatctttcaacaatcccatttggtactattatccacattttactgccatgaaaactagggctctgagaagtgaagtcacctgtctaaagcaacagagctaatgagtggtagagctgggattcaaacaaaggtggtctgaccccagagcctgtgttagatcaacaggaatatcaacagcaaaggcacagaatcaggaagggacagagctggttgcaggctgtgattggagcagagaaatgagagattgagctgatgggtaaggatagcttattgaagactttgaaactgatctagtttacgtttgatgtgggacagagtaagaaatagggagccagtgaagattcttgaataggagagtaccccaattcagttggcgtttaacatgatatgacctaaaagcagtgactggaggtagaacaaggcagacaggccggcagacttctgcagtatttggggcataaagtttcaagggcctggactagaacaggagctgctggtggtgggttctgggagaagagctgtggttctgtctaatggccacagtgaaaatggagggggggtagggggagagagagagagagcaaaccagggccagagaaacatcataaaaaaaagactcagtagaactccgtgtgggattggatggttagggagaaggtggcaccaaggctgactgcccgcactttaaacccagaactcaagaaccctaaatatggaaaaaggcttgaaataggaaggataccctgttcaccactatatcctcagtgtctaaaagcataggtcatagtagatacccatggtacatagtactactactggtagatgcttgacaaatagttgttgaccggataactacctggtagcagcagctggagagatttcccggcagtgtggctttgtgtgtaggactccagagcaagcatagcccccaaggtctccttgtgccttcagcccccactctgggcactctgaaatcaataatagaacaatgtgattacaaagctaggggcttcacctggctttcctccgcttaaatcttagccactgttgctgacctgtggctatacttcctggcctttgacaaacagcttcccctgcccttcctcctatacctcctggtctgtgtctggcctattaccactcaatccttgttttccccagcaaggctattcttctgaagactatctttttaggccttagccctctagagccttgtactactgagatcttctatgcttctgctggggtgaggggcatttccagctaggatggaatcctccagcttgagtgtgaccatgaatgctcctgggaggtagagagctgctttatctcacgatatagccagcttgttgaaggcaggggcccttatcctattcaaccctgtgctaccagtgcctagtctggaccctggcacagtaaatatgaataaattgatgaaaataatttttctgtttacttctgtatcatctacttatttatcatgtttcttttactctgccattcacctctttctctgtcatccatttctctctactatatatttctctacaatctttctcagagttttctctttttctgtcatttattttcccctctatcatctctccttcttatctctatcatttgtctggcgcttccagcatctctctctctccattctctctctactctccctccttctgtcattctccctcccatcaatcacctttttatctcctggcattatccatgccccacatgtactcttcaccacactactcttccccactcgcaagggtggcaactgctcatgcgaagtatgccaggggacagcgatgggtcctgtatgtggcagtcagtgcaaaagttgtggctgtattcagagtcatggcctcaggcctatttccctttatatacccctgacctgctgagcagccaatctcctctgtcagcctaacatggtgcattcaccactttgttctatcttccctcacaggagttggggcttcctgccaccagtttgcctaccaactcaggtgtctcacctctgtacccatcttatctttcactctgtcaatacctatcccatgctttgtttgaaccagctctgtctctcccattagtctgtaagctctcaagagcaaagactgtattggattcatctctgtaatcccagagttacacgtagaggacacacagtaaacatacaacaaatgcttattcaatgaatggctaaaaattggagaattgacagcccagtgttgacctgttcaaacttttcaatcacttgcccattcctttctcagagaaaaatgggaagattgaccagattgattttctttctcaaagagaagtgaggatgtgctcactgttcattaggcagcagcactcatttattccacaaatatttattgaacatctactatgtgtccagcactgtgatacgtgctcaggatactcttgtgaacaaagcagccctatgaagctgacattccatatctccagaatgaaggagacttgagaactaggagctcaggagggccactaagattcccacaccagttccttgcaagatgttctactttactgaaggaaaagagggggtggggcggaagctgcctgggaagtgatttcagctctggttccttcagcccacttcctgtccctttcttgctgtaggaggaacgcccctgtcagtaggccgcactcatggcatgtggccaagctgctggagggatgccctgaagcagccaccaccatgcatttcccttctgaagccttcagcttgtcctggcattctggctgcaacacaaggtgagtctagagccctcccctcaagacaggctggagggtagacaccttggacactcctcctcctctgctctagtccctgttggatgttagagcctcaagtactataatggaaaagcaagtgggagtccagagtacctgagttcaagtgctagtctcttgctaattctctgtgattttgggctagtccctttccttctggatgatgtttccttgaaatacctcattgggcttacaagacaccacactgtcctgcttttcattctatttcactagctgttctttctccgtatctcttttcctaattccttttgttctcctgtctcttaatgtaggaggaccccagggctcagttctggcctgcttctctgtcaatggcgactcactggtgcccttatctggtctttattacctctgtcacatagccaaagccttcaaaatagggaccttcctgaataaccattgttgaaacagttgcccaagaggcagacaacgttttcttcaggctgagagccagcaaaggtgctgcccttcactgccttttcccttccacaagagcttccctccaagaagggatttctgttgcaggttcagagaaactaagggttgcgtttaccccaattcggtgactttatttggaaaccaagggctcagggcacaggcagttttgttctggaagaatatgcagaaacacactttgacattcttgagcttggctcctgtttgagtgaggatttgtttttgtttttgttcttttcagcaggaatagtggtggagtgggtagcaggttcccttgccaataagaaattgatggattccttgcccagagaacaagtgagctgactgactaaggggcaaggcagggagcaagaatgagcagaaaatgacctgagggtctcatgggctgctgccacagttcaactctggctttctagactatggcctttctgagagcagcctgcaacctctcgggttctagtcaaagggagttactggcatgacttggttcagtttggctttgtgtttgggaaatggtacttaaaattgaagattgcatctgatcctagcccttcccttggtcttccaggtttggctttgctgtgggagttgggggaggcgtgggtgggcagaggcccctatattatcaatactagtattagagaggatcctgatggcaaaaactaataatcaagagagtagcagctgccatgtattgaacccttgctaggtacctgggctgtggtaaggactttacatttactatctgctttatctacacatcaaccctctgatatagctattactattattcctatttaaaagaccatatggcagtagcgctaagacactggactcaggcctgattcagattccagctgtgcttcttcagcagcttagtgagtttgtcagtttactttacctctctaagcttaagattcttccattgtgaagtgtagataataatctgtcccataaagatgggaacaatagacactggagaatacaaaagcagggagaaaggaagtgggacaagggttgaaaaactacctgttgggtactctgctcacttcccaggtgatgagttcaattgtactccacacctcagcatcatgtgatatacctttgtaacaaacctgtacgtgtacccccggaatctaaaataaaggttgaaaaagaaaaaaaaagatctgtcctcttcagcttgaaatgaaaccttgtaaagtgtccggcacattgtaggtcctcagtaaatagtcaggattgctattatcaagaaaagaataggggaacacctgaattacagccctgtctgtgccagtagttagagctgggtgttcttgagtaaatcaccatctcaaaatcacttccctttgctgggcttgctttacaccagtggttctcaaaagtgtgattgctggatgagcaagcagccccagcagcacctgggaagttgttggaagtacaaattctcaggattcaccgagacctaaagctctaggatgaggacaagtgacccgtgtttcaacaagccctgcatgtgattctgacgcacatgctcaagtttgagaatcactgatttatttacaaaatggtccggctaaaactgaatcagccctttagggcccctctctaatgctgatattctgtgattgtctcttttggcagggagccacatgctgactccctagggacagggacagcctagaagcaatttcagacttgctaatgtcagggaaatagaggataacccccatagagctctcccacttttagtctttggggtgtttccccatcttttttccatatatcatcttgtgtcccattttactaagcccctgaggcaccccaatgtccatcttcttccctgtttccctttcttcccccttttttttttttgcctaccctcctctcttttgtggcatgggtacctctgggctggcctgccctctcctatagtagggctggccatgacttcgctaactaaccagtatgccctgtgtcttacagtgacgtgtgtgtgcagtggtgtccactctcccggcattgcagcaccgagaaaagcagctccattggcagcatggagagcctggagcaaccaggccaagccacctatgagagccatctgttgcctattgaccagaacatgtaccctaaccagcgtgactcagcctacagctccttctcggccagctcaaatgcttctgactgtgccctttccctcaggccagaggagccagcctctacagactgcatcatgcaaggcccagggccaactaaggcccccagtggccggcctaatgtggctgagacctcaggaggtagtcggcgcaccaatgggggccacctgacccccagctctcagatgtcatcccgtccacaggagggataccagtcagggcccgccaaagcagtcaggggcccaccacaacctccagtgaggcgggacagccttcaggcctccagagcccaactcctcaatggagagcagcgcagggcatctgagcctgtggtccccttgccacagaaggagaaactgagcttagagcctgtgctacccgcaaggaaccctaataggttctgttgcctcagtgggcatgaccaagtgacaagtgagggccatcagaactgtgagttcagtcagcctcctgaatccagccaacagggctctgagcatctactgatgcaggcctcaaccaaagctgttggatccccaaaagcctgtgacagagcttccagcgtggattccaacccactcaatgaggcttctgcagagctagctaaggcttcttttggcagacctccacatctcataggacccacagggcatcgccatagtgcccctgaacagctgctggcatcccacctgcagcatgtgcaccttgataccaggggcagcaaagggatggagctcccacccgtacaggatgggcaccagtggactctgtcccctttgcacagcagccacaaagggaagaaaagtccatgcccccctacaggaggaacccatgaccagtccagcaaagaaagaaagaccagacaagtggatgacaggtctttagttttgggacaccagagccaaagcagtcccccacatggagaggctgatggacacccctcagaaaaaggtttcctggacccaaacagaacaagcagagcagccagtgaattggccaaccagcaaccctctgcctctggctcccttgttcaacaagccacggactgttcttcaaccactaaagcagctagtggcacagaggcaggtgaagaaggggacagcgagcccaaggagtgcagccggatgggtggtaggcgaagtggagggacccggggccgctcgatccaaaaccggcggaagagtgagcgttttgctaccaatctgcgtaatgaaattcagaggaggaaggcccagctccagaaaagcaagggtcccttgtcacagctgtgtgacactaaggagccagtggaagagacccaggagcccccagaaagtcctccactcactgcctctaacacatctcttctatcttcatgtaaaaaacctcccagccccagagacaagctcttcaacaaaagcatgatgctcagagctaggtcttccgagtgcctcagccaagcccctgagagccatgaatctaggacaggcttagagggacgaataagccctggccagaggcctggccagtcctctttgggcctgaacacctggtggaaagcacctgacccatcctcctcagaccctgagaaagcacatgctcactgtggagtccgtggaggtcattggagatggtctccagagcataattcacagccacttgtggcagcagccatggaaggcccttccaacccaggtgacaacaaggaattgaaggcttctactgctcaagctggggaggatgccatcctcttgccttttgcagacagaagaaagttctttgaagagagtagcaaatccttatctacatctcatttgccaggtttaaccactcatagcaacaagacttttacccagagaccaaaacctatagaccaaaacttccagccaatgagctccagctgtagggaattgaggcgccatcccatggaccaatcatatcattccgcagaccaaccatatcatgccacagaccaatcatatcattccatgtcaccccttcagtcagaaactcccacttactcagaatgttttgcaagcaaaggtctagaaaattccatgtgttgtaagccactacactgtggtgattttgattaccacaggacctgctcttactcctgcagtgttcaaggagctctagtccatgatccttgcatttattgttctggggaaatctgccctgccttgctaaagagaaatatgatgccaaattgctacaactgccggtgccaccaccaccaatgcattcggtgttcagtttgctatcataatcctcagcacagtgccctcgaggacagcagcttggcacctggcaacacttggaaacccaggaagctgacagtgcaggtgaggacttggttcttgggtgggtaaccttcattattgtctttgagaggggaaagctacgtaaattatttaaaaatataacaattataattccttgaaactgtacagcactggcttcagtagttgttagcttagtaaccttgaaaaagatactcagccaccaaaattgcagttgtctcatctttagggttagataaaagtaacttttgcttcataaaatgggcacaactgagatttatatcctgactataaaattgatatctgagtgacccaaagcaagtcattcaaccacacaaatttgaagtatgtaattctaaagggaaaaaataatttttctgtcataaaatagccagtattaagaagagtctcactacctcatctctaaaatggaggaatatcatggccgcctcatggatcacttgtgagaatcaaatcagattgtgtctatggagttctaggcccagtgcatgatacaaaatatcacttattgcctcccattttctacttcagaagtatttagagatgcaaaacttgcaaatatccccaggctttgctttcagagatctgacttgttgggtttttaaaaagacaaatcctttcccctttctccatcctgtctctgttggagacccaggtctaaactggctgctcttatatcccggttatgacctattaccataacacaagctaccaccatcccccaggctacttctgggaggactccctaggtccttgcctactcactgccagattacttccccatggcatccctgatgccatcttttggccggtgcattcaaaccagaagttaattcctgtgttcagctgttgcatacacagacacttttgaaatgacttagtatctgaatttgctcaatatatatccttggtaaaaaggaacttcaagggtgatagaagccttacacaaaagactatgaactctacaattccttttatatgaaattctaaaacagctattctatgggggaacaaattcagaacactgctcgccaatgggaggtggcacagagattgactggaaaagggcagagggaacttgtggggtggtgacaatgttctatatcttggtaagagtttgagttaaacatatgtacctgtcagaactcaacaaatgtatagcaaggctcctagacagccaatgcacttagtatttgtgcatttcactggaagtaaattttgcctaaaaatgttgtaaacaaatattaaactttatttaatatgtatgctgaagtgtgtttgaagtatactgctgtattcaacttatgttttcagcatacaaatcttgtacatattttgttatatttgtccctgagattttatgaaagcgccgaatcctagccacccaaccaccagggatatttgtccctaagattttatgtttttagatgctattataaagagtattattttcttaatgtcaagttgaaattcttgattactagtctatagaaatataattgaattttgtgtattgacattgtatcctgcaaccttgccaaactcacttattagttctaatagctttttggtggattataaaacattttctacatacacaatcatgccatctccaaatagaatttagtgtcttcctttctcctgtacatgcccttttctgggagagagaagagccttattgcactctcaccttcaatacaatgtttggaggaaatggtaagagtggacattgtagcttttttcttaatctttgactataaagtttgatgttagctgtaggatttttttgtaggtgccctttaattgaggaaaatctcttttattcttagtttactgagagttttcatcagaagtggatgttgtattttttttcaaatgctttttctgtatctgttgagatgatcatatagtttttctcttttagtctactgatgtggtgaatgacattgattgatttttaaaataaatagaagcctagcattgccaggataaatcccacttggtcatgatgtattatccttttatatgttactagatttgctaatattttgttaaggattttgcccttatgtttatcagggattttagtctatagttttattataacatctttttctgttttttgttttttttgtttgtttgtatcaaggtaatgctagccttaaaaaatgagttgggatgtattcccttctcttttattttcaggaagagtttgtataaaatgtcttccttaaatgtttgcttgaattcatcactgaagccatctgggcctggaggttttttggtagaaagctttttaactacaaattcaatttctttaatagatttggggacatttaggtcatctatttctccttgagtaagctttagtagtttgtgtctttcaagaaatttgtccatttcatttacattttaaaatttatggggatatagttgttttcaacttactttaaaatgcaccaggattttaagatggattggtagatggatagaggagtaaatggatatatgataaggcaaatatatcaaaatgttaattgtagaatctaggtgctgggtatatgggtgatcactgtgaacttctttcaacatttttgtatgtttgaatatattcataatgttgaaaaaaagaggagaggaaatataaaataatggttttaagggcaccgaagctggaaccagactgcctggttttgaatttcttcccccgaacttacaatgcctaagctttcccatctaaaagcatgggggtagtaacaacacctacttcataagttggttgtggggattaagtgatgtaacacatttaagactcagagcagtgactgccagattgtaatcatcttataagtgagttatcatctcttaaagggacattttggcttagcttgagagacttttgctggaagaaggactcacagatagacagtagacaaagggggctgagattgggggtgagtggggcgggggaagtgaggagatgacggctgcagcggtgtcagcccaggaccagcagctctataagagatggaggtacgatttgcaggttgcagcaattggcagcagtaatgcatgcgggtgaggctgtgcctacaccatgcctctattttttgtactctgagggagggataccttgggttcctaatgcttgttagaccagctaagcaggtctgcttagatactaggcattccgacacgtggatggctgcctaggagacaccacatgcccatttctgcccatcatctgaaccttccactcctactccacccccctcaagaaatgggaaaaacttgcagcatgggttaagatgccatcgctctgatgactcaggtacttgtggtggtagctatctgaagtagggctgagatcctgctcctaatgcccctggacgaggttggtgaactaattgtctcctgttcagtgctgtgaagactgaaatcagcatgcactcacgtccttcataccagcttgtttttcattcattgtcaaattatttcacttaccaattgtatgggataagttataataggatctcccattttacagctgaggaagctgagaaagccaaggctcagagaggtcacacatctagcaagtggcagagccagaatttgaataacatgacagtaactagcatctcagtgtctactgggcaccaggtactattctagatgctttacatgtatcaagtcattgagttctcaagcaatattattatcgtgattatactattatatagttggggaaactgagataaagagaagttgaatggcttgcctgaggccgcaagtgaaaggcaggtgtgcgatttgaatccatgctatcaagctccagaggccaagctcctgactgtgctacactgcctctccataagctgattgcaaagcccaggccctctctagtgtggccggatgccctctagcagtatcacttccactgggacagcaagttcccatcacaatctccatttgcagcaagcggtggggataactgcctctttgattcaaagggtgcaagcaatgtaccaggaacctatgtggcttagggaaaaaaaaagtagagtgatactgtggacctgggaaggtggttgggagttggtataggactttggtttggccactgctatttactgagcacgtccacagggctagacagggcatggacaggaaatcctggcccccactgtggttgaacaagtaatggtgtctttgcaggcaggaacgtctcacaagggcatcgaggcagagtctaaagtacaagtggttagagctgttctgacatgccagatataggcagggactgctgtggtcctttaaaagctgaagccaagaaataaacctcaacttttccattgctgctaacatccagagcctcttatgtgccaagcaatgtgctaggagttctctctgcatatcttatttattatcactactggtcacccagataggaaactgaggtgaggttcaaggaggtaatatgaataacctcaaataacaccactattaagtgtcttagccagtgagactgcgccaaggatctatgtttattctgcttcaccaggcgtcttacttccagtagggagacctactggggcaaaggtaataaaactttgaatgggactaatagtagtagcattggagaaagagggagtttggaagatcagtgaaatttaggaaaaactgtgcattcccattgaactaaactctgagtctctaggtgtggagtattggatacaaagagagaatctgaaaggctaatttgcattcagtttggagctaaaataggaaggcagggacagttttacaaacggcacatatggcttggcctagaaaaaaaaaagagttgcttggacatggcccttaaggaaaaaatgcccagggtagagagtctgctcctgtaatgtagggactgtggcaacctgcactcatattccccagagatgggcccacctcagcccctgccagcagatgtgggcagagaaggaggagccactgcagttggaggcatgctggcatacctgctgtccctctgcctcacctggggagagggttgctgcagccggagcttctgccctcaaagcccccctcaagggtcagggcttccaagtagatgctttctctgttggaagaggcaggaggaatgagcaggttcacccagcagaacaaacaaaaagacctccatctctctgtgcaggcaagagccagggcaaacagcaaacatactaaactggtttttaatgtggtttgggaggggagtggagaaagagggaaacagcattcctagaccatggtgtccaggtccctaagtgctcccttagtctctgcatgtctgcagcagtttagcaagcctgccgacagaaaggcagccctccaggtacaaatttctcagcctgcatagcagagtagaagaaacaagctggggggctgggccagacaccggctcctgacctcttcacatttttgaggccatctagatacctggctgctcaaagctttctaacttatcaggatttttctttacaggaatttcctggggacaaatggaatccaataacaggaaacaggaagaccagccagtcagggaggtaagtgagcgctcagggagttggggtgggttggtgcctctggagcttctgtagaaattgctaaggtctttggtttgcttagtttcctttgaggaaactggcctggtatctagactaagggcttgataccatagatataattcagcctgtccccctgccccccgcactcctagatagctgggtacagaccaaactgattgctaggacattttggaatatgcaagtttcctgtattagactgagatccttgagagaggacaccataccttggtcatagctttattctctgtacctagtacggtgcccgatacagagaagttgctcaagaggtacttgtcatttgcttgccaaatgaagaaatggaacctcctccaccattaatgggtgaaatgacacaaaataatgctagctaacatttcttgaacacagtgctctattctagaccccattcaaatcattttacaagtatgtatttatcactatgaccttatggagttggtaatattagtctctccatttgacagagagaagaaattgaggcacacagagatacattcatttgcctgaagtcccacagctaatcagttgactagacccaggcggtctagcttcagggacactatactacattacagtgtttctctgaaatggttcttttactgattagtcagtgaaataagaggactttattgaaaacctaatataggtcctgcctttttctgggcaaggtgagaaatacgagcaaaagaacagcaggaagcacagtgcctgcccacagcttgagcagggaagactaacccacacaaagctaaatggcaataataataaattaccacttgccaaacaacctatgtgctgcaagccgaattacacatattatcttatgctttatcttcccaacaactctgtcaggtaggtatgattataactggggcggtgggtctcaaaacttgattgcgcaattgaaacacagataaatagttggacctgaccctgcatcctgagagtgattcagtaagtggggagtggagctcaaaacctgcaattcgaacaggctcaaacagcatctgggtgatgctgatgcagctggtcctgggatccagtttgagaattgctaactcacataaagggtcacagtcagagagcctaaggaatctactcaaggtctcacagctagtaaagggataagctaggaattaagcccagcttttactttctcacacaagttgacagaagatgaaaccctgtcaaatacagggcttaagaagcacctggcacctggtaagggggcagcacgtggtaactattactgtacactatttaagttcattggaggataaaaataactgagggttggtagctgtaagaggaaaggcccatagaggagactaagcagggtgtgttggaggaataatccccactggttaagttctggccttggagtcagttctgcctgggtacaaagccagattcttctattcactagccatgtggccttggcaagtgcctacctgcctgcctcactccctctctctctttcccttccccccttatttataaaatgggataagagtacctatctcaaatgtttgttgttatgaggactaaatgaattaatatatgtaaagcatttagagcaaaacctgacaccgtaaactctcaggaaatgttatctgtaatgaggaggaagaagaacagcagcagcagagaagaaaggtgagtagtgaagcactggaccagcctaggcaggccttgaccagcctaggtagaccagcctaggtaaacctagataggatcacaaacatgggagcaatgaaaggttaccatcaggtaagtgatatgataaatgtggccctttaggcaactttgcagtgtttgcagcctaagtgggttgaagagagaccaattaggagaagtgatctggccatgacagaatgtggccctggattggggaggtagaggtgcgatagaaatggagcagaaggaatagataaataggtgtgatatttgggggaggggagtttgtttattgtaaaaacaatattacaggaaattaaaaatagaagaaaaaaaaaccttattgtcaccaccttaacaccttggttgttttcatttccctgtcagctttatctataggtatagagagttttctaagcatgattataataaccatgtagatgtaattttgtgtgtcctgcttctttttcctctctaagcattatgtggtaaacaacttttcatgttgctatgcaggcttcctcaagtcataatttttagtggctgtataatatttcaccagcttaatatgctctaatttgcttaatcattcccaaattgttgggtaaataggttgtttccaatttctggctattataaagtaatgcagcagaaatattttgagtcactatagctttttttctcattttgaattatctcattaaaaacaattatgtggagttgggattactagtgcaaacaatacaaacattcttatggttcttcatagatcttaccaaactgttttccccacgagatgttttacatgccattagcaatatatgagcataccagttttccaaaattatgtcaccattgaaaattttctttttctaatgccatacagtttgatgggacctattatagtattaatttgcttactttgataattctagtttgaatattttgtgtgtctaattaatatattaatatctttattgcttctcatgtgaattatctgttcagattatttgctcacaaatatgtgacaccttttgagggcaaggtagagaaaacttggtgactagaacttgaggagaaaaaaggaaatatatcttagccaagcatgagatagtacacacctgtagtcctaactgctcaggaggctgaggtgggaggatcacttaagcccaggtgttcgaggcggcagtgagctgtgatcacatgaccgcattccatcctgggtgacagagcgagaccctgtctcaaaaaaaaaaaaaaaaagataaaaagataaaaaacaactctgagccccagtgacttggagaatgttattggcatagatggggcacttgagaaggggacctggtttggtgaagatgctgctaagtttgaattgggatatgttgtatttgaagttagtggaagatacaagttgagtctttcaaggcttgtcaaacacccagccagggcacaggatgaggaagaagaatcaacaaaggaaactgaagggtcaagcagctgaagtagtagaaggagaaatctgccagtgtagaagataagcagatgactgttaatgcccttaacagtttggaattacaagtgaccttcaagaaagcaaattcagtaaagcggtaggcatagaaaatagatggcatggtggtctgtaaggggggagcacagagaagaaatgcaagcagcttttaagtgtacctgttttaagtgtacaatttaatgcaatttaaatgcaagtacctgttctaagtgtacaattcaatgatttttagtaaatttacagtgatgtacaatcaccacaatcaagttttagaacatttctatcaccctaaaaagacccctcatgcccattagccattgctctccattcccactctcaaccttaagcaaccactaatctactttgtctttatagatcttccttttctgtgcactgcatatgactctaatcgcacaatatgtggtcttttatgcctgactcctttcacttagcataatgtttagcagttcatccatgtatcagtacttcgttcctttttatttccaaataatattccattgtatggatgcatcacattttgtttactagtccttccactaatggattgttgggttgttttcactttttggctattgtgaatattactgctatgaacattcatgtacaagtttctgtgtagatttatgtttttaattatctttggtacatatttaagagtgaaattgctgggccaaatggtaattttattgtttaactttttgaggaactgcccgttttctaaagcgactgcaccattttacattcccaccagcaaaagagagttccagtttcttttggctaattttactacaaagattaattgttactgtgtggtttttaaaatgtttaaaaaggggcccggcgcggtggctcacacctgtaatctcaacactttggtaggccgaagccggcagatcccttgaggtcaggagttcgagaccagcttggccaacatggtgaaaccccgtctctactaaaaatataaaaattagccagccatggtggcaggcgcctgtaatcccagctactcaggaggctgaggcaggagaatcgcttgaatctgggacgcggatgttgcagtgagccaagattgtgatactgcactccagcctgggcaacagaacgagactctgtctcaaaagaaaaaaaaatgtttaaaaaggaagatgtttaaaaatagtaaattagctaggaaaaggaaagagagaaataggatgatagttagagggagcaattgggtttaatttagtggttctcaaaatgtggccccaggcccagcaacctcagtatcacctgagaacttgttagaaatgcacattctcaggccatactcagacctactgattcagaaagtgaggatgtggcccagcaatctctgttttaacaagccctccaggcaattctgacgcaagctaagtttcagaaccaccagttcaaatgaaacttcagtcagaatctagaaaactgaattaagtttaaaacagaaaggaaagctcaatagaaaaggaagtattgacactgaagatggaagaggcaggtcccaattaaaggtctcaggaaacatgagaaggactaggagatgtccagggcatagatgacatctgtgaggagaaatcctgatagagtttcccttcacaccttcccccaccaccacacacacaaattttaacatttactatgttatttctgtaaaaactggaatgatgagtgtaggtggaaaaatcaaatgtgtattcttaagccactctctttgcctggaagcctgcaatgaattgctaatttcaggtagttatactcttagttgtcttcctccactgttatttggttttccgtgaagagaatgtaaaaattgtaatattagcaggagggataaaaatggtgagtagatctactgggagaaaaagctacattactgtgatatatttaaaagccaaaataagttattttctggattatctctcttggttttctgtacctatgattgcctgctgtgaccctttccatttttttcactttgcacagaactttagaatgtgtagggtgtttttatatgcatgaccacagttaattctcacaacaacactgaggttaaaccttatttttcccgttttactgatgaggaagccaagactcagaaaaggtattataccattaacagcagccacaacaggtataatagctaacatttattgagtgtttattctgtgtcagacactgttgtaagcatttcatatgaagtattttattatttgtaataaccccgtgagagcattactgtttattgacccagttttgcagatgaagaaattgactcacaaagagattaaagtcatttgcccaaggtcaaacaggcatctgacttcagagcccattactactgggattatacagcaagtaagtgaccaaactagagctctacttaggattttccattctcagcctagggttctcttccttccctttgtcacaccacatcatgagcagagtgtgaaatacccggtacagagttcctatttactgattgagtgaaagaatatgggtaattcagagttgaatctgatttcattaggaagagtacacttttcaggaagcctttactacctaagaagaatgcagccttcagaggctcggaaggatttgtcacaagtataactaagtgaatttaaatacttaggaattaatttaacgccaggcacacgaaacttattcaaggaaaattataaaactctaatgggagaaataatatgaataaatgcatagtgtatactttgctttaatttaggaagactgaatatagtaatgattacaattctccctaaatttaatgtgtagacataatgtactccaattgtagtcaccatgggatactttatagaatttgtcaaatttatagtaaaatttatctggaagaataagtaagtgggcggaaataccaaagagtacatttattttaaaagttaatgatggtagacttaccctatcagattttaaagcgtatcataaaacaacaattatcaaaaccatatgatagtgggttaaaaaaagtcaaacagtgaaattaaaaaagagcttctagaaacagactcaagctattttaagtatataggacacactggaaacaaccctgaactggggaaagcaattactatttctttaaaaaatgttgggaattttagatatcaatatggagaataattaacttagattcatatcacatactgtatagaaagtggaccagtagaatcgcatatttattccaggtgtggatggaagataaatttgtgtctgttaaatggaggatatcatcagagacaagatcgatggattcaaatatataaaagttggtgggggggaagcctttgtacaacaaaatgtaataaaaagctaagcaacagaacgaggaaaatgtctgggatcagcatcactgacaacagttgcatgtccaaaaaatatatatataaaaatgggtagaaggtcagctttcagatttagcttcgtaagtgggcaaggaaaatgaacaggcaatttacacatgaggcaataaagggagtaaaatcattgcatggaaaagtaccacctctctagcaattaaagaagtacaaatagaagcaacttcaaggcatcataatctgcttattaaactatcagcaattaaaaaaatcaataaatagaaattgtaaaatgctaccttggcaaggctgtgaggaaacgtgcttctggaaacaatacaaattggtttagtcttcctagagggcaatctagaaaaatgtgacaagagtatgtgtttctgggtttagtcttcctagaggacaatctagaaatatgtgttcatattatttggcctaaaatacccccaaggaaataacctaagagggaaaaaattatttaaagatgttcatagtagtgcttattatactcatggaaagagtttaccaatctaatatatcatcatcttggaacaaaatagaatagccatcaacagtgacaggtatacaaatgttgggtctttcccagaaatgagtggttgtaatattaacaaaaaaataataaatatgaaaccacatgttgaatctaatctgatagtagccatacacaaagaaaattcagaaaggaatctggcaaaatgtaaatagttggatatgaatgtacatggtgttctttaggtacatgtcaagttgttggaatttataattaaaaagaaaatctgaataagaggtggcccacgttggtttgatatagacccgagaagttaaagatcaagggctttgtaaaaaatccccgtaccaatgacagacaatgttacttaccagacatgcttactctcactgctagctagaattgggtttgctagaattctccatccactagcacttttgcttgcttaaatccacaagaactttgacatcaccagacctctacgaatctccaaatttgtcaccaccactacaacatagtaccccctcacacacacccccaccaataaacattttattatctgcctcagaaccatccctttcttaaagcttttccatttcccttcatttctatcactagcactagtttgcatttcagtgctattattcacaaagaagcacattttctctctaccacagtgactgcatatgtatgtattacttgacaacaaatatagattggggtcattggagagaaggagctaagcttcacccaggacagccccagtaaagcaaggacttctctgatttcttcacaggacactttgcatcagcctcctgaggactagagaaggttcagggcaagcactgccacttgcatttgttgttgccaagctaattgttcattacttgaatttctgtgggcccgggggcaagcaggggtggcagcaacaggctctctgggtccttctcccctccctgtgtatcctccttgcgtctcacttcctggatcttgcaaatatttccttcggcaataacctgggagtgtctgtttctcttggagcagtcttacttggctgctgagggaagggaaaggcgagacgggttgggcttgtgtgctgttgctactgagattctagaatgccaagctattgtggtgagcttaaaaataaagtttccaaacaagaaacttcaaaagggccgaggaagaggtaggaggagatttttcagtctctgcaaatattggttttcattttcaattcctattaggccaaaaaaaaatattttaacaaaaagggaaaatccgttcttcagaagaaaaggcaacccatggaagcggaaaagagatgaacaaccctggttttggcaggcaatttacttttgtttttgagatgtagtctccttgctgatgtcaacaaagccctttctcatagtttgctttcatgcttcctctgctttcctcagtgaggcgctaaagccttcatggacgcccgaggatgaatgtagcacaagtaccttttgctgtaccccaggagtccctgcttccctgcgattatctctcagagacagacaaggcaggtctggacactgtgctttttactagctgggaaaatgatttatcctttttaagcctcaggagtctcatctgcaaactgacaataatggttgttgtgaagattaatggaaatacatacgtgaaagtgcctaacacggggcccaacacttggcaaccagagtagtcgactgggtgcggtggctcacgcctgtaatcccagaactttgggaggccaaggtggatagatcacttgaggtcaggagttcgagaccaacctggccaacatggcaaaaaccagtttctactaaaaatacaaaaattagctaggcatggtggcacacggggaggctgaggcatgagaatcacttgaacctgggaggcagaggttgcagtcggccaagattgcgccactgcactctagactgggcaagacactgtctcaaaaataagaaaggaaggaaggaaggaaggaaggaaggaaggaaggaaggaaggaaggaaggaaggaaggaaggaaggaaggaaggaaggaaggaaggaaggaaggaaggaaggaaggaaggaaggaaggaaggaaggaaggaaggaaggaaggggaagagaagagaagaaaagaaagaaaccagagtagttccttttccttaatgaagctccttgccctccactccaaggaaagaatccttacttggtctcaaagcagagttgcaaatttctgtacatttaggaggcctgatccccttgaaaataggacttctagaggccaaccaatatccttggcttgaggctgacacccttcaatggaagcctccctttcaccatcaccattttgcttcaattgttaaagccaggaagacaggagcaacattggttttgctcccctttgatctggtcatcttgcacagtgtaatattcagcaaggatttgttgaaggaatgactagtacacacgttggcccagatgatcccattaagggtagcccttccccttctggagttggtcttcttctgcctgcttgatataagtgactctgcaagtctcaggctgccccaacacagggcaagtgagtgggagggcagtggttttaaaatgagggctgatgcagagaatagcaattcccaagttgccttgtgcccagtacctccagatagggtcacagttccatgacttggggcaccagatgtccctagaagggcatgttcttttcttccaactgtttctggagtttattaccgggatggggtggggggggggatttttttaaggctaacacacatagttagtacttaagacacctttgaatatccagaccttttgattgtcacactgctcttaaccctaaacttgccttttattatatctccctttttagtagataggaaaagtttgagtgaatgagtccaggcttaaactccttagtaaactagggcctcctggctagtcagctatgtggttgagctgggacttgaggtctcctggtttcttggctattgagcagggttgaacattaatcagggagtgcagtccaattctcttgatgggaacaaggagcaagcctgaagcatacaattgtgaaggcaattttccatgttcctagcatcatttctaggtcctttttacatagttcatccttatgactgcttatttgtaagataggtattttgttgaaaatgaggtaagtgaaataccttgctcaaggtcacacagcttttgagttatagagccagatttttaaattttattggaattcagacccaagtctttccaacactgtgttctttctgctttgctcaattgcctgtcctgtgccctggttagggaagaagaaaatgtggtaaatttgattgttatcatggagcagggttgttttcatcacagctgcaatacattggcccaattgttgcctttgaggatattgctgcatttcataaaatctacatcggaggtgaaggtcgggagagaggcagggacaggagatagaaatgggcaaccaggtgtgtgtggtgagggatgggggacagaatgtatagtttggaaaccaacctaattggaacaaataactgcccccaaaccatagcactcccaacccttttactctgaacctttgtttccatgatatggtccctgaaccacctgtgttagaatcctttaggtgaattgcttaaaatgctgattcctggatcccaccacagaggtatgaaacccaatttctagggttggggcctatgaatttgcattttaaacaacttcctgggtaattctaatgaggagccactttgattatgagctgttttcccagactagtggtttccaatgaaagttggatcatgtacccttctcagaaagaattttttaagcatgtaccctcaacatatgttggcaatatatttattaatttcttatatgtgctaatgtcctcatatttatgctttgaaatgcaagaaatagaaaaaaataaatataaaagaagttctgtgaacacaactaccctagactaaaaaataaatgaccagtcaaaaaaaaagggtaggtggttgaaatccagtttcagggagaaggaaaaaagaatggtaaaagcccagtagagtggagagttgaccttatttttctacaaacccagaactcctccagaatgaagaaaaagggaactgaccataaaggtttcaaggtaaatatcagtaacccattaatcgttaatctttggataccaaaaactgaaaaaatgattggacaaggctgaagggcgttggccaggcacccagttgaagtaggaagcagcattttatgagagcacctacatgagacaagcacctcatcttttgagatgtgtagctaaggacggcattgacaaggcaccagctttgatcaaagcagcaaagctccatgcagctcatgaactccggtgctctttgagcactgtagggtaaatcagcccagtaatagaattaggaagcttgataaggttgagcaaagcaaataatttccattagcttgcgctaccccaaataaatacgcaatttaggtaaaaacaacagacttgctatgcaaacacagcctcgagataaatcccaggccactccccctccccccaccacacacaaaccccaatcagattctggagcaattggacagctgctgactgctttacctgctactcattgttcccattgcctggcaacctgggctacgaggttacagtaaaaaagatctaacttttcttcttttccatagtcacacaaacctgcatttatttcacattgaagaaatatgtactgagcacccactgtgtgccgggcactgtgctggatactagtgatacagtggtgaacttgacatgtgccttcaccctcaatatggttatgtggaaggggcagacaactaagcagtagtgtgctaggaaaattaatgggtgctgttagaggacagtctgggcacctatcccatgctttgggggaatcagggaaggcttcctcaaggaaatgatatctcagtggaattctaaaagtaagtcagataaagaggcggaaagagaagataaagagcaaacagcatgtaaaggcaaaaagaagtgtgggaggataggaaaggcagaattttaagaaacctaacaaatcctagtaagggtctgtattttatgaataatgtaggcttcaagcagaaaaatgtataacaaaatcagatttatgctttatttttctgtttactaatttttaattgaaaaaagtaataaatgcatttagtgtatacacacacacacacacacacacacacacacacaataagagaatctcaccccaaaccatcagtacaactctttacaagagacattactggcaatttgttgtgtatccttccagaaaagtaacgtgtgtgcatgtatatacattcttttttacaaaaatgggaacatattgcatatcttttctattgtacatcctgcttttttattttagtgattattctatgttacacatagctctattgcatcacctttaacgctacatagtgttccatatatagatattccctattttatttagtccctattgaaggacatttagatggtttccagtcttttgtgattacatacaaatctacagtgaatatccttatggatatctctttgtgttcatgttggaatgtgtctgtaggataaatccctagaagttgaactactgggtcaaaggatatgcacattttaccttctttgccttccaaattgccctccctaggagttatgctaatttcaactcccaccaacagtgtgtaagatcacctgtttccttataccctcattaattctttaactttttttatttaaaaagtgtcattattgtttggatttgcattttttaaattttaagtgaggtcgaacaccttttggtaaattgataagtcattttctgtgaactatacctttttctccctatggagttgttggtcccttttattgattggtaagcatacttcacatattaaggatatttactcttagttgtatatgttacaaatatttttcccagtatatcttcacctttagactttatggtgttttttctggacataattttttaagttttaagaagtcaaatttataaactttcccttattacttttatgttttgtgtcttacttaaaaagaacttatcctgccaagattattttatatttttaaaaatgttttcttctagtacctttatggtatttttttgacaattgagtcttgatacatctaaactttatttcgttgtaaaaagtgataggatgattcagctttatttttgtctcaatggctatccagttctaaaactacgtattgaatgattcatccttcccccactatttgaaatgcttcatcacaaactaacttcccctatgcatttgagttgacttcagtgttctagtgttctctgttttattccatggatctacctttctatttgtgagactgccttatttactgctaactttagaaattatttcaataattggtagggctggtcttccctctttcatctctctttttccataccgttcataataattcttacgattttaattttcccatatgaaatttacaataatgttccaaaatgcagtctgttgacacttttattgagtttctattaagtttatagattcacttggagttgacatcttaacaatgttgagtcatcgttgctaggaaattgtgagtcctttcatttatgtgcatctagttttatgtttctcaatagagttttaaagtttttgcgtatagatcctgcatatatcttgttaggtttatttctaggcatcttacctttataattgctgcagtaaatgtgatctttccctccattatatattctaactaattgttgcatctatgtagaaaagatgatttccatatatgaattttataccctgacaccttactgaattttcctgttgttggtattatttttaaattgtttatgatgaggctgcgcacagtggcacatgcctgtaatcttagcactttgcgaggccgaagtgggtggattgcttaaggccaggagtttgagaccagcctgggcaacatggcaaaaccctgtctctactaaaaatacaaaaattagccgggtatggtggtgcatgcctatagtcctagctacttgggaggctgaggcacgagtgtcgcttgaacctgggaggcagaggttgcagtgagcggagatcatgcactccagcctaggtgacagagctggactctgtctcaaaaaaaaagtttctgatgaattttccagataaataatcgtatcatctatacataatgagaagatatccccttcttccaatgtttacatctttattttgttaaattgcactattgctttcagaacaatattaaatattagtggggaaagtgggcacctttgccttgttcttgtttttaatgggtatacctctagtgttttgccattaagcacaatattggcttttgactttaaaacaaaagtctgatgataatgatggtattatggaaatagacatctttttctgttaggttttttttttatctggaagtgatgttgaattgttatcaaatacattttagcattagggaaattgttatgtgccttttatcctttgatttattaatgttgtcaattatatcagtagattttctattactgaaccagtcttacatttctaggatgaaccccacttgatcatggtgtatcatatttcttaacatcctcttagattctgtttgctaatattttatttaagatttttgcatctgtattctcagatgagatgggtctctagtttgctttttctgttctgtttgctgggttttagtatcaatgtaatgcaggaatcttttcttctctctctattctctagatttccagattctagaaaatgtaaataacattggtttgattttttttccttgaaggttggtagaattaacacaagactatgtgattgtgctatttttggtcaaatttatacttttttttcctatggtaactggtgggtttatatattctcattcttctgaaatcagttttggtaatatttgttttcacagaaaaatactttaagttttcaaatttgttttatggggtagagcaaagtattctcttattcttttcatttactctgtaactgtggttatttctcaatttctaattttgtgcatttgggtgttttttttttaattagattagcaagtggttaatctgtttcattgttttttattttcttttcaggaattggttttgcctttaattattctatcacttgttctctagtatattaatttctgccgttagttttattgtctttctgctttgttttaggtttatttttatgattcttttcttcttttgttgaatgcttaattcatttattttaattcattcttacatactaatataagtatttaaggctacaagtttttctttttctttttcttgagacagagtctcaccctgtcaacctggctggagctctggagtgcattggcgcgatctcagttcactgcagcctccgcctcctaggttcaagcaattcccctgcctcagcctcccgagtagctgggattacaagcgcacgccactacatctggctaatttttctattcttagtagagacagggttttaccatgttggacagcctcgtctggaactcctggcctcaagtgatccgcccgcctcggcctcccaaagtgctgtgattacaggagtgagctgccacgcccagcctacaagtttttctttaactactgctttagtcaaccatatcctctagcttctgatattttcattgtttgttgtcattttctagatattcaacaatttcaaattagattttctcttcgactaaagtggaagaatttttttcccgtttattttctacatgctaaagatttttattttcattttgttattaatttctagtgttaccgtattgtcattagaaaatatggtctggggaggccgaggcgggcggatcacgaggtcaggagatcgagaccatcctggctaacacggtgaaaccccgtctctactaaaaatacaaaaaaaattagccgggcgcggtagcgggcgcctgtagtcccagctactggggaggctgaggcaggagaatggcgtgaacccgggaggcggagcttgcagtgagctaagaaagcgccactgcagtccggcctgggcgaaagagcgagactccgtctcaaaaaaaaaaaaaaaaaaaaaagaaaaaaagaaaatatggtctgtactactagtgttaccgtattgtcatgagaaaatatggtctgtactacttccattttctggctcagtatatagccaattaaaaatatactcaatgggcccttgattaaaaaaatacagtctgtttcagtatatgaagaaatttagattttctcattatcttagtttttgactgtcatgatctgtcatcagctgaaacagtctcatattttgtttctactttttttctacctttgcatttgctatagattttgctttaagaatttttatgctatgttttttggtgcataaaagatcagaggaggtagaccatcatgtgttctagttgttaacattatagtgcccttctttgtcttatttattgcattttgcctttaattcaacttatgtatgaaatgagtatcataatttattttttctttaattttgaccttaattcctttgttaaacatatttattgaacacttactgtgtgccaggcactagaaacctatgaatgagacagacaagatcctgccctcatggagcttacattttagttagagattggagcagaaaataatcaagtaaaaatagatatgtgatatgatatcaggtggggatgaagatgaatactcaaagaatgaagtagaataaggataattaaatgtaagttgtctctatttttgataaagtagtcaggaaaggcttctctgcctggtacacgtttgtcatttttttactttccacttgtccatcactgtgtgtgtgtgtgtgtgtgtgtgtgtgtgtgagagagagagagagagagaatatgccaggtggaacagtttgcacaaaagggattgttataatcttaatgatctataagtgtgcaaaggcccaaatgagaagatagtgggtatgtctggatatgaatttctgatccacatgagtggtgagctgaccagaatgggggagggataagaggagaattaaggacattttgtcttccattctgtctgaatttggctattattatgtgtattattattttttaaagaactatttccaatcttcatcatgattattgaatggatattctgtatgatgatttaattgaacccctggaatttcctgtcactgggcaggacttagcatgatgctgattgctcacaggctacagcaggaaaccagatcttgtggtttagagggcttaactctttatactctgaggctaaagagatgtcttttaactttagtcagtgtttattatacagaagtttgaatttttatgtaaattcaaataaacctggacttatttggaggttttcttctattgcttatgagaatcttatttcacctcacaatgatagtctttttaattttctgataggtttttcttatgttatatatgtgcataatatatacacatatatatacacatataacatatataatatattaaaattatacacacacacacacacacacacacacatatccatgactcttgatctggaatttattttggtatataatatatgatgtagctccaaaaagcactgctttgcagttatctcaaaaagatttattaaataatatttctttatctcctttttgggggaagattatgtatatgatgtttttataggtagtctgctttgtttctgaactttctattctgttttgttgatcaataacacagtttcaattacaattattttataatatactttatcccttacttacccccttccccatttcttctgtagcagaatactctttaatattatatcctgcttttattacaagttaattttctaaaaattctgtagttaaatgtagtttaaaaattcctattgagaattctgattggaattgcattaggatatttttttttttgagacaaggtcttactctgtcaccccagctggagtacagtggtgcaatgatggctcactgtagcctcgacctcccagtctcaagctgtcttcccatctcagcctcccatgtagctgggactaaaggcacgcaccatcatgcacagctaattaaaaaaaaaatttagagacagggtcttgctatgttgcctaggctagtcttgaactcctggacacaagtgatctacacacctcagcctctcaaagtgctgggattacaggcataagccactgtgtctggccagaaggagatattttaaatccaaaatagcagataactatgaatgacctgtgtggtgttttttgttacaagtataaaaacacagaaagtatatatatctaattcataatacaggttgcatctagagaggcaataggggaatggaagtggagagttatgtgaagggtattatttcttaagaaacagtcataaaacataaatggcaaagtattcaaacttactaagtctgggtgataggtaggaacatgggtattatggcaatcaatctctgtacatttctaaatattcaacatttttataatgaaaaacaaacaaaaacaacagatgaggcaggataaccaggcttgtaagccccagaaaacagcacatgcaatctgactcctataaacagactggggtagtatgtgtatatccagactttggagctaaactgttcaagttcaaatcctagctctaccacatactagctttatgaccccaggcaagttacttaaatgctctatgcctcagtttccccaactgtaaaatcagtgcaatagtaatagctacctcctggggttattgtgaggattagataagtgaagacatggaaaccacttaaacagtgcctagtatttagtgtgtgctcagtaagtgttagctatcattattataatattattattactattattacatttactacacatactacattgttttgtggacattttaaattttatataaatgttgtcatccaaaatatgggcctatctgcaacttgcttgtttttctcagtactcatctgatgttttgcagggaaatggctcattccaagactagcttttcatgggcaacccctttccatccttgccttgagaacccagcactggacttgtcaagctaccgagcaatttcttctcttgacctccttggagacttcaaacatgctttgaaaaaatcagaggaaacttcagtttatgaggaggggagctcccttgcctccatgccccacccactgcgcagccgtgccttctcagagagtcacatcagcttggcgccccaaagcacccgggcctgggggcagcataggagggagctctttagcaaaggtgatgagacccagtcggatcttctcggagccaggaagaaggcctttcctcctcctcgccctcctcctcccaactgggagaagtacaggctctttcgtgcagcccagcagcagaagcagcaacagcagcagcagaagcaacaggaggaggaggaggaggaggaagaagaagaagaagaggaagaggaagaggaggaggaggaggcagaggaggaggaagaggagctgccaccccagtatttcagttcagaaacctctggttcctgtgctctcaatcctgaggaggtcctagagcagccacaacccctcagctttggccacctggagggctcgagacagggttcacaaagtgtcccagcagagcaagaatcctttgcactccattccagtgatttcttgcctccaataaggggtcacttgggatctcaacctgagcaggctcagcccccttgctactatggcattggtgggctttggaggacatcgggacaggaagccactgaatccgccaagtaagtacatatgaaagatactaggtctctgaagaggcaggcagcacaagtttgaattttacctccactatttactaactggatgacctcaggctggccagttaaactgctcccagcctcagttttcttacctggaaaatgggtataatgatacttgcttcacatgattgttatgaatattaagataatctacataaaggatatagctccatgcttagcacatagtacatgctcagtaaatatcatgttcttatccctaaatatctttattaaagtactatacttttccttagtgtgtcttcatggtatccatcaatttctggcccctgatcccaaaggcattgaacacttgttgcctatactaggtctttcccagaaacctggctcaggcacttttcctgccttctcttctgcttgccctccagaataagaggccagctcacaacctgacctgcctctgctctaggacaagtagcctgggcttctaaactcgtccccccacaaccaccagcatcaaaggtattcctggggctgggtgcttcatgccttgataattccttacaatagataaggacattctttttctcttccactttctccccctccttgtttacctgcctctttgcattcatgtgggtgtgtaataggtggtagttgacagggtgagctgcctgggcagggaggccaaagcaagagtgtgttctggcagcaggactgccagtgtttgttcactccactgagccagttgtcatctgcatgccctatagtgcatggttgggtttttttttttaatttcttttgctccaaagcaaaagccccaggaccatcattgctattattgctcagtgctctggctgtcagcagctccacctgctctcctgtggagagctcagcccactctctgctggggctgaggttcgggaggcaggtggcttataagtgctttccttaactctctttatagcaggaatttgcctgagacttgttgcggttagaagtaccttgttatcatgtcttttattgtcagacaaatctgtgacttgtctatgtggagctagttgatcagttttccagcccaagatgccataagcacagcatttacagggcctggctcccaggcactgttaagaatccttcatgagggggggaggggggagggatagcattgggagacatacctaatgctagatgatgagttagtgggtgcagcgcaccagcatggcacatgtatacatatgtaactaacctgcacaatgtgcacatgtaccctaaaatttaaagtataattaaaaaaaaaaaaaagaatccttcattagatcccatgtggctgcttctcaagctgttcttctacctggggagcattctcattgtaattagaaaacattttgtgaaaaatacctgtgattgttatctatcatagcagggaaaagggaaaatgacctcccaatagtaggcacttaacaaatatttaagaagaaagaacaaataaatgaatggatgaacatttattaagtatttcttatataccagacactgccagacattatgtatctatttcatttaatcctcccaatagccctattagccattattatccccatttgacagatgaggaaactaactaattccaagttacacagcaaacattcaaagccagagctgtctgactccaaagcccatgcttattttgccttcctaggcagcctctcccagagagatcttgttctttccataggccaggagtcacagggtcctcttctctcctgtagggcaaggtgtaccagaggcagcagttacaagccctggttcttccttctttgtgtagctccctttgccttggcaccttggccagacagaaagaaatcactattactagagatcttgtaacttgctccagagatttatttttaatgactctaggatgtaagggaaaacatttgtttgcacacagctctgcttgtgactacaaaatcaattagatgctcctttgagtgatggagatttaaggaacagcatcattcccaaaatagctaatttttttgattgcttactatgtgccctgcattgttctaagcactttgggtaatgattgatttaatcatgaaaataaacctatgaaatagttaccattcatcttctccatttcttagatgaaaaaagcaaggcccagggagataaagtaactttatcacaagatctcaggtagctcactatgcttgctatatcatcccacgatctctgggctcttgaagaagattctattccagaccctaggagaggacagtgtcctagccagaaggaagcagctttaagattttgtaagggacatatagatgcataatattttgaatctaaaatgcaaacaaagatatcctaatttcagccaagttaaactctagtacctttataacctacatactgttctgttaaaaaatgctgggatacacacagaagccagctagtggaataattaagtattatttaagtctaataactgattcaggtataggtatagcttgctttatggactctatgcatttcctctcagtgctctgtgaaaggaatctgctttttgctttgatgtttactacatagaccacctataatcacttccctattaatggaggtgataaggaaaggatccctagaatatagtgcctaatgtgatatactataatatgatgcagggatgtgtatgctggggaactgagtctccaattagcacatcctttttttcctttataacaccttctgacacagaactttcacacataccctaaatatttttcttgtagataggaattccctaagttcagaccttcatattccctccagaatattctccattatctgctaacatagatatactccagccagaaaattccttacatgtaggcttttatatgatctcaagttgtccctttggcagtatagcatagcggcttgaagcacagattctagagtcaggttgtccaggtgcaaattgcaggtctgtcatttaatgtctggtgaccttgaggaagtcactgtacctcatgttgcctcatgttccttatctgtataatggttttcatgagcattcaattatatatgtatatacctatgtgtgcatgtatctatcttaggatggtttctggggcatggtaagtatggtgtgcatgttagctagtattgttcttttatcagtgttacaagcttgaaacttacatataaatgaatttacctaggataaaaaatattggcgggcccaactttcttttgtgtgatgaattaggagacagcatagcatgaatcagtaaatagctgtggagccttttaaccattatttttgacctttaagaactgcaaatagctgcaaaaatgactaatgagtttctcctattttccctttcaaacagctagaggttagcgaaggggtagtgacacagacaggtggaggatgggagtggctagcaggcaatgagaatatagtgagggcgggccaccccctagcataaaccacgggcaaaattatttgcccctccatcgctgagacctaacattgtagcatttctctctacttccttcctcacaccagactggaagctttgatggcagaagaggccaaacccaagccagcatggaaccagaactactttttttcctgagaagttctatttcatgggctggggctctgagaagcaatgcctcagccccacaggctttggtgaacccaagacaacagggtctgttgctatacttgtcaagcccctgggtgccactggttccatttttttccccatttcattctacaaccatggaggaggcaggagccattgggaatatgccagaagtggagagatgctatcccttttcaggctgaagtcctgccctacagcaggcaatgtctgaagagttcatgagagatgtggtgggcggtgacaagtccctggcagggtgctaactgcagcctccaacatggtgaccactgttgaggtcatgggtgacctctttgctgtgggagatctgcagcagagggtccatttcaagtaggagtggcattggaaaagaaaaaaatgatgagagtgtccaggaaagccacagggtgcctttgtaagcaagaagactagatagagccaggatgggttgagatccaggggtaggtctgagggaggccaacaggcttggagaaccaatagataaggtctcagatacttctctaccacctagcccctactttgggatccacatactggggtcatgcaccaaagggatgatgatcagaaggcctgccaggttttctggattttaattgagtgttaatgaccaaaccaaattatctcgaaagaagtctccctagccgatgaagtcaggggcatggaaatagccttctaagttcttaaaacttacctttacttaactccagtttgccttcatgtggcctgtttacatttgaacagtgccttctccatttttttcaactccttggtgaagcagggttccatttttcagatggagaaattaagaagcagaaatgtcagcagcctctcaacagaggtgctcaaatggtcattctttgtttccacagacaagagtttcagcacttttcgcctccttcaggggccccaggaatccctacctcttactcagcttattacaatatttctgtggccaaggcagagctgctgaacaaactgaaagaccaacctgagatggcagagattggcctaggagaggaggaagttgaccatgaactggctcaaaaaaaggtaaagttttttgatgtgtcctagagattttcagaatttagcttgaatgtatctggaggatgaccagccttctacactctctagaacatctcgcattcccatattttcagtatggaaaccatacagcctctctggatttctcacagatccaagtcctgtctatttttgatccagtcaataataataataacaatcataatcatcattattgtctctgtgatccttagaacaacccaacaagggctgggcacggtggctcccgcctgtaatcccagcactttgggaggccaaggtgggtggatcacctgaggtcaggagtttgagaacagcctggccaacatggtgaaaccccgtctctactaaaaatacaaaaattagccaggcgtggtggtgggcacctgtaatctcagctgctcgggaggctgagacaggagaattgcttgaacccgggaggcggaggttgcagtgagccgagatcgcgccactgcactccagcctgggcaaccaagagtgaaactcagtctcaaaaaaaaaaaaaagaagaaaagaaaagaacagcccaacaaggcagatattactatcccttttttactagttgaagggacgaatttgcccagggattacagactaaatggtagatccagcacttgaagtcaagactgtctgaatttctactgtacagtacatgctgtctctctgaattaagccagccttgtaagtaactcactacccagggcacatcagagtttctgccagtgggctcctctaaccaatggcagtgccattgatttttattctttgtgcaactttgtgggagacagaagagactaagtaaaataaggacaacttataggctggcaaactttagtatttatttgcaaggatagtcaattatgtcttaaaagtacaaaatagttaagtggagatgatgatgttgttgtcgttccaaagctttcctttctttgtctaagtaccactagtctggttttctaatccaattcttggaatcactttcccctccctgcacttacctattgtatttcataagcaaatagggttgtcatggcaacctcaaaggctcaatttaccttctttgtggacatctaaactcaatgtaaattgttctgcccatatttctttcaggatatgacccgtaggaagttacagggccatttgcaagagtccttcctccaatttcctatctgaagcaaaatgtcaggggaagaattggaagcatggtggtgttgaagttttactgatgcagatgtctgcttccttggattccatgttccccgagcaggggtactcctagcttactcagggcctggcctctgcaggggcaaacctagaagtctgaccaggaaaagagagagatgatcagaaatggcagagcacagaacgacagaaagtgaactaaagtgattgtgggtgggctatgacagtttttgtctctgaggaagaaaggtgaggaatgtcaccaatttgcgatgtcccagaaaaagcaactcagctctggctggatctgtgatgactccacaactctatccatcacacttccccaggactgaggttcaggttgtagagcccaagttccaagaagtaaagggctctctccacttttatccttccatctatccctggagcttgggaactggggtaagaaggtgattttccaagtgggtcattttctagatggcccctagccatcctttgtccccagcattgacttttatttgggagagcagatggtgggaatataactgacagcctcttcatctaattgtgttgccttattcatatcactgatccccagttctcagtgggttttggaactttccccaaatgcaaacctattatacttcagactgagatcatggtgatctcctgacttttgaagagttctaaaatatgacaacaggtcttggaacctggaggaggctttcttagtcttggtcactttggacatctctaattaaattactagaggggaatacattccagaaaactacaaacctatgggcccagtgcttgggctagaataagattaaaacatacactgaagcatactcctatgaacaagatactattctaaacatgtaacatgtgttaacttatttaattctcataacaactctatgaggtaggtcctattgttatcttattttttagatgtggaaattgacgtgcagagaggttgagtaatttgctcaaggtcgtatataataccactactttccagcagagcaggagttcaaactctggtagtctggcactggagtctctgtgctcttaaccacaaagcagtactgtctacagaggctatgggcagcctgggacagggccattcttgtcataaccttgcagctagacaagtatctattagtttggagtatgttgtagaactaatttaataataataataacattagtaagcatgcattgagcatttaagtgccagtcataatactaagtcttttacttatgtggtttcatttacccatcagaaaatctctggagttggggaggtgtccactttacagatgaggaaacagaagtgggattaggtatctatcctaaggccatagagtttggaggtggaattggaatccagatgtctccgactctaaaactttgctgtacttccctgtgactgtactcacctataggggagacaaatcagaagacacagacagcacttcccttaagaaacttacaatcattagcaggtgagagatcagacacacacaaggaatagaaagtgaggaacttcaagttacactatagggttctaattctaaaatacttaaaagctcggacaaaaaaagatcactgagagaagacttacagaggagggcttcctgtgagggaggggaggggcagagctgtcccctgaagaaatttaggaataatcaaaatgaagaaagagataaagagtaggtggaactgcataagctactcaggaacacaagaatgagtgttgtgaacacagaggagaatgaggagctaattctgaaaggctctgaggagggacattagaatggcaaggtggggccagactgagtaacaaataatagcagcctagcttttacgcagcacttactatgggccaaacactttgcatgcataatctcattgactccttattatgactcaatgcagtgggtaaagcaattatccccattctacagataaagaaagtgaagctcaataatgtcaagtcacccaaggtcccacagctacgaagtggcaaagctataaatcaaacccagtcgttataactccagaactcacagtcttatccaaaaggcctcaaaagccaagctaaggaagcaaagatctagcatagtgtcatgaacttgagaggtacttaaatggattgaaggagaatgaatgaagtgataggcaaataccttagtgcaaatgcttttccaacctaggctctcaaaaggactgtagctcctatttattaaatcgtcccaggaagggactgggtgcagaggctcacacctgtgatcccagcattttggaaggctgaggggggctgatcacttgaggtcagcctggccaacatcatgaaaccccatctctactaaaagtacacacacacacacacacacacacacaaacacacacacaaaattagcctggcatccatgacatgcacctgtaacctcagctacttaggaggccgagacgcaagactcgcttgaacctgagaggcggaggttgcagtgagctgagatcgtgccactgcactccagcctgggcaacagagtgagactccatctcaaaaaaaaaacaaagtgccagcaagtatttattaagttgcatctggtaaatgaagtttagtgcatggataccacttacccaatgccaaaaagtttggtggtgacatggagatccctaccagacggatagaaggtgcttgcccaaaagactggagttgctcatgacttgcccaagtttcctttgtttccagtgactaggatagagcccaccatctgttccttggattccaaaacagaggttacaggcacaaatcagtttctgttgatccccattctcatcctttgtcttctcctgtttaattcccctagatacagcttatcgaaagcatcagcagaaaactttctgtcttgcgggaggcccagcgagggctgctagaggacatcaatgccaattctgcccttggggaggaggtggaggccaacttaaaagccgtctgcaaatccaatgaatttgaaaagtaccacttgtttgttggggacctggacaaagtggtcaacctgttgctgtcactctctggacgactggcccgggtggagaatgctctgaacagcatcgattcagaggccaaccaggagaaggtagagttggggtctgtggggtgtgggtagagggaaataccatttgtttcttctcagggctccctctttcaagttgggctactataggaaacagtagagcatgggattaaaagcatgtgagcactgaggatgggcacggtggctcatgtctgtaatcccagtactttgggaggccaaagcgggcagattgcttcagtccaggagtttgagaccaacctgggcaacttagtgaatccccatctctactaaaaatacaaaaattagtctggcagggtggcgcatgcctataatcccagctactccggaggctgaggtggaaggtttgcttgagcttgggaggcggagactgccgtgagcaaagattgtgccactgcactccagcctgggtgacagagcaagaccctgtctcaaaaaaaataataataataaaataaaaaaataagagtgtgaacactggcttttaagtgccctgaaattcttgccctaccatttattagctgtgtgactgtggacaacttacataacgtcactctgcctcaatctcttcacctgtaaaatgaggtgagcatactacctgccttatgggattattgtgagaattaaattagtttatgttaattacataaaacagggcctgggacagggtaaacactgaatcaatgctagctcccagtagtagtagtagcagcagcagttttgcctcactctagagttggagggggaggtctcatcaagtatttgagattggaaagctgtcagtttcacaggttgggtcactatgcatatactcctgaaccaaaattgcatcacctttccctatacaggtggctttggatatacctttgaatccacaacaagaggcacatatctacatacatatacatacatacacagacacatacactcacacatatccactcacacagacacacacatcatacagaaagcacctccacagtgacagttgttcaccaggtgaaagggacacaggctggctttgtcagagccttcctccaccccaagcccagtggtggtccctacattgaagacagcgttaaagagatggaaagaggtaatttcacatcccctatccagaattgttgtcatgtttaccctcctgctacaggaaacaaaggcttttgcatggaggtagacttcagggcagaaaatctaggactgactaattagcagaatgtatagctgctttgtggcagcatctctggtggagtactgctaggcagcactgttggacagatgcctggtaattgagagagcccttacttggtcctctgcttccccagttggtactgatagagaagaagcagcagctgacggggcagttggcagatgccaaggagctgaaggagcacgtggaccgccgggagaagttggtgtttggcatggtctcccgctacctgcctcaggaccagctccaagattaccagcactttgtcaagatgaaatctgctctcatcattgaacagcgagagctggaggagaagatcaagctcggggaagagcaactcaaatgtctcagggagagtctactcctggggcccagcaatttctaattctaccagcactctgccacagcatccctgcccagccatgtgggaagtgctttcaatcttctttgttagcagtttctcagcaagtagatagcaattagcagtttgttccagccctctaccctggatgtctctcactaccccttccctagcagtggtcctaaccagctaggagaccctggggaagccacaagcttctacccaagggagctgcagcaaggtgtgatcttagaaccacactctccttcccacagttgccaagggcaagtacttgctgcacagagaaccaaggaagtgccttcattctgctttgtactaggacaccaaagacatcaagtactcatcacccacccatatcatcaacagcctctaaaggctcagagggaatctgccttgcagctctactctgccccagggcttgtggccagccatttctcacagagagctggctgccttgagggcattcacctggcaccagtttcagggcctcacccaagctttgcaggggaaagcacagagggaggaattacactgaaaaaaatgcaagcaaaggttgagtacccccaggtgccccttaggaaggaaccaggtttaaataggctctacccttacctttcccagcagcaagttcaggggaagaggcctactcttagccctggctagtgtgaccctcttcctgtcctaagactttggtcctaccacctcttgtttcatctttcctttacattgctgggggttaccgcaggtgcctaccccagggcttcaccatatgggccattaatagctctactaaaactgacttctagatgtaggtttcattattgggggagggggttcttattgttatattttaaatggccttttgattttatttatttttatgttttgattatttttttcttttttaactaataaggcgagaagagggaagttggagagggaaaagttagcccagaaggaaagcattttctgcagatcagcctgaatccaccgtggctaggtaagcaagtgccaaggcgttgaattgttcccaccatagctaccgatgtctaggaaggagttttccccttgaactcagagcctccctactgtggcctggccttgtgcttcccttaaagtctaagtgacttgagtttagcattccccagcagggtttaagtttttcttactgatttctttttgaaaccaaagaaatctcctgaaatggagaaaggttcagtcatttctctaccatctccaagctatgggatcagtagaggtgagctcagaaggaactcctctaaccattgctttctcagcctgtggcctggctcaagggaaccaaaactcaaggtagctgggagctccagccagagccagctccccagagcaattgaagacccagccaggatcttaggcatacaaacaactaaaactgctgctgttgccaaggccctgacaccagtagctagtttctatgctggaaaagcagccctcaggtggacgatggcaagaagggggttatggccaaatgctgccctgttatccagcttagctccctgttcctcactaactggggccaatccttggtatcacacaacccagccaaggcctggcatctcttctagttactgctgagttcctcagggtccttgaaggtcaactgtagcagcagggatgtctcattcaaccaaagaatttgccaaggaacttttgctgctgttacaaatacttgtcactagcttccatttcctcttcattgtatttgaaaacaatgggagaatcttggccagcagggtgtcctggggtagggggtggggtaagcctttctgtggagctctgggtttgctcttagtactgctgccagaaacactgttagaatggcaaccctgccattctcccctccagtggaagattctactttattcaggaaggctggtggcttgcaggggctaggcttacacaagccagccaagattgagaaggtaggggagtgctttcaatggaggccatagttgtcatcttttcttctgagcaggctctaggacaaacaatgagcaaattgagatgtcctgtattgggaggatgaggctgatatgtttcatcattctcagaatttgtgggctagagcacctttttgggaatatgggcctagggaaaagaacggtcacttacctggacactatggccatagtcttgagtttttctagtcagcatgtgattggttgtaccttaagtttatgacaccaaaaatactattaactctgttatttttgttcttaatcccatctcaaattagtttctagagttagaatcagaacacaaggatgctcattttcacatggagggaaagttgccaaagcatttaaaaaataaccccaaaagtatatctagcagtgaagcttggtagataaaggtgaactgctaaacagacactggcgtgccacactcctgccagggcagtctcattgtgtgtgacggtgctgcaacactgccagtattacttgagatgcagtctctctcccctgttctcagttcctgggctcagccctcctccaaggcctgccagtgagtagcagtttggaaggcaggccaagggagatccccaaagacagttatcagtcttaacttctgctgtctcccgtcaaatacttatacaggcccccatgggtaataggcaagcatgatggctgatagagaagtcagtgcatgagttactatcacatgtccccccaacccctcctgccacctcccagggctctggataattgaatcttcctgagtcccacagctggagactcaaccaggatatagctgtaaatgcccaagtagaatctgacagaataagacagagacactgaaaataaagccctagaaaggaagaaattggaagcaaagaaaaggagaggtgaaaagataaaaagcctccttcaaggttaggttcaggttctgttttccatttaacctcatgtgccataaagctgcccaggcacaccagagccacatcctgaacccgaccctccctgacagtgctgctctgccagtagcaagccccagatggaggaagctgggcccatttctggccacttccacccatttggagctttgccagaggagtcgtctatgccaataatatttctgcaacagcatattatattatttgaagattagtagatctttttgggggggtggggcaggggacagtttctatagatgaagaaccagtgttggttgtacagctgttgggggtcatctatcccatgtgaagctattctttttccaaatcttgttgtttctgcatttgtgtcctccaccactcccttcttggctgacatagatatgcctgccagattgtcatcaagggtcatatttcaataaaaggtgctaaggac

SEQ ID NO: 1161 - DNA, 23994 bp, mus musculus; identical to SEQ ID NO: 188

SEQ ID NO: 1162 - DNA, 34856 bp, mus musculus; identical to SEQ ID NO: 189

SEQ ID NO: 1163 - DNA, 34856 bp, mus musculus; identical to SEQ ID NO: 189

SEQ ID NO: 1164 - DNA, 3235 bp, mus musculus
cgggaccgccttccagcgcacatgcgcatcatggtctccaggacgaagcttttgttgggaaagcaggcgggactgactttggctcttcagtgtttgcgcatgcgcgtaacgtcctgaggcggtgggtggtatattaggcgaagaggcggggtcgcccaagctgccgcgctggcattttctcctggacaaggagagagtgcggctgctgagagccgagcccagcaatcccgatcctctgagtcgtgaagaagggaggcagcgagggggttggggttggggcctgaggcaaggtgagaattagcccccagactgggcatctgccccctggtgcgggcccccatttttttttatcccgatcccttcaccctggattctgaatccccttccaccccccaaaccccaattcaatgcccctcccgatccttcctgattcaaaacccctgtccgatccctcccatcgttcgaaatcctcagattccttgacctcgatctgtactgttagatgattcctcctgactcaaaacctccatgcaacttcccaaatgcgaatcccaacccaaccgcacccccgctccgaattcagaactcatctgcttcccgatccccatttgaagcttcgccctgtcagtagcttctcggggttcagaacctccatctggacgcccattcacttttaccgctccgatccgttcctcctcacattcaccttatccgcccgcacagtcagaccacagtcacccccctcccaattaggtccttcgtatttgccctctgtagtataacgccctgcccctctcccacagcccccaggctccgctcttgccagagggacaggagccatggctcagaaaatggactgtggtgcgggcctcctcggcttccaggtgagatctccactccccaccccaccatttccccagccgacagtcacccctccccgcgggcctctttggtctcccaaacgccgggatccggtttgaccctatttagtgactagactccgtgggcttttcgaattcccatcgtttatcgaagggggggaggggcgtctcttttcagccatcagtccctgctcagagagaggggagaccctgttagtagtcagggcaatctgcccagagaatgcggggtgggtaaggaaccatttttttttttttccagaatcctgacgcttgtagagcagtctgtcaccccctcccccagcctcctgcctccaccctccctctttctgcattccccactctgtgcgaccccccttattctcaactccgcgatccgcctgccgtcctgagctgctactgcacgcctcttggagcgtccccggctcctgttcgtgcccactttccgcataccgccccacccctcattttgcccttgccctacttcacccctgccacatgtttagtacccgcctggtcccccatcgcccctcgcgggccccctagatctctgcctcagcccccctgtttttgcacccaccgcccgcctgcagctccgctgctgcgctgccacccgggctccctattcccaccccacctcctgcctcagaggcccagagatttaattttttcccccctgtgtttgcaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaaggtgagatctctgctaacttcattttgctttggggctgtctcctttcttctctgagggtgttcatttgttctaaacaaaacaatgtatgtaactgtattcagctaggctatagggcatttgaagagaatgtttattcctgtcctccggatgttcacaaactgatggggagataatacatggacacaaataatatatacaacctgtatgtaattcagtttacattttgttatgttagtaaccaccatgtgttaagccttgagctaggcacattcacacaggttgtctcattaaaccttaaaggcacctcctaccaggtagggatcatagtgccaattttacaaagaaggaaattaagtgccagagaggtgaagtgacttgagtgatttgttcagggtggtacaggcagaaccagtggtggacataggaagaggagaagcctcaggccccatctttgggttgctcctggcctggctcggagatgaaactcctgcctggaagacagtgaaagacaaacccaggactcagggtgaccaatggctagtgggtcaggctgtcactacaggtgagggtttagagggcattcctggaatagataaggtgaggacacagaacccactggtgattctgaacttctctctgatgatgcagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaa

SEQ ID NO: 1165 - DNA, 3235 bp, mus musculus; identical to SEQ ID NO: 1164

SEQ ID NO: 1166 - DNA, 17695 bp, mus musculus
tgtgggcagtcgtttcctgtcgctgcttggtaacaatggggaagataatggctgcctgagcaacgtctccgagcaggcgctgggctagaggcgggtctcaaccagctactcattggaggcgggcttgagagcggcggccagggaggtgcggagcagcctcggcggcggcggccgaaccaaccgagtcggatcctgaccctaaaacctagtaagtgaagacttgggaatcctgtgagaaatgatgtagagcgagaggaagacagcggagccgcggctgccgcgttctctcaaaatggcccgagtgacgcgtcgtggcagaggctcagcgccgcctccggaccccaggcccgttgctgcggggggctccgtggcgtagtcgccgctgccattttagttgagtggtatagtcgacaggctctttgaaggggaaggaggtgggtagtacttcctctcggtggccgcgcgagctgcagcccaggccctccggagccttaggaaatcgggggaggcagtttttgagttttggcctcaggcgtcagaatcttagaacgtctcaggctttttcttctctgttctctggaggcttccctgacctccccgcgttttccatggcgggcttgggtttgggaaaagggaagtaaaaaatcaggctgccccaagtgagatgctggcaactcttgggcctttagatttccaaaacctcattttgagcccttctgcagggtattaccaattaggcgccccctggggccgcgatgacatcttccctgaggatctgaggcaaatgtggtttactcccttgctcgaataaccctggcatatcctttgccaggtatcactggaaggatccccccgcaaaagagagggaaaagccgttaggtgtttgttgtgttctcctggataagggatggaattgggccaaattttcaagttaatttgtgtttaatccaccaacaactcaatccctcccccattaaaaaaaaaaaaaaaagcctaggggggtctctgcttctgcagacggtacctgccacgcatgccatagcttagtaactagtattaaccggttgggcttctgcttcctgaatactcggtccctttttcccttatgctgattaatttcaagatggaggagacagccacgttccttccctagacagtttcaccatacttattccacaggttagtctgggaatctgaggcctagcagtcttgttattgaggtcattttttttttcattttggggcaagaggaagcagttgtatcagattgtcatcttccatttgcaagaccccacaatgattttttgccagaagtaaggagcccgcatttcctgaatcagaattaaccgcagtgttttggactgattgaaagggggaagaaataataaacctactgctactaatcatttctttcattcttcgtgattatagacagagtaactacttatcaccccattaagtacattgtatcttccctggaggactggcacaattataacccctccccccccatgacttttctaaactgtagaaatatagcttaggtagctagaaagaccaatccactttttaaaacttgattttaggacacactccacttactgaaaaatgttacaaagatttttttagtccatgatgttctgatgaattttaatactttagttcctaccttaggctagtgtaatgtgccagataagtccttgaaagtgactatcagaatctgaaaataattactggtctgataaggaaaggcttattttaagcaagcttataataaaacgtaaattgtctctcagtcttagaagacatcttttatctaactcctggtcccctctgaccttcttgctctccccaaatgccctaatactaatattgaattaggttgggttatggtgtgtctgtatttttttttttaggttgtgtctaattcaaagaaaatgtgtatctttttaaagaggaagaataatggattctttttttttctagagcagagtgaagaaaactaaaatccagtttattgtatttcaatactatgtcataacagtcaggtaatttattttttgttgcgtctcctgatgatttatgtgtagaatgcatgtttacaaatatttattgttctattttgcaggccctgtaattggatgggctcattgatagatgttagatggtgttgggtattcttcatgataagaatgggtacttttcactgggaattaaaagggtaatgtttctggatacctggaactcaccagtgctttatctgtgaatttgactctttaaaataatgtctgaagtttaccaatacctgtatagaacaacaacaacaaaaaatttgttgtcttatatcattgttggaatggcatgagtataagtaaaataacatttaaatgttcattggataactaaatgaaatatcagaatagcttacgagagtataattttacgttactttgtgtgtggtggttgatttttttcctttaagattcaaaaattcataattgatacatgatacttttaattgatattgactcctttcattattattatcatcatcattagggtaaccacataatttattgcctaaccaagacacttttaagaacaaaaggaacattaataattcctggacagcaggtgcaaaccttgattgtccccgacaaactgggatggatacttagcctaaattcataaccaacttctgctgaaggcctgtggtgctaggccatgtgctttatatgcattattttataattctcacaacagagcctcatgagaatgttaacttttatagaggaaaccaaaaacccaaagaggttaagtataatttgtcctcagttaaatagctttaagtggtggagccctcattttatcccaggcctgtctgacgttatacttctgggtttgattgctgtctaattagataggaaatgcaatgaaaatgaaaggttgtagtaaaaagtctgtaggttatgttgcatcagaaacttttgttaatacttaaaggttatccagcaatccccccttttcgtctgttacgttcctgtttcagctattatgcatgtttacacatatttattgttctatttcacaggccctgtaattggatgggctcattgatagatgttaaatggatagctccttgtatatcatttgataaacttaatttaaaatcagaaatgattttaagaaatagcttaataattaaatgatctggaaatactaggctggttggatatctttgaggttagtgaacatgtagtgagccttaatatagtagtaggtcaaatgaggcatctgcatttatggaattatattatatgtacattaatttttccatggccatggtggattagaaatagagcaaatcaccagccagcctcctgttctcttcatttaccatagagtggatgacaaattagagaataaaaagtcttctgtcaaacccaaaccaatgagggcctagaattttgtgccactgcctagaactggacaggtttttctttaacacaaagatttctaaaacctatggcccattgatttcagaaagtatctagtttacataataaattgaagttctgatgtccaatataagaaagtaataacacttctgtatctatttttctttcatttttttttctcagcctcaaacatgaaagtttcccagataatccagcaattcatttctctttttatcaattgaggtatttttatttatttattttttatttttttatttttttgagacggagtctcactctgtcgcccaggctggaatgcagtggtgcactctcggctcactgcaacctccacctcctggtttcaagcaattctcttacctcagcctcccaagtagctgggagtacaggcgctctccaccacgcctggctaatttttgtatttttagtaaagatggggtttcaccatattggccaggctggtctcgaactcctgaccttgtgatctgcccaccttggcctcccaaagtgctgggattacagacgtgagccaccgcgactggccaattgaggtattttttaaatatacctcaattgggggaatatatttatgaacttgtggtttttctcctgacatatatagttggtatttttgctctagattttcttatattttaatgttccaacacaagggttttttttttttggttttttttgtttgtttgtttgtttgtttgtttgttttttggttaggagggcaggacgagttttgctctgtcgcccaggctggagtgcggtggcacgatcttggctcactgcaacctccgcctcctgggttcaagcggttctcctgcctcagcctcccgagtagctgggattacaggcacgtgccaccacgcctggctaacttttgtatttttactagagatggagtttcaccatgttggccaagctggtcttgaacccctgacctcaggtgatccgcccgccttggcctcccaaagtacagggattacaggcctgagccaccgcgcctggccaccaatccaagagtttaatttcattagtcacagtagcacctacatatctgtgagacaaataatctgtaggcagagagcacttggtgcattacatagattggtggatttcttgcaataattttgcaactacaggttggtttgcttttataacatttgagagtctaatggcgtttccatgatgatgaacatgttacttcctgggagaaaggaagtatttgtgtttgatgtttaaaatttttttctggaatgacaaaaggtcccttctgatctccccttgactataggaggaaaagtgttaactacaacttttgttttttattgaccaatgatccctttagtgctgattataactaaggagaccatatgaattatctaaactgggacacttttgagagtgaaagggagagccatattactgattacttcagtacaagtgtaaacccttactcttctggacaaaccaaagatatattgtcaccctcttcatgttatttttatgtaggtatactagttcaggaaggacaattgtcagcatggttggtcttaaatacaaaattacttcctcaaataactgattggtatagataatactttcttttttagttaagtgattttaattttttttttttttttttttttttttttttgaaacggagtctcgctctgtcgcccaggctggagtgcagtggcgcgatctcggctcactgcaagctctgcctcccgggttcacgccattctcctgcttcagcctcccgagtagctgggactacaggcgcccaccactacgcctggctaatttttttctatttttagtagagacggggtttcactgtgttagccaggatggtcttgatctcttgaccttgtgatctgcccgtctcggcctcccaaagtgctgggattacaggcgtgagccaccgcacccggctaagtgattttaattttaaaaattggcttcaatctttaaaaacctgatttttgatggaaaaatcttaggtccttaaaatagtgccttagttactgatgaacaccaacattgtcagttatcagtgatttttaccttagtaacttaaacacatgcactccttgggtttttgagtcattttctttttgacttcttaggaataatgagagaagcaagtcaaaacgagtttatggataagaccaaattataatttagtggcatagcttgataataaaagaacataaaacgggtaattgaagattaaattcactgtctagattaaagtatttgactgagatgaaatgtcataatggtttccttttttaactaacttgatcctgtagatcaaccgcatttggcatggtcttcagtcctttgatttactgaagttcttaacactctttcagttttaactgttttagagcgttttagtaaaagttgtttgagctgcaagtcggtgcgtacatgaggaacattcctgagtccttttagtttttctctgctgtccttttcaactggtaaagatagaagaatgtaagtggaggctaagctaactgccattcagatattttataatctcttattgttatggtagcatgagcagtgggggataccttggtagcattttctgataggccactcttggaaattatcaacaaattttttagttggtgagaggtatcatgcaataaggaaagtcagtgagacattaaccctgcctgttcttttttttttttttttttaggaatgctttatatttcttttcaaaaagataactgcgtgagtggagatagaagtacattgagtgaaatggtagtgagaaaagcagagcttataagcttatgtcctagttatttgtgctgtttcctaaacttaatatttcttaatatcgtaatgtggtgtaggttatatcttatttacagttacagattcatagaactggaaagtaccttgcagatggtttaatccaatactctaatattgatggagacttctctggcacaagaggttaaatgaattggccaaatccacataaccaagttacaaccaagactggatttcagtatctcttttttcctttcacagagctgagtttcaccctgctacccatgtgtagaataaaaaaagatacctggttgttagcaaatatttttctgttacaaataccataacattttaattaaacattctatatatgaagaatccccaacacttttggtgcctacatacgtaatgatatgatggtactttttgttttctggccttaaattcagcagttctttgtgatttaacttttaaaaaactgaataaagtatttttcattttggtgatggtatttaacattttcttcattgacacagatcacatgtcactagttcttaaaggactcctttatgaagttcttttttgttttttttgtgtgtgtgtgtttttggtgtgtggttttttgtttgtttgttttgagacggagtctcgctctgtcacccaggctggagtgcaatggcacgatctctgctcactgcaacctccacctcccaggttcaagcaattctcccacctcagcctcctgagtagctgggattacaggcacctgccatcatgcctggcaaatttttgtatttttgtagagacagggtttcaccatgttggccagactgctcttgaactcctgacctcaggtgatccgcccgcgtcggcctcccgaagtgttgggattacaggcatgagccactgtactcagcctcctttatgagattcttgatgaagctctgttgcaaacaaaatggattgcccttctcttgtcagtgtgacacatttttgtgttcatacccataattttttaaaaattggcatgtcctgctttagaactttattatagaatttggagcttgaatgaacacatatgcacaaggtgaaatattcaacatgatttagtagttagttgatgttacgttaccttaattcctccctcccacccaccccactttttttaaaaaacgaggtaatttcttccatatgactttttaaattttgatatggagtctctgtcacccagactagactgctgtgacgtgatctgagttcactgcaacctctgcccccaaactcaagtgatcctcccacctcagccacatcagctcccaagtagctaggaccacagatgcgcgttaccatgcccagctaagtttttgtgtctttggtagaaacggtttcaccatgttgcccaggctggttttgaactcccgggctcaagcgatccgccgacctcgacctcccaaagtgctaggattacagatgtcggccaccacactcggccagcaccatgcccagccaagatgactcactttttaaaattggtttttacacaggcatttcacttggtgtttcagaatttagttttgtaaggtctgttttattaacagtatttttggatgccttaagtctccttaattgggtactataatgtagtgtgtccatcaaatataacatgcctgtgtttatacttagcaccaggtctcctgacctgttagtactgaacaatatgttttaaataactttttgccttaacattataacaattaaattttttaaaagtttggtgtgcatggattagaagaattaaatgagatactacatttagcagtaatcagaaacagtcatttgcataatttatattaatatataataatgactagaagaagttgagattattaacaatactttaaaattctcaaagtgaataaaatctgttttaaataaatctcagggttggtgttcttgctggcctttcctccccagaattaaacttactggatacagtcccattcattgaccagatgagtagctctttgaaacgattgggcaaaatttctcatttggtttcttgtttccaggaatggatttggatatattggcacacagtactctaaaagaaataaggttaataaaatatgctgtttatctaaggagcaactgtatttttaaaaattactaaaagttgacttatttaaaaataagtccatctaggtttgtgctgcttacaaaaggtgttttgtcattttggaatttttcatacagggagtgaacatggtataaaaagctcatagattgaatagtttagtcatacctattgggattgaaggaaggaatgtgttttaaagtatagagtcttgggatatgttgggaggcagttgtcttagtgaaaagttgactggatttggaatgcagagacctggatttaattactggccctttcccacttactagtcacatggtttttggtaaatcactttctttctctgtgcttctgtttgtcacctgtagaggtggtgattcctaattcatgggattattgtgaagattaaatgaaatacaggtgtaagggctatgtaaatacagggtgatgagtattgcttatagccagagagagacctaagtgacttcaaaacagttatatttcattgtttaaattactgtatgtttcacgggtaatcttttcatagaaaaacagctgatgctaatcatatgctgaagtcagaatttctgacttatctgagataactaaagaaatggatttatgaccttctcttttacgatgatgttgaaagatcccagcggtgtataaggattctctttttcctcttgctacttaagctagaaatgtaccacaatgttactcactgcaaagtagaatctggagacctgttttgttaatgttattcttcactaatattttcacacccaaaatggagatagagctgtatttgatcatttggagtatggttttctggtatttttggcatgcctaaactttaaaatgtttgtttgcacttagtaaacaatagtggcagattatatctacctggggcagaacttgtggtttttagatttattccatttctttcttttatgccgcttagatagtgaaggtctgcttaaaataagaccaggctcattgggtgtgtgagagtaaaattagtttacaaggcatttgagagcattgccttgatttccattttctttgcaaatgtaattatgtctagtccaggggacctctgcaggtattgtagccatagcttactctttgaattcccttataagggagggagtgccttgccagtgctgaaatctcttgacccccaattccagcccaggggaaatgctaagttaaggcagaaaggatggaggctttgaaataagtgtgttgcaggagtatcatggggaaaatattttccttgattgtctctggcatatatatggaagggtagcaggaaaggagacagcagcatattattattattgaagaggtagtgatttggatttgttcacatgttgctttatgagtgtgtctcattaaaattttgaattaaataaaatttagaattccctctttcatggaacggaatccaagctcatcaagcaggagctgtttaggattcaaaaatctctgaaatcagtgtcaggaaaattttgaatggaggtaaaatgttttgtctctagtttctatgtaggaaatggtagaaattctaaaaggtcaagaatgaatcttgaagattcatgagcataggaaagacttatctatcccatgagtattgaacattgtagagtattgaaccttattgttttatttttggaaaacataaaggggatgcaaatagtgggtttgtagagcatgaaaaatatattggggacatttgaaactctccctatttgggatttctctatcttacaaagaaatactttaaagctgtgctgcccaatatggtagccattaaccactatgtgactgttagacacttgaaataagactagtgaaactgaaattttaagttttttttttattttaagcttaaaaaactgaagtagtgtaaaatgtttttccactaaacacaactgtattgttttgctgaactacattccattttatctgtcgaaaatttagcatccaacttgtgataggctgtaagtgtaaaacacacaccaggtttcaaaaacagtattttttaatgtaaaacatctaaatttttttttatgttgaaatgattttttttttttttgagacagagtctactctgtcgcccaggctggagtgcagtggcttgatctcagcttactgcaacctccgcctcctgggttcaagcaattctcctgcctcaacctcctgactaggagtagctgggactatgggtgcctgctaccacgtccggctaatttttgtatttttagtagagacggggtttcactatgttggccagtctggtctcagaactcctgaccttgtgatccgcccacctcggcctcccaaagtgctgggattacaggcatgagccaccgtggtcagtcagctgaaatgattttttttgattatgttgagtcaataagatacattactaagattaatttcacatgtttttactcttagtgcagctgcttggcattttgaaaaattacatatatggttcaaattgtatctcttttggactgtgctgtttcagagagattactaagggaaatgaactcagtgttcacattggatttctttcagtcatttaaatatccacaatgtgcaaggcattgtgctagtggcatttggcagaagttttaaagggactgtaattctggtttgttccctaaaagaaatctatttgggaagagaagacacatacacttcaaaaatataaaacattatggaaggcaggaagtgccactctagtagcatagacaagtgctatatgcagagatggatggaaaaattgctagctgagatagtaatagctccttaggagggaagatctcgttggatctttaagggttggtgaaatagggagaagctaagaggggactgaggggaatagcagtacattgtgacggtggtaaagcacaaggtatgttgggggaggggagtatggggtagaggtaacctaagtggattggtgttgccaagaaaatgttgtaattttgtgtcactggagtatgtagcttactatgaccctaagcccagaatagaagaccaagagacttcactacccttaatagcattttagtccaaatggtcttttggaatcagtctcttctggctctcacctaataaggaatcctctttttaatatccagcttctgcttgattatctcaggagacaggaagtttgcttgcttcaagagactggtagcatctctatttttttgacaattttgttagattgttttactaaaaggaagaattatttgcttctgcatgtctttaactattgaccttaatttaaccctatggttgtgctctccttcatgttattcctctctaaatatttgaagatggtaattgtgtccatttttagtctttctccaggctaactacctccaggtaattcatccatttcttttatgatgctcccaggcttctcactcgtgtttcacttactctacatgtagtctgcttttgtttttgagacgggatctcccaggctggagtgcagtgatgcagtcttggctcacagcagcctctgcctcccaggttcatgccattctcctgcctcaacctcccgagtagctgggactacaggcatgcgccaccacgcccagataatttttttgtattttttttagtagagacggggttttgccatgttagtcaggctagtctcaaacttctgacctcaaatgatccgcccaactcggcatcccaaagtgctgggattacaggtgtgagccaccgtgtccggccttctacatgtactatgaacagcaggtttcagtggggctgttacctgcttttatttgaacaccgtggtctatgaaagcaacttgtgattctcgtaggtttcatagccaggtcaaacaggctttttattgagcttgtgttagccaaaaacttgaggtatctttcatgtgaattgccaagacaggttcttccccgactgtgtacttttactatgggttattttagcttgatagcccttcataaagtgtccgaggtaggatatttaccattgtttttatttcagcccatcctaggaatccactgataattcagaataatatttattatatacatcttctgtgctaactcacagcttcgagttgtttatggatttgtttaccatgtcttgggtggattcatccaactggttcatttaaaaatgctaaagtttacagggctgtttgcaagttaacattgctttgtaatctttgagggtggtgttcaacaactgtgaatctgtttaactgtattgtcatcaagctccttactactcagagtatgattctaggttcagcatcaacatcacctggaggcttaataaaaatgcagaatctcaggccctaccccaatctactgaatcagaatctgtattttaacaagatttccagataattcctattacactggtctatatttcttcttaataggaagaaaaacctcagatcctgtgcagaaatcaagtcagtaagtcagcagtgttatcctgatgtccctatcaaagaggttctcaaccctgactttcaaaatagaattacctgtggaatttaaaaaatatccatgtctgaccaaccccagagaaagctccccaagtaattctaatgtgcaagccaaggtttagaaccatccctatgtgaagcaaataaggttaaataaggttaatctttttgggggggggtttgtatttttttaagttgaccagcagtgaactccacttcttgtgaacatactgtcttctacatgtttgcagtttatctgataatgtatttgcagaattttcccctagatgtattgtcacattttactgctctgtagtttgtagatctcactttttttgaagattggatcatttagcatctctcctgttctctatgacatctcaaaagattgtcattagaaattacgcattcttggcttttgattttctttgaaaagttgttttttccactctttccagttagaagatgattctcattgttgaataaaatagaaacaaaatggaagttgagtgactcttccgtcttctgttaatatacctgatacacccccctccatactcagtacaagacccctttcttgcttcacattcagtgttttaaatctttcccatatttttgtaagtttctgttccttctgggcttttacctccctgataacttttttttttcctttgagacggagtttcattcttgtcacccaggctggggtgcagtggcacgatctcggctcactgcaacccccatctcccaggttcaagtgattctcctgcctcagcctccctcccaagtagctgggattacacgcatgggccaccacgccaagctctttttttttttttttttttttaagtagagatggggtttcaccatgttgaccaggctggtctcaaactcctgaccttaggtgatccacctgcctccgcctcccagagtgctgggattacaggtgtgagccactgcacccagcccccgatactattgttaaagagtttgtgccactgctgtaaatgtctttggcatgtgagttttctcttttatttggttcatgtccttcaaatgtcagaacttaaccagatatctttgccttctttggaagatttatatttttcaagccttttaaccctgcagttgttttcagaacaatttacctatcctacacaagtgaattttgtcttaactttcatgcattagcgttcaaactactaaccgctttattaagaacattagttaaatgttcttagcaaatttgagaaattatggctgactttttttttcctttgtgcttttctatatttttaaaaatcggctgcctttaccacttctaataccaagttgtattacttgagattcatgtgggaaaacttggcttccttttcagggtttttttttgttttgttttgttttgtatttttttagtgcctgttttttgtgcgtgttttatttaagctggtgatttctagtgtcaaagtttcaagtattataaagtaaccatttgtcagaagtttatgtagtataatcttattacagttaagcaatctcagttatgagattaagaaactccaaaaatattatgatctcccccccaccaccacatttcttgacatactcatcttaattaaacaagataggatagttctaaaaataatgatctaaggaaaacagtggagatctaggtatgcctctgtctagactaaaatttatttaggcttagcaagcaggcaaggtttgacaagacaggcttctttgtgtttttatatctggagtaagacttgacttatttttctctctaggattgaattgtgaacattccggcacttcaggtgttgtgtgtgggtgtatgtgggattaagtcatagtaccaatatagactaccctttttccataaattttttcgtattgtcctagtctgttcaggctgctgtaatagaatatcataaactgggtggcttataaacaacaaaaacatatctttcacagttctggagactagaaaatccaagatcagggtgccagcaggtttgatatatgttgagggcccaattcctcatagacagctgtcttctcactttaacctcacatggcaaaaggacaaaggaactctctggggactattttataaaagcgttaatctcattcatgagggccccacccttatgaccaaaggccctacctcctaatatattcaccttgggatttaggatttcaacatgtgaatttgagggggacaaacatttggtcagtagcacatatgttcatggaatttagttgtgttcgtggggaacataaggggaatctggggttgtaaggtaaagaattagaggatgaacatttttgtttgtagtctccctgtattttagattgttgactaccattgttttttattagtgtgcagttcattgatgagtatgtgtggaatgtctgccaatattctggtttccttaaactcgtacaaatagtgaatgacaagaatttttggctaagtttatgtattacctagaacaggagttggcatcctttttctttaaaaggccagatagtataatattttaggctttgcagatcaaaaagcaaaattgagcatattgtcacacaaaagagagaaaccaaattctcacagtttttcctgataaaactcaaaatgtaataacaataattgagtacagtgtttcgtgagataggtttactaatgagaagaatgatactcttttgagggtaacattttgcttaattgggattcatagctagtattccttattagtcatttgcaaatgtccatttattgctgacttaaatatttaatctttgaaaatatcttttcatacatataggtattgctatcttaagcaatccacaagtgtatgattttagtgaagcatatatagaattttgttagatttttatctttttttttttttttttgaaacagagtctcactgtgtcgcacaggcaggagtgcagtggcgcgatctctgctcactgcaagctccgcctcccaggttcatgccattctcctgcctcagcctcccgagtagctgggactacaggcgcccgccaccacacccagctaatttttttgtgttttgagtacaggtggggtttcactgtgttagccaggatggtctctatctcctgacctcgtgatccgcccacctcagcctcccaaagtgctgggattacaggcgtgagccaccgcgcctggcaattttttatcttttaatttaatttaattttttatgaagatggggtctcactatgttgcccaagctcgtcttgaacttctgggctcaagtgatcctcccacctcggcctcccaaagtgctgagattacaggtgtgagccaccacaccccagccagatgactttaatatttaccttttggcatattaccactgcagagatgtcacttctagttgagggttagatggaagctcctcagttgcacagttaaatggattttgaaataaggaaatttattttgtgcttacattggggtctgcaaaacagttctggaactgtagtttgagctcagaaaatgtatgtgctacaaatttgtgtgggaatggagctctcattactttgtcaggacatgaagtatataaaacagcttgacattacatgtgataccaatgttgttgctgaaatggctttaccacagtataagtttcatatataagtattttttgctttgttgttttaggatggattcattaagaaacattatcaagtctgcaggaaacactaattttccaagctatttattgtttgataatagtaattgagagcggttctcacagaaaataaatccatctttgccttgagcacaacaaatcacaataaaactttaccaatattagcccatcaaatgttgtgttgtagagcaagacaaaatttctgacaaaaattcatggaacttgagcttaaaccagagttcataagagagaagtttatcattagtgctactggttcagtaatatgatagattgaaattttcttcagatcacttgatgatgagtaataaaatatataaccataaacgttaaataccttacattttcataaactttgtaaatttgtccaactaggtctttttccattccatatatatttttaccattccagtagtaacatatcttattatgagattctgcttcaggttttgctgaattagttttctcaactttgaaaatattctcacctatgattatttcatgtagactacacataggggctacttctgcagttcaaactccttgaataatcaacacttggctctttgaataaacaataacttaagtagtatcagttacatttgtcaacaaatcaagagccaaagagaaaaccactccatcatttaccttatttttcagttgattagtgacattgcttttcaatattcccagctttttggaccactatacttaccaaaagtccaatattatgtttattttctctggacacatttcttcagcttctgcactcaaacataatttcactaactcaccatcaataaacagctttcctcgtttagccaataaatgagcccctgggaaatttactttgattgaagcctcatttttatttttgtgaagaaatattttgtgatgagatttcactttaaattttctaactttttgaactgtagttttcctgtgaattgggaatattgtcactagtgtttaatagtgtcagtatatattgtatttagtatatagtattttttgcataatcatgcattctttgccatctaatctgatttttgaaaa

SEQ ID NO: 1167 - DNA, 17695 bp, mus musculus; identical to SEQ ID NO: 1166

SEQ ID NO: 1168 - DNA, 191883 bp, mus musculus
aggaaaaccagtagcatcagcagcagcagcagcagccgccgccgccaccaccgccgccacagcagtagcattagcggcagtagcagcatttagcaatagctttaacagctatagcgacagtagcagccgccctcctctctccctctcgcggacggccgcagccaccgcacagagcgggctccaggcgccgagcgcgcagcccgctcgctaggtagctccagccggggcgagcgacagtgtaagcgaagcacggacccttggagcagccgggcagccgcggaggctctgagtttcagggccagagcccgacagctctgactccatctagcgcggcggcggcggagcctgagggagcgagcgaggagagaggcgcgtccacctggcgggcccagcgtatggagctgaggcagaggcggcggcggcggcggcagcagtagcagcggcggtggcggctaaggcagctcgaacagctgcggcgacggcgacagcccagccttgactgcgaccgcgctagctacagcgcctgctgcctgagcccgccagcgacgtgcgcctcgggagtcggcctgtgaggtgagtaggagcgctgccatacagcttcctggccttctcgccggctccccggctggctcggggtggcggccgcagggggtggaatgaactggggtaagtcgagctagacgagaaggaagggaaaacggaacggaggacgtctgtatgcgaatgtgtgtgtctgtgtatgagggagcgaggccgctagggcgagagatcccggctcgccctgacaggcactgcaatctaggaaaggcctctgtgcttgcgccgtaggaagggggttgcggggggaggggaagcgagcggaccggagccgccgcgcttacacgcacgcagctcggcagagtgccgcctcctttcggactggtgcagggtagagcctggccagggaatggggcatgggcatggcacgcttcggcgagagcgggaaaacccacgcggcggccgaggccgggcgctcggaccaaagccgcaaaggtgcgaagccgggcggccgtggcgaccacagagcgcccccaggacacgcgccactcggccgaggctgcggacaggtttaagttggaggccagaccgagcctcgcccagctcatctcctttgcggaaattggcttgtggccccttcgcgctctcggtggcggtcgaattgacgcttttctgtgtggcttctggcgcttctctctgccgcgccccgcagcacacgtcggctcgcgtcttgtacaccctgtagggcgggaaggccgtgagccggcgcggggagcggagtcccgctccgggaaagtgtggaaaccgcgctgctgagttggcgccgttccgctgaggaattcagcgatttcagcatgactgcttctgtctgtctgattcgtgagggaccgaatcacccgcgcaaggttttctgtctttttcgaagttaaaaaaaaattggcatccccatttcgacaacagcactcttgatttttatcaagcttctggttgcattttggaataagtgggtctcatattttgcttctggatcttggctcccagcatattgttgaatgctgtgcacagcactacatttagatatgtggcctttttctaatgttgcattttctagactgttatctgaaaagacatgatttgtgttgtagggctggcagggctgtttttaaaaatgtctaaagcactttaatcccgggatttgaatatatccttggttgtttttggtggaggagttcctggaatattttgcttggtgagaaaaggtgctgtaatggtcttctctgaactccttacgaccatttgtgttttggaggggtgaatctcccttacatcttttacacatgaggtaacatatgaccaaacgttttatttacagcagtgacgttcttatggctgaggagaatttacacttattgaaaaaatatttttagaagggaacaaaaaagtcctaagtaactgtcattttacatattaactgggaaaccggctaatcaaataaaactggctgagtgtctgaaactctatcccagtgaaatatgtggctgtgaatataattaaccatctgtctagtgagcaatttaaatttgggctggtacatttttattacagtgtctaatttctggaagacatacattttacccagcagtaacaacaaaaacgtatttgcttactaggtcaaaaatttactgtgtggtggtggtatttccctttcttcctccatgtctttcatagtccccacactgcgtaacctgggaggtcaaaaatgagcttcttgtttttgcaaatagcgtatttacaatagaggaactgaaactagccctggtggctagtgattagacatttttgtctcttagaaatactttccaatatttcacctccccgaaaatctagatagattgcatgcatgctagttaaaaaaatataattttttggtgcacatggggtagggtgattgaacaaaatttgtaagacttgaaatttctctatttactttctcttattctgatgaattctctacctggctgtcccaactggcccccccagacataaactcatacaaaaacacatgcttttttccttttagacagtttttaaggttaacagcattcagatctgtgattttaacaatatactgataaactgcttttttttgtaaatcgtaagtgtaaaataccatgacataaaaatacattgtacatatatttaaagttttccctatggtgtgattttagccagaaatttattactaggaaaaaagagggatagagtttgagtagagatgaaatggctccgggaagattagatttgagagaccttcaccaaatagctattgttaacataacataatttaaatgaaccacggattgattgtgcagtaagctagagaaagtcatttaaaggaaaatatttttaaagcaaatatttgcctaaataacagctctgataaattggtaacaattatgtaagtacatggcagaatttgacatatgtcaagtctgttaaataaatcaacctgttcagtgaataaatctttgatgcatcagtgctttttcacacacacacacacacacacacacacacacacccataacaccctgttgccaaagtcaaacaactgcagtactgccactttctgttttacttcaagtctgtcccttttccctctttttcttttttccacaatcttctggttacctgtaagctacctggtgagcagagagaactaaaggtgaggtggtgttgcctgtgtttaggaggtgggagaagatgagaaaagtgctaagtgttggagcacacaaagatgggttcatggatcctggacacggtcactatggaggtcctcgtctcacggaccaccatagtgtatttgcataggagaaggactggcctatccagagaagcattggttgcagtttctctgttcctaaatccagttctagtaaataatattttttcttctgtatatcccttagtaaggggagaaaaatagattctaaatggcattcgactgttacattatctttaatcttttatctgatggcacatatataagtgttcccggtaggagtaagcaaaaggagaaaagggccaaagtggatgaaagggaaggggaatgattgactaaggagtaggtcatttggcttccttgtttttcccatcttaagagatttttggtttggacattattcattttttttttcttttacttcctctgaaaagttggccaccagctccctaatggacagtttctccaccagagcaccttttcaaacccaaggtcatagggtcagacacaaagcacttgttacgttctctatggcacttctccagggctgcttgaaaacaaaacaaagaatatatacacctactacgtacccataagaattagaaaaacaaaaacaaaaacaaagagcaccagacaagtttgcatcacttggagctacctttaagttcacaccttttctcttgcccagaaaatttctttttaggcagaggtgaacattcgtgtcttctcaaacaacaagtggctctgtttgtaagtacatcacaaccttggggaaatctggtctggggtgtcgtcagttgggaaagtggagggttggggaaagctgccttttagtgatgatagagtcttttatggaccagctacaggtaggcgtgaggaccttcattgtctctgttcccttcagtccctcattgcccacagtgattcacaggcctctgctagggaacgtgctcattttggtctttttctgcaggtaagcactatgatctgatttctttccctaccatcttctctggtggaaaagaagctgaagtcttcatgaccaactattaatactatgtacacaattattacttttccaaagagcacttcaatatgtcatcttatttatccccagtgtgataattttgatgtaaacaattatctactgttttctctagcaccctcaagccccattaaaaaaattttcagcttctcaccctcagtagcccattttaagtgttataccactagcttaaacaagaagttcctcctgatgtttactctgaaggggtttagaggtttgagaccaagattaattataccttgggcctgagtgctaaagtagtgccaagtcatcctctgtcaagaacaggtgtaaagacttaaacgttagacctaaaaccataaaaaccctagaagaaaacctaggcattaccattcaggacataggcatgggcaaggacttcatgtctaaaacaccaaaagcaatggcaacaaaaaacaaaattgacaaatgggatctaattcaactaaagagcttctgcacagccaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccagaagacacatgaaaaactgctcatcatcactggccatcagagaaatgcaaatgaaaaccacaatgagataccatgtcacaccagttagaatggcaatcattaaaaagtcaggaaacaacaggtgctggagaggatgtggagaaataggaacacttttacactgttgctgggactgtaaactagttcaacccttgtggaagtcagtgtggcgattcctcagggatctagaactagaaataccatttgacccagccatcccattactgggtatatacccaaaagactataaatcatgctgctataaagacacatgcacacatatgtttattgcagcactattcacaatagcaaagacttggaaccaacccaaacgtccaacaatgatagactggattaagaaaatgtggcacatatacaccatggaatactatgcagctataaaaaatgatgagttcatgtcctttgtagggacatggatgaaattggaaatcatcattctcagtaaactatcacaaggacaaaaaaccaaacaccgcgtgttctcactcataggtgggaattgaacaatgagaacacatggacacaggaaggggaacatcacactctggggactgttgtggggttgggggagcgaggaaggatagcattaggagatatacctaatgctaaatgatgagttaatgggtgcagcacaccagcatggcacatgtatacgtatgtaacaaacctgcacattgtgcacatgtaccctaaaactgaaagtataataataataaaaaaaaagaacaggtgtagcaattcattttatttaggggaagttaaaacatttcctctatggaggactataagtagagtgaccatatgttgtggtttatgcctgttgctccagcatacttattttaccctcaaaaatgtcccagtttggaaaagaattttgtgatcaccttagtataagccacctttgaaagaaaccatgattctcaatttggggaggtgattatatttgcaaaacttgagggtataatgagctttggagacattatagtcccctaacccagctcaacctatctttttcctagttaagagatctttctggagaagaacccctgaaatgattcagggtttcggctcaacagaattggattattggctccaaaggcatctctcctaaatgcctgtttgtatttgcacatacacatgcacataaagaggtgatgtctgcatgctggaaaatggctgctctaactttcatgaaagactggtaagaattaataagtttaaagtttatcaggagaaacttaggtttagaagcaacatcctgaccatggtatttgtgagatacaagggcatagcaccaagagaagtgttaattcttttcagaataggtttgagaagtgcacaggcaactttctatttcaaatagtttgtatgtggtcattactcttatgtatatagtttttcaatttgccttttccataatggacacgatgatcttttcaactacctctcattcctcccagtatccatgattggctttcatcgatctagggcaggagttaaaagaaactatggcccacaggccaaatctggcctgccatggaaaaagaaataatgcagacaagaaaaaaaatggagccatttagagttgcttctgcaaacattttcaggcttcctcttcttaattgagcttcatttagttcaatgttaggatgagtccacatttcatgattatatttcagctcatatctagtgtttggagattgtccagagcctggtagagtggcagggggtgacccgaaaagtgaaatccacaaatggatttttttgtttgagtcaaaatgtcaatagctattttttctttcctgcctaggtgagtaatccaaattttgttgtgccactaaattctttatgccttcctccccaatatttgtcatgttattccagacatgcatatgatttattaacccagagactagatctcagcaaattgcttgaataggaacatgctttgtctttagttactaaataactggaacacatcctgaagatgtgctgttttactaagtagggaagtagaaaaagtgggtcatcaccatctagccaatagtccctaaccttggcatgaacccctgtgaaaattcagtgaatgccaaggatactctcttcagaaaagtgcatatttacacatgtaacacttgcatacattttcaggaagtccagccatatattgtgagtttaaacctccgtgctggcctttccctagctgttacagaattcttgttgtatggctgtcatggtcatggtagcttgaaatggaagccattaaatgtctctctcaaaaaacatgttattagtatatttatgggccacatccctcagctaccgtacaagcatttttctgattagccttcacagacatttttttattatgaagaagagccacttagcactcacttttacattaccattctcaccaaaaacgtcaagactagtttccccaaattattgacttgtcaactctctgattcttcaaaatgcctgttcagctttcacacaccccacacacaagttcatcattaatatataaaatatattccataaaagctcactcacatttcatctgcctctacctctctctgtttcatctgtttctctcactctatatatttctcttagccaaggttctgacaaatgtggggaactctttctagcaccaatcattaggtatggtgatggagtcagagagggagatggtgtctagacaccttcatggggaccttgagacacatgagctttttggagtattagacatcttggagagagttaatgtatttcatcctggatatctaacatcatatattaaaggcaaagttccttaagctctgcaaacacaaatatatgccacatctgcgccttgcagttgggatggtagtaataggtggtatattagtctgttctcatactgctataaagaaataactgaaactaggtaatttacaaagaaaagaggtttaattggctcatggtcccacaggctgtacaagaagcatggctgggtaggcttcaggaaactttcaattatggcagaagtggaagcaggcatgtcttacatggccagagcaggaggaagagaccaaaggaggtggtgctacacacttttaaacaaccagagctcatgagaactcactcactatcatgagaacagcaagggggaaatctgccccccatgacccaactacctcccaccaggcctgtcctccaacattggggattacaattcaacatgggatttgggcagggacacaaatccaaaccatatcaagtggtattcagattcatgaataaatgtttattgcttgttgtcttggtagtttagaatactgtagagcatgtgggttaatagaaccctaagactggaggggtccattaatgataattactgattcaattcagcaaacacttattgaacatctactctgtgctaagccctgagatattggggacagataaaagaataaaatgaatttttctgtctcatagggaattagctttgctcctggctgggtctttttaccatctgcatgaatttacccccctattttcctaattcaatgcattcttctattgtttctatgttctaccccttggtaaatgtcttagtctgtttcctgttgcttttaatggaatgcctgaaactgagtaatttataaagaaaaggaatttatttcttaaagttatggaggctgaaaagttcaaggtagaggggctgcatctggtgagggccttcttgctggtgaattctctgtagggtcctgaagcagtaccatggcatcacatggcaagggggctgaatgtgctagctcaggtctctctcttcctcttcttataaagctaccagtcccactcccgtgataacccatttatccattaacctattaatccattaatccatgaatggatcaatccattcaccttttaaaggctccacctctcaatactgccacatcagggattaaatttcaaaatgagttttggaggagacaaatcaaacctcagggagtttcttggcaaataggtatctctagctgggttgagacaagatttccagcccctatggcaaaaatgcttcttttcttatccttgcattagtttagcaggccccatttaatagggaataatgtgattgtttccctgtgattctgaggcaacatttctatcactgctatcattggtgatgtggaattgcaaatatcattagccgtgatgtattgactactgccttaaaattatagtatggagttgttgattctgactaatgaattgaatgtactctgcaaaaagccagctgtccatctttgagtgagttgatttttaacccctatttggtagctttagcagttttctactatggttgctgtaacaaatttccaaaatcttagtggtttaaaacaacaaatttatatttctacagttttgaaggtcagagattgtctgaactaggcactgactaggctataatcaaggtgtaggcagggctatatttatttctggggtctctgggtggagactccattttcttgcttttctggcttctaggggctgctggaattttttagctcatggtccccttccatattcaagccagagatgggagattgtttcctcacactgcatcacttaaatcttgcttccatcattacatttccttttctgactctcactcttctacctccctcttctgtttataatgacccctctacttatatttggtctatctggatggataatctgggataatatttccatcccaagatttgttgattttcaaccataattctatctgcaattttaattcctcttgtgccatgtaacctaacatattcacaggttctaggagtaggatgtgaacatctttgaaggcctttattctgcctaccacagtgacttgacttttttgttgttactttttattttggaataattatagaatcactggaagttgcaaggacagagaggccctgtgtatccttctcccaatgccccaatggttacattttgcataatagttctgtgtagttctgtatcactttatcacatgtgtatatttgtgttttttatttatttttagttttgtagaaacatggttttactgtgttgcccaggctgatcttgaactcctggactcaagaaatcctcctgccttggcctcccaaattgcttggattacaggtgtaagccagcgtgcccagccagcacacatgtatatttgtgtatccaccatcacaatcaagataaaatattatttcatcaccgctagagatctcttttgtgctacacctttatagtctttgtaattcacccccactcctttgccatatcaaacttgcaatcaccaatatattttccatatctaaagttttatcatttcaagatttttatataaatggaatcattgagtatgtgacttttgggggttggcttttttcactcagcgtaatgccctgagatctattccagttgttttgggcattaacaattcatttctttttactgttgaacagtattacatggtattagtgtatcacaatttatttaatcattcacctgtagggagaaattttggttgtctggagtttttggttattacaaataaaactgctatgaacattagcatacaggtgctttttgtttggttggttggttttgtttgtttgtttgtttgagtggggcggagactttctctgttgcccaggctggagtgcagtggcacaatctcggcccactgcaatctccacctcccaggttcaagtagttctcctacctcagcctcccgagtagctgggactacaggcgcatgccaccatgcctggtcaatttttctaatttttgtatttttagtagggataggtttcaccatgttggccaggctggtcttaaactcctgacctcaagtgatccacctgccttagcctctgattacagagttggaattacagtgctgggattacaggcatgagccactgcacctggcctagcatttttgtgtgaacataagttttcatttctctgggaaaagctcccaggagtgcaattgctgcattgtatggtaaatgtatgttttagttttttaaactaaaaactgattttgcagttttttcagaaactgaaaatctattttccaaagtgtctgtaagtacataacttattatagtctactagtatcaacattttacctgtttgagtaaattatagaaaccttacccctctttaagttcctttaaccttccccacttataattgccttactttctctacatatatctagaactacattagacaatgctacaatttttgcttcaaccctcaaacataattgagaaacccaatgggagaagcaaagtcaattatatttacccttttactctttctgttgttgtttctttctgaggtttctagatttcttcttttacattttttttctgttagagatcttcctttacttattcttttaatgcaggtttgctagcaacaaattatcttagttttccttcttctgagaatttattgatttcccattcattcctgaaggatattttcacctgatgtagaaatcctggttgacaggttgttgttgtttcctgaaagcatttgaaaaatgtgccatttctttctggtcttcatgggttctgatgagaaatctgctttcatttgaattgttttacacttgtagttagggtgtcatttctctcttgctgcttttaaggtttttttttttttctttagtctttagaagtttgactatgatgtgccttggcaaaatttctttgggttcatctggtttggtatatgctaagcttcttatgtctgaaggtttatgtcttttgccaagttttggaagttttcaagtattattccttcaaataatgtttctgtcctgccttctattcttcatggtttcttctgatgagagaaaacttagatcttgtttttgtagttctacaggtccccgaggcctgttcatttttctcgtctattttttctctgttgttcagactagatagtttctatcattatattttcaagttaagtgattcttttctccatcttcttcattctgttgtagagaccatacattgagtttttatgttttgattattatatttatgagactttctatttttcgtttgttacaagagtgtttctaattacttattgaaacatttttgtgatggctggtttaaaatctttgtcagataattctaatatctctttcatcctggttttgccacctatcaattgccttttttcattcagtttgagatctttctggtcattggtatgataagtgatttttatagaaatatatacgttttgtggtatgtcatgagactttggatcttatttaaactttctgttttatctggctttctctggcactgctctagctccaggacctccaattcctggggaagggagttgctgtcttgttactgccagatggtagtagaagtctgcttgcttgttgacagttggagggcaggacttctcattattgcttgttaggggttggaattcagccacatttcaagtgcttggtagccatgtatggttagtggctaccatattggataacatatatgtagagcatttctgtcactgctctaggaagactgaggttgggggagggagcagtaaaagagcttggcactacaggaattggggtttgggaaaactggcacagatggaataagacaaggatctagttattgtatctgaggtccatggctagggtttggttccaaaacctgaggtgctgtgagttctatctagagaaatatgggcacagagaactcatctggttaatatggatccagtagggcagagttagtatccatagtattaactaagttttgtcctctcagccattgtaaaagacatggtgtggcatgctgcagatcctagtaccactctatttgagtagagggaaagtcttccctattagatggcagttagtttgcttatttgtagcaacatacttgacctccatgactgaggtaaccattgattgaggaaacgttaacagaaaagagtgagttgtgaaaagggtattcatttagtttataggatctagggtttctttggcatcttggtggccttaatgttctaatccttgagacttccagcatgcttagccaggtggggagcatttatgtaagaactctgtccttcactgagctctgtgttgacttgttggcactttttgtccaagtcccaaagagttagtggaccctgttacacagcttctttgtacactgaaataactgttgccttctcaagtctctctttgcttagattagtgggggtgtacttaatgtagattcagtgttttcaatctccccttggggcagttcgttatattttcccttactggctctatgtgtgtatacatcctaatgtgcttgtatttatggactgcctgtgtactgtatctcttggcaagggaaaaggaatacctagtgtctattgaatatgtattgtttgtatagtatacaggtcacatgaccttttcccttagcaagacctgtatgtgcaaagctgtggctttgacatgttaagatatttcataacacagtcaaatccacttggctgaataggtgaaagaaaagggaattgagccagggctatagtgggatttttcacatctatgtcgtttgacttaaaatgaaacaaaaatacacactcatttgagaaagaagcagtttcagagttaggctgtaaagagaaaataaacatgctttataacccaaagccaaggtgttggttttaaaaccctagactatggctcacccagatccttccagtatgtgtatatgtggggaggaggtgagtgttgctggtctgctactcagagatatggagatggtatcatgggagcaaaatcccaatttgtcactttgtcttttaagaaggctccaaatatgccacttacttttttttctttgagaaggagtcttgctctgtgtagtggcatgatctcagctcactgcaacctccacttcccgggttcaagtgattctcctgcctcagcctcctgagtagctgggattacaggcacccgccacaacccctggctaatttttgtatttttagtagagacagggtttcaccatgttgtcaaggctggtctcaaactcctgacttcaggtgatcttcccgccttggcctcccaaagtgctgggattacaggtgtgagccaccacatccggctgccacttacttttgaagacagtggtcactagttgtgctgaggggccaaagggtcaggatactcttatacaaatctaagaagagaacctggaatcaccttttcttgccattgatcttaccattttcctataagccacagtattagtttgttttcacgctgctgataaagacatacctgggaagaaaaagaggtttaattagacttacaattccacatggctggggaggcctcagaatcatggtgggaggtgaaaggcactacttacatggttgcagcaagggagaatgagggagatgcaaaagcagaaacccttgataaaaccgtcagatcttgcaagacttattcactaccaccacaacagtatgggggaaactgcccccgtgattcaaattatctctgacaaggtccctcccacagcatgagggaatgatgggaatactattcaagatgagatttgggtgggcacacagagccaaaccataacattccatccctggcccctccaaatcttatgtactcacatttcaaaaccaaacacgccttcccaacagtctcccaaagtcttaactcatttcagtattaacccaaaagtgcacagtccaaagcctcatctaagacaaggcaagtcccttccatctatgagcctgtaaagtcaaaagcaagctagttacttcccagatacaatgggggtacaggtattgggtaaatacatctgtccaaatgggagaaattggccaaaacaaaggggttacagggcccatgcaagtccaaaatccagcatggcagtcaaattctaaagctgcaaaatgatctcctttgactccatatctcatgtccaggtcacgctgatgcaagaggtaggttcccatagtcttgggcagctccacctctgtggctttgcagggtatggcacccctgctggctgctttcacaggctggcactgagtgtggattttcctggcacatggtgcaagctttcagtggatctaccattctgggtctggaggatggtgggcctcttctcacagctccactaggcagtgccccagtagggactctgtgtgggggctctaaccccacatttttcttctgcactgccctagcagaggttctccgtgagggctccacccctgcagcaaacttttgcctgggcatccagcatttccatgcatcttctgaaatctaggtggaggttcccaaacctcaattcttgacacctgtgcacccacaggctcaacaccacgtggaagctgccaaggtttggggcttgtaccctctgaaaccatgggccgagctgtacgttggccccttttagcaacagctggagcagctgagacacaaggcaccaaattcctaggctgcacacagcatggagaccttgggcctatcccacaaaaccattttttcctcttaggctcctgtgtctatgatgggagaggctgccatgaagacctgtgatatgccctggagacattttccccattgtcttggggattaacatgtggctccttgttacttatgcaaatttctgcagccagcttgaatttctcttcaaaaagtgggtttttcttttttactgcatcatcaggctacaaattatctgaacgtttatgctctgtttcccttataaaagggaatgcttttaacagcacccaagtcaccttttgaatgccttgctgcttagaaatttattccaccagataccctaaatcattttgctcaagttcaaagttccacaaatctctagggcaggggcaaaatgccaccagtctctttgctaaaacataacaagggtcacctttgctccagttcctaacaagttcctcatctccatctgagaccacctcagcctggaccttattgttcatatcactgtcagcatttttgtcaaagccattcaacaagtctctaggaggttccaaactttcccacattttcctttttctgagccctccaaactgtgccaacctctgcctgatacccagttccaaagtcacttccacattttcaggtatcttttcagcaatgccccactctgctggtaccaatttactgtattggtccattttcatgctgctgataaagacatacccgagaatgggaagaaaaagaagtttaattggacttacagttccacatggctggggaggcctcagaatcatggcgggaggtgaaaggcacttcttaaatggtggtggcaagagaaaatgagggagatgcaaaagtggagacccctgataaaaccattggatctcatgaaacttattcactaccacaacaacggtatgggggaaactgcccccatgattcaaattatctcccactgagtccctcccacaacatgtgggaattatgggagtataattcaagatgagatttggtggggacacagagccaaaccatatcagccactgtggggtgggtggttgtgtgtgtgtgtgtgtgcacgtgcatgtgcacatttttctccctaattcagtaatgctttgttagctatacttacatggatttagcacctgaatgaacagaaaaacccatttgtttattgtcgaaatagtggggatgccatgacattgctgactgccatgatttgtgattcattaaggccaggatacttctagacaatcactgaaagttgaaaagcaggtaagtgaattaatctcttccctttgattttcacctttaatattataaccttagatatgacttcaatatcttccagcactgagtagaattggttaagggaaggccagagtggatgtagttaacaccaggaatggaattccttttgttttctgaaaattcagtttatagtttattagactgaagaatccacaggcctgcctcagacaaccaggccatatactagacaagagcactctcagattacactttgaaatgaaagcctattttggcataatatgcactgaaaggaaaagtgtgctcctaggtatgctctttactttgccttttggactgtcctcttgggtttcctcagcctttctctgatctgtatggctctaggccccactcccaataaccctctaggaggctctgttccatgtcatctacttatggcactgaaataccaggtgtcacatggtataaggtagtagtgaccacaaggggcccagaggaggatgtttgccgagggaagcagcctgtttccagatcctcaggtagagggtgtgctcaagcagctgagacagcctgaggtgggagaaggagcagtggatgataggtcagagctgccatttccattggttgttgagatggccagctgagggagacagttgtttgttcagtggtcctgaggaagtaaaatcatatactggtgttttttgattcaggcgacagattgatgttaagggaccataggcatttaggctgccaataataatacctgatcatcctatagctccttctaaaggactcaaaggactcctatattttatttcatttggcctcacaaacatcttcatggacttaggaaaggtaaatattgatagtcatgtaggacaagcttttctctctctctgggcctcagaattttcaaattgtgaaatggaggcttggtctagagatgatgatctctaaggtcgtttcccacagtaacagtttctatggtggcaacatcttccaggtggaggaattaagtctcagacactttaaagtgagttggacacaactacactctctatcaggtacagagtgatgattacaggcccaggccatgatcccttcccttagcttgccctattagtggtctctttgaacagtgaggtaaggggcgggggggggggtgctcttgcttctgaacacacaagggctttacttatctgtttcatttaacactctcccctcacctgaccaccttcccaaactacctcctgtcactcatcagcagggccttcaacttttcccttgatgttcctcgggattcatatcttgtttgactgtagctgttttcctggtgtattgtgtggctagatgcaaagtcattgctacccttagagagtaaagtctggaaccagcacttcagttacatcaggaaagagaggctgtgcctcctgggtgtggcagggggtcaaagtgagaagagacattcaaaaacatcatattataaggtgccctgaaaaagcaaggagggtctgtagattagggctggggaaaaaggactggacaaaggtatgatgggggaaatcagacagtgagttgatgaaagcaaatacattcaatgatcaattaatatgcagcaaagaggctaggatgcctgagatttctttggagttggaggataaacatggcatttatgactgtgacagggatttatcttgggagagggcagtaggggaaaaatgaaaagctttattttcagcaagttcagcttttgtagtaagatatttagcttaagaaatgcaagctaagtactgtgagggaataaattcagagaaccatattccccatatgattcctggaaaccagtaggaatttggctcaagaagggacggcagaaggtgatttgtggtgttataacagccgccttggaagccaagatggaaaatttgtccctgaaaggctaggcagttggaggagactcactggaaatttctgtccggagaaaataaatgaaccagagaagagcttaaaaacacatggtggagggtgaagtctgggacacccaggaacccatatcttgtaataggtccacttgttaaattcctggcttatggtctagaacaggattttgttcatttccttggaacaaaaaggtccccaggcacccagagcttctatcttatcccagtccacagcctcttacccgttctttcatttctcttttcttttcctttttttttttttaagagatggggtcttgctctgtcacccaagctggagtacaatggcacaaacacagtttactgcagccttgaattcctgggctcaagggatcctcctgcctcagcctcccaagtagctggcattacaggcgtgtgccaccatgcctggctaatttaaaaaaaaaattgtgtagagacagagtctcgtcatcttgcccaggctggtcttaaactcctaggctcaaacaatccttccacgtcagcctcccaaagtgctgggattacaggcatgagccaccctgcccagccttttttttcctatttctctcattttaagaataaattcatttatcatttatcaaaagaatccatgaaaatttcacaaatattgaaaaatagggaaaagaaatagttcaacgttttgtttttagaaattatttgtgtctttatttttgtttttgttttttgttttgttttgtttttgagacagatggagtctcgctctgttgcccaggctggagtgcagtggtgcagtctgggctcattgcagcctccaactcctgagttcaagcaattctcattcctcaacctcccaagtagctgggattacaggcacccgccatgatgcctggcaaatctttgtatttttagcagagacggggttctaccatgttggccaggctggtctcgaactcctgatctcaagtgatctgaccgctttggtctcccaaagtgctaagattacaggtgtgagccactgtgcccgacgtttgtctttattttgaataattataaaagtattgaaaagactaggaataatataagaaatacttggatctctacttggagaaataaaacattacagacaagttaaattatatcccctattttcagtcacattcctctccattcattttcagaagcaagcactaagataagcttggtatgtattcttccattttgttttatacttttgcatgaaagtatgtctctcctctcccctcttcccataaataatatatagagcttgtctgtgtgtttttaaaatttatgtaagtaataccttaatgtatgtgtcattctgcaacaagtttttttgttttgttttgttttgtttttacccaatatcttgttttggaatttattctattctcttttttacattccccttttctactcaaactgtaccctggagctgatgacatgtacattactttttcatatttttatgataaaaataatatgtaaccacattacaggaaagttggaaaatccaaccaattgatggctcttaggaccagagagctcagtgtcctactgtagacttgatttgcaaaggttctaggcagctgggctaacctagtggttctgcctgtaaaatactgaagagcaaaattggaagtctctagggacacttccttgcctgtctgttaccccattccatgaagtagtaaaacagaggcccagagaaggaaaatgacttaacaagggcacacattcattgaatattgtactcgagatttctggatccctgtcttgtacttgaaacgtttccaaggaaaaaaagagcggtggggagagagagagagggagagagggaaaggaaacctagaactgcaatttttcatcgtaaaaattatccattttaataaagcatgggaaatacagaagagtaagaaaaatgaagatatcaagaattgtccattttcctattttgaacttctgatcttttttcttgtacaacttttgtttctttgattgtaccctatcttgcttttttccacttaactttataatgtcataatgcacatctttttcaaaaagcagacttctacactgaaatcttgacagtaaatatttttaaggcacatatttgctatttagccatttaaaatggtataggcagggaattgtgtagagaggaaaacaatggcgtgggatattttccagcaagtttgttcctgtcctttggctagatctttttcttctaaaacaaaacaacaataacaataagatctaggtagacatttctaggattcctgctactaaagtattcattcagagaagtttcattactctctcaaatggcctagggtgtgaccaagggtcactctaatatactcccctccacttacaaggcaagggcaagtgttgcccttggggcccaaagggagccaattctggagctacctgggtcatggaagttgaccctgaggaaaagactgtggtagtttccccagtccatggagtgaggagtgaggtggggtgctcaatttttccagagcctgagcacaaagacagtgacagtcattaaaacttcttcagcacttactatgagaggcaagacatccattcccaacaaagccacaccacttcacacacacacacacacacacacacacacacacacacacacgattagaattgttgcctacagttttggttgcattgtttaattgtaatagtgcaaaagtgcatttaactatgaaggcttgctgggagaaaggaaagtgacggtttattattctagtcagttcaacatgtttgaaacagtgaagcaatgagagattaacctgctcgctcaaagtcacacagcaaaaaagtaacgatgctgagattaacaaataaaaaatgaaaacacccttattcttggtcttgggtcttgaaagctgggccttagcctgctgaagctcactgtacttctgctttaatcagtttaattcattgctagcttgcccttgccacctttgattctctttgcattggccaaataccaatttgcagtagttgttctgaagtgcttgccagtttcaatttttcaattccaggctctattctttctcacagggctagaaagccacaagtcacactagtggccagctgtatctatgacccaaacttgctcaggtctgtgtgtgtgtgtgtgtgtgtgtgtgtgtgtgtgtgtgtgtgtgtgtgtgtgtgtgtgtgtatgcctgagaatcagtgaggactccaggactgggaatgttcaaggttttgaattgaaataattgaacaaattcctctataaagaaaccttttcccctgccaaatgattttcttcttaatgatttctgcagttgattaacgtttagaaataggcagtgaagcctcagtgaacgtgtatttgctaggccatagggtgctcttgcttccaggttgtagaaaccaatgttgaaacaagtcccagctgtgtttacctccagattcaagtttcaatacaggggagctcctttccacatctattttccctccttcctgcaaaggcagctgagctaaagctgcccttaataaggagtggccttaggcactgcagtagcatttacccttcaaactgggcagacaacttctctgtggggagtctgagcctgccacacctatcacacaggctttgggaaatgtgaagtggcacttactgcaatctaacctccagagaacttgcctgcatgctggccagttgggctatgggaaaccttgccattttttgcctatccaaaggcccacacctaaacaggtctgaatgcaaatgcatgggtgaaaggggtaagcgaggggcactacagaaagctcacaactgtcctcagacccaggaggatggcaggccaagaagtccattattcatttgtttccagtgtctcaggtaagtgaagattgcagtcctcactggaaaagacaagaggggcaaggagatacatgagcccagaagagctacaatggacctcatttacagataagctagataggcacttcccagtctttttgtaccctccccaatccttctgttacctttttttgtaagacccaactttgaagagttgttttttctcctgaaaactgcacttattaaataatagcttttctgtgttcctatacatatgcatacataaaactgtaatatatatacatatatatgtatatatatacacacacataaacatacatgcatcagagctgatcagcacagagagccaatgttattctgcttggttgctataattccagggaaaggtaaaaacatttagctaactggggcagctgtatgaaaaaactctccattttctttaaagttctgaaatactgaaaatggtttgaggatcccatttattaccttttttttgttaagatgaccagggtcctcaggttggaaactactgatctagttaactcctcttccctatttttgagtcagaatgtaaggcaaattttggccaaatagaaagttagtctttgagctgggattaaaactcatcccactgggagccagtttgcatcccttcacttggtttcccctacgacatttctgagctataaatctgactcatccatgattaattttaaaaaatgtcctgaatgatacttttggcagtggtctttaatatatattaaaggcacatatggtggtttggaactgccttgagatttgagacaggacttcaatttctggtagaggtattaaaggagctctctccatttatttggagctgtaagtcatttgtagataaaatgtacttagggagtgcctactaagtgtgagatgctatcatagctgggagaagggaaggggtaggagtaacaatggaggagtgggttagtagaacagcccccatttcaggaaaactatattttattagggagatatatgtgcacaggactatttctatggcaaggcataaaacagcgcatgcctcagtagtaaattgcacatgtaacactttgtccagcagaattctctggaactgaaagatgtataatggaaccaagtaaaccagcaactgtaccatttctaactgtgaggagaaaacaagtggtgaaagttgtgcctcacaggtgctttgtgcaacaaattacaacaaaatttagaagcactaccatcctggctatttatatgtttatcattaaacctcacattgacatcttagctgcaattgttttctacctccaggaaacaacctaggagatcatctaaaccatctttatctgaaacattaattacttttgttagattatcttgcctagaaatatccatagacaggcagctacctctaaaggcaatccatgccagaaagcccattctttatattttcttttactatttttattgtggtaaaatacacataaaatttaccatcttaaccacttttaagtgtacagttgtgtggaattaaattcattcacactgttatgcaaccatcaccaccatccatctccagaattcttttcatcttgtgatactgaaactctgtacccattaaacaacagctccctattttcccttctccccagcccctggcagccagcattctattttctatccctatggatttgatgactctaaatacctcatgtaaatggaatcatacagtatttgtctttttgtaactggcttatgttcatcaccataatgttcttcagtttcatccatgttgtagcatgtgtcagaatttacttctttttaggctgaataatattctattgtgcatatataccacattttgtttatccattcatccatcaatggatacttgatttcctttcaccttttggctattgtgaatgacaatgggtgtacaaatatctcttcaagaccctgccttcaataattttgagtatatacccagaagtgggattgttgggtcatatggtgactatttttaatcttgtgaagaatttccacactgctttccattgtggttacaccattttaccttcccaccagtagtacacaagggtttccattttttcagatcctcaccaacatttgttgttttctgtttttcctttttctttttctttttctttttttttttttttttgagacggagtctcactctgttgccaggctggagtgcagtggcatgatcttggcccactgcaacctccacctcctgggttgaagcgattcccctgcctcagcctcccgagtagctgggactacaggcatgcaccaccacacccgtctaattttttgtattttagtagagacgggattttcaccatgttgtccaggctggtcttgatctcctgacctcgtgatccgcctgcctcaccctcccaaagtgctgggattacaggcgtgagccaccgcgcctggccctgttttttcaatagtagccatcctaatgggtgtaaggtgatatcttattgtggttttgatgtacatttccctaataactagagatgttgagtatctgctcttgtgcttatttgccattcatatatcttctttggagaaatgtctatttgactcctttgctcattttaaaacttagggtgttaggttttttgttattgagttataggagctctttatatattctagatattaatactttaccagatatatgatttgcaagtattttctttcattttctacattgcccttttacaatgttatttcacaataatgttgttcaatgcacagaagtcttagacttttatatactccaatttatctattttttctttggctgcctgtgctttgttctttccccccaagattactctggctattcagggtcttttgtggttccatgtgagttttaggattgtatttttctatttctgtgaaaaatgtcatcagaattttggtagggattgcattaaatctgtagatcactttgggtagtatggacattttaacaacattaattattctaatccatgaacatgggatatcttcctatttatttgtgttttcttccatttgtttcatcagtgtattatagttttccatgtacagatctttcacctccttggttaaatttattcttaacttattttattgtttttgatgctatcataaacagaattgttttcttaatttctttcttgggtagtccattattagtgtataggaatacaactggtttttgtatgttgattttgtgtcctgcagcttcactgaattcattgatcagttctaacagttttttttgggggacgatctttagggttttgtatatataagatcatgtcatcagcaaagagagacaatttaacttctttctttcctatttgatgccttttatttctttcttttgcctaatttttctggctagaacttccagtactatgttgaaaagaagtagtgagagtgggcgtccttgtcttgttcctgattgtcgaggaaagtatttcagcttttcattgatgagtatgatgttagctgtgggcttgtcatcattgggtttttgatagggattgcattacatttgtaaggtctctctggtggtatttacatcttaacattaagtcttccaatccatgaacgcaggatgtctttccatttattagtgtcttctttaatttctttcatcaacattttgtacttttctgtgtacaagtctttcttctccttgattaagtttattcctaagtattgtttgtgatggtactataaatggaattgatttcttcatttccttttctgattgtttcttgttagtttatagaaatgcaactaatttttgatgctgattttgtatcctgcaactttgctgaatttgttattagttataacagtcttttgtggaatcattaggatttttcctatttttaaaaaatagaacagtttattttagaacagttttacatttacagaattattttaatgataataaagaaaattcccacataccccacaccatcttctcctattattaacatattccaagagtgtggtacgtttgtcacaattaatgaactgatattgatatattataattaactaaagtctatactttatatttcttcagttttcttctaatgtcctttttctgttctgaaatcccatccaggataccatatgacatttagctatcacgtctccttaggctcctcttgactgtgacagtttctcaggctttccttgtttttgatgaccttgatagctttgaggattcatggtgaggtattctgtagaatgtcccttaattgggattcacctgatgtttttctcatgattagactggggtaatgtgttttgaagaagaccacaggaataaagtgcccttatcattacattgtattaaggatacatgctatcaacacgactttaacactgttgatgttgactgtaattatctggctaaggtagtgtttatcaggattctccagggtaaagttacatttttctcatttccataatgtactctctggaaataatcactttgggcagttcatactttaagactggggagttatgtgtcacctccttgaggatggagtatccacctacattatttggaattcttgtgcactggagatgtatctgttcctgctcatttatttatttgttcaatcatttatttatataagtatgtacacatgtatatcatgtatatttattttaaactttggattatagtccaatactgctttattttgtttctcaaattgtttcagctttggccattgggagctttttttggttgactcctgtgtccctttgacataccttcaccatgtggtttaatttgttttttcttttgagattgatttttgttttgccttctgccatgaaaaacttaagctctccagcatgtgacagcccttcagatttataaaaacatccaccattaccccctctagtgttctccagactaaacatttcccactcattcctttacacattcctcatgtgacagatttattgaccccttactcatctagcagctttcttctggaaacattccattttgtcagttacctgaaatacctcctttcactctccttaccctccacaacaattataaaatttaagagaaatcaaaggtagttcttctactagaaactatgtatgatagtaaatagtacccaggctgtgtcactgaatgaaaaaaattatccccatattagaattaagacccttagaaattagaggagaaatatgtttccattttgtgcagagcttactatttttcaaagctatttaggaaactattagtttgactctcctaacccatgtgggaggtaggtagggcagttagtggtatgcccagaaagccaaagcccagagaaggtgccttatccaaagtcaccatatgagttagacagactgggttctcttgactcttactccagtaaccttaaaattaggtttaaactttaactgtgtaggctaatttttgtttgtcagaccctcaaccattaatcagaattgccaatacattttcttttgagccgaacttagcctcccaatataatatgagatatgaaaggtaagtctgaaatgcaaacacttaagaaatgtttctagaaatcaaaatcatttttgtatgctagtagatatcaattgggtgatcaagccagaacttagaaagcatatggttagctttgggaacagaagtgtcaacagaacaaaaatgaatattttctaattgtccttgcttgctgcggatattaggcagctagctttgtgtctttttcagcacttatcaaattctaatggaaaggtgctgaggtgtggctaatcccaaacagtgtataatccccaaataatttatacagtaatatcctgtcacacatacacactccagtgcccagtctctgctcttctattttggaggttgcagagactgcactagatttggcagatggcaccagtttttattcctgggctgtctctgctcattcacacccagggtaaggaattagtgggagccttttcatgtattcctttataaactgagcaggagagaaaagaaagagctagaaaacttttctctcttactacctgaccactccttcaatcttaaaaccagttcgtgcaaaccagaaattgtagtatgtacagaatatttcaagtcacaactttctgggatgaatggtttccatacccaaagagcctcctgcctttaaggagtcatcagttgaaaagaaacagtcagatatctgtggcattacctactggccagagtgggatggagaaagtggtctgaagtttagttagcaaatgttgaatttcagggttgaggaaggggaagtatggtatctagataaggaagaaggcagcaaaggggctgagagcttttcaactttggtgacaaggatggggaggagtaagtgggaacagacactatccttacttggagagtggtggttgctgaggagaaggacttattgctttatattgaattttagcattaatactttctggatctctgagatggagagttgacagaagaacctaggaagcatgactaagtggttgaatctgctatggaaaaaggggaaacggggcaggcttttacttatttgaacctaggtactttgtttctttgccacctaaaagttctgggatgaactgaatgaggaatatgaattgagcagataagattccttttactggagaaaaactaagtcctttggaaacttgaacttttttctcattcaaattcatttctaggccttattcattcattctatgtttttttttttttttacacagtagccaccgcccccgcttcacacccctaccccctacccttcccagcctctggtaactatccttctactctctgtcttcatgacttcaattgttttgatttttaaatcccacaaataagtaagagcatgtgatgttcttggcaactttgtggaaaatgagttcactgtaggtgtgtggaattgtttctggattttttattctgttccattggtctatgcacctgttttttatgccagtaccatgctcttttagttactatacctctgtagtataatttaaagtcaggtaatgtgattcctccagttttgttctttttgcttaggaaggttttggctattctgagtcttttgttgttccatatacattttaggatttttttctatttctgtgaataatgtcattgatattttgatagagattgcattgaatctgtaaattgtttgagtagtatgcacattttaacaatattgattcttccaacccacaaacatggaatatctttccattttttggtgtccttttcaatttctcttatcagtgctttatatttttcattgtagagaactttcacttatttggttaattcctaggtatttaactttatttgtggctgttgtaattgggactactttttgatttctttttcagattgttcactgttggcatatagaaatgctattgttttttgtatgttgattttgtctcctgaaacatcaccgaatttgtttactatttctaacagttttctattggtttttccaaatataagatgatatcatatgcaaacaaggataatttgacttcttcctttccaatttggatgccctttctatctttctcttgtctgattgctctagctagggctgccagtactatgttgaataacagtgatgacagtgggcatccttgtagtgttccagatcttagaggaaaggctttctgtttctcccaattcagtgtgatactagctgtgtgtctgtcatagatggcttttattatgttgaggtatgttccttctttgagggtttttattatgaaggaatgttgaattttatcaaatgctttttcagcatagattgatatgatcatattgtttttatcctttattttgttgatatgatgtatcacattgattgatttgtgagtgttggaccatccttgcatcccagggataaatcccacttggtcatgataaatgatctttctaatgtattgttgaatttggtttgctagtattttgttgaggatttctgaatcaatatttatcagagatattggcctgtagttttctttttttgatgtgattttgtctggtttcagtatcagggtattactgacctcatagaataagtttggaagtattccttcctcctttattttttggcatagtctgagtaagattgataatagttgcttatagtagctactaatgatcctttggatttctgaagtatcagttgtaatgccgtctttttcagttctgattgtatttctttggctcttctctctttttaatttattttattttattttttgacagaatctcgctctgccacccaggctggagtgcagtgctgtgattggctcactgcagcctccgcctgccaggctcaagtgatcctctccctcagcctcctaagtaactgggactacaggtgcgtgccaccatgcccagatatatttttttttttgtacttttagtagagaagggttttcactctgtggcccaggctggtcttgaactcctggactcaagtgatctgcctgccttagcctcccaaagttctgggatttcaagcgtgagccaccatagcctggctctttttatctcagttagtctggctaatggtttgtctattttgcttaatttttcaaaaagtcaactgttttggaaactggaactttttaattctccctcacccacaaaaggattattcattgtaaattgaattaacatactcttccctagatggggtatctcagttaatgggaaagccaggtcatgactccaggtccaaatggccctgtctgatcctggtggttgggcagctttgcataaatttaggatgctataatttctgcaaagcgtcttatgattccaatattagactttcagaaaaaccttccacatcatccatgcactgtgtgtacatgtgtgctgaatatttttaaaatcttacaacttgcctaaatagagtttttccatctccatcttgggtgcttaatcacctcatcttcttttatctcttctttctctcctatgtttgttgaggaaacaagattaaatataacaatttttacattgcacacaaaataaaatggcttgtttagctgtgactttaaggccacgcatgagacagtctgtacaggacttacctccctcatcagaggaaccctttgagtctttaaaaaaggtgaggatgaaaaacaagaaaactcttttagattttcagctctccatttgctctgcagcatgagaactaagaagcaggtggcaaagatagacagtaaactagaaggaaacaaaacaaggtcattttcctccttgtaccttagcttcttgaatgataatttaagataccttcaattttctgttatctgaagtagtctgctttatggattacttagactcttgtttcttcatcctttaactgtttggtgtcacttcttccaaagctttttaaaatatattttctgattctactggaagagcagtcatagggtgtaggcatgtaggaggaaacaaaattatagggacagaaatcagtctattttctagtactttaattccttaagacctaagtcagtatccttatttttaaaaactactgtctagctccccatccttgcccatttctttttctatacatacatattctctctctctccatcctttccttctcagcaagtctggtagacagactagtctgatgcctcaaaaatactctaattcgtagaaagaaagtaaattctgcctctgacgttccattccccctgtggttttaattagggtaaattctcctatgctcactttgaaacatgccttgggatcttagggagatggcaggcagatggcgtattaatgcagggtgatgtttctcacttcatggtgcccatgcaacatttattgtcattaaaatagtgtcattcaaatgaggtggctgatgttggaaaatgaatgcaaagttgatcattgttctgtggatctgagctttgatgaagaaattgaattagaggcagcatttcaactctgtttaagtaataagtatatatgtatctataactcagtagtgaaacctttcagactgacaggagggcaaagcctctaagactatattagggtttacgggtataaaaatacgtgcctctcctgctttaccaggctgtggggagaatgaggaaaataatatctgtaaagtgacctgagcacccagaaagaaaaatttagatgttttattagacctacgcaagatctttggttagttccccagagccctgtaaagtcttggaagccctgtaacaaatttctcttttcccttgtcaggtttttgttttcccctggtgcccaggttaaagagaaattgatttctttccatcttgtgtttagcttttgtccctctgcattgaggctttgaattgagaatatttctttgggtctgtagggctgtccaatgatagttaggcttaaacattaaacaaccttacagaactaattaggctttattgcctgtggccaagtcaacgaattttgcttcatagaatttctgagagaaaaaaaaatacatatttaggacttggtaaaacttttcttaaaatgtctccttgtaaatgccagcgttgctgaccctgtgcaaatattttgtaatagcccggcttgagaacatcccccacatttctctgttgtattctttatgacttccctccaggttgagctgtgaaagggtgaggggaaaggagccatgtcggagaagtagaagagactgaatcaaatgtttagagaacatagcttgattaattcaaaactgaagccctggcctctctagtctcatgttccacagcaataatttctccttggccagaagcctaagcatctgtgtccaaatctcatactctttcctaaatggattcatcaagtcagaccttgagttgcttggttttttctgaaccaccccctaatttaagttaaacttaaaaatgggagccattaaatagcaaaacaaacaaatacaacaataataacaggacattatgtcctggccctcagaggtcaatttaatgtgattagcagcataaaacttcacaacgcctttcactggaagattaccagaagcaacatcattcagtatgttgccatgcactgccattctttcactttggcattatttattgattgtagcagaaacacaatatttgtacctcttaagcattttagtttcctttaggcttttctctagtaaatgtggaactgcatcattttgttaaactgttctgaagtctaaaaaaaaaaaaaaaccctcctgaatattgtttacatccctggttacaaaggccagtactgaggcggagctgctctgcctgctttgattcttatcaagggcaacactgtatgtgtgcatatgtatgtgtgtgtgttcacacaggagagggtagtaagtggagcaagagttttaaggaaggagcggggctggaaggaaaaaaactttcaatgaattgaaactgcataatgaaaagattctgaaatttaattacaaaaatggctctgttttttctctcacctcctcctcgctcccttttctcctctccatcctctccaaaagcactgaagtaaaatgagactgtcagatcaaagccacacacccactctaggtctgttttgagaaagggatttttttctccccttatttactttgtagcagtggcagcatgtctactgcaggatgcagtgacagtgtggagccttgtcactgttctgcttgatctcctcccgtgtgccactccctggtctggtgagcagggtcaaagtttcaaatgatgactgtggccacagttctcaccatctcttgtgttttcacacttggccattcagtatttaggcattgtccctctgacatatggcctgaaagagttgaagattaagtttccaagtttggaaatgcccaagcgtagccatggagggtgtatttgtcccatgtggctgcgggttctgttgagtatttttgcaaaaatattaaaatgtctacttaggatttaagaatatgtttgatgatatgtacataattcatagcgcattttagggcacacctgcattatttaatattggagtttctctttttaagtttttttatttttgtctaggactctttagagtgcctgtgcctgggttccttaatattctttcagaccagttgtcaatttccaagtgccttaaaatagagctattgggttttcttggccttttctggccctcattctcttctagttcatgatttttcctcaaaataaagttgtacctaattaataaaggtatataggtattcagttttaatactgtctataaagtatgactcatactttctctattaggaacatctttgttacattgaatgcatatctctcctgtagttggttgagagaaacatgtaggtctaggatcaaagtcctagaacaggatcagagtcactggaaatgcaaccaaaatggggatagaggctcatgggacaagaactggaatgtgtgttgtattgagctacagggagaaggaagaaactaagtaccgatttggtagagagaaagaggggcagagagagagagagagagagggagagagagaaagagaatgagagagaatgagagagagagagagagagagagagagacagattaggttaggattaggttaggaagaaccttgaaacatcagacaaaaagaagaaaactaaagcagactgaagagcagtgtgtctttgattatggctattcaccaaaccattcttattgctctttctgttattattaagctatctctgagatgtacacagtgtatatctcagtgcacaacagacctaccagtgtagatcttttaactcattcctttaatgaatttttatcactttcacagtccttattagctctctttttaatggtttttttggagcccataactagatatgccacctcaggaagaattttatcagtgctctgggaagatggatttactattttgagttgtatttgtacaccatgcaaccatgaaccacttagaaaccaccttagtgactcatactttctttatggtccattctgattctgaaatcctttgagtgttacatttctcaatctgattttaacaaggattaaaataaataagtaaataaataaaaagttttctaaggtttgcgaaacactattactgaaatttagaggacttgaggcctttaaatcaaacaatattttcattataatttgcctttccatccccatttggtcttgccacatctatgctgcgacaaaagaaaacctttagtacctaatatcggtacttggtgttcattcatctcactgtggttttcactttcaaagcacaatacattgcttccccatcccattccttttgtttctaccattctactttggccttggaaattaaatattgcatcctgtccctcacagcttatttctgcctctcaattttgcagatctgggcattaacggaaataataagcactttataattttatagtgctttataattttcaaggtattttcacatccattgtcttgagtgatcctctccacacctcactatataagcagggcatggattattaccccattctagctcaaggccatatagctaactaagggaagaaccaataaagtttctagatgaatttgtttcactacacttcttccaccatcagttccatggccaaatttttttcctgctactttttgaaaactgagtatatataggaattttctttttggtatataaattttgggaacaatgaactattcgtctaggtgagtaaaagtgtatgtctgcatccatttgtttatgtgaataatatgtgttcgctaaaacttgaaaatgtttgacatcattctttttgtttgtttgttttctttagtttttttattgtactttagattctgggatacatgtgcagagggtgcaggtttgttacataggtatacacgtgccatgatggtttgctgcacccatcaactcgtcatctacattaggtatttctcctaatgctatccctcccctagcccctcacccctcaacatgccccggtgtgtgatgttcccctccctgtgtccatgttttctcattgttcaactcccacttatgagtgagaacatgcagtgtttggttttctgttcctgtgttagttttctgagaatgatgttttccagcttcatccatgtccctgcaagggacatgaactcatccttttttatagctgcatagcattccatggtgtatatgtgccacattttctttttttttttgtttgtttgtttattattattattatactttaagttttagggtacatgtgcacaacgtgaaggtttgttacatatgtatacatgtgccatgtttgtgtgctgcacccattaaatcctcatttagcattaggtatatctcctactgctatccttcccccctgcccccaccccacaacagtcccaggtgtgtgatgttccccttcctgtgtccatgtgttctcattcttcagttcccacctatgagtgagaacatgccgtgtttggttttttgtccttgtgatagtttgctgagaatgatggtttcatccatgtccctacaaaggacatgaactcatccttttttatagctgcatagtattccatggtgtatatgtgccacattttcttaatccagtctaccattgttggacatttgggttggttccaagtctttgctattgtgaatagtgccgcaataaacatatgtgtgcatgtgtctttatagcagcatgatttataatcctttgggtatatacccagtaatgggatggctgggtcaatggtgtttctagttctagatccctgaggaatcaccacaccgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcatttcttcatgtgttttttggctgaataaatgtcttcttttgagaagtgtctgttaatatccttcgcccactttttgatggggttgtttgtttttttcttgtaaatttgagttcattgtagattctggatattagccctttgtcagatgagtaggttgcaaaaattttctcccattctgtaggttgcctgttcactctgatggtggtttcttttgctgtgcagaagctctttagtttaattagatcccatttgtcaattttggcttttgctgccattgcttttggtgttttcgacatgaagtccttgcccatgcctatgtcctgaatggtaatgcctaggttttcttctagggtttttatggttttaggtctaacctgtaagtctttaatccatcttgaattaatttttgtataaggtgtaaggaagggatccagtttcagctttctacatctggctagccagtttttccagcaccatttattaaatagggaatcctttccccattgcttgtttttgtcagctttgtcaaagatcagatagttgtacatacgcggcattatttctgagggctctgttctgttccattggtctatatctctgttttggtaccagtaccatgctgttttggttactgtagccttgtagtatagtttgaagtcaggtagcgtgatgcctccagctttgttcttttggcttaggattgacttggtgatgtgggctcttttttggttccatatgaactttaaagtagttttttccaattctgtgaagaaagtcattggtagcttgatggggatggcattgaatctgtaaattaccttgggcagtatggccattgtcatgatattgattcttcctacccatgagcatggaatgttcttccatttgtttgtatcctcttttatttccttgagcagtggtttgtagttctccttgaagaggtccttcacatcccttgtaagttggattcctaggtatttcattttctttgaagcaattgtgaatgggatttcactcatgatttggctctctgtttgtctgtttttggtgtataagaatgcttgtgatttttgtacattgattttctatcctgagactttgctgaagtagcttatcagcttgaggagattttgggctgagacgatggggttttccagatatgcaatcatgtcatctgcaaacagggacaatttgacttcctcttttcctaattgaataccctttatttccttctcctgcctcattgccctagccagaacttccaacactatgttgaataggagtggtgagagagggcatccctgtcttgtgccagttttcaaagggaatgcttccagtttttgtccattcagtatgatattggctgtgggtttgtcatagatagctcttattatcttgagatacgtcccatcaatacctaatttattgagagtttttagcatgaaaggctgttgaattttgtcaaaggccttttctgcatctattgagataaccatgtggtttttgtcattggttctgtttatatgctggattatgtttattgatttgcatatgttgaaccagccttgcatcccagggatgaagcacacttgatcatggtgggtaagctttttgatgtgttgctggatttggttttccagtatttcattgaggatttttgcatcaatgttcatcaaggatattggtctaaaattctctttttttgttgtgtctctgcccggctttggtatcaggatgatgctggcctcataaaatgagttagggaggattccctctttttctattgattggaatagtttcagaatgaatggtaccagctcctccttgtacctctggtagaattcagctgtgaatccgtctggtccctggactttttttggttggtaagctattaattattgccacaatttcagatcctgttattggtctattcagagattcaacttcttcctggtttagtcttgggagggtgtatgtgtcgaggaatttatccatttcttctagattttctagtttatttgcgtagaggtgtttatagtattctctgatggtagtttgtatttctgtgggatcagtggtgatatcccctttgtcattttttattgcgtctatttgattcttctcccttttcttctttattattcttgctagcggtctatcaattttgttgatcttttcaaaaaaccagctccagggttcactgattttttgaagggttttttgtgtctctatttccttcagttctgctctgatcttagttatttcttgctttctgctagcttttgaatttttttgctgttgcttctctagttcttttaattgtgatgctagagtgtcaatttcagatctttcctgctttctcttgtgggcatttagtgctataaatttccctctacacactgctttgaatgtgtcccagagattctggtatgttgtgtctttgttctcgttggtttcaaagaacatctttatttctgccttcatttcattatgtacccagtagtcattcaggagcaggttgttcagtttccatgtagttgagtggttttgagtgagtttcttaatcctgagttctagtttgattgcactgtggtctgagagacagtttgttataatttctgttcttttacatttgctgaggactgctttacttccaagaatgtggtcagttttggaataggtgtggtgtggtgctgaaaagaatgtatattctgttgatttggggtggggaattctgtagatgtctattaggcccgcttggtgcagagctgagttcaattcctggatatccttgttaactctctgtcacattgatttgtctaatgttgacagtggggtgttaaaatctcccattattattgtgtgggagtctaagtcactttgtaggccactaaggacttgctttatgaatctgggtgctcctgtattgtgcgcatatatatttaggatagttagttcttcttgttgaattgattcctttaccattatataatggcctgctttgtctcttttgatctttgttggtttaaagtttgttttatcagagactaggattgcaacccctgcctttttttgttttccatttgcttggtagatcttcctccatccctttattttgagcctatgtgtgtctctgcacgtgagatgggtttcctgaatacagcacactgatgggtcttgactctttatccaatttgccagtctgttccttttaattggagcatttagcccatttacatttaaggttagtattgttatgtatgaatttgatcctgtcactatgatgttagctggttattttgctcattagttgatgcagtttcttcctagcctgggtggtctttacaatttggcatgtgtttgcagtggctggtactggttgttcctttccatgtttagtgcttccttcaggagctttttagggcaggcctggtggttacaaaatctctcagcatttgcttgtctgtaaagaattttatttctccttcacttatgaagcttagtttggctggatatgaaattctgggttgaaaattcttttctttaagaatgttgaatattggcccccactctcttctggcttgtagattttctgcagagagatccgctgttagtctgatgggcttccctttgtgggtaacccaacctttctctctggctgcccttaacattttttccttcatttcaactttggtgaatctgacaattatgtgtcttggagttgctcttcttgaggagtatctttgtggcgttctctgtatttcctgtatttgaatgttggcctgctttgctagattggggaagttctcctggagaatatcctgcagagtgttttccagcttggttccattctgcccgtcactttcagatacaccaattagacgtagatttggtcttttcacatagtcccatatttcttggaggctttgtttgtttctttttattcttttttctctaaacttctcttcacacttcatttcattcatttcgtcttccatcgctgataccctttctttcagttgattgcattggtcactgaggcttgtgcattcgtcacgtaattctcatgccatggttttcatctccatcaggtcctttaaggtcttctctccattggtttttctagttatccattcatctaattttttttcaaagtttttaacttctttgccattggttcgaacttccttctttagctcggagtagtttggtcttctgaagccttcctctctcaactcgtcaaagtcattctccatccagcttcttccgttgctggtgaggagctgctttcctttggaggaggagaggcactctgatttttagagtttccggtttttctgctctgtttttttccctatctttgtggttttatgtacctttgttctttgatgatggtgacgtacagatgggtttttggtgtgtatgtcctttctttttgttagttttccttctaacagtcaggaccctcacctgcaggtctgttggagtttgctggaggtctactccagaccctgtttgcctaggtatcagcagtggtggctgcagaacagcggatattggtgaaccgcaaatgctgctccctgatcattcctctggaagttttgtctcagaggagtacccagttgtgtgaggtgtcagtccacccctactagggggcgcctcccatttaggctactcaggggtcagggacccacttgaggaggcagtctgcccattctcagatctcaagctgcatgctgggagaaccactactctcttcaaagctgtcagacagggacatttaagtctgcagaggttattgctgtcttttgtttttctgtgccctgtctccagaggtggagcctacagaggcaggcaggcctctttgagctgtgatgggctccacccagttcgagcttcctggacacttcgtttacctactcaagcctgagcaatggtgggcgcccctcccccaacctcactgccaccttgcagtttgatctcagactgctgtgctagcaatgagtgaggctccgtgggcgtaggaccctccgagccagttgtgggatataatctcctggtgtgctgtttgataagcccgttggaaaagcacagtattagggtgggagtgacccgattttccaggtgccgtctgtcacccctttctttgactaggaaagggaattccctgaccctttgcacttcccgggtgaggcgaagccttgacctccttcgactcacgcacggtgcactgcacccactgtcctgcaccaactgtccagcactccccagtgagatgaacccgttacctcagttggaaatgcagaaatcacccatcttctgcgtcgctcacgctgggagctgtagaccggagctgttcctattcggccatcttggctccaccccaccacattttctttatccagtctatcattgatggatatttgggttggttccaagtctttgctattgtgaataggaattttcttagcaaatatgaaaatttgctgagagaggaagtgtgcaaaatggtttggcaggaaatcacacatggaagggcccaactgggtcactttgtgtttgaacactacatgggagactatgttgaaatcctagatttcaacaatcctagattagaccatcacggaaaagactcactactaggtggcagaggccctttcctgttgctcagagggacttctagtcgtgaaaacccataacctcctccttgactgtgtactagaagcactgctaagtgaaactggttaattctgcatctatttttgtaatgtggcaatttacatgctgattggagccaggctgtgggaatgtttttggtctaaggccatggttctcatggtggagaattttgccatttaggacatttggcaatgcctggagacatttttagtcacaagtgggttggggggtgctactggcttctaatgggtagaggacacagatgcttccaaacctcctaaaattcacagggcagctcttccctacaccacacatacaaaaagaagtacctgacccaagatgtcaacagtacctggattgagaaacactggtttaagtgaagaagcctgggtctcagagaattatttgtatttagtctctgcctttttcccctgtatttgctctgtgtgtgtgtgtgtgtgtgtgtgtgtgtgtgcatgtgtatgtgtgtgtgtgtgttggaatttatccatttaagtaaatgtaggaaagccctcagagtaccttaagagtatcactgtgctatgaagaaatgattgtgctttacagtgaacttgaggggagattcacttggggtaccaggctccccaaaggttgtaggtacagcacacatgcctgaaaacacagaaacatctgccaacactcacctgggtgtgtctttttgtctctatctttcttttctctagcaatttccaaactttataggcctcaattcttacttgaggagtgagcagcaggggttactgtcagttttagggcatacatctggcgagaagtgcctcaaagctgtctgcagaagtgcttttggggtttgaggatggcttgggttctttcttttaaataggtggagctgagatgaaggatgagggacagtgttcatgatcgttgtttaggctcttctccaactgtcatatttcttatgtgtcaaaggatactgtgacaaacccagtcactgatgttgggaatgtgagggatctaaggagagagcagtgtatatgggaagaagaagtacagccatttgatgtgcagaaggaatgtctgagcatctgggtatgtgtttgcagttttgtattttggctccaattcaagcccctttcattttgtatgataaataatttcttttctacacctaatttccattgactaatggtgattaatcttcaactttgacattagagataacaagtgatgctcattccattaggctttaccaaaatgctggtatttgagtagaaacaaagactgggataacaattgcttgcattcattgtggccctaaagtaattgtgaacccttgtaaagcctctacttatggtgcacagaattgtaacgtttgtaatgtaggggtggggctctgagaattaccaaatgttataaccaagggcaggtgttggtaaagtcctggaaaactggccccagtttcctccttccctcttctcttaggccatcatcatgaagtcacatgaaattcatgagtggcacaatgctgagctacgagttccattgctggtgaaagagggtggttcagtctgtctgtggaagttatgtttgatttccacctctcctttgctcatccctctgactttgtgtggagtttctccactggggtgtagagagtgtttattcacaataagtgtaacgtaaggtgatgtggaaatgagtagtcctctaattatagagtgacttacataaaaactatgccattggaaatagatgcatttaagttcctaaaggtcaggaggtatggttgagcctggcagccattagcaaatgtgatacagttcaatggtgagtacttacgagtttatacatgtatacataatattggggatatgtcattggtatgttaattagagaatgcgtttgagtatcaatgtatgatcatttccccattatcgatgacaatggaaaaaagcagtagtacaaataatcccaagcgttaggtgattttaaaatattttctatcaagtttgagtgttttattatgatttttttaactgaggttcacctatatatgtcaacagactatggaaagtcatagtgaggttaaaaagaaaatatgaagtaattatatcaaatagtccacaaaggaaaacattctgaaaagtgaatagttcaattaggtggcctataaatgttaagaccagtgttcggcaacagctcagtttcagacccccattccaaatgtcagtacattcttgaaatgggagtggtctttactatgtatgctttgtacacctttcctgaaatttgcttccaggtgttcttgtatattaaataccacagccttgatctttaaatgatgacaaattgtccaaatgtattaacttttcccctttatttttctctttgctttattctcagtaacctcttttctctaattcttacattaacatataaataaaataattccagatgaattcatcatagatgataattataacgtgttcaggtgtggatctctttgaatctatcctacttggaatttgttgagctccttggatgtgtagattaatgtttgtcatcaaattttgaaagtttggctattattcaatacagtcatgcatcacttaaaaataggaatactttctgagaaatgtgttcttcggaaatttaacccttgtaccaacatcatagagtgtacttacacaaacgtagatgatttagcctactacacacttaggctatgtggtatagcctatggctcctaggctacaaacctcacagcatgttactgtactggatactgtagaaaattgtaacacagtggtatttgtgtgtgcaaacatatataaaaagataaaaaataatgcgagggaggagccaagatggccgaataggaacagctgcggtctacagctcccagcatgagcgacgcagaagacgggtgatttctgcatttccatctgaggtaccgggttcatctcattgggagtgccagacagtgggcgcaggtcagtgggtgcgcgcaccatgcgcgagctgaagcagggcaaggcattgcttcacacgggaagcgcaaggggtcagggagttccctttcctagtcaaagaaaggggtgacagacggcacctggaaaatcgggtcactcccacccgaatactgcgcttttccaacaggcttaaaaaacggcgcatcaggagattctatcctgcacctggctcgcaggatcctacgcccacggagtcccgctgattgcgagcactgcagtctgagatcaatctgcaaggtggcagcgaggctgggggaggggcgcctgccattgcccaggcttgcttaggtaaacaaagcagccaggaagcttgaactgggtggagaccaccacagctcaaggaggcctgcctgcctctgtaggctccacctctgggggcagggcacacacaaacacaaagacagcagtaacctctgccgacttaaatgtccctgtctgacagctttgaagagagcagtggttctcccagcacgcagctggagatctgagaacgggcagactgcctcctcaagtgggtccctgacccctgacccctgagcagcctaactgggaagcacacccgagcaggggcagactcatacctcacacggccgggtactccaacagacctgcagctgagggtcccgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgactctcctcctccaaaggaacacagttcctcaccagcaatggaataaagctggatggagaatgactgacaagctgagagaagaaggcttcagacgatcaaattactccgagccaggggaggacattcaaaccaaaggcaaagaagttgaaaactttgaaaacaatttagaagaatgtataattagaataaccaatacagagaagtgcttaaaggagctgatggagctgaaaaccaaggctcgagaactacgtgaagaatgcagaagcctcaggagccgatgcgatcaactgcaagaaacggtatcagtgatggaagatgaaatgaatgaaatgaagcgagaagggaagtttagagaaaaaagaataaaaagaaacgagcaaagcctccaagaaatatgggactatgtgaaaagaccaaatctacgtctgattggtgtacctgaaagtgacggggagaatggaaccaagttggaaaacactctgcaggatattctccaggagaacttccccaatctagcaaggcaggccaacgttcagattcaggaaatacagagaacgccccagagatactcctcgagaagagcaactccaagacacataattgtcagattcaccaaagttgaaattaaggaaaaaatgctaagggcagccagagagaaaggtcggttactctcaaagggaagcccatcagactaacagcagatctctcagcagaaactctacaagccagaagagagtgggggccaatattcaacattcttaaagaaaagaattttcaacccagaatttcatatccagccaaactaagcttcataagtgaaggagaaataaaatactttacagataagcaaatgctgagagattttgtcaccaccaggcctgccctaaaagagctcctgaaggaagcgctaaacatggaaaggaacgacctgtaccagctgctgcaaaatcatgccaaaatgtaaagaccatcaagactaggaagaaactgcatcaactaacgagcaaaatacccagctaacatcgtaaagacaggatcaaattcacacataacaatattaactttaaatgtaaatggactaaatgctccaattaaaagacacagactggcaaattggataaagagtcaagacccatcagtgtgttgtattcgggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcgaacctaatagacatctacagaactctccaccccaaatccacagaatatacatttttttcagcaccacactacacctattccaaaattgaccatatacttggaagcaaagcagtcctcagcaaatgtaaaagaacagaaattataacaaactgtctctcagaccacagtgcaatcaaactagaactcaggattaagaatctcactcaaaaccgctcaactacattgaaactgagcaacctgctcctgaatgactactgggtacataatgaaacgaaggcagaaataaagatgttctttgaaaccaacgagaacaaagacacaacataccagaatctctgggacacattcaaagcagtgtgtggagggaaatttatagcactaaatgcccacaagagaaagcaggaaagatccaaaattgacaccctaacatcacaaaggaactagaaaagcaagagcaaacacattcaaaagctagcagaaggcaagaaataatgaaaatcagagcagaactgaaggaaatagagacacaaaaaaaccttcaaaaaattaatgaatctaggagctggttttttgaaaggatcaacaaaattgatagaccactagcaagactaataaggaaaaaaagagagaagaatcaaatagacacaataaaaaatgataaaggggatatcaccaccgatcccacagaaatacaaactaccatcagagaatactacaaacacctctacacaaataaactagaaaatctagaagaaatagataaatttctggacacatacactctcccaagactaaaccaggaagaagttgaatctctgaatagaccaataacacgctcggaaattgtagcaataatcaatagcttaccaaccaaaaagagtccaggaccagatggattcacagccgaactctaccagaggtacaaggaggaactggtaccattccttctgaaactattccaatcaatagaaaaagagggactcctccctaactcattttatgaggccagcgtcatcctgataccaaagcctggcagagacacaaccaaaaaagagaattttagaccaatatccttgatgaacattgatgcaaaaatcctcaataaaataccagcaaaccaaatccagcagcgcagcaaaaagcttatccatcatgatcaagtgtgcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacatgtttcaaaataataagagctatctatgacaaactcacagccaatatcatactgaagggacaaaaactggaagcattccctttgaaaactggcacaagacagggatgccctctctcaccactcctattcaacatagtgttggaagttctggccagggcaatgaggcaggagaaggaaataaaatgtattcaattaggaaaagaggaagtcaaattgtccctgtttgcagatgacatggttgtatatctagaaaaccccatcgtctcagcccaaaatatccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaagctactttaaagttcatatggaaccaaaaaagagcccacatcaccaagtcaatcctaagctaaaagaacaaagctggaggcatcacgctacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagaaatggggaaaggattccctatttaataaatggtgctgggaaaactggctagccagatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattcaaccaaagagcttctgcacagcaaaagaaactaccatcagagtgaacaggcagcctacaaaatgggagaaaatttttgcaacctactcatctgacaaagggctaatatccagaatctacaatgaactcaaacaaatttacaagaaaaaaacaaacaaccccatcaaaaagtgggtgaaggacatgaacagacatttctgaaaaaaagacatttatgcagccaaaaaacacatgaaaaaatgctcatcatcactggccatcagagaaatgcaaatcaaaaccacaatgagatcaccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgtttcctcagggatctagaactagaaataccatttgacccagccatcccattactgggtatatacccaaaggactttaaatcatgctgctataaagacacttgcacacgtatgtttattgtggcattattcacaatagcaaagacttggaaccaacccaaacatccaacaatgatagactggattaagaaaatgtggcacatatacaccatggaatactatgcagccataaaaaatgatgagttcatgtcctttgtagggacatggacgaatgtggaaatcatcattctcagtaaactatcacaagaacaaaaaaccaaacaccgcatattctcactcataggtgggaattgaacaatgagaacacatggacactggaaggggaacatcacactctggggactgttgtggggttgggggatgggggagggatagcattgggagatatacctaatgctagatgacgagttagtgggtgcagcgcaccagcatggcacatgtatacataagtaatgaacctgcacattttgcacatgtatcctaaaacttaaagtataataataataaattaattaattaaaaaaaaaccaaaacaattttaaaaaaaataaaaactaaaaaaataaaaaataaaaaaataaggcattgcactacagcattatggcagctagtgtgtcagtaggtgacaggtatttttctactccattataatatttttaaaaaattgtttatttttaaatttttgttgacacatagtaggtatgtatatgtttatgggttacatgagatattttgatacaggaatgcagtgggtaataaccacatcagggtatatgggctagccatcacctcaagcatttatcctttgtgttataatttaattatactgttttagttatttttaaaatgtataattatgtacatttaaatatagtaaatattgtgactgtagtaaaacataatttactacagtcacaatatttactatatttactaagtgactatagtaaattactttttactatagtcagtctgatgtgctagcaaatactaggtcttattcattatttctgattttttgtaaccactaactgtcatttccccccaccaccccccacccacacactacccttaacatcctctgataaccatccttctgctgtctatccctatgtgttaaattattttgatttttagcttccacaaataagtgacagcatgtgaagtttgtctttctgtgcctggtttatttcacttaatagaatgacctccagttccatccatgctgttgcaaatgacaggatctcattctttttatggcccagtagcactccattatgtagatgtaacacatttttgttgcgggaagtcagggaccctgaacggggggaccggctgaagctgtagcagaagaacataaattttgaagatttcatggacatttagcagtttccaaagttaatacttttatcatttcttaggcctgtctttactgcagtctctgaacgtgaattgtgaagatttcatggacatttatcacttccccaattaatactcttataatttcttatgcctgtctttaatctcttaatcacattatctttgtaagctgaggatgtatgtcacctcaggaccctgtaatgattgcgttaactgtacaaattgtttgtaaaatgtgtgtttcaacaatatgaaatctgattgtgaaacaagggtgtttgaacaatatgaaaccagtgcaccctgaaaaaacagaataatagcaattttcagggaaaaagggaagataaccataagggctgactgcctgtggggtcgagcagaatagagacatatttttcttctcacagaaagcctatagatggatgtgcgagtaggagaaatattgctgaattattttcccagcatggagtaaccctcaggaaggaatgcattcctgggggtaggtctatagatggctgctctgggagtgtctgtcttatgcggttgagataggactgaaatacgccctggtctcctgcagtgccctcaggcttactaggattgggaaattccagcctggtaaattctagtcagaccagttgtctgctctcgaaccctgtttcctgttaagatgtttatcaagacaatgtgtgcacagtgggacacagaccttcatcagtaattctaatttttgcctctgccttttgatcttttattgccctttgaagcatctgatctctgtgacctactccctgttcgtacaccccctcccctttcaaaatccctaataaaaacttgctgattttgcagcttgaggtcaccatcatggtcctaccaatatgtgatgacacccccggaggcccagctataaaatttctctctttgtactctttttgtttatttctcagaccggccgacacttagggaaaatagaaaagaacctacattgaaatattgggggctggttcccccgatacattttctgtatctattcatctattgatggacaggtaggttgcatccaaatcctggctattgtgaatactgctgcaataaacacaggagtaccaatatctcttcgatgtaccattttcctttcttttgggtatacacccagcagtgggattgctagattttgtggtagctctatctttagttttttgaggaccctacaaactgttctgcatagcgattgtactaatatataatacattcccaccaacagtgtaagaggattcccttttctccatattctcaccagcatttgttattgcctgtcttttagataaaagccactttaactggtgtgagatgatatcttattgtagtttgatttgcatttctctgatgattgatgatgttgagccattgtacctgtttgccatttgtatgtcttgttttgagaaatgtctgttcagatctatggcccattttttattcagattattagatttcttcctgtaaagtcgattgagctccttatatattctggttattaatcccttgtcagatgggtattttgcaaatattttctcctgttctgtgggttaccctttcactttgttgattgtttcctttgctgtgcagaagcttttcagcttgatgtgaccccatttgtccatttttgctttggttgtcagtgcttgtggggtattactctagaaatccttgcacagactgatgtcctggagagtttcctcaaggtttttagtggattcatagcttgaggtcttagatttcagtctttaatctattttgatttgatttttgtatatgatgagagatggggggtcaagtttcctttttctgtatatggatatccagtttccccgcaccgtttattgaggatactctcctttctccaatgtatattcttggcacctttgtcaaaaatgagttcactgtggatgtatggattttcttgaggttctctattctgttccactgatatatgtatctgttttttatgacaatacagtgctcttttggttactatagctctgtagtataatttgagaaattaatataatgtgattccttcagatttgttctttttgctcaggatagctttggctattctgggtctgttttggttccagataaactttaggatttttttttctatttctgtgaataatgtcattggtattttgatagggattgcattggatctgtagatttatttgggtagtatagacattttaacattattgattcttgcaatccattaacatggatatatctttccattttttggtgtcctattcaattttttgcatcaacgttgtatagttttcattgcacagatatttcacttctttggttaagctaattcctaggtatttaattttatttatagctattgtaaatggaattattttctttatttcattttcagattgctgttggcatataaaaatatgactgatttctgcatgttgatagcatattctgcaactttactgaatttgtttttcagctctaattgttttttgtggagtcattagtttttccaaatataagatcatatcatctggaaataaggatattttgacttcttcatttccaatttggatgccctttagttctttcttttgtctgattgctctagctaggacttccagtaatatgttgaatatcagtggtgatagtgggcatctttgtcatgttccagatcttagaggaaatgctttccatttttcctcattcagtatgatactaacttttggtctgtcatagatggcttttattattttgacatatgttccttctatccccagttttttgagggtttttatcatgaaggtatgttgaattttgttaaatgctttttcagcatccatggaaatgatcacatgatttttgtcctgtattctattgctacaatgtatgatattgattgatttgcatatgttgaaccaccctttcattcctgggataaatctcagttataataaatgatctttttaatgttttgttgaactttgctagtatattgttgaggatttttgcatcaatattcatcagtcatattgttttatagttttcttttttgatgtgtcattgtctagttttggtatcagggtaatactggccttgtacaatgagattggaagtattttcttctcctctatttattggaatagttggagtagtattggtattagttcttctttaaatgtttggtagaactcagcagtgaagccatcagggtcattggctttgctttgctgggagactttttattatggcttcgaactcattacttttttttctaattttaatttaattttattttattttaagctctgggatacatgtgaaggatgggaggtttgttacataggtaaacatgtgccctggtggtttgctgcacctatcaacccatcacctaggtattaagccccacatgtattagctatttatcctgatgctcttcttcccccccaccccccaacaggccccagtgcatgttgttcccctccctgtgtccatgtggtctcattgtccagctccaacttataagtgagaacatgtgatgcttggttttctgttcctgtgttagtttgctgaagataatggcttccagctctatccatgtccctgcaaataacataatcttgttcctttttatgcctgcatagtattcaatggtgtatatataccacattttctttatccagtctatcactgatgggcatttgggttgattccatgtctttgctattgtgaatagtgctgcaattaacacatgcctgcatgtatgtttataatagaatgatttatattcctttgggtatatacccagtaacaggattgctgggtcaaatggtatttctggtttctaggtctttgaggaattgccatactatcttccacaatggttgaactaatttacattcccaccaacagtgtgaaagtgttcctatttctgcacagcctcaccagtatctgttgtttcttgactttttaatagtcaccattctgactggcataagatggtatcttattgtggttttgatttgcatttctctaatgatcagtgctattgagctttttttcatgtctcttggccatgtgagtgtcttcttttaagaagtgtccatgttctttgcccactttttaacgggattttctgtttcttataaatttgtttaagttccttgtagactctggatattagacctttgtcagatggagagattgcaaaaaatttctcccattctgtaggttgtctcttcactctgatgatagtttattttgctgtgcagaagctctttagtttaattagatcacacttgtcaatttttacttttgttgccattgcttttgatgtctttgtcattaaatctttgcctgtgtccaagtcctgaatggtattgcttaggttgtcttccaggttttatatagttttgggttttacatttaagtctttagtccatcttcagcatattttgtatatggtgtaaggaaggggtccagtttctatcttctgcacatggctagccagttatctcagcaccatttattgaataaggattcctttcttcattgcttgtttttgtcaagtttgttgaagatcagatggttgtagatgtgtggtcttatttctgagatctctattctgttccattggtctatgtgtctgtttttgtaccagtaccatgctgctttggttactgtagccttgtagtatagtttgaagttgggtggcatgatgtgatgcctccagctttgctctttttgcttaggattgtcatggctatacgggctcttttttggttccatacgaattttaaagtagttttttctacttttgtgaagaatgtcaatggtagtgtaatggtaatagcgtggaatctataaattactttgggcagtgtggccattttcatgatattgattctttctatccatgagcatggaatgttttttcatgtttgtgtcctttctgatttttttgagcagtggtttgtatttctccttgaagaggtccttcacttcccatgttagctgtattcctaggtattctattctctgtagtaattgtaaatgggagttcatttatgatttgtttctccccttgtctattgtttgtgtataggaatgcttgtcattcttgcacattggttttgtattctgagtgtattagtcctttctcatgctgctataaggacatacccgagactgggtagtttataaagcaaggaggtttagtggactcaatagtttcacatggctaaggaggcctcacaatcatggcggaaggtgaagggggagcaaaggcacatctgacatggcagcatgccagagcacatgttcaggggaactgccctatataaaaccaacaggctttttgagacttattcactatcatgagaacagcatggtaaaaacccactcccatgattcaattatgtcccaccaggtccctcccaccacatatggtgattatgggagctacaattcaagatgagatttgcgtggggacacaaccaaaccatatcattccacccttggccccttccaaatctcatgttctcacattttgaaaccaataatgccttcctaacagtcccccaaagtcttaactcattccaacattaacttaaaattcacagtccaaagtctcatctgagacaagacaagtcccttccacctatgagcctgtaaaatcagaagcaagttagttacttcctagatacaatgggtgtgcaggcattgggcaaatacaccccttccaaatgggagaaattggccaaaacaaaggggctgcaggctctatggaagtccaaaatccaatcaggctgtcattaaaccttaaagttccaatgtgatctcctttgaccccatgtctcacatccaggtcacactgatgcaagcagtgggatcccacggccttgggcagctccatccctgtggcttggaagcatatagccccctcccagctgctttcaccgattagctttgagtttctgtggcatttccgggaacatggtgcaagctgtcggcagatctaccattctgggttctggagtacagtggccctcttctcacagctccactaggcagtgccccagtggagattctgtgtggggacttccaccccatatttgccttccacagttctctagcagaggttctccatgagggccccaccccggcagcaaacttctgcctggacatccaggcatttccataccaccactgaaatctaggcagaggttcccaaacctcaatccttgaacttctgtgtacccacaagctcaacaacacatggaagctgccaaggttttgggcttgaaccctctgaagccatggcccaagctgtactttagccatggctagagaggctgggatgcaggtctccaagtccctaggctgcacataacagaggggccctggacctgacctaagaaaccatttttcccttctaggcctccaggcctttgatgggaggctctgccatgaaggtctctgacatggcctggagatgttttccccattgtcttggtgattaacattcagctccttgttatttatgcaaatttctgcaggaggcttgagtttctccccagaaaatgggtttttcttggcaggctgcaagtttttcaaacttttatgctcttcttccttttgaatgctttgcagattagaaatttcttctgccagataccctaagttatctctctcaagttcaaagttccacagatctctagggcaggagccaaatgccacccatctctttgctaaatcataacaacagtcactttccctccagttcccaacaaattcctcatctccatctaagaccacctcagtctggatcttattgtccatatcactatcagcattttggtcaaagccattgaacaagtctctaggaagttccaaactttcccacatcttactaccttcttatgagcactccaaactgttccaacctctacttactaagcagtacaaaagttgcttccacattttcaggtatcttaatagcagtactccactctactggtaccatttgactgtattagtccattttcctactgctatgaagaaatacctgatggccgggtatggttgctcatgcctgtaatcctggcactgtaggaggccaaggtgggcagatcacctgaggtcaggagttcaagaccagtctggccaacatggtgaaacccagtctctactaaaaatataaaaattagctggaggtggtggtgggtgcctatagtcccagctactcaggaggctgaggcatgagaattgcttgaacccaggaggctgaggttgcattgagccaagatcataccactgcactccagcctgggcaacaagagcgaaactccatctcagaaaaaaaaaaaagaaatacctgagactgggtaatttataaaggaaaaaggtttaatggactcacagttccccatggctgggaaggcctcacaatcatagtggaaggcaaaggaggagtaaaggcacgtcttacatggcagcaggcaagagcacatgtgtagtggacctgccctttataaaaccatcagatcccttgagacttatccactattataacaacagcatgggaaaaacctgcccccatgattcaattacttccaactgggtccctcccacatggggattatgagagctacattcaagatgtggtttgggtggggacacagccaaaccatatcactaagactttgctgaagttgcttattagcttaagaagctttggggctgagacgatggggttttctagatatagaatcatgtcatttgcaaacagacagtttggcttcctctcttcctatttgaataccctgtatttctttctcttgaccgattgccctggccagaacttccaatacgatattgagtaggagtgatgagagaggacatcctcgtcttgtgccagttttcaaatggaatgcttccagctttcatgaattgctcttattatattgatgtatatcctttcaatacctagtttattgagagtttttaacatgaagggatgtttaattttattgaaggccttttctgcatctattgagataatcaatgtggtttttgtctttagttctgtctatgtgatcagttatgtttattgatttgcttatgttgaaccagccttgcatccaaggaatgaagctgacttgattgtggtgaataagctttttgatgtgctgttggatttggtttgccagtattttactgaggatttttgcattgctgttcatgagagatattggcctgaagttttctttttttattgtatctctgccaggttttggtatcaagatgatgctggcctcataaaatgagttatggagaagtccctccttttcaattgtttagaatagtttcagaagaaatggtaccagctccactttgtacctttggtagaattcagctctaaatccatcttgtcctgggcttttatttattactacctcaatttcagaacttgttattggtctattcagggattcaactccttcctggttcagtcttgggagggtgtatgtgtccaggattttatccattttgtctagattttttagtttatttgcatagaggtgtttatattaaatagtattctctgatggttttttgtatttctgtggagtcagtggtgatatctttatcatttttgttgtgtttatttgattcttctctctcattagtctagctagaggtctatctattttattatttttttgaagaaaccagcctctggattcattgattgtttgaacagttttttgtgtctctatctccttcagttcactctgatcttggttattttttgtcttctgctagctttgaagtttgtttgctcttggttctctagttcttttagttgtgatgctatggtgctgattggagacttttttttttttttgagatgtagtcctgctctgtcacccaggctggagtccagtggcatggactcagctcactgcaacctctgcctcctgggttcaagtgattctcatgcctcagcctcccgaataggggggactacaagcacatgccaccacacccggctaagttttgtatttttttgtagggaccgagtttcaccatgttagccaggctggtctcaaacccctgacctcaagtgatccatccacttcagcctcccaaattgctgggattacaggcatgagccactgtgcctggctttctagctttttcatatgggcatatagtgctataaatttcccttttaacactgctttagctgcgttccagagattctgatatgttatctgtttgttctcgttggtttcaaagaactttttgatttctgccttaatttctttatttacccagtagtcattcaggagcaggttgttcaatttccatgtagttgtgtgactttgagtgagtttcttaatcttgagttctaatttgattgtgctgtggtctgagcgactgtttgttatgatatcagtccttttgcatttgctgaggaattttttactttcatttatgtgatcaattttagagtaaacgccatgtggcacagggaagaatgtatattctgttgtgttttggtggagagttctgtagatatgtatcaggtccacttggtgagctgagttcaagtcctgaaaatttttgttaattttctgtctcgatggtctgtataatattgacaatggggtgttaaagtctcccactattattgtgtgggagtgtaagtctctttgtaggtctctaagaacttgttttacgaatctgggtgcttctgtattgggtgtatatatatttacaatagttaactcttcttgttgaattgatccctttaccattatgtaatgtccctctttgtctttttttatctttgtcgttttaaagtctgttttgtcagaaactaggattgtcactcctgtcttttctgctttccattggctgggtaaattttcctccatccctttattttgagcctatgtgtgtctttgcacgtgagatgggtctcttgaatacagcaaagcaatgggtcttgactacccagcttaccattctgtgtcttttaatttgggcattagtccatttacatttaaggttaatattgttatgtgtgaatttggtcctttcatcatgatgctagctggttattttgcagacttgttgatgtagttgcttcatagtgtcattggtctttgtaattcagtgtgtttttgcagtggctggtattgatttttccttttcatatttagtgcttcattcaggagttcttgcaaggcaggtctggtggtgatgaattccctaagcattttcttgtctgaaaaggactttatttcttcttcacttatgaagcttagtttgatcagatatgaaattctgggttggaaattcttttctttaagaatgttgaatattagctcccaatctcttctggcttgtagggtttctgctgagagatccactcttagtctgatggacttctctttgtaggtgacatggcctttctctctgactgcccttaacatttgttttcattttgaacttggacaatctgatgattatgtgtcttggggttgatcttctcatggagtatcttattgggtttctctgggtttcctgagtttgaatgtttgcctgtcttgttaggttgtggaagttctcctggatgatattctgtagtatgttttccaacttatttccgttctgtctctgtctctttcaggtaccccaattagtcgtaagttcagtctttttacataatcccatagttctcagaggttttgttcattccttgttattctgtttcttctaatcttgcctgcctgtcttatttcagcaagatagtcttcaagctctgaaattctttcttctacttggtctattcagttactgatacttgtggttgcattatgaagttcttatgttgtgttttcagctctatcaagttatttgtgttcctctttaaactggttattctggttaacagctcttataatgttttatcatcgttcttagcatctttgctttgggttaggacatccttttttagctccgattttgtttatttgtgcgttctctctttttctgagttattctaactaaaggtttgtcagtttcatttatcttttcaaatagccaggttttggttttgttgatcttttgttattgttttctttatttcagtttcatttgtttctgctctgatctttcttatttcttttcttctactaattttgggtttggtttgctcttctctagttcattaagatgcatcattaggttgtttatttgaagttgttcttcttttttgatgtacacacttatagctataaacttccctcttagcactgctttggctatatctcattggtttttatatgttgtatttccataatcatttgttttcactctatatttgaattttttcttaatttattcattgaccattggtcattcaggagcatgttgtttaatttccatgtgtttgtatagtttccaaaattattcttatttatttctagttttattccattgtggtggagaagatgcttgatataatttcaatttttgaatgttttaagacttgttttgtgacctaacatatggtctctttgagaatgatattcatgtgctgaagaaaagaatatatattctgcagccattggatgaaatgttctgtaaatatctgttagagccatttggtctattgtgcagaataaatcagatgtttctttgttcgttttttgtttgggagatatgtccaatgctgaaagtgatttgttgaagtctctagattttattgtattggagtctatttctttccttagctgtaataatatttgctttatatatctgggtgctccagtattgagtgcatatatatttaaaattggtatatcctcttgttgaattaaccctttatcattttatactgactttcttataggtgaagtatgtttcttgtaggtcatagatcattgggcctttttaaaaatttattcaaccactccttatcttctgactggagagattagtccatttacagtcaatgttattatcaataagtaggaacttactctaccattttgttacttctctgctggttgttttgtggccttctctttcttccttctttccttcctgtcttgcttttggtgaaggtaattttcttaggtggtgttatttaattcctttctttttattttttgtgtatcaattatatgttacttgatttgaggttaccacgaggctttttaagctgacaacaacatagcattgtttccataaacaaacaagcaagcaaaatgtaaactaataaacactctaccccttaacttcatcctcccgctttttaactttttgttgtttctatttatatcttattgtattgtgtcttgaaaagttgttgtagttattatctttgattggctcattgtttagcctttctacttaagagtagtttacacaccacagttatggtgttataatattctagtttttcagtatacttactattaccagtgagttttgtaccttcaagtgattatttattgctcattaatgtccttttctttctgattgaagtactccatttagcatttcttgtatacaggtctggtattgatgaaatctcttagcttttgtttgtgtgggaaagtctttatttctccttcatgtttgaaggcaattttcacgggatatactattttagggtaaaagttattttctgtcatcactttaaatatttcatgccactctctcctggcctgtaaggtttctaccgaaaagtctgctgcaagatgtaatggagctttattgtgtgttgtttcttttctcttgctgcttttcggatccttctttatccctgacctttggaagtttgatgactaaatgctttgaggtattcttttggtaaaatctgttgggtgttctataaccttctcgtacttggatggtgatatctttctctgtttggggcagttctctgttattatctctgaataaactttctacctcacctctttctctaccttctctttaaggtcaattactcttagatttccccttttgagactattttctagattttataggcatgcatcattcttttctatttttttcttttgtctactcttactgtgtattttcaaataacctgtcttcattcttactaattctttcttctgcttgatcaattctgctattaaaagactgatgcattcttcagtgtgtccattgcatttttcaactccagaatttctgcttgatttttaattatttcaatctctttgttaatcttatctgatagagtgctgaatttcttctttgtgttatctttgaatttcctcaaaacagctattttgaactctctgtctgaatgttcacatatctgtttctccaggattggcccctggtgcctaatttagtttgcttggtaatttcatgtttctcctggatggattttaagcttgtggacattcatccgtgtctactaattgaagaattaagtgtgtattgtaatcttcgtagtctgcgtttatttgtacccatccttcttgggaaagctttccaggtatttaaaaggacttgcatgttgtgatccatgctgtatctgcatcagggggctccccaaacccagtaatgctgtgactcttgtagtcttatagaggtaccaccttgctggtcttggataagaatccacagaaattatctgcattaccagacagagagactcttgttttcttcccttactttcttccaaacaaatggagtctctctctttctgtgctgagctgcctggagcttgggatgaggtgacacaagtacctctgtggccaccaccactgggactccactgggtcagacctgaagccagcacagcactgggtctcacccaaggtcccctgtaatactgcctggctactgcctgtgttttcttaaggtcgcagagctctacagtcaacaggtggcaaatcgagtgacaattttgttcttcccttcagggcagcaagtttctctaggtcccaggcagctcttgagatgccatccaggccaggaactagagtcaaaaatcctagaaatctacctggtgttctattatattgcagctgagctggcactcaaatcaggcgacacagttcttcttcccactcttccactctattcttttcacaggcagaagagactcactccatggcttccaccagcacaggcccacagggagttctgccaggctactgccaatgttcacttgaagcccaagggctcttcaatcagcttgtggcaaatgctgccaggcctgggactcattcttcatggaagtcagcctccctttggcccagggcaggtccagaaatgccatccaagagccagggcttagaatcggagaccccaagagcccagttggttctctacacccctgtggctgagttggtacctaaagtgcaaaattccctttacttttccctctgtttttctcaagcaggagtctctcactatagccactacaattgagaatgtgctgggtctcacccaaagccagcacatctcagagtcttacccaaggcccacagtgtactacctgagtatcactactggttattcagggcccaagtgctctttagtcagcagatgatgggtccttccaggaccaggtccttcccttgaaggcaacgggtacccttctgtttcagaatgtgtctagaaatgttgttcaggagctagggcctggaactggggtgctaagactctgaccagtgccctattctgctttggctgagcagggagccaagatgcaagaccaagtcttctttactcttccctctcctctcctgaagaggaaggaaggggtctcttttggagccatgagctgtgcagcctgggatttgggtagtggtggtgcaagcactcccttcactgccctggcttgtgtatgttacatgccctccaagcccactagctctaagcccagctcagcatacatactcacctaggagttgcagttcttgtgtcctagaccgcctttcaaatttacttagagcccagagcactttagcagatgatggcaaagcttgccagaactcacattccaactgctgggaaatgggattcccttctagttagggctgctctacatgcgttctccatgggtaagtgtcagctgcattcagtgcagttttgctttccactgggacaaggcagcactgagtttaatgcagtctcacaattgcttcattctccttctcctaagcacagagattctctctccatgccacacagccactgctgggggaatgggggaggggtcatgtcagtggttcaagactgtctttcctaccctgtttagtgcctctttcagaaatattaagttaaaacaggtactgtgggggctcacctgattttcagctcttatgaaggtgcttttttgtgtgtagatagttgtcagttttggtgttcctgtgggataggagagatgatcagtagagccttctattcagccatcttgctctgccctctcccctccattataatcttatgtggccactgttgtatatgtggtctattgttcactgaaacattacgcagtgcattactgtattcttttcgtcctttttctctctcctccgcttctgggcatatcatcatgtgtatgttggggcactagatggttcccacagttctcttaggctctctttgtttttcttcattgtctgtgttccttagactggttaatctcaatcaatatatcttcaagttcactgatgctttcttctacctgctgaaatgtgcagtcatcttgctcttctagtgaatttttcatatgatttatacttttgagtctagaatgtctactttgtctttacaacttatgtgtctttattcatagtctgtatttggtgagacattgttttcctactttagttctttagacatggtttctttcagtttatgaacatatttataataactggtttaaagtgtttgtctagtaagttcaatatttgggcttcctcaggaacagtttctattgattgctttttttctgtgtttgggccatactttcttgttttttgcatgtttcataatggtgttttgttgaaaactagatattttgaataatacaatgtagcatatctgcaaatcagattcttttcctatctccccaggtctttttgttgctcctgtagtttgtttagtgactttcctgaactaattctgtaaagtctgtattcttttgtcatatgtgtccactgaaatctttgcttggttaggttagtggtcagctaatgaatgaacagagatttctttaagcacctggaaccaataaatctcccagtctttgtgaagggactctgtgtgcatgttggaagtatgccttcaatgctcaggcaggtagttgacagctttgccttagccttcacttcccacttgcttagaacctcagggtcagtcacaggtgggagcttaggcctttttcaggtatttcctgtgcatgcacccagcctcgagcaacaacacagccctacacatgcatgtggccatggagaattccaggaatatgtgagtttttcaaatcgccccatagaaatttcattcctcagctttaagctatttggttaacctattgttggccccatctattatgcattgcctcagacagccatgataatacacaattgccactgattgttttcagcaaatgccactggagggatagggatccagtttccttcttctacatatgaatatccatttttcccagcaacatgtattgaagagagtatttttccccaatgtacgttctttgtgccttcatagaaatcagttgactgtaaatatgggctttgtttctgggttctctgttctatttcatttatctgtgtgtctgtttttataccaatatcatgctgttttgggtactacagctttgtaatatattttgaagtcagatagtgtgatgcctccagttctgtaccttttgctcagaattcttttggctacttggactactttgagttccatataaattttagggttttttttccatttctgtgaaaaatgacattgatattttgatagggactgaaattattttttacattgctttgtgcagtatggtcattggaaaaatattaatttttctgatccatgagtatgggatgtatttttatttgtttgttttctgtttcatttctttcatcagtgttttgtagttttctttaaaagaggtcatttatctccttggttaaatataatactaggtattttatttttgtaactcttttttataactattgtaaatgggattgccttcttgatttcttctcagctagttgattatttatgtgtagaaatactactgatttgtgtgtgttgattttgtgttctgtaactttactaagagtttttggtgaagtctttaggtttttctagatacaagatcatgttgtctgcagaggtggatagtttgacttcctcttttccaatgtgaatgccttttatttctttctcttgcctgattgctttggctaggtacagaaagacctagccaagtggtgagtggtgaaagtgggcatccttttcttgctccagttctcagaggaaaggcttccagcttttccccatatcattacctgtgctctttattatgtttacatacggtctttagtatgttgagttatgttccttctatgcccagtttctgagtgctgttatcataaagggctgttgaattttatcaaatatttttcctgtgcctattgagattatcatattattgttgtccgtcattctgttgatttgatgtattgtgtttattgttttgtatatgttgaaccatccttgcatccctgggatagatcccatttgatcatggtgtattatctttttcatgtgctgttggatttgatttgctagtatgtagttaaggagttttgcatctatattcatcagggatattggcctgtagtttttgttgttgttgtatacttgtctagttttggtattagggcaatggtgcctcatggaatgaattagggagaaatccatttgcttcaatttttttgaatagtttgaggagaagtgatgttagttctttttaaatttggtagaattcaacagtgaagccatctggtcctgggcttttctttgttgagagactttattagtgattaaatctcattattcgttattagtctgttaaggttttctacttcttcctgattcaatcttggtaagttgtatgggtccaggaatttatttttttcctctaggtcttccagtttgttaatgtatagttgttcttaataggctctgatgatcttttatatttctgtgctatcagttgtaatatctccttttctatttgtgattttgagtcttctctctctttttttggttagcttaactagtaatacaggagttattaagaaattatttttaggcagctagaaagggtgaaaactcccagtgtaatttttctttaataaaaagcagtccccaaaccatttcttctctaacaggaagcagcctgagaagtcaggcatagatatgcaaactaggagcttttatatgtaaatgatggcagctgtacctggaagccaggtacattcaatgtggcatctcccatcctcttttgcttgtcactatgttaatgggtatcatggcagcctccaggtaaaaccgtgtgtacaggcatcatggcctccaccaggtggaggccgcatttgcataataaaagactagggtcagagggccagtctttttgcaagctatgtaaatggcacacctggtaaacccaatcccctgagccctatgtaaatcaatcactgcctcctcaagcctctgtacaaaaccgattatgttttgccacaaactagagaccctcttttgggcgacccactttttcagcatgaggaagctttttttctctttcttctttttctattaaactttccgctcctaaatccactccttgtgtgtgtccatgtcttgaattctttctcaactgtgacaaagaaccagggtatataccccagaaaatggagccatttcactagcagtttatcaattttatctttttttgaaaaaaaacttttcattttgttgatgctttgtaaattttttagtctctatttaatttagttctgctctgatctttattatttccttcctcctactaattttgggtttgatttgttcttgcttttctagtacttggggtgcatcattagactatttatttgaaatctctctgcttttttgatctagatgcttattgctataaacttccctcttagcagtgcttttgtgtgtcctgtaagttttggtgtcttgcgtttccattttcatttgtttcaggaaatttttaaaacattttttccttaactttttctttaatccagtggtcattcaggagcatgttgtttaatttccatgtgtttgtagtttccaaagttcctcttattattgatttagagtttcagaccattgtgatcttgatatgattttgattttttaaaaactgttgagatttgttgtgtggcctatatcttggagaatgttccatgtgctgatgagaataatgtgtattctgtagctgttggatgaaatgttctgtaaatgtctgttaggtccatttggtctaaagtgccgtttaaatccaatgtttctttattaattttctgtttagatgatctgtcttatgctgtgagcggagtgttgaagttcccaactattattgtattggagtctatctctccctttagatctaaaaatatttgctttacatatctgggtggcctggtgttgggtgcatatgtatttggaattgttatattctcttgctgaattgatctctgtatcattatatattgaccttctttgtttctttttattgttttcaagttaaagtatcttttgtcttatttaaacatagctacccttgctcatttttttatttcaatttgcatggaatatctttttttcatccctttactttcaatctatatgtgtctttacaggtgaaatgagttcttatagggattctatacataggtcatttttttttaaatccattcagcccatctatatcttttaagtggaatgcctcatttgtttacattcaagattattattaatatgtgagggcttattcctatcattttacttggtttcttgttgtttgtatatcttttgtgtctttctttctgtcttattgtttattcattatggtttggtggttttccgtagtcataacatttgagtccttttttgtccttgtttgtctgtttgctctaccagtggttttatacttttgtgtctttttgtgatagtagatagtgtccttttgcttccaggtgtaggactaccttaaacatttcttgtaggattggtcttatgctgatgaattccctcagctttggcttgtctgggaaagactttatcttttgtttatgaatgttaactttgctgggtatagtatccttggctggcagttattttttttttttcctttaagcactttgaagatgtcatcccattctcttctggcctgttaagtttctgctgagaaaccaactgttagtctgttaggggttcccttataagtggctagatgcttttctcttgctgtttttaaaattatctctttgtctttgacttttggcaatttgactataatacacagtggataagacctttttagacgatatgtatttggagatctctgagcttcctgtgtctggatgtctaaatctcctgctagacttgagatgttttcagctattattttgttcaataggttttctaccccctttgttcttctattcaccttttggaacactgaaggtcaagtatttggtcaatttgtggtctcctttatgtcatgtaggttttgttcatttttaaaaattatttctttaaaaaaaatttgactgactgggtgatttcaaaagacctgtcgtcaagtcctgaaattttttcttctgcttgatctagtctattgttgaagctttagaatgtatttttttttcattcagtgaattcttcagttccaggatttctgtttgtttctttttttaataatatctctttgataaatttctcattaatatactgaattgtttttctgatttttttgtgctgtttatgaggttctcttgtctctcactgaggtttttaatatcaacacttttaataatttttctaggatttcataaatctctttttttggggatcttttgctggagaataattatttttatttggaggtgtcatatttccttgctttttcatgtttcttgtgtccctccattgatatctgcacatctggtgtgccagttgcttcttccaaaattttggattttctttcatacgggaggacttttcctgaagatgtatctgttgtgttggctgggtagggcaccttggctttgattctgggtacgtgcaatagtgtattctctatatgatttcttcagttgtaaacagcttcagtagtgtttgtgatttcctcagtagcttagggtgtggttgttagtgaaggctgtggtgaagctttgctgggcactgggatgccaggtaggaatgtcatcaggcccactgtggtaatggtaggcctagcatacctgtcattgggcctcagggcaacataggctggcaacaatgttagttggtcctggcaggccaatggttgcacctccatgtggctcaggtgccagaagtggtagtggtggtcctcgggtccctgggcagtgggcttggaaagagtgatggcagtagcagtggcagaacaactctttggccccaaaatggtttgtgctggtgttagcagtggctgtggaaggctgggtgggccagtctcaggtctgcaagtcacacatgcaggtgagtgtcagctgctgtagttgtggcaggttgggtgggtctgtcctcaggcccctgggagaagtgctcaagtgctaatggtggtagatgagacagtgaaatccccaggcctccaggtggcatgctcagacactgggagtgggacagagctggaccaggtcatcctttcctcaatcctcagtcatatgtgtgggcactggctgtgttggcagagccagggtgattccaaagtttctagtggaatgcttggatgggaacagcagtgactgtgctgtggctctactgttggagcgtgcaaggttgctttcattggtagcagtaataggcaggaagctgtggagcacatgccttggtctcaggtggtagctgtaggcagggtagcctgtcctcagagtcactaccagtagctcacacttcagccctggcagcatcagccagcagtggcagtgactgcagatggagaaatctgtcttcagggagtgggaaaatgcaccctatagcagggtcacgccaacggcttatggttctgctctggatgcaccagacagcagtggtggtggctacagatggatgatgtgaattcagctccagggatgtggagatgcaaggcctgctgggctccagtgcaggatgcagcctggtggggcctggcctttcaaaatggagacatgctgcagcttcttaggagttggagggtgtgtgggtctcagtgtgatctccctctctggagcatgccatcatgcagtctccaggcagatccctatgttagtctcaggacccaagagggtggatgggctctttgaaggctgagattgcaggagtctgcagtgggaatgtggactgctgagggtttctcacatacccttttcctgcactggagagcctctctgggctcccacccaatctggctgagcagagtgcctttcttccctctccttccttgccttaggtgtttcctgtctcttctctgttgaattctagtgttgtcttttggatgatcaattcaaagtgtgattctaatactattttggttcctctttctggaggaggcaagtaccggatgcttccagtcagccaccttgaacagacatactggaagaccaagttgtaccatctttataggcagatgtggctgaagagatgaaatttatgccctctctccatcagtttgggctgctataacaaatcaccacagactggctggcttagaaacaacagaaatttatttttcacaattctggaggctggcaagtccaagatcaagaaatcagtagattcggtgtctggtgagggctcacttcctggttcacagactatgccttcttgctgtttcttcatgtggtggaagaaatgagagaactctctggggtctcttttatgaaggcactaatctcattcatgagtggtccactctcatgtcctaatcacctcccaaaggaccccaccttcaaataccatcacattggggattagatttcagcatatttattttggagggacacaaactgctcttttaatattcattttttttaccaagacctacttattaatttctcagctattttgatctttataggatattctaataagtgtttttatgttttaagtattaatcattgtagtgggctgaatagtggccctctaaaaggtctgtcaatgtcctaatccctggaacctgtgaatgttaccttatttggacaaagtgcctttgcagagcctccagaggagggtacagacctactgacactttgattttacagtctggcctctctaactatgagagaataaattactgttgttttatgccactgactttgttgtaatttattacagcagccatagaaaactaatacaattattaatgtgttttaaatccatggtgttttgagaatacaattcaaatacaggttcaatattaaccatctggcttccttgccagctagcttgaaattcatttgtttatcatggaggagtaggtcatttgtgttaattactagctcaactagtagttttgctaaaagtaattttcattttttaaataaacaaggacacattttttgaccaaggagaaaaatcaagcatagagaataatcataacctttgaatactattcaacaggagggatttttttgtctatgggaatacagaagaaaattggtaaacaagcagtctagaccagacataagctgtatgtcagtgattataaggcaagtaaataattgtgccttagaattgatcaattcagttagaagaagggggaggagtcagccaagcctctaactagatggtctgaccatttacttgactaaagagtcatttgatgagatgagtgagatgaatatttatgctcagcaagtgtctgacatagtatgtactcaaaatttaatttaatattattattattactatcattaattaactcacagccttgagttgacatggatactttttaaaaataatgaagaaggtgttaaagactgcatgctgccacttgaaaatgtccttgccaacaggcccttataattgaggtagagagacaacatatgtgggctgcgattacaaagtaataaatatttgctttaaaaaatcagtagttacatatgaaaattcatgctgtccctttccaaattggctactttaggaaacttacattattttcacaaaaccgatgttacttaaaagtgtttttgagatcatctccagaccctccagtatgttgcttagaacctactttgaaatgacagtcctttttcctttgagggtggagcagctatgtcatttggaactaagttcacattttctaggttaacgtctttaaagtagaatgcttatatgtatgcatgtacttgagtttgtcttcttttggggagaaactatatttattttgttatcaaggaatccacttctatgactcgtgaagcccaggctgagttaacagtgatgagttctagagggacctacttcccagtctgaattttctggtttcaattcatcttctctcttaacctgaactgaaaacccagacttatgaagcctcaatccttgccctcttattcctggaaaattgcaaagccaaatatgtaggaggctttttcagaagagaaaatgactttgtgttttcagaaaacaaacccttcactttgctttatgaggcagatagcagccccaaaccatgtacaggttgggtcctgcacagatcttaattggtttcttttctaaagatgaatttatgtcattacttaatgggcacaccccatatatcatcagcattaaaatgggacattttgaatattctagttccatccccttcacccagcatgggatccttgcctccaacagttctgaggaaaagagcttattactttataagacacactagtacattgtttgaatcagttatactgttagaaaaacctattatagttaaatgatacaagatatgggtatgtgcccaatatagcacatagaacatagtaaaatacatgatagatatttataacctgctcatgtagccctaaaatgtgcttccttcaaactctatcttctggagcaacaaaggttaattcttaattcttcttctatatgacaaagcttcaatcgtttaaaaatatatttacctaatgtgtccttgaaacatctcccctccaggccaagcaccctcaagttcttctgtcattctcatatgtcaggatttctagacaggatacacttgaaacaggtaataatactaaataatatatgataagggagaaataagtggtattgagagctagttaaatagtccatagacaggatatccataggctagagtggtcttgagaaggtttagtggtgggagtggaatttatgcaaggccttaaaattcaagtagaatttggaaggactgagaacagactagaatagatctcctaagtgaggtaaagggccttttaatttagtccagtacagtgataggtgtttttattatttgttctatcttcctggagatgaaggttttaaaacaaaccctaaacaaaaaggaggagataaaattaaagatggtttcactctttaaagctgggcccttcggcaagtagctgtactagttgagggtggctgggagaagaaccagtggtttctgacaaagtagagcctttagcattgggaaagaagatattaattacaatggatgctaatagtttctatttgaaaattattgtagtggtttttctgaaaacacaataagtaagcattaggtgggtaactaaatcactgctgataaagaatcttctttactactagtgtgggaagacagttgcataaggaaatgtgcttggtgcctccatttctgttatacctttctcaggagctgataattggaaatgttttaagagaggttataattagggcttgggggcttcatgtatagttttttttttaattctcttggatttttatgtttattttcaaggcaaataagttgtggctcacttgtaggaggaaagactcaacttttgtcagtgttcaaaaaaagttgccattatacattgtccacttaaattattgaattatatcacaaataggtttgtatattagagtagcactatgtatactgagagcagtagagcttgcttcacttgttattatttgactagccatataaacccatgtacttagcatctacactctccctttctttctttctcactgtctcctttgcaccctcccgtaaatataccttgagttcttgaactatatctattgtataccaacatgtttgaatcttttggttggggtttctaacccccaccccaaacaaagacatagaatatgagttatttgaacaatgagaatttgtttttttggaaacagcacctttatttttgtttatttttgatccatgtgtatcctcagagtagactattttctaaaaagggtaaacaacacacagtataacagtggcagtgcaaggtgtgtggggtattttttattccacaggggagactatgatggagtcatctttatttaagatggcttctaatactctatgtcactcctgccactcagcatgtattactgagtcatgcacctagtagatactcaaataaggtctaattcagggcttctgtttcctggagcctaggagcacctaatagttaagaagtgatatatgtacataatcattaattctctttaccaatagcttccctggttgggtttgtttagtaacattatttatttagctaaacccattgctctatatgtgaacactaatcaatcagggcaagccctagcccagttaaaaaatccatgtctagttagttttgttgaaaaaaatggtgttggatgtattaatagatataattaagggagtatcctagttctctcatgtttgtattgcttctcaccttgtacataggaggctctctgaaaatgcttgttgaattattgagctggattgcaggacttaagtatcacaattattagcattacctcttccaaaatgttttgcagttatggtacagttaaagccaaaagtatagagacgatttgttattatggtttagatgagtaacagaggctccttagctcacttaaagagaaatcaggcaagtcacctgtggactagaaatctcctcagtctctcctctctagcccccctgtattaggtgttcatgaggctcgccaggggagttgaggaggtttactgcaaacaactgttcttttttcttttggggtaaatggtggtgcaaggagtaaggggacctggaagatggagaaagtgttgaaaacccaaagcacaacccattagttttgagagtataatgattaatcatcatttaaaatcccaggttggctgggaaacatatttcagaatatcatccatgaaaatttccccaaccttgctagagaggccaacagtgaaattcaggaaatacagagaactcctgcaagattctacacaagaagatcatccccaagacacacaatcatcagattttccaaggtcaaaatgaaagaaagaatgttaaaggcagctagagagaatgggcaggtcacctacaaaggggttatcagtctaacagcagacctctcagctgaagccctacaagccagaagagactgggagcctatatttaatattcttaaagaaaaaaatcttcaaccaagaatttcatatccagctaaactaagcttcctaagtgaaggagaaataagatccttttcagataagcaaatgttgaggggattcattaacaccagacctgccttacaagagatcttgaaagaagcactaaatatcgaaaggaaaggctgctactggctaatacaaaaacacacttaaacacacagaccagtgtcattgtaaagcaaccacataaacaagccaacatcataaccagctaacagcacaatgacaggatcaaatccacacatatcaatactaaccttgaatgcaaatgggctaaatgcccaacttaaaaggcagagagtggcaagctggattaaaaaagcaagacccggctgggcacggtggctcacgcctgtaatcccagcactttgggaggctgaggcaggcggatcacgaggtcaggagatcaacaccatcctccctaacatggtgaaaccctgtctctactaaaaatacaaaaaattagctgtgcgtgttggcaggcgcctgtagtcccagctactcgggaggctgaggcaggaggatgatgtgaacctgggaggtggaggttgcagtaagccgagatcacaccactgcactccagcctggggaacagagcaagactccatctcaaacaaacaaaaaaaaaaagcaagacccaatagtatgctatcttcaagagacccatctcacacataatgacacttacaggctcaaaataaagggatgcatgaaaatctaccaagcaaatggaaaacagagcaaaaacaagggttgcaatcctaatttcagacaaaacagatttcaaacgaagaaagatcaaaaaagcctaagagcattacataatggtaaaggtttcaattcaacgagaaaatctaaccatcctaagtatatatgcacccaacacaggagcacccatattcataaagcaagttcttagaaacataaaaagagacttagattcccacacaataatagtgggagacttcaacactccactgacagtattagacagatcatcaaggcagaaaattaacaaaggtattcaggacctaaactcaacattggaccaaatggatctgatagaccatgacagaactctccacccgcaaacaacagaatgtacattattctcattgccacgtggcacatactctaaaactgaccacataattagacataaaacaatcgtcagcaactgcaaaagatccacattcataccaaacacactctcaggaccacagcacaataaaaatagaaataaaaactatgaaaattgctcaaaaccatacaattacatggaaattaaacagcatgctcctgaatgacttttgggtaaataatgaaattaagacagaagtcaagaagttctttgaaaagaatgagaatcaagatacaacatgccagaatctctgggacacagctagggcaatgttaagagggaaactaatagcactaaatgcccacgtcaaaaagttagaaagatctcaaattaacaacctaacatcgcaactgaaagaattagagaagtaagaacaaatcaactccaaagctcgcagaagacaagaaataaaaaaaatcagaactgaactgaaggaaattgagacatgaaaaatcaaaagatcagtgaatccagaagtttgtttcttggaaaaattaataagatagataggcctctagctagactaataaagaagaaaataagatacaaataaacacaattagaaatgatgaaggggatgttactactgaccccacagaaataaaaacaaccatcagaaactactatgaacacctctgtgcacacaaactagaaaacctagaagagatggataaatttctggacacatactctctcccaagactgagccagaaagaacttgattccctgaatagaccaataacaagctccaaaattgaatcagtaacaaatagcctaccaaccaaaaaaatcccagaacctgatagattcacaatagaattcaaccagattacaaagaagagctggtactattctcacagaaactattccaaaaagttgaggaggaagatctcctccccaactcatcctgtgaggccagcatcatcttgatttcaaaacctggcggagacacaacagcaaaagaaaacttcaggtcaatatccttgatgaacattgatacaaaaattctcaacaacagacttgcaaaccgaatccagcagcacgtcaaaagctaattcaccatgatcaaccaggcttcatcaccatgatgcaaggctggttcaacataagcaaatcaaaaaaatgtgattcatcacataaacagaactaaaaacaaaacccacatgattatctcaatagatgcacaaaaagcctttgataaaattcaacatccgtttatgttaaaaactctcaataaactaggtattgaaggaacatacctcaaaataataagagccatctatgacagtcccacagccaacaacatgcggaatggggaaaagctggaagcataccccttgaaaaccagcacaagacaaggatggcttctctcaccacttctattcagcatagtaaggggaagtcctagacagagccatcaggcaagagaaagaaataaaaggcatccacatagaaagagaggaagtcaaactatctctgtttgcagacgacatgattctacatcaagaaaaccccatagtcttggcccaaaacctccttcagctgataaacaacttcaacaaagtttcaggatacaaaatcaatgtacaagaatcactagcattcctataaaccaacaacagccagaccgagagccaaatcagaaagacaaattcattcacaattgccacaaaagaataaaatacctaggaatacagctatccagggaggtgaaatatctctacaatgagaattacaaaacactgcaaaaaaaatcagagaggacacaaataaagggaaaaacatcccatgctcagctgggaagaatcaatgtcattaaaattatcatactgcccaaagcaacttacagattcaattctattcctatcaaactaccaatgacattcttcacagaattagaaaaaactattttaaaattcatatggaaccaaaatagagcctgaatatccaagacaatactaagcaagaagaacaaacctggaggtatcacattatctgacttcaaactatactacagggctacagtaaccaaaacagcatgatactggtacaaaacaggcacatagaacagtggaacagaatagaaagcccagaagtgaggcctttcacctacaaccatctgatcttggacaaacctgacaaaaacaagcaattgggaaaagacttcctattcaataaatagtgacgagataactggctagccatatacagaagattgaaactggacaccttccttacaccatatacaaaactaacaagatggattaaagacttaaatgtaaaacccaaaactataaaaaccctggaagacaacctaggcaataccatcctagacataggaatggccaaagatttcataacaaagacaccaaaggcaattccaacaaatgcaaaaattgacaagtgggatctaattaaacttaagggcttctgcaccacaaaagaaactatcaacagagtaaagaaacaacctgcagctgagcatcccagcggagcatgggatgtttttccctttatttgtgtcctctctgatttttttgcaacctacagaatgggagaacatatttgcaaaccatgcatctgacaaaggtctcataatcagcatctatagggaacttacacaaatttacaagagaaaaacaaccccacttaaaagtgggcaaaggatatgaacagacagttctcaaaagaagacatacatgcagccaacaagcatatgaaaaatagctcaaaatcactgatcattagagatatgcaaatcaaaaccacaatgagatgccgtctcaccccagacagaatggctattattaaaaagtcaataaatactggatgttggcgaggttgtggagaaaaggaaacacttatacactattggtgagtgtgtaaattagttcaactattgtggaaagcagtatggtgattcctcaaagagctgaaagcagaactgccattcaatccagtgatcccatgactgggtatatacccagaggaatataaatcatcctaccataaagacacaggcatctgaatgttcattgcagcactattcacaatagtgaagatatggaataagtctaaatgtccatcaatgacagattggataacgaaaatgtgatacacatacaccatagaataccatgcagaaataaaaagaacaagatcatgtcttttgtgggaacatggatggagctggaggctattattcttagcaaactaacgcaggaacagaaaaccaaataccgcgtgttctcacttgtaagtgggagctaaatgataagaacttatgaacacaaagaaggaaacaacagacactggggtctacttgagggtgaagggtgggaggacagagaggagcagaaaagataactattgggtactgggcttaatacctgtgtgatgaaataatctgtaaaacaaactcccatgttacaacctcctatgtaacaaaccatcacatgtacccccaaacctaaaataaaagtttttaaaaatcccaatttgggcaattaaaaatgctacagttgtagttagaaggctcttctagtgataccacctaaggaagagtatgggtctgggatatttctctcatatctctaggaaaggaccaaatgtcatttttaagtaggcattgaatacctacaatatgaaaagttctgtgtggaatgcagtgatgaactggattcccaccctttttccacctactggtttatagtgttttaggtaaagataaataaaggaacaatggaaggcagaatgtattaactgttctaagtggtacaaggtgcgagaagaggaaagagtgatttgtaatgattcagtaagtgagattatcacaaggtaggggatgcatgtttacttttccagggtaattatttttaatggcaactgaacttagttcacactgacaattgacagcactcctttgagaaaaggataataatttatatcctaagtaaggactgagcagattactagaattttaccataaaactataaagaggaattaaaattgtaggcttatactcacatatttgcaggttttcattatatatttttctcattctatgttttctttataccataatgatgtacaaggatgataataaatgatgtataagaatcatgttttccttataactggggatggtagggtgcagtttgatggggagagatcttcagtttcagcaagactgagtggttaaagcagagccttaaaaaccaacaatttaaataaaaagaagggaccttggagcacagcaaaagctgtgtacactgcctgaagtttaaaaagacatccctgtattgttaccatatgttgttaatagcactcattcaaggaaaagcccattggcaaactggttgatgaggctggccagttcaaatatagaggaaacttcacagggagcataataaaatggtaatcaaaagatattattgtatgctttaaaaacctgatttaaaaaatcaaatttaatgtaaatttaccccactttgattcagttgcttcaaactaattttctatttaacttaatatctagtaatatcagaatttttctttggtaaaaagctcaatttaaaatgtttttaaattaaaagttgggggttctaaaccctttgctttccccaagttcagggtagttagaattatcacccagattgtttggatcaggttcgcccatatacaggcttagcacattgtacatacacacatacctacattaagtcatgaggattttctggattcaatattttattcttttaataaaaatttgtaattgctcagattccaatttattctggactgaaactagtttttccttcaggttcagggcttgtaagtccagggcacttgctgtttgaggcctatttttattatttcctccatccacaatgggcactatgttcttctttttcaccacttacttataaaagacacacatgcatgcacacacacatacatagaaacatacgtatttatagacaggaaactgctatgccgtttaaataagaaatcactgcgcctttctcataagctcagttttttttccttttgatgcctgatttattctttcttataagaatctgagctgttagttacatataacaattgtcccccttgatgactactttctgatagcctgaccctttcattttcagacctgtattgctgttcttgttttcttttactaacagtggtctcttctcttcagctcttctctggtgtttgcagttctgcctttgtagatgacaaagaatcttggaaaaaatgcagaaatggtaggaataaagaggagcaggacaagatagtgaagagattcttattctgctattcattactcttctgttggaggggctgaattgtaaaatgtgacaaaagcagggaacaggaaaattataatgatacggtcttctgttaggaggtaatatttacttattgggtaaccaaaatgagtatctggttagtgtaaggaagatgagaaagacagtccttatgtttgctggtatataaaactattgggaggggcagaacaagatggcagaatacaaacctgcaacgttagtactccccacaggaacaccaaattttaacaactatctgcacacagaaagcactgtcacaaaaaaacaaaaatcaggtgagcaatcacagtaccggactttatattgttgaaagaggtattgaggagggtcagagagacagtcttgaatcaccagatccacccctcccctatcccccagcagcagccatgcagcacagagtgtctgtgcactttcaggagggagagtgaagtgactggggacattatattgatttcagtgctacactgtcacagtggagaaaaaagccatgctgggctcagtcagcacctgtgcacagagggggcatttgcagcagccctagccagagagggatcaatcatccatcccatcagtcagaactccactctctcagcaagcctcaccaccacaggcaaaagagctctggggtcctaggtaaacttgaaaggcagtctaggacacagtgactgcaatttccaggtggcccttagtgctgggctaggctcagagccagaggactagggtggcacgtgacctagggagacaccagccagggcagctaaaggagtgcttgccccatgcctccccccaaccccaggcaatgcagttcacagcaacgaaattgtctccttccttctgcttaaggggaggaaaacaaagatgaaagaggacttcgtcttgcatcttggataccagctaagccacaatagggtagggtaccaggcagagtcgtgaggcccttattccagggcctaggtcctggacaacatttctagctataccttggtccaaaagagaaactgctgccttgagggaaggactcactcctggcaggattcatcacctgctaactaaagagctcttgggacctgaataaccagcaccaataccctagtagtatgctgtgggctttgggttctaagacgttctgaccacagatgtgatccagcacattcccagctgtgttgtctacagtaaacaactccttctgtatgagaaaagcagacagaaaagtaaaggggacttcgtcttgcaccttaggtaccaacttgaccaaagtggggtagagcaacaagcaggctcttgggttccctgagtctaggcctaggctcctggatggcatttctggacctgccctgggtcagaccatagccctgaagggtgagtcacaggcctggcagtattcagcacaagctaactgaagaggccttaggctttaagggaacattggcagtggccaggcagaagcccgccctcctccttcccccaccatgggcaagtggtggtgatggtgacagggagaggcctctctgcctgtggaaagaagaagaaagagtgggaaagactgcatgtcatggttttagcaccagcttagccacttatctatttagtaggatagaacatcaggctaatttctgatgtttttttaactccaatccctggcacccagacaacatctcctgaccagcttgtggcatggaggaacttgtcaccctgaagggaaggacaccaaacagtctgactttgccacctgctggttgtagagcccaaggacttgagtaaatgtgggtggtagccaggtagtggtttcagcagaccttgggtaagatccagtgttgtgctggcttcaggtatgaacaagtgcagtctcagggatggtggccacaggagtgcttccatcaccatacccccacctccagacagctcagctcagagacagagactgtttgtgagaaagtagggacaaaaaaaaacaagagttcctttctggtcatccagaaaattcttccagattttatttaagaccaccaaggtggtacctcttatgagtctgcaaaaaccacagaaatattgggcttggggtccagtctcttaaaatacttgtaaagcctcctcaagaaaggcagaagcaaataagcccagactgtgaagactacaataaatacctaactcatcaatgttcagacaccggtgaacatctacaagcagcaagatcatccaggaaaacatgagctcatcaaacgaactaaataaggcaccaggacctatcctaaagaaacagcgatatgtgacctttcagacagaattcagaatagctgttttgaggaaacttaaagaaattcaaggtaacacagggaaggaattcagaattctgtcagataaacttaacaaagagattaaaataattaaaaagaatcaagcagaaattctagagttgaaaatgaaattgacgtactgaagaatgaatgcatcagagtctcttagcagaactgatcgagcacaagaaagaattagtgagcttgaagacagactatttgacaatacacagtagacgaaagaaaaaagaatgaaaaacaatgaagcacacctacaatatctagaaaacagcctcaacagggcaaatctaagagctattgcatttagatgggggatagagaaacagatagaggtagaaattttattcagggggataatatcaaagaacttcccaaacctacggaaatatatcagcattcaggtacaaggttatagaacactaagcagctttaacccaaagaagactacctcaaggcatctaataatcaaacctcctaaaggtcaaggataaagaaaggatcctaaaagcagcaagagaaaagaaacaacataacatactatggaactccaatacctgtggcagcagtcttttcagtggaaaccttacaggccaggagagagtggcatgacatatttaaagggctaaaggaaacatattttaccctagaagagtatttctggtgaaaatatccttcaagcatgaagcagaaataaagaccttcccagagaaacaaaagctgggcatttcaacaccagacctgtcctacaacaaatgctacagggaattcttcaatctgaaataaaaggatgtcaatgagcaaaaagaagttgtctgaaggtacaaaactcactggtaataataagtacacagaaaaacacagaatattataatgatataattatggtattttaactacccttatcataagtagaaagatgaaatgatgaaccaatcaaaaataatatctacactacaacaacttttcaagacatagacaatacaacaagacacaaagagaaacaacaaaaagttaaaaagtggaaaggatgaagtttaagcgtagaacttttattagttttcttttcttttctttctttttttttttttttttgagatggagtttcgctcttgttgcccaggctggagtgcaatggtgcaatcttggctcaccgcaacctccgcctcctgggttcaagcaattctcctgcctcagcctcccgagtagctgggattacaggcatgcaccaccatgcctggctaattttgtatttttagtagagatggggtttctccatgtcggtcagactcccgacctcaggtgatctgcctgcctcggcctcccaaagtgctggaattagtcatgagccaccgcacccagccttattagttttctttttgtgtgtttgtttgtttacgtaatcagtgttaagttgttatcagttgaaaacaatgagttataaaatcgtatttgcaagcctctcagtaacctcaaatcaaaaaacatgcaatggatcacacaaaataaaaggcaaacaattaaatcataccaccagagaaaatcacctttactaaaaggaaaggaagggaagtaggaagagaagaccacaaaacaactggaaatcaagaaacaaatgacagaaataaatcactacttatgaataataccagtgaatgtaaatggactaaactgtccaatcaaaagatataaaatagctgaatggatgaaaatacaagaccccatgatccattgcctacaagaaacacatttcaactataaagatatacatggactgaaaataaagggatgaaaaaagatatttcatgccaatggaaacaaaaaaggagcaggaatagctataaacactctaagaagacacaaagaacatcattatataatgataaagggttcaatccagtgacaggatagaacgattgtaaatatatatgcaacaaacactggaacacacatatataaagcaaatattattagagctaaagagagagatagacctcaatacagtaatagctggagacttcaacactctactttcagcattaggcagatgttccagacaatcaacaaagaaacatggaacttaatcttctctatagaacaaatggacctaatagatatttacagaacatttcatccaaaggctgcagaatacatattcttctcagcacatggatcattctcagggatagaccatatgttaggtcacaaaacaactcttaaagcattcaaaaaattaaaataatgtcaagcatcttctctcatacaatggaataaaacaaaaaattaagaacaaaacgaattttggaaactatacaaacacatggaaactaaacaatgttcttcctaatgaccagtgagtcagtgaaaaaattaagaaggaaattggaaattttcttgaagccaatgataatggaaacacagcatacaaaaacatgtgggacacaatgaaaacagtactcagagggaagcttatagctataagtgactacctcaaaaaagaaaaagaacttcaaataaacaacctaccaatgcatcttaaagaattaaaaaagcaagagcaaaccaaacccagaattagaaggaaagaaataatgatcggagcaaagataaatgaaaatgaagaaaacaatacaaaaaatcaatgaaaccaaaccttggttttttttattttgttttcattttgttttgttttgagaagataaaattgacaaactgtaacccagactaactaataaaaaaagagagaaagtccaaataaataaaatcagagatgaaaatggagacatataactgataccacgggaatgtaaaggatcaccagtggctactatcagcaactatatgctaataaactgaaaaatgtagaagaaataaataaattttgagacacatacaacctaccatgtttgaaccaggaaaaaattcaaaacctgaacagaccaattacaagtaatgagatcaaaaccataataaaagtctcttagtaaagaaaagcccaggaactgatggcttcactggggaattattccaagtatttaaagaggaactaataccaatcctactcaaactatctggaaaaaaagagcaggagggaaactcattctgtgagggcggtattactctaataaccaaaacaaacaaagacacaacagaaaaagaaaactacaggccaatatctctgatgaatattgctgtaaaagtcctcattaaaatactagcaaactgaattcaacaatacattagtatgatcattcattgtgaccaagtgggatttatcccagggatacaaggatggtacagcatacacaaatcaatatgatacatcatatgaatggagtgtagcacaaaaaccgtgtgatcatttcagttgatactgaaaaagcatttgctaaaatttgaaattccttcatgataaaaattctcaaaaaactagggatagaaggaacatatcttgataaaataaaagccatatatgacagaccacagctagtattataatgaatgggataaaactgaaagtctttccttcacccaaaggattataaatcatgctgctataaagacacatgcacacgtatgtttattgcggcactattcacaatagcaaagacttggaaccaacccaaatgtccaacaacgatagactggattaagaaaatttggcacatatacaccatggaatactatgcagccataaaaaatgaagagttcatgtcctttgtagggacatggatgaaactggaaaccatcattctcagcaaactatcgcaaggacaaaaaaccaaacaccgcatgttctcactcataggtgggaattgaacaatgagaacacatggacacaggaagggggacatcacactccggggactgttgtggggttgggggaggggggcgggatagcattaggagatatacgtaatgctaaatgacgagttaatgggtacagcacaccaacatggcacatgtatacatatgtaacaaacctgcacattgtgcacatgtaccctaaaacttaaagtataataataattttaaaaaatgttcattatgggaaatttggaaaaatatataaaagttgaaggcataaaaaaaaagaaagtctttccttcaagattggaaaaaacaaggatgctgactgtctccactattatttaacatactagtggaagtcctagctagagaaaggtattaaaggcattcaaattggaaaggaagaagtcaaagtatccttgtttgcagatgatataatcttacatttgaaaaaaaacaacgatgccaccaaaaaactattagaactgataaacaaattcagtaaagttggatgataccaaatcaacatacaaaaatcagtagcatttctatataccaagagtgaataatctgaaaaaggaataaaaaagtaatctctttcataatagccaccaataaaatcaaatacctaggaattaatttaaccaaagaagtgaaagatctctacaatgaaaagtacaaaatgctgatgaaagaaattgaagaggacaccaaaaaatggaaagatattccatgttcatggattggaagaatcaatattgttaaaatgtttgtagtacccaaagcaatctgtagattcaatgcaatccttatcaaaataccagtgacatttttcacataatttttttttaaaacctaaagtttatttggaaccacaaaagtctcagaattgccaaggctatctggagcataaaggacaaaactgaaggaatcacattacctgagttcttcaagttatactatagagctatggtaaccaaaacagcaaggtactggcatgaaaacagacacattgatcaatggaacagaatagagaacccagaaataaatccatacacctatgatgagctcgtgttcgacaaagatgccaagaacatacaatggagaaaggactgtcttttcaatgaatggtgctgggaaaactggatatccatatgcagaagaatgaaacttgatccccatctcttgccatatactaaaatgaaatcaaaatggattaaagacttaaatcttagacctcaaactatgaaactactacaagaaaacattggagaaactctccaggacattggtctgggcaaaaatttcttgagtaatactccacaagcataggcaaccaaagcaaaagtggacaaatgggatcatatcaagttaaaaagattctgtacagcaaaggaaacaatcaacaaagtgaagagacaactcacggattaggaaaaaatatttgcaaactacccatctgacaagggatcaataaccagaataagaagctcaaacaactccataggaaaaaaaatctaataatcagatttaaaaactgacagaagatttgaacagacatttccaaaaagaagaaatataaatggcaaacaggaatatgaaaaggtgctcaacattattgatcatcagagatgatcaaaggtacaatgagaagatatcatctcaccccagttaaaatggcttttatccaaaagacaggcaataacaaatgctggtaagaatgtggagaaaagggaactctcctacactgttgtgggaatgtaaattagtgcaagcactgtggagaacagtttggaggttcctcaaaaaaatgcaaatagggctatgatatgatccagcaattccactgctgggtatataccctaaagaaaggaaatcagtatatcaaagtgatatctgcactcccacgtttgttgcagcactgttcacaatagccaagatttggaagcaacctaagtgtctatcaacagatgaatggagaaagaaaatatggtacatatacaccatgaagtactattcaaccataaagaagaataagatcctgccatttgcaacaacgtagatggaattggaggtcattttgttaagtgaaatcaaccaagcacagaaatacaaacatcacatgttctgtcacttgtttgtgggatctaataatcaaaacgattaaactcatggacataattgcacatttaaaaataactaagagtataattggattgtttgtaacacaaaggataaatgcttgagtggatggataccccatttaccattatgtgattattattcattgcatgcatgtattaaaatatctcatgtaccccataaacatatgtacctactatgtacccacaaaaattttaaaaatttaaaaacttggaatgtgtagaagaatggaggaaaattaatttgtcctgcttagacctattatgtatcgccttttctagataactgtgcaaggtgtattcccagcatgtgcaggtgttgtcggtcatgagtgctttagttttagatgcaaagcagtaaatgtggcccctaataaggtttgttgactgctgattccgtagcacaaatgagcaaagaagagattagataagggaagatttcagaggctgtagtgaaaatgaaattttctttgcttttttaaggctaggatgacaaaacctcaaagtaacactgctttcaagcagtgacttgttgccctgagtgatttcaacttaatttgttgtttcacggttgcctggtaggcaagaagaccactaaaaccagaagctatcataggctattttatcaataagatacagcatattcctattgcttaaagtctgctatttttgagaaggcatcctatgccaagaagcaagggactgacctgagattgcacagcaagttggtaacattcattttatgacaacaccaacctagacttccacttttttcttattgaaaccttggataggttgatcaattttatggttaattatatgataataagcatgaatattttaacttttactggatacctgtagcacagcaatagagttggagtctttgaagtgttgtagtacttggaactttatgtagtgtgtattcctacaactgctgtatcatgtattcaaacataatactccaaataccttccactgcagtttaagccctgttttcttttccaattccccttggagattattcgctcatcatactccctcctcttttccttttgtctcttcctaaacaaatgaacagcctttccaattaaataatgatttttctctctacaaacccacccatccaccttctttctctactccatgctgaaagatgccagtaatttagacccatcttcatcccttgtttccattatctttgtagtttgctttctctcttcttaactccttattgatgtggtatggggcatgctattttttccactacataattaggaaactatatgcaccaattttatgggatatctgttttcatctggctcctgtgctctccacccatgaaggcaacaagacaaaaatatcttgggaatcacttttctttctcacagggatggggtgggttggagaggggtcttttctgatttgtttctgctctatatccagtggtgtactagaattggtttgcattggcttttgacaactaattgtacacatctcttcccaacttcaagttcatgtttagtgattggtagcttgaaattgaccatggtggaattgtttaatccatggaaatcagcaaagctaacaaataagggctccccacccatcaggcttgttgttaaacatttaccagcatattactgcctgtttcaaaattagtcttgataagaaagtctatcttaagtacctgtccagttggaatcaactaggcaagaacctgggcaatgaaactaaggcatcatggtagatcagaggaatactatatctgttttggttctatgcttctgagttctcagtccaagaatacttatttaccctacctaggggatgaaatgacccaacaactggaatggagttgggcccacctgctggagcttgactttagctgtgggaattagaaggtggtagtgaggtggaaatcaggactgactgtacccttcagcagccagattctcttgttacatgtttcaggcctacctcccttgttgatttatcaagcaacttgctggtagaggttggtgcatctgacccttcacaagaactagatatgaaatatgcaaactagtatttacttcagctttagtgctgacaggcttgggggtcatttaggttgtctgagcctcagctgttcttgtcagtgaaagggaaaagctagagtggacattaatttgcatttatgtaaaagtgattacttataattagtgggtagataagtagaagctatagtctgtagtggcaaagatgtgacttagctttcttggcaaataagtccctgtaggtcaaggtctatgtctttgactaattttatactgtaccatatttggagagggatttattaagtatatttcaagaggaattaatcctcccaacaataaatttaatattagaatcataacacttcagaattgaaaggaacccttagaaattcatctagtccaatatcctttagtttaaaacatgcatggctataaaagtcaactcaaaatggaataaagacttaaatgtaagcctgaaactataaaattacttgaaaaaaacacagggggaaactacaatacattggtctgggcagtaattttttggatttgaccccaaaagtgcagacaacaaaagaaaaaaggacaaaggggattgtatcaaactaaaaactttcttcacagcaaaggaaacaattaacagtgtgaagaaacaacctacagattgggagaaaatatgtgtaagccatacattcgataaggggttattatccaaaatatataaggaactcagacaacttagtagccaggaaacaaatgacccaattaaaaaatggacaagaaacaatgcatctgacaaaggtctaatgtccagaatctataaggaatttcaacaaatttacaagaagaaaacaaacaaccccattaaaaagtgggcaaagtatgtgaacagacacttttcaaaagaagacatacatgtggccagcaatcatatgaaaaaaagctcaatatcactgatagagaaatgtaaatcaaaaccacaatgagatgccatttcatgctagtcagaatggctattactaaaaagccaaaaaataacagatgctggcaaaattttagagaaaaaggaacacttatacactgttgttaggagtgtaaattaattcaatcattgtaaaaaacagtgtggcaattcctcaaagagctaaaaacagaactaccattccagccagcaatcccattactgggtatatgaccaaaggaatataaattattctattataaatacacaagtacacctatgttcattgcagcatgttcacaatagcaaagacatgggatccacctaaatgcctatcagtggcagataggataaaggaaatgtggtacatatacactatatgcagccataaaaaagaacaagatcatggccgggtggtggctcacacctgtaatcccagcactttgggaggccaaggctggtggatcacgaggtcaggtgttcaaaaccagcctggccaacatggcaaaacaccatctctactaaaaatacaaaaattagccagacatgatggtgggcgcctgtaatcccagctactcgggaagctgaagcaggagaatcacttgaacctgggaggtgaaggttgcaatgagccgagatcatgcctttgcacttcagcctgggcgacaagagcaagactctgtcaaaaaaaagaacaagatcatgtactttgcaggaacatggttgctggaggccattatccttaccaaactaacacaggaacagaaaaccaaatactacttgttcttactgataagtggcagctaaatgatgcaaacacatgggcacaaagaggaacaacagacactgaggacttccagatggtggggggtgggaggagggagaggatcaggagaaataactaatgggtactaggttcaatacctgggtgatgaaataaactgtacaacgcaaccccatgacacgagtttacctatttaataaacctgcacatgtatctctgaacttaaagtaaaagtttttttaaatgggcaagggacctgaataggcaattctcaaaaggacttgtaaaaatggccaacagaaaagatatgaaaaaatgctcaatattgctaattgttagggaaagccaaattaaaaccacagtgaaatataacctcatattcatcaaaatagctattatccaaaagatgaaagttaacaagtattggtgaggatgtgaagaaaagagaacccttgtatactgttgataggaatgtaaattagtacagccattatggaaaactgaatagggattccttaaaaaactaggccgggctcgggggcttatacctgtaatcccagcactttgggaggccgaggtgggcggatcacgacgtcaggagatagagaccatcctggctaacacggtgaaactctgtctgtactaaaaataaaaaaaattagctgggcgtggtggcgggtgcctgtagccccagctgctggggaggctgaggcaggagaatggcgtgaatccgggaggcggagctttctatgagccaagatcgcaccactgcactccagcctgggcgacagagtgagactctgtctcaaaaaaaaaaaaaactaaaagcagaattaccatatgatccatcaatcccacttctgggtatttacccaaaatatttgaagacagtttgtcaaagaaatgtctgcactcccatgttcattgccaagttatagaatcagcctaagtgtccatcaaggaataaatggctaaagaaaatgtggtacatatacacaatggaatgctattcagcctttaaaaagaaggaactgctgtcatttacagtaacatagatgaacctggagttatgctaagtgaaagaagccaggcacagaaagacaaataccgcatgttttcacttgtggaatctaaaacaatcaaactcatggaatcagatagtagatggtggttacacaggctggggcttgtggggaatggggagatgatagtcaaaagacacaaagtctcaggtaagagaaatacaggtttttttgagatctattgcacatcatggtgattatagttaataataatatactgtgcatttcaaaattgctaagacacatacatcttagattttattgttccttggagagctgttgcatcttgaacagaacacttttttcatactgaatatagaaacttgccctgagacttgaatggtatgaggaccaactggaggggaagcaattaaactttggtcgagaagactgaatatttctctagatattcaaatacagtctctgaaatacaactctaaatgtatacagttgatataagttggttttcctttaatttttaattttgaaataatttaggacttacagaaaatttgcaagaataaattgtaaaacgaactcctgtatacaccttccccagatttcccaaatgttaacgttttttacatttactttatccttctctcccccatctattttctcattcatagtcttacacagtgttcattttgccctatctatctatctatctatctatctatctatctatctatctgtctttctctgtctctttctgcttctctctctttctctccttttttttctgaagcatttgagaacaaatacatagtgtccccaatactatagtgtatatttcctaaaaacaagataattctctttcataacaacggtactacaatcaaaatttggaatttcatcaattgtcacaattatgtttttatagaaaatgaaaagctcaaattgtgtttagcattcagatgtcacaatgttttagtgccctttaactcagaatagttcctcagtctgtcttttaaggcattgacttttttgaagagtatagaccagttatttttagcagctttatcaagatgtaattagcatactatacaattcactcgtataaggcatttaaggcatacagttcattgttctttagtatattttcaggactgtgcaaccatcaccacaatctaattttagaatatttttgtcctcgataaaagaaaatcattactcattagcagttactccccaccatttctgatcctaggtaaccactaatttactttctgtttttatatatttgcctattatggacatattttataaatggatctgtagcaatatgtggccttttgtgtctggcttcttttagttggcataatgttttcaaggttcacctatgttatagtgtgtacttcgttcctttttgcagcggaataatataccattgtatgggtatgctacattatttatttattcataatgtgaggaacatttaggtttttaacacattttggctattgtgaaaaatgctgctatgaacattcatgtacaagtgtttctgcggacatatgttttcaactgagtggaattgctgggtcacatggtaacctaactttataagaaattaccaaactgttttctaaagcagttgcaccattttacattcccaccagtcagagggaccaatttatctacatccatgccaacattattatcttttttataatagccatcatagtgggtatgaagtggtatctcattgtcatttttatttgcatttctctgctgaccagtgatgtgaaacatctttgcatgtgcatattggccatttgtatatcttctttgaagaaatgtctattcagactctttgcccatttttaattgatttacttgacttttttattgttgagttgtaggtattctttgtatattctagatacatgttccttatcagatatatgatttacaaataccttattacattctgtgagttgtttctccatttttggtggtgtcttttgcagcacaaaagattttacttttggaaataattttcttaaataccttattgaaacttcaaagaaaaaggttttaattttgaagttcaatttatctatttatacagttggtgcttgtgcttttgttgtcatatccaagaaaccattgtctaaccaagatcaagaagatttacttccatgttttcttctgagggttttgtagttttagctcttccgtttgggtctttgattcactttgtgttaatttttaagtatggtgtgaggaaggggtgcaactttattcttttgcatgtggatattcagttttcccagcaacatttgttgaaaagactcttctttccctcattgaatgatcttggcactcaaaaaaatcaactgagaccgggtgtgatggctcactcctgtaatcccaacactgggaggccgaggcggaaggatctcttgagccaaagagttccagacctgcctgagctacgtggcaaaacctcgtctctacaaaaaaatgcaaaaattagccgagcgtggtggtgcatgcctgtagtcccagctacttggtagcctgaggtgggaggatagcttgatcctgttaattagcttgattaaaccagaggtggaggctgcagtgagccaggattgagccacggcgctccggcctggttgacagaaatctttgtctcagaaacacacacacacacacacaattttcaaccccttaaaattttattaacttttttgtttttattattcctctgtccttgcttccagttaatcttgctacttaggtaaaagagggaaagggaggagattgaaaactaatgaattaaattaagttttgatgcagtcgatattattcattttctctctgtcccccatcttaggatactgaaaattgttcatctataggagtaatggaaaacctgatagtgctaaagaaatatcccatggcagaaacaaaggactttttcccctttcaggaatcattgacccaaaattcagtctgagacaaaataaaagtcaaaaagaacctatttgagttataggtttttgtgatttttttccctcataaaacctccacagggacaaactcacctgatttttaaaatatagaacaggagtcaaggtgagtataacaaataattgaaatgttctttacttttatgtcatgggtagttagaggatagagaagaaaaagaaaagggtgagagagagaaagaagataatgttggaaaggaatgggagaggtataagaagagagggcaggaaagggtccatctcagaagagacaaacagttgttttctactaaagtatgagagattttttttttctggacagcagcctggacaacatagtgagactctctctgcaaaaaaaattacttatttcttatttttttccttcaaagttttattttaggttgaggggacacatgtacaggttggttacattggtaaattgcatgtggctggggtttcagttgccaattatttcatgttcacccaggcagtgaacatagtactcgataggtagtttctcaatgttcaccctccttccaccctctgccctcaggtaggccccagtgtccattgttcccgtctttatgtccatgtgtttagctcccacttgtaagtgagaatatgtggtatttggttttgcattaggaaattaggaacagaaatgttcctgcattaatttgcttaaggtaatggcctccagctgcatccacgttgctgcaaaggacatgatttcattcttttttatggatgcatagtattccatgatgtacagcacagtttctttatccagtccaccgtcgatggacacctaggttgattccttatctttgctaagtgaatagtgctatcatgaacatactcatgcatgtgtcttaatggtagaatagttaatattcctttgggtatatacccaatagtgggattgctgggtcaaatggtaattctattttaagttctttgaaaaatcatcacattgattttccaatggctgaactaatttgcattcccaacaacagtatataagctttcccttttctccacaaccttgccagcataggttattattattattattattattatactttaagttctagggtacatgtgcacaatgtgcaggtttgatacataggtatacatgggtcatgttggtttgctgcacccatcaactggtcatttacattaggtatttctcctaatgctatccctcctccaaccctcaccccccaacaggccccagtgtgtgatgttccccaccctgtgtccaagtgatctcattgtccatttcccacctatgagtgagaaaatgtggtgtttggttttctgtccttgtgatagtttgctgagaatgatggtttccagcttcatccatgtccctgcaaaggacatgaactcatcctttttcatggctgcatagtattccatggtgtatatgtgccgcattttcttaatccagtctatcattgatggacatttcagttggttccaagtctttgctattgtgaacagtgccgcaataaacatatgtgtgcatgtgtctttatagtagcatgatttataatcctttgggtatatacccagtaatgggattgctgggtcaaatggtatttctagttctagaatcttgagggatcgctacactgtcttccagaatggttgaactaatttacactcccaccaacagtgtaaaagcatttctatttctccacatcctctccagcatctgttctttcctgactttttaatgatcgccattctaactggcgtgggatggtatctcattgtggttttgatttgcatttctctaatgagcagtgatgatgagctttttttcagatgtttattggctgcataaatgtcttcgtttgaaaagtgtcttttcatatccttcgctccctttttgatggggttgtttgatttttttcttgtaaatttgtttaagttctttgtagattctggatatcagccctttgtcagatgggtagattacaaaaattttctcccattctttaggttgcctattcactctgatgatagtttcttttgccgtgcagaagctctttaagtttaattagatctcatttgtctattttggcttttgttgccattgcttttggtgttttagtcatgaagtccttgcccatgcctatgtcctgaatggtattgcctaggttttcttctggggtttttatggtttttggtctaacatttaagtctttaatccatcttgaattaatttttgtacaaggtgtaaggaagggatccagtttcagctttctacatacggctagccagtttttccaacaccatttattaaatagggaatccttttcccatttcttgtttttgtaaggtttgtcaaagatcagatggttgtagatgtgtggtgttatttctgaggcctctgttctgttccgttggtctatatatctgttttggtaccagtaccagcagcattggttgttttttgacttttgaatgatagctattctgactggtctgagagggtatctcattgtggttttgatttgcatttctctaatgattagtgatgttgagcattttttcatatgcttgttggccacatgcatgtcttgttttgaaaagtgtctcttcatgttctttgcctactttttaatggggttgttttttgctcattgatttaagttccttatagatgctagatattagacctttgtcagatgcatagtttgcaaatattttatcccattctgtgagttgtctgtttactttgttaatagtttcttttgctgtgcagaaaatctttagtttaattaggtcccacatgtcaatttttgtttttgttataattccttttgaggtcttcatcatgaaatctttgccaggacctgtgttcagaatggtattttctgggtttttatagttttaggatttacatttaagtctttaatccatcttgagttgatttttgtatatggtgaaaggaagaggtccagttttaatcttctgcacatggctagccagttatcccatcaccattttttgaatagggagtcctttccccattgcttgttcttgttgacactgttgaagatcagatggttgtaggtgtgcggctttatttctaggttctttaacctgattccttggtctatgtgtctgtttttgtaccagtaccatgttttggttactgtaaccttgtagtatagtttgaaatcaggtagtgtgatacctccagctttgttctttttgcttaggatggcattggctatttgggctcttttttggttctgaattttataagttttttttataattttttttataatttttttttaattctgtgaaaaatgtcattggtggtttcataggaatagcattgaatctttaaattactttgggcagtatagccattttaacattattgagtcttcttattcatgagcatggaatgtttttcttatttgtttgtgtcatctttcatttctttcagcagtattttgtcatttttttgtatagatcttcaacctctttggttagctgtattcctaagtattttattaatttttggctactgaagcatggcagactgaaagttaatatttctactgtgtaaaatcacctagaagtaaagagaataagactattatgaggaaaatggaattgtaggaagattagagatgctagaattgtttatcccagagaagagaagactaggggaaggtggcatgattactgcctttatctaccttaaagccctaaaggaaaagagtaaatatacttctattttaaggcagaagctatagggaaacaaagtttttctcaacataggtgagcaatggaatgggatggtaggaaatctattttcaggaggcaaggatggtagtattcactaaagttactttaacatcgaatgcaactttagtttagatgattattaaggtcttcctgaccctttagtatatggactgtatttaaagaactttagtgtatttttttcactattcataaatgatggtttggaaagtgtttgttgccttgccttagtcttccggaagatgggtcatgattgtgcagtttgtgcaatggctagtgtagaatgggcctccttcaataggaaccggcagtttaagacttaggccatggcattaatgctatagtaaccttccattcttgtcgggctctttgaagtagctaaagaccaatggcataaaatagcaaattcaaattcaagaattgaatttctgtttagcttgctatttccaatactaattattcatttcacatagggcttttgtctaggttagaagccttacttaaaaaaaaaatctgaatctctcaagtccttttatttcacaccagtgaacttccatattctaatagtgcaaacgaagacaaaatagggtgagtggatgaataagaatcaatagtataaatggagaaatccgatttcaaattggactttcaagtgtattgaaatgcattgtgtaagaaatctatgtaagatgcttcttaatatgttactactcacagattataacatgatttaagttgttggaaaagtttaatagatcacagcagatggtatactatctcagacccattttcctgccaagtcctcaactgctgaagaaaaggagttacttgtgataggggtattttcctgtcatcccttcatacaaaagtaagaaatttcagggttaaggataactcattcaggaatctatgtttactgatgagattttaaaggaagtcatgccatgtgaaggggatgcacttaagcataaggattattgaaaagcattaaaatattaatctagcttttaaaagcaatgcttttatctctgagtgtaaagagagtgtttgcttattcattatcttttcattctaaatagaataaatcacttaagaattaaaaaagaagcaactcatctttttcaatctataaaggaaatggttgaataaattaactacaaaagccaatattttcatttctttttatatttactgggcttcaattttttatttagagacttaccttagattcttaatattcaaagatgtgttaatttaacctaacacatagataattttgctctaaataaaaacagcataagtgtgcattgtttttgatgacaggaatattcccagtataaatttgtgaggatctgtccacttgggaagactcaacttacacaaaaagaaaaacaatataaagtaactaagatatatgaggttcaaaggtagtacgtactctggagtttaaagaaagaaagaggttgttgtgagctaggttagtggagaaaactttttgagaaatgtaggatttcaacaagatggtaaaggaagaccaatacttaaggaaaagaatggaatttcctatgtagttaataagcagtgttaagttgtggacaggaatggaaatagtgtcatatgggggaaacagtaagtggaccagtttgttagagaacaagaattcatattaaaaagtagttgtaggccaggcacggtggttcctgcctataatcccagcactttgggatgccgaggcgggtggatcacgaggtcaggagatcaagaccatcctggctaacacgatgaaaccccatctctactaaagatacaaaaaattagccgggaatggtggcacgtgcctgtaatcccagctactcaggaggctgaggcaggagaatggcatgaacccgggaggcggagcttgcagtgagccgagatcgcgccactgcactccagcctgggagacagagcgagactccatctcaaaaaaaaaaaaaaaaagtagttgtagaaaatgttaaaatatactagggtcagatcatgaagtgctttaatgcaagtaggcagtaagaaccactggttttttaataggggaatgagaatatgtggaaaggaatatttttcaagagagtgttctgctggcagtgtggaaaatgttttggaggcacggagagcaactagaaagttcttgccttaacccaaatgtgacaatgagggaataacatagggtattgctagcatcgtattaataaaaagatgcaagagagataagacttggtagctgtactagatttaggggaaaaggaatagcttaaggatgactctcagtcacttagacttaaaacccatgatccattcctttgacagaaataagatagtgaccttaattctagctattctccagtgatcttgaaaggatttatttcaattagctttgatacataaaataaaaaattcatcattcacttttctgatgaagctggaaaattaatctaaataatgtaaaatataaatcactactttaattacatacctatgtgtcttctaaaaataaatcctacatctgtctgagttatgaagaatatgtattaagggtaaatcaaacaagtatacattctttacagaaatattgattaaattgactcttcctgattagtgatttaaattgacatgatttattccattcatgcaaagattctgtgccctctggggggtctgtctggaatagcaaagcagctcactgacagcagtgactggaatattgccaagctagtcccagagctcagcctactttgtttagaaattaagcaaatggaaagtttcctgaggttctcttacaatgcaagaatgtatggggtttcatttgtgaaccaacagggagttaaaaagcaggaagtcaattatatattaagtctcacattgttctgtaattgttttcatcaattatatttttagttgtatatttttggccaattcgcttgtgtcaattacatatacttccttatattgttgtcaaattgtttcatgtgcatcagtcatagcattcctatgtaaactggaaattccccagggatagggaccatgattctcttttgtttcccccaggaaatagcaagagacctggcacatgttttgagtgttgaactagaataaggtatttcagaatacttaagtctaggtctgtagtactattgtggatcccctaaaacactttagattccacaatagcactgtgaatgttgacttaaagcagtagcatgactttatattccttatagagttgtttccagggacactgttaatgtatacagtcattcaggatacaaactagaaagtagaaacatacacttatctttaaaatgagaggatctaactgattcatggcctgttcttggcttttccacttgtgtctaccaattaaactctttggactcaagagtttttctacctgcaaaatgggatagtaattcctacctcggcaacttgttgtgatgattaaatacaatatcatgtcaatatcctggcagtaccagttccttggagtgagaacaggtaacctgttgtccattttcttggaatgtgctacagggatgacaatgaatctttctgcaaatctattcagaaattctggttctgaggagtagtatccatgactgatatgataatactaaagttctgtcaagctctaaaattctgtgattataattttcattatcccttttcatgtgtattatatattgccatttagagtaaacaaaatgttttcccaaccccttatctcatttgaccctcacaactgaaagaaatgcatgaaaagctttagcttattcattgagtccttaatatatactacatgagtacatgtgttcaataaaaccactgagtattggtgatactggtaatacatcattgatacatacagatgaaaatttctgctttcatggaattcacatactggtggattgaaatctgagtgaagaaacctggattctagttctgttgtagctactagctcactagttgtgagagaaaatgtgtatatgggtattcatgtgtgcacatgctcttacctagatgctttcacaggatgcttattgtcttgaagagaacactggtttcaactttacccattgtcagagtttacaaaacacatttttaaaatgcgtacaattgcactgggctctgtttggtggcaactgtgggcagctcttggaaaagcttcttttctaaaggaaggacctggggacaattatttacccttttttatagcatgttttttttcttaatttccttttcttttattgaatattggatataggtatatcttttttgtgtgtagcatgttattttatatatctgccttatgttttgtttttgttttatttaaatgttggacttaatgcagagtaatgtggaggctctaaattgtttgcttccttttgtttaattaaggctatgccatctacttattccacctccttaaagaatctcaattaactaaaatatttcttttccaagtgttttctcacctctcttctttaacctcacatcatccctaggaattttgtgcctgttattatgatttctgtttgacagagaagaaactaaggtataaagaaagtaaacagctaggccagtattctctgggataaaaagcagtcaatgttactcttagacttgtgctttttttcactacagcaggttttccaagttcagcaccaatcacattaggagaaaaggctgcagttgcactgatcttggaatcaaaagatttggtctgtgcccctggttctgcctctcttatgaccttggacaagcatttaaggtctctgagatcctacaaaattgggtaaatgccagcttttcttgaaactgtctctcaaacttttctactcttcagatatctttctctaatatcatcttctttcctctgattttcttgtacttagcttttctttcttctatttttcttcctgagactttctctgtctgttgcagccctgactatcttttctggcctgcccctcctcctattggtatcatgttatcctatgtaatatttatctgatcagtttcttgcattatctttggatgaagagaaagtaagcctcatttggcatctttataaaggatacagtaccttaattgattacttgtcagaaagaatataaaatattaaacacgatgaagattaaagattccaaataagttggtaaaaatctattttactttaaggaactaacaaagaagtttatttaaataaatttttttaatgaagaggccatcaagctagggaaactatgtgttaatttggtgttgggagagatatatgtatatgtgtgtatagtttcaattaagtttggatagtgtttgtatatgatatataaattgtgtgtaccaaatgagttattgctagtgattaacagtgaataaaataacttctaagatgtgttagttactatttactgaggctgaatgctagaaatactgatagcatgaaactctatttcctaattattctcagagtccaattctgccttctgtctaatcttcactaaatcacagcagcatatttttcagcaaattgtgaaactcaggtaacctggttagaggagaaaagattaattgaatcacataaatattctctttgaagctagacttttcttcctcttatgttcagatgggaataaatcatatccacccaccccaccttacttagagagttttctccatgcctggaaggcaagggcaaagaacacagagatttcctgtctacagtcacttaggagtttagcatcctgggacactgtgaggaacaagggaatcttgttactgtgctgtagggagcccagaaagggggaacctagttttatgatgcaactggtttcctccccaagtttagggcatgtaggttcaaagaatgtaatagcctacaggctcagaaagatggctaggtaaatccagcttgtttagaagaatgattgacttttgcccacagcaggtaaactcagtctcgttcctgactgctagtctcttcagtctagactgtgtgacagttgctactagctaaggaatagagctacaagtgaatattttaagctgataaaggatttgggtttgtctgtaagattacgctaaatatgtgaattgtggttttaatgttagacataagagaataccatcaacaatgagaccttgaaatgcagacttcaactttacttcaagtgggacgttttcttatgttcttatgggaaggagccagtcccacgtcacatagcctacagatggaatgcggaaggaaagggaaaatggaaggggaagtcatatttggagatgagattggaaggtagacaatgtaagccttatcttagaagacctttattgccaggctgaggggatctaaacttcattgtatatacaaacaattggagaaagccttgtgatctggactgaaaaggtgtagaataatgcagctttagggtttaaacaagcctggctttgaagtcctctttctgatacttactatgggctcttagctatgttgccccttctttcaaatgcctcacttttctctcttgtagaatatggatagtagtaatttcccttgcatagctgttaatactaaatattgtaaatattaagtgagataatatatataaagtccagtgcctagcgttgtaggtactcagtgaatagtagctattatgagtaatccttggacctcattacagccctttgattccagtttggtaattgagctttagaagaaacaaatgaggttgctctctgtttagtcgttaagtcactttcaatttgtacagcagttggtaaccttcattcatattattccatttgatctttagaatgattcttcgaagttgttaagatcattgtacacaagaaaaacctgaggcccgtacaggaaatggattacttaaggtgacgtaacaatgtcagagctaggactagaacccagacagatttcctttttttttttttttgtagagggagggttttgccatgttgctcaggctggtccctcactccctgactcctaacctcaagcagtccacccgcctcggcctcccaaagagctgggattacaagcgtgagccacctcacccggcctagaacccaggtttcttaatgcttttactcccaattcagtgctcttactcttaactggagtttaggtaactttgacttttacttttttctgtcaaacctatggtagaccacattgtgtagcttttaaagttaaagctacttgaatgacaaaagattaggctacacagtaatttacataccaatgttgtatgttacttatggtaaatccactagaaagcccccatccctacatctccctatgttttatccttgaagtctagcatttattaaaacttaaatataaataaaaaggcttcttactcctgagataagctttctgcagttgtaatttgctaaaaaaatattctaattacaaaggattgcaactttcaagtagtacaaggatgattccatttataatttgcaatcattaatcttactctgtctagagaagaaaacacgtggaagtttccttttttcaagaataccaaagccatattaatatattttgtttcttcctcttggtagatcttgctctcatagaactattttgtaatcctatttaaaacccagttgtactaataacggtcctttgagtttcccgggttccactgtttattactcagctcttatttctgctcctttgcatgcagtaaaccaaacaccctcattattcagccaaataatgagtatctactgtgtgctaaacatcacacaagatgcaagtatgattgatactggactgtgttgaaacccaagtactctgggtatgggtgttggcaggggctgcagaagcagtttgtatcatagtaaactagaaagagcaatggatttggcatcaggaaacacgaattcaacctctagcatgtcatatgactcagtttcttcatctattaagtgaggctactaaactaaagtctttgcttagcaatttttgggccaacattggcccaaaattcttggttgggtgcatcaaaacttttaagctaaacattgtagttctgaaggtgaccagttcctctgcaggttttgtaaatgaataaagaaacacaatgcaaagacagttctctaatttgtctagggatttcatgttcagatttcctatgagtgcaggatcagccaggctccatgcttgacagattgcagctcatattccctaaagtagacagttgcctttgccttcatctgggcacaagacatggttctacaattttaattgcattatgacttttactttttatttttattcctaatggaaataatggtctgggtgtgacaagggaatgttaagacttatttttttttaagcagtgttttagtctgtgctgctataacagaataccagactgggtaattgagtaggaaaagaaattcatttctcacacttctggaggctgggaagtccaagatcaaggtgctgctctctggtgaggcccttcttactgtgtcttcacatggcagaagatcagaaaagagcagacccactcctgcaagctctttttataacagcactaatccattcatgagagcaaagcctagagccccaatgaccaaaacaccttttattaggccccacttcccaacactgttgcattggagattcagtttccaacacatgcattttggaaggaacaaaagcattgaaatcatagcatgcaaaaaccgcttccctcctccagccgttaaagctcctttccattccattttaagttgaagggatcatctttatttagaggtgagatagctttggaatgttatcagtaaaagctaatagagcctatatatgttaaagaaattgaatcaacaattaaccttccaaaacagaaagcaccaggcccagactggatcaccagtgaattctaccaaacttttaacgaagaagttataccagttctctgtaatcgcttccagaaagttgaggtagatggaatacttcctaacttattttataagaccagcattacactaataccaaagccagacaaagacattacaagaaaggaaaactacataccaatatctctcattaatacagatgtagaaatcctcagtaaaagattatcaaattaagtctaacaatgtacaaaaagaattatacctcacaccaagtagatttttttttgagacagagtctcactcactttgtcacccaggctggagtgcagtggtgcaatcttggctcactgcagcctctgactcctgggttcaagggatcctcctgcctcagcctcccaagtagctgagattacagtcttatgccaccacacctggctaatttttgaatttttagtagagacagggttgtaccattttggccaggctggtctcgaactcctgacctcaagtgatctgcccaccttggcctcccaaggtgctgggattacaggtatgagccactgcacccagccccaagtagaatttattctaggtttacaaggctggttcaacatttgaaatacaattaatgtaatccatcatattaacagaaaaaaatcataagattatatcaatagatgcagaaaaagcatttgacagaattcaacacctattcataataaaagctcctagcaatctaagaatggaggggaacttcttcaatttgataaaggacatttagaaaaaaacctacagctaaaagtatactgaatggtgagaaactacatgctttccctctaagactgagaacgagacaaggctattcactcctaccactcctattcaatattgtactggaagttctagctaattcagtaagacaaggaaaagaatgtcagcatggtggctcacgcctgtattcccagcactttgggaagccaaggtggaagaatcacttgaggccaggagttcaagaccagcctggccaacatggtgaaaccccatctctactaaaaatacaaaaattagctgggtgtggtggcacgtgtctgtaatcccagctacttgtgaggccgaggcaggagaatcgcttgaacctgggagatggaggttgcagtgagccaagatggcgccactgcactccagcccaggcgacaaagcaagactccatgtcaaaaaaaaaaaggctgagcactgtagcatatgcctatagtcccagctactcaagaggctgaggcaggagtattgcttcagtccaggagtttttggtatgatcacactactgcactccagcttagatgacagagtgagaccctcaaaaccaaaacaaaagaaaaacaataccatttacattagcatccaaaaaaggaaatacttaggtataaatctaacaaaatatgtacaaaatctatatgagggaaactacaaaactctgatgaaaaaaatcaaaggagatctaaataaatggagatatttcacgtacatggataaaaagactcgatgttgtcaagatgtcacttcttcccaacttagtctttagattccacacaatccaaataaaaatcccagtaagttattttgtggatatcaacaaagtaattctaaagcttatatgggcaggtaaaagatagaatatccaacataatgttgaagaggaaaaacaaaattggagggctgacactatgcaattataagacttactataaagctacagtaatcaaaacgttgtggaattggcaacagacaaatagataatggaacagaatagatacacaaatacagtcaactgatcttccagaaagctgcaaaggcaatgcaataaggaaaagatagacttttcaacaaatagtttctgggacaattggacaaccatatacaaataaatgaatcgagacacagaccttacacctttcacaaaaattaacataaaaagtatcatagacctaaatataaaattaaaactattaacctactagaagaaaacataggagaaaatctacgtgatcttgggcttggtgatgacttttatttttaaaaatagattttatttttttgattagtttttgatttacaaaacaaaataagcaggcagcacagagtttctatataccctgcacctggtttcccttatagtatgatacatttgttacaattaaggaaccaatattgaaacattattattaattaatagctatagagtagtcagatttcctgaattttttataatttcaacttttatttcagattcatagggtacatgtgcaagtttgttacatgggtatgttgcatgatgctgaggtttgggatacacttgtctcatcacccaggtactgagcatagtacccaatagttagtttttcaatccttgccccactccctccgtcccacctcttatagtccccagtgtctattgttgccaggtaataactttttagataaaacatcaaaggcgtgatccatgaaagaaaaaaaacggtaagttgaacttcatttgagtttaaaacttctgctctgagaaaaacactgttaagagaataaaataacaaaccacagagtgggaaaaaatatttgcaaatcacgtatctgataaaggactggtatccaaaaaatatatagaactgttaaagctcaacaataagaaaacacacagcccaatgaaaaatgggcaaaaaaaaaatgaatagccaaagcaatcctaagcaaaaagagcaaagccagaggcatcgccttacccaacttcaaactatactacaaggctacagtaaccaaaatagcatggtactgataaagaaaacaacaacaacaaaaacagacacattgaccaatggatcagaatagagagccaagaaatgaagccaaacacctgtaatctctgatctttgacaaagttgacaaaaataagcaaaggagaaaagactccctattcaataaatggtgcttggaaaactggccacatgcagaagaatgaaactggacccctacttattaccacatacaaaaattaactcaagatctcaaactacaaaaatcatagaagaaaacctaggaaaaacccatgtcaacatgagcactggcaaagaatttatggctaagacctcaaaagcaattgtaacaaaaacaaaaatttacaagtgggacctcattaaactaaagagcttctgcacagcaaaagaagctatcaacagagtaaacaggcagcctacagaatgggtgaaaatatttgcatactatgcatctcacaaaggtctaattcagaatctataaggaacttaaatcaacacgcaaaaagcaaataacccattaaaaagtgggcaagggaggggtggagcaagatagccaaatagaaggctttaccaatcattccccaccacaaggacaccaatttaacaattatgtacacacacacacaaagcaccttcataagaaccaaaaatccggcgagcactcacagtacatggttttaacttcatattggtgaaagaggcactgaaaagggcaggaaatacagtcttgaattgcagatatgacccctcctctatgtcctggcagcagccatggggcatgaagaatctggggtttgaaagagggagagcacagcgattgtgagacattgcattgaactcagtgcttccccatcacagcagaaagcaaaaccaggctgaattcagctgattcccacccacagagggagtatttaaattaatcctagtgagaggggaatcgcacatctagtggttggaacttgagttccagcaagcctctgcaacacaggctaaaatgctctggggctctaaataaacttgaaaggcagcctaggtcacaaggactgcaacacctaggcgaatccttgtgcagaactgggcgcagagccagtggactgggcagtactgagacaccagctggggtggttaaggaactgcttgcaacaccccaccctcaaccccagactgcgcagcttgtggctacaaaagagacccattccgtccacttgaagagaggagagggaagagtgggaaggactttgtctagcatcttggataccacctgagccatagcaggataaggcagcaggcagagtcatgaggcacctggatgacattttgaaacacaacctgggccaaaaggaaacctgctgccttcaagggaaggacacaatgctggcatgacccatcacctgctcaggaaagagcccttggaccttgaataaccagcagctgtacccaggtactatgccattggccttggatgagactctgagactagctggcttcaggtaagactcagtacattcccagctctggtggctatgggaagagacttcttttacttgagaaaagtggaaggaaaagtaatgcagactttgtcttgcaccttaggtgaggcttgcaaatactatcttttaacccattattttaagctgataacaagttaacactgcataaacaaacaaatgagcaaaaagaaaaccaataaaaactctattccttaacttcatctcccgagtttttaactttttgttcttttatatcttattgtactatctatatcttcaaaagttgttgtagttattattttttgatttgctcattgttagtcttctacttaatagtaatttacacaccacaattacagttctataatatcctgtctttttctgtatacttactattatcagtgagttttataccttcagatgatttattcttgctcattaacacccttttctttctgattgaagtactccctttagcatttcttgtaggagaaatctggtgttgatgaaattcctcagcttttgtttgtctggaaagtctttatttctccttcgtgcttgaaggatattttcaccagatatactactctagggtaaaagtgtgtgtgttttttttttccttcagcactttaaatatgtcatgccactctctcctgacctgtaaggtttccactgaaaagtctgctgccacactatttgagctgcattgtatattgtttgtttcttttctgtttctgcttttaggaccctttctttatcattgacctttcacagtttgtattatttatttatttatttatttatttatttttttgagacagagtctcgctctgttgcccaggctggagtgcagtggcgcaatctctgctcactgcaagctccgcctcctgggttcacgtcgttctcctgcctcaccctcccaagtagctgggactacaggcgcctgccaccacgcctggctacttatttatttatttatttatttttgtatttttagaacagacagggtttcaccgtgttagccaggatggtctcgatctcctaacctcatgatctgcccgcctcagcctcccaaagtgctgggattacaggcgtgagcccggcccacagtttgattattaaatgccttgaggtagtctttgggtcaaatatgcttggtcttctataaccttttgcacttaaatgttgatacatttctccaggtttggggagttctcgttattttccctttgagtaagctttctacctttatctctgtctcttcctcctctttaaggccagtaattcatatttttcctttcgaggctattttctagatcttgtaagtgtgcttaattgtttttcattcttttttcttttgtctcctctgactgtgtattttcaaatagcctgtcttcgagctcacaaattcttccttctgcttgatcaattctgctgtgaaagagtctgatgccttcttcagtatgccggttccatttttcagctccagaatttctactttattctttttaattattttaatatctctgctaaatgtatctgatagaattctaaatttcttctctgtttgcttgaatttatttgcatttcctcaaaacagctattttgaattctctgtgtgaaacgtcacatatctctgttgctccagcattggtccccggtgccttatttagttcatttggtgtggttatgttttcctggatggtcttgatatttgtagatgttcatctgtgaacattgaagagttgtatatttattgtagtcttcgcagtctgggtttgtttgtacctgtccttcttggaaaggctttcgagatattcaaaaggacttaggtgttgtcacctaagctctatctactttaggagacaccccaagcccaataattctgcggcttttgcagactcttagaggtaccgccttggtgatcttgaataagaatctgaaagaattctctggattaccaagcagaaactcttgttctcttcccttactttctcccaaacaaacagacactctctctctgttctgagccacctggagctgggggtagactgacacaagcaccccgcgtgaccaccaccactaggactgtgctgggtcagatctgaagccagcacaacactgggtcttacacaaggcctgctgtaaccactccctggataccacctatgttcagagtacctgggactccacaatcaatatgtggcaaaagcacccaggcctgtgtcctacccttcagggtggcgagctccccacaggacccaggcaggtccagaggtgctgtacaggtgccagggactagagtccaaaaccttagaagtctacctggtgttctgttgttgcagctgagctggcactcaaatcacaagatacagttcttcccactcttccctcccatttccacaggcagaggagcctcaccccatggccaccacaaccacaggcccacagggagtactgccagactagcaccaatgttcccttaggcccaagggctcttcagtcagcttgtggtgaatactacctggtttcagactctcctttcagggcagtgggctctgctctggcccagtgcaggtccagaaatgtcatccaagagccagagcctgtaattggggaccctgatagttggcttgatgctctatgcccctgtgggcaagatggtatctgaggtgcaagacaaagtccccttcacttttccctttgcttttctcaggcaggagtcttgccctgcagccaccaaagctgggaatgtgatgagtctctcctgaagccagcaagtctcagagacccatcaagaccttcagtgtagtaccagggtaactcaagggctcttcagttagcagctgatgaatgtcaccaggactgggttcttcctttcaaggcagcattttcccttctggccttctagacatctggtggatgtctagaaatgtcatccaccatcttgctctgacccctccttggtgtggccattttggaaggcagtttgacagtttcttacaaagcttatcatattcttaccatatgatccagtaatcatgctacttgtatttatccaaatgagtggaaaacttgcatccacaaaaaacctgcacgagtgtttatagtagcattattcataattgctcaaacttctaagcaaccgtgatgtcttctaataggtgaattgataaatacactgttatatccatgcaatgaaatattattcagcactgaaaagaaatgagctatcaagccacaaaaagacatggagaaacttgaaatgcatattgctacatgaaagaagccaatctgaaaggctacataatgtatgattccgactatacgacattctggaaaaggcaaaactatggcgacaaaaaaaaattcagtggttaccaggtgttttgggggaagagagagagggatgagtaggtggagcacagagcatttttagggcagtgtaactattctgtatgatgctgtaatagtggatacatatcattatacattcctcaaaacccatagaatattcaacacaaagagtgagtcttaatataaactatagactttagttaacagtctatcaacattagtttggggtgggggaaaagaaaaaaattgctaaataaataaaatttagtaataacttcactaaataaattctattgtatggcctatctatacaatagaatatatttttaattttaattttttaaaaatagaatattttgcagctattaaaaaaggatgatacattatggaaagacaaaactatagggacagaaaacaggttagttgttacttaagaactaggggagggattgactacaaaggggtagcttgagggaatttttgggatcacggaactgttctgaattgtgattgtggagtgattatcccactgcatgtgtctgtaaaaactcatagaactgtacaatgaaaaattatttttactatgcgtaatttttaaagtaaataaaaataggatggggaattttaaaaagctttttataaaaaaaaaagctagtagtagccttccaattgtgaaagttctcacagcacgcaagggcattattttcagttaacaaatgtttcacttagactcagattactcaggatagaagggtccttcaagatcactaaagcccctacatgcaccctcactttacagagggagaaacaggcccagaaagaagggagtttcccaaggttacatgcaaattagtggatactttgtgtagtttcagtcttttgacatttattgagaattattttgtggcctaacatatatggcttgtcttggagtatgtgtattctgctgctgttgggtctggtgttctttgtatgtctgttaggtcttattggtgtttaggctttctattttctcattgatcttgtatttagttgttctgtctatcattaaaagtggggttttgaagtctccagctattattatagaaatgcctatttctcccttcaatactatgagtttttgcttcttatattttgggcctctcttgttaggtacttaacaagagaggtgtttataattattatgtcttcttgatgaattgactcttttatcaatgtataatgttcctggatgggcacagtggctcatgcctgtaatcccagcactttgggaggctgaggcaggagtatcccttgagcccaggaggtcgaggttgcagtgagccgtgatcgtgccggtgcactccagcctggacaacagagcaagaccctgtctccaaaaagaaaaatgttctgttacttgttttgagagttcattattgttcattatttgagctagatccctcaatttgaggaagtatgtatttgtttgtgtatatgtgcatgcatgcatgtgctgctgaccagtgtggtaaatagcgtggggctactctacttggtctttaattccatggaaaatgagaaacttttttttaatttttaatttgatgtatgtatgtatgcatgtatttctttatttattttgctggcagctctaaaaccagcacaaattgggatcataagctccctattctaataagatcttgtagttgagaatgagtcaggggactcactgtgaaggagaccaggtctttattgaggcctttgtgaaaatctctgctacacacagataacaattgaaatccaatttacttcacactcaacaggaagtcttagttttattgactcaacaactagtcaataaaattaaaaagcattagtggccaggtgtgatggctcatgcctgtaattccagcactttgggaggctgaggtgggaggatcacttgaggccaggggttcaagaccagcctaggcaacatggcaagaccccctccctacaaaaataaaaaataaagcagtaccaatttgagaattttcttcattgttcccttgtttcactgtcatcttttttttttttttactttattcctttttctttctctggtttttctccaactgttctattttccctgttttctttacatctttccttttttcttctctacttccccttctctttaccctttcctcccatgtatctttctctctgatttctccttttctgtattattctctttaccctgtgactgttgcattactggacactggcagtgagactaaatattttaagttagcatcaatagggatatgttaatagaagacataactataattttgtttctttgtgggagaaatatacacattaaaataaaaggcctatactctattgccatctaattggagcttctgtgctggcagaaaatgcactggaaaaaaagtaaaccaaaattacttgataagaaaagcatagtagctaggcccaaatgtccaccttgctctttattagaattatctaaatacaaagatgaaagcaagactcttctccaagaaacaatctctgcaaaaagcccctttggcatcaaagctatgaactttacgggaaagccagagtttctcaggttgtgtgccatatggatagtttggcctattataagttttgattgagagaagaatgcaatataaaagcagctattgggtttaagcacagctaagtgtggtggttgcagtgatagtcttgagtgcctttctgagttaggcactcttttattattttgttttggttttttgttttggtttggtttttggtgtttttgagacaggatttcaaaccatgatggtttgctgaatagatcaacctgtcacctagttattaaagccagcatccattagctattcttcctgatgctctcactccctcaagaatggcattttgaaggtacttgggtttactggcaatgtgtccttgcttagccagtgtggctggatggccagggcttgacaagaagtaacatttcttggccatagaaattcaagtttttgttcactttctgttcttcttaaaccccacctttagattggctttcacgttgccctcatttcccggagaacactgaatacttcccaggaaaagaggcttatgccatgcacagttccatccttcttcttactgaacccatctctctgggattgctggtgattggaattcacatggaacattctacgttgagcttggtaaagcagctggttttgttaagaaagcccaaggaaagctttggcctctgttcccacctcccacacagtcaaaaagaagcccagtctaggtagagctgaaagggcatttgaacaccatctagttccactcctcatggtacagatggaaaattcaagcctgaagttgaaaaaaggaacttgcttaaggtcacacagttagataatggttaccttctgacttcagaagactgttctcctccctaattgtatgttaaggaagaatctgacagacatctgtttaaactattaactctgtgtgtgtgtgtgaacatggtttaatttttaaactttatttgagatgacttttgtacttacagaaaagttgcaaagctagtacaaagagttccaatataccgtttgcccagtttcccctaatgttatcatctgtacattactatggtacatttataaaaactaagaaatcaacactggtatattactattaactaaactccagacttcattcagatttcaccagtttttccattaattatcatttttctaaaatatcaggatccaatccaagataatacattgcatttaatcatcatgtgtccttagtcttctctggtctgtggcagtttctctgcttttccataacgttaagatttttaagagtactggtcaggtattttgcagaatgtccttcaatttgtggtagtttgatgtttttcttatgattgcactggggttatagattttggagaagaatctcacagaggtaaagttccattttcattacattatttcaaggcgcacataatagcctttaacaagacatcactactaattatcacatttaactttggtcatttggttaaggttgtgtttgccatgtttttgcagtgtaaagcaactactttttcctttttcattctctattctttggaagtaagtccagcccacacccaagctctacctccttgaaaggggagtatctacatacattatttagaattcttctgttaggacgatatgtcttttctccaccatttatgcatttatttgatcatttatttatgctgtatatgtgggctaatatttatttattttatactttgggctttaatccgatactaccttatctattttgttactcaaatgctcctgctttagccattaggaattatttcaggttggttcctgcgtccctttaaacacatgccctcttccttttatctttttagtacttgctaattttctggtactacaagatactccaggctcatcttgtgttttccctgacctagccctagaatgaaccatttatccaaataactctggttccttttattggaaaatgttatttagaaaccaagatctaggagtggtcatttttaccaagctatcattgcttccagactttctcagtggacataactgggtaatatatgtttgtttatgtactaacctttgtatacatatatatctataatcatttgtgtgtctatccattgtgtgtgtgtgtgtatatatatataatatatataatatatatgtatatatataatatatataatatatatgtgtatatatatatatattatatatgtatatatatataatatatatgtatatatataatatatatgtatatatataatatatataatatatatgtatatatataatatatatattatatataaatatatatataatatatataaagctaaacatgagtttatattgatgtctctaactctaatccaatactacagggttcattctagccttcctttctttttatctgtaacttccccctataacaatgacaaacttagcttccactacccaccatccatttacttacttgttcaaacccagtacattcaaaccagtctcacaattgttcatctataccaccatgacaacagctttatcaactacagtacagtgtttatgtatggttatttgtcttttatctttatactttctagctaaaacacaatttttcaaagttaaatcagcttcgtacccccttcctcagtgcacttatgtcacacatttgtaatacagttagattcatttgtcacagtctgcatttcatcctgggatcctctgacatctggttgatgtttgcatttgcatatgttaaggctcattctttgtaaattacaggtctataggttttgacaaatgcataatgtcatgtgctcaccaccccaataccatacagaagagttccatcactctcaaaattcctctgtgaatcccctctgttatcaaccagttcccccacccctaatattcagaaactactgataagtatcccatccctatagttttatattttccagagtgtcatatgaatggaataatacaatatgtagtctttgggtatggcttctgtctcctagcaaaatgcatttaagactcattcatgttgtgtgaatcaatagctccttttatgtaagtagttccttttaaacactgaatagtattccattgtaagaatacttgtttatccattctcttgttgaaagacatcttgattgtttttagctttgagaaattaggaataaagttgctagagacatccacaagcaggtttttgtgtggatgtaaattttcaattcacttgggtaaatacctagaagtgtatttgctgtatcatatggtaggtctaacttttaacacaattcctttccaagaagtctgggttgagtatgtatgtatggtgcagtagaatatctgttcctgagctggactgaaatagtgatcactctcacaccatattccatgtggacggaaaatagaatatcaatgggatgggaggagccaagatggccgaataggaacagctccagtctacagctcccagcgtgagcaacacagaagacggtgatttctgcatttccatctgaggtaccaggttcatctcactagggagtgccagacagtgggcgtaggtcagtgggtgcgcgcactgtgcatgagccaaagcagggcgaggcattgcctcacttgggaagcgcaaggggtcagggagttccctttccgagtcaaagaaaggggtgacggacggcacctggaaaatcgggccactcccacccgaatatggcgcttttccgacgggcttaaaaaaaggcgcaccacgagattatatcccgcacctggcttggagggtcctatgcccacagagtctcgctgattgctagcacagcagtccgagatcaaactgcaaggcagcagcgaggctgggggaggggcgctcgccattgcccaggcttgataaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcagactgacacctcacacggcagggtattccaacagacctgcagctgagggtactgtctgttagaaggaaaactaataaacagaaaggacatccaaaccaaaaacccatctgtacatcaccatcatcaaagaccaaaagtagataaaaccacaaagatggggaaaaaacagaacagaaaaactggaaactctaaaatgcagagcgcctctcctcctccaaaggaacgcagttcctcaccagcaacgaaacaaagctgggtggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaataagcaaagcctccaagaaatatgggactatgtgaaaagaccaaatctacgtctgattggtgtacctgaaagtgacggggagaatggaaccaagttggaaaacactctgcaggatattctccaggagaacttccccaatctagcaaggcagtccaaccttcagattcaggaaatacagagaacaccccagagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacatgcttaaagaaaagaattttcaacccagaatttcatatccagccaaactaagcttcataagtgaaggagaaattaaatactttacagacaagcaaatgctgagagattttgtcaccaccaggcctgccctaaaagagctcctgaaggaagcactaaacatggaaaggaacaaccggaaccagccgctgcaaaatcatgccaaaatgtaaagaccatcaagactaggaagaaactgcatcaactaacgagcaaaataaccagctaacatcataatgacaggatcaaattcacacataacaatattaactttaaacgtaaatggactaaatgctccaattaaaagacacagactggcaaattggataaagagtcaagacccatcagtgtactgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctgtgcaccaagcagacctaatagacatctacagaactctccaccccaaatcaacagaatatacatttttttcagcaccacgccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactgcatggaaactgaacaacctgctcctgaatgactactgggtacataacgaaatgaaggcagaaataaagatgttctttgaaaccaatgagaacaaagacacaacataccagaatctctgggacgcattcaaagcagtgtgtagggggaaatttatagcactaaatgcccacaagagaaagcaggaaagatccaaaattgacaccctaacatcacaattaaaagaactagaaaagcaagagcaaacacattcaaaagctagcagaaggcaagaaataactaagatcagagcagaactgaaggaaatagagacacaaacaacccttcaaaaaaatcagtgaatccaggagctggttttttgaaaggatcaacaaaattgatagaccgctatcaagactaataaagaaaaaaagaagaatctaatagacgcaataaaaaatgataaaggggatatcaccactgatcccacagaaatacaaactaccatcagagaatactaaaaacacctctatgcaaataaactagaaaatctagaagaaatggataaattcctcgtcacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggattagctggtaccattccttctgaaactattccaatcaatagaaaaagagggaatcctccctaactcattttatgaggccagcatcattctgataccaaagccaggcagagacacaacaaaaaaagagaattttagaccactatccttgatgaacattgatgcaaaaatcctcaataaaatactggcaaaccgaatccagcagcacatcaaaaagcttatccagcatgatcaagtgggcttcatccctgggatgcaaggctggttcaatatacacaaatcaataaatgtaatccagcacataaacagagccaaagacaaaaaccacatgattatctcaatagatgcagaaaaagcctttgacaaaattcaacaaccattcacgctaaaaactctcaataaattaggtattgatgggacgtatttcaaaataataagagctatctatgacaaacccacagccaatatcatactgaatgggcaaaaactggaagcattccctttgaaaactggcacaagacagggatgccgtctctcaccactcctattcaacatagtgttggaagttctggccagggcaattaggcaggagaaggagataaagggtattcaattaggaaaagaggaactcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcaggagtgaactcccattcgcaattgcttcaaagagaataaaatacctaggaatccaacttacaagggatgtgaaggacctcttcaaggagaactacaaactactgctcaatgaaataaaagaggatacaaacaaatggaagaacattccatgctcatgggtaggaagaatcagtattgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactgtactacaaggctacagtaaccaaaacatcatggtactgttaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactgactagccatatgtagaaagctgaaactggatcccttccttacaccttatacaaaaatcaattcaagatggattaaagagttaaacgttagacctaaaaccataaaaaccctagaagaaaacctaggcattaccattcaggacacaggcatgggcaaggacttcatgtctaaaacaccaaaagcaatggcaacaaaagccaaaattgacaaatgggatctaattcaactaaagagcttctgcacagcaaaagaaactaccatcagagtgaacaggcaacccacaaaatgggagaaaattttcgcaacctactcatctgacaaagggctaatatccagaatctacaatgaactcaaacaaatttacaaggaaaaaacaaacaaccccatcaaaaagtgggcgaaggacatgaacagacacttctcaaaagaagacatttatgcagccaaaaaacacatgaaaaaatgctcatcatcactggccatcagagaaatgtaaatcaaaaccacaatgagataccatctcacaccagttagaatggcaatcattaaaaagtcaggaaacaacaggtgctggagaggatgtggagaaataggaacagttttatactgttggtgggactgtaaactagttcaaccattgtggaagtcagtgtggcaattcctcagggatctagaactggaaataccatttgacccagccatcccattactggatatatacccaaaggactataaatcatgctgctataaagacacatgcacacatatgtttattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaacatcattctcagtaaactatcacaagaacaaaaaaccaaacaccgcatattctcactcataggtgggaattgaacaatgagaacacatggacacaggaaggggaatatcacactggggactgtggtggggtggggggagggggagggatagcattgggagatatacctaatgctagatgatgagttagtgggtgcagtgcaccagcatggcatatgtatacatatgtaactaacctgcacaatgtgcacatgtaccctaaaacttaaaagtataataaaaaataaaaataaataaataaataaataaataaaagaatatcaatgggatgtcttcttctcctacctggaagatgaagtttctgcaaatgaccattagatggcggggtacttgctggcactctgagctggaagtctgggagattgtgggagactgaaaattatatcactctacccccttcccttttcttggcaaagggatattctagccacactcaggaaataaaatacctgatttatgactcctggcatgtacctttatactgcttcaggaagttaggcttgggtttcatgttggcaagtatcccaacagctaaatttgtgtaatggtaaactttaggttagataatgagttttgacctgaaatggggtaagcaacatcatgtcatgtttgtgccccttgctgacctcattgcaaagtaaaggaagcatagaaccttgattcctgggttctaatgccagccatctattgtcccaactctcttggcctcatattcatcatctttaaaataaggataatacctgcccattcatgctcacagggctgttgtcagagatcaacctaagatacataatgtgaaatatattgaaggactttataagtttaacatcatacaaatatgaatgattattaatgatcaaaccaaatagaatatgaaatactattgatattaggtggcatcatacattaataaatctgacttaaaaatacaatctgtttaccttgatcaggagaggtagatatttagtctctgaagtgatgcagtattttcctcagaacttagtgggtgggtaatttattattatctacttgtttaatttttggtgtagcagttacagaaaatacttgattccagattgaacgattttatagggtaattcctcaccctcataaaatccacattatttcaatttaccaagtaaatactggcacattcagtagatgttactattttgggttccaactggtactcatgattgactctggtgctctggatccagatcctttggtatgtaccaggggacagcaaacctcagttatagaggtggctttacctttaccctagaaatcatctgcagttgctctggttcaaagcttaaaggaaggtttgaggagtgtactttcaaggtttgaggagtgtactctctcttcccagcagtgcagaaaccaataatcatcaaaacattgtcaccataactgttgtcaggtttttttcaaccttgcccttgcatctcagcacagctctctcgcccaaagaggtaagctggggaaaacagaatctactcattgtaatcttttcagcttatttatctgcatttagaaagtctcaaccctctgggctcccctgcctgtcagagtcaaaaagaaaggccccatgtgtatgtgtgggcctgtatgtaagaagtaaggcttgaaggcatccttggcatctgtcatgtgacacatgcaatggtttgtaatagagtcagggaatcataggatatgacctgaggtgggaggtccagtttctacccttcattttacaattggggaaactgaaacccagaccaaaaagtaacaactaattagctatgtaggtcttgctttattattactggtcacggagagtgcatcttaacagtagccaaagaaggtattgatcaagtagagaagggacactgtcattcccatagcttcaatcttttttttttttcttttttcttttgagatggaatctcgctctgtcgcccagactggagtacagtggcgtgatcttggctcaccacaacctccgcctcctgggttcacgccattctcctgcctcagcctcccgagtagctgggactacaggcacccaccaccacgcctggctaattttttttcttttttttttttttttttttgtatttttggtagagacagggtttcaccatgttagccaggatggtctcgatctcctgacctcgtgatctgcccgcctcagcctcccaaaatgctgggattacaggcgtgagccactgtgcccggcccatagcttcaatctttatttttctccagtggaaggggcttagcctaactgaaaacagttgatgtaatttagggcatgggagggactagtgataggggtgtgtgtgtgtgtgtgcacacacgcacatgcacatgtgctcacgtgtgtgtgtgtgtgtgtgtgtacaaccttgttttcagttatctacttctctttggcctctaaattctacatattttccccttctcctgtcagaatcatttagtcaatatgtgcctttttgagtttgtaagtggaggctaggttaaagagtgtccttagtttaggaatgtcatgtgctcatttggctaggtgtgtggtgattgtgtgtgggggaatgtgctggattcagaatagtaatagttgcttaaaactggaactttttaatgagggagaatggtctaccttttttcttgcagagctcagttttattaatgtgatatgctgtgtgctagtctgtgccagaaagtatctctgtaggtaattgatctgcctcttcttcctttctctttagatattcccttccatgtatgataaaaaccaatcttggtgtgtttatctcttttttaagcactttatcaagggttttttccagctcttgaaaagacaacttgtatacccaccctccacactacactgtacaaccaacccaacattctctgcatagacaatcagtcttcttttctgtgtgatataaatctatgaaaactcccacacattatagtacaactggacttgctgattccaaaccctgagcagaaaaaccctctaggaagccattgccaaggataagattgattgctacactggcaggtgcctgcccatttccctcgctcagtggaaaatctggcccaccatgacaaaaaatagctcatcccagggccttaaaacccaccgaatgagattttagtgttggggataaaagcaaggctgtagactaactcattcatttgctttagtgttctctataaaatataaaacatatatttcataaacaccaaatttcatgaaagcagatttatttcataagttttgtctattaccttatctaagcacagtctcttcctccaccattctcaggacatatggcttagtcagacagactacacagatgaatgcagagtgttgagtgacaaagccagccctttaggcgtttggagcacagcaaggttatgttggcaaggccaggtcagacaaggctataaactttgcctttcatctttaccctaataatgccactgaacaaacccaaccaggatctttctcaaatccatgtgtacagtttttatttgtcagagactaagcagaatgcctgggggaaggcatgcataatagaactaatcattctttaaagtgtaattttccttgcctatgcattcttgtagagtttcagtagagcccttgacaccctaagatagaagtgaactatgcaaagggggaatgagtggagataacttgaaaaaaaattttttttttagttttacatcctcctttttttcatatggactttagacataaacagttaatgtctgtcagagctaaaaggtacctctgataccattttatctaccccttaaccacaaaaaaagattatatagggagcagttcagtatagtagaaagaacatgggatttggaaagaactgaattctacttccagctcaagccatttgatctcagtttctttatatgtaaaatggaggtggtaatcctcataatgacattgtaaagcaatgtactggtggcccccaatactatccccaggttcactgatttgctagaaggactcacaggactcataaattgttacaatcaggctacagtttattatatcaaaaggacagaaagcagaatcaataatgggaaaacgtacatcagtcagagaccggaggataccaggtgcaagcttccaagagtcttctcccaatagagtcacacaggttgtgcttaatcctccaacaatgaagttcagaaacatatgcaaagtgttttctgccggggaagcgtacttgagcctgaaactccaggatttttattggggtaactagtgactgaaactccatatcccttggaaagaaagcatgcattcaccataaatcatattttttgcacaagatacctagacaggctgttacagcatggttgaaagggcatacacaatgcccttaccagttactagaatagagaacattctaagacctcagttcccaggagctggccaaggaccagtcacacaagtgggcccttctaaaaatgtatacgatttgagcaactcaagactgctgggttaactctttctttcacagataggtattaaattattgtatgtgtgtatatatatatatatataaaatattgcatatacatacacacagtataaagcagtacattaaatgtgagggattattatacatatgagtaaagagagctagagctattctggggtgtgattaagtgcagtaagaatggaagtatctaagacaactctccagggcaatgaatggggaagctgtaaacaatcccactgaggattttatttttctctatgattagagataatttcgtcaccactaccattctgtccctcatcagtttcacattgtactttcttatcatagctatatatttcttgggatttttgcataagccaaattgtttcactacgcactgtggagttttggcaaggatgtgatcctcttaaggaaagtgcagaattgagcctttgcagaaggcataggcaggtgcttcctagaaaaccctgagcaagtcccaatgaaagactatggttaattatactataatcgtggtaactaataccaacagtgaattttagtctgaattgaattgaagtgaatttatgtgaacctaaatactattgaaatacgattttgagctaaatactgcactagatgcccagcctagcccaatcattttataaaaatttgccctctaaggatgacggaaatgactatagaaaggaagctcaggcattgtatgctaggatgtggaggggaacatcctgaggaagtgcacatactcatacctaaaactactgaaagcatttgccaagggtagcctgtactgcctgaactcaggtggtaatggcaccaagtagactggagaacagcttgagaaagtgggcatatcttacagatggacaataaacctcctgatggaactttggtaatggagtatttgttaatagcattttagctgctgtaagcctctttgtctgctttatacccccagagctgctgtagctctccccaaactcatgaatggggcctaaggcagctgcctttattctgcatgtaagctagagctggctcatttgtctacctggtatgttcttttaccctttacgttggagccatgtcaatggttctcctcaaattgaccctctgctgccagactttattgagccctatctgagactttttctgagccctctgctccaggtggccctaaaaacttcatatacaatgtaatgtaggctctttaatgtgctagcagaaaatgacagagattaaatggtggccctgccatcaagggaactcattgcttcttttgaaataaagtatttggcaggttttgcctagaattgagggatggaatcactcctttccctaccttatcttttcttaaaacagctcctacatttcaccccatttaaaatactagcccttgcatttgtatcacattctatacttttctaacactttcttatttattattttattcttacatattttcattcatgctccgaggccaagctcagatgctattttctacagagagattaattttaacttcctctgacctcttaaggaactttccatgatgctctcgtggtttttaaccatttttcctatttttattctaattatttatatatatatcatttattagactctaagatcctcaatggcaagatctagataggattcatcaacaacttacatatagcaggcaagcaatgaataataaagatgaaatagaatagaaaacaaacaaatgcttgaagcttagataactgcctctcatttactctaattactggaaggcctagaacttgaatcttcttctagtcctgtactgctatcttaaattctccaccacactgcctcccttacccaggccagatagcatttactcttcagaaggaaggaaattagctaagtctctaataatcaggaaaggctttaaggaggaggtagaccttgacaaatgagtataatgttactaagtgaaatgcagagcgaagggtattccagaattagcagtgaaagcacataaagagggtgggaggaagaacatggtctgtagagtaatgaggccaagcctaagaaccagggcagcaagaattgtttggggcaagtcttgaaaaccatacagaaatgttggaatgtgttgtagcaggaagtaagggccccatacagaaggccttatatgaaggaagggtctgtagtagggaggacttagggctttctggtctactggctcttttggaagtttgaaatcatggcagggacctaagaccctgaacctcctgcctcttgatttggtcaactctgaatgtgaagtatattttattaagatattctaacttgctcactagcatttaatgttagttgccaaatttccaaacctgagctcaaagggaactctcttacaagtttgaaagcatttcagaactctttttcatggtaataaggattttgcctggcctagaagaagctgccaactccagaggtctctctggcactctaactcagagaagtttaaagtaaatgtagctcctgagagagagtatgagtccttaaaccaccaacccctcatccttttaaatctctgggtttatcctctgggaaacactgtcattcagctactgttttgttcaggtctctcaagttcttgcctaccatccagcccttcagatgtctgtgtcatctggttagttccctatattgtgaggacttaacaaattttcagtcagtcattcagtcagtcagttcctgtcttgtcctccagaatatcaaatattgaaaaaccactggcctcaactaaactgagctacaccacaccctggtaaaagggaaaatcttagtataaatttcacatacacctaaggctttcacatacatttcacatacacataaaccactggcctccactaaactgagctacaccacatcctggtaagagggaaaatcttagtataaatttcacatacacctaaggctttcacatacacataaatcactggcctccactaaactgaactacaccacaccctggtaagagggaaaatcttagtatacatttcacatacacctaaggctttcacatacatttcacatacacataaaccactggcctccacgaaactgagctacaccacaccctggtaagagggaaaatcttagtataaatttcacatacacctaaggctttcacatacacctaaggcttcacatacacctaaggaaacctaaggcttccctcttgttctttctccctcttctcctccttcacctctccctccactcttcctctgatctctctttttcaaacgttatggtttgttgttccataccaactgcacatttggcaatagacaaaaatacaaaactcctgccctcatcgatttatgccactaacctgattcagttctctctaaaggagatcgtagcaacctctctcaatattcatttccagctaacattctcttactatttctccggagagcagtgaaactttatcaaagtctactttgtaacgatgccaaaagctggcctctgaaagctaaaaggagaagagctagaatgtggtaagtgggagctgggccctagcaacagaactgtgggaggcagtgtggaataatggaaggaccataggtctgaagacctcattttggacttaacagttgcccaggctttctatattctcacacatttatgtacctttagggtaaggataatcactcatatttgtctcatctgacagtacctatcacacagctcatgttcaggtgagtccccagggcccccactgtgctgtactctcccttccctgcccaacttctctgcaccttggattcatgtcttgtttctaccacttcctagccttgaggctttggtaggtttcttaacttctctgactgagtttgtttcatcttccctagaagagataatacatgcttcatagctttgttgtacagatcaaataaaataacagatatgaaatattttatagcctataaggtgctgtgaaaattttaagatggggctaggcgcagtggctcatgcctgtaatcacagcactttgggaggccacagcgggccgattgcctgagctcaggagttagagaccagtctgggcaacatagcgaaaccccatctctagagaaaatacaaaaaaaaaaaaattagccaggcatggtggcacacgcctgtagtcccgggagggactgaggcaggaggattgcttgagcccaggaggtaaagcccagtgagccatattcatgccactgcactccagcctgggtgacagagccagaccccatctctaagaaaaaaaaaaaaaaacagtaagatggttttatcagattagtcaacaaatgtcaaaaggcacacaatttttattacatccatgaaccatgcctccaactagatcatgtggtatatagagttccaggcctatttatagacccacatttgcttaggttcagttcatctgaacactgattaaagttaacattaggaaagacaaaaacctaacctttatctgtgtttgatacaaagaccagtagcaattacatcacttgaatgtggttagattttattttcctttggtattttggtgaagttcccaaacgaatgcccaggaataattacagcagactggctttggcggaggaagtatataaaggcaattagtaaaatgtaacaaacttaaatgataattgaacctacattcccccagccatttccaagtataaactatataaatctgtgtcccagattcaccaaatgaaatatttttgagggaatcaagcagcaaggatctagtgatcccttattgcagcccagctatgtgtttaggggcagggtatggtggtagatgtaaaatcctaaaagcctgctttccaggagctcatattctggttgggtctacaaaacagaaaaattaagtcttttgttagaagaaatgaaacaatctaagacaaaatagcatcaggtgtcaaatagtgtggagcaaaaggcattcagaaaagtagaggtcaaggtgggctgggcctttcagcttaagaaagacagaggaagaaggcagggagatcttgcctatgttgggaaagtaagggcaggagcctctgagttggaaagaacatgtcaggtgttgtgcatggtgccacgtaagactgctgaggtatgatagagccagattatagatgtccctgaaggcctggcaaaggagacttgactgtatatagtaagcagtggtgactcattgtgagttcttgagccaggagactgctgaaaaagtagtgtgttaaaaagcagcatgcagggtgaattagaacagagacagacacctactaccagaaacccatttgttagcttccattgtaagatgtggtcgtagtcatggaagaggatgattgaaaacaagatatggccaaagaaaagagaacaataagaacactggggcttagaaggtcagattacgtcttactcaatcagtcagaactctggcatcataggtgattttagtgaaaaacatatctatttgttggaaacaaatttttaactttaaatggttagcttataggcttaagatataagttcccagagatgaattggtgaatggcgtctgaacttgacctatttgcagcagcaagaatgtgcaagaatcttctccaggctttctcagagctggaggacccagcatttgtgttaatgtgactgggttaaaatgaaagcctttgttgtctctgaaaagaaattgaggaagtactgttaaaagatgatgagatcagccgggcacagtggctcatgcctgtaatcccagcactttgggaggctgaggtgggcggatcatttaaggtcaggggttcaaaaccagcctggccaacatggtgaaaccccagctggatgtggtggcatgcacctgtaatcccagctactctggaggttgaggcaggagaatcacttgaacccgggaggcagaggttgcagtgagacaaaatgtaatgtaaggtaaaagtgagacaaaaatgtctattgtgacctgaacatattggcctataatgatggtaaagctgtgtcactctgagaaagttacttaaactctctgagaagctttagagcttctcatttataatatagtaatgctaattcctacctgcttcacagggtttttgtaagggttaaatgtatatcaacataaagtttctagcacacagcaggtaattgcaccactgcactccagcctgggcgagagagcgagatgaaagaaaaaagaaaagaaggaaggaagggaggaagggagaaagggagatgagatccatggaggaaggaaaggagactttattttcagaggagatacaatctgtagatccgggagtgcagcttcagtacaagccccacagaaggggcaaggagctggggtcagccatccatacataattgagttaggttgggaaaaatctatgaatatttataagaggaatcaggcaccatgcacagtgggtaaacatgtatgtagcatgcatttcatgttcactttggggtgaggttttagtattaaaatgaggtggaatttggctctttacatctaaaggtgaactacaggacacaaagttcatgcacagtctttataagttggttgaaactggctcaaggtctgcagccatttatcagtaaaaaatgttcataagacaggtcctctgtccaatcagagctgtggtgggactgcaaggcaggggcttgggatagagagtggaggtcagtggattcaataggttggcatcaggcagtctatctcggtcaactgggaaattttccagctgtagttgtttcagtaatgctttttgggagctggtttctgcttaattacaggggaaaaagcttatggcagttaataacacagaaatacttaactaagccccaatcctgctggccatgagattctgtttttggtgtgtctcattttagccacagggagtccattttatctgtctgttggggcatattttaacagtacaaaagacaaactgagcaaaacaccagcacaaaaagactgtaaactaaggggaaattacatggaaaacgagaaaaatattgaagtagcaatgtattcttatagttactcaggaaactgctgttcactttgacacacacatgcatctcttccctccttaaactgcctatatgtgattcgatagtacagtagggaaattatatttaacagtaatttattgtatatttttaaatatctagaagagaaaaattgtaatgttcccaacacaaagaaaagatgaatgttggaggtgatggatatctcaattaccctgacttgatcattacacattgtatacatgtatcaaattatcacgtgtaccccaaaagtatgtacaactatgatatatcaattttaaaaatttaaacagggtcaaaaatgtctattctgacctgagcatattggcctataatgatggtaaagctgtgtgactctgagcaagttacttaaactctctgagaagctttagagcttctcatttataatatagtaatgctaattcctacctacttcacagggtttttgtaagggttaaatgtatatcaacataaagtttctagcacacagcaggtaattgatagatgttaatatccttatcattagaggggataggtcaacttagtgttggaacttaaacttgcactcatctaaaagcagcaaacatttcccccagcttgttgtttaagtagtcgctaatgtgtagaatttaacccagccccatcagcagctgctaaaatagcagcctgggtttcagtttacttgactgcatacaactgggctaaggttatgttggagaaatggtcagtaactagtaagtctaacgtataactggtcctggggaaatgccatatttttaatcttgaaaagtcgactcattcattgttatataagataatcctacttcctttttttgtttgttttttttttttttttttgagactgagtttcgctcttgttgcccaggctggagtgcagtggtgcgatctcagctcactgcaacctccacctcccaggttcaagcaattcttctgcctcagcctcccaagtagctgagattacaggtgcccgccaccacgcccaggttattttttgtatttttagtagagacggggtttcaccatgttggccaagctggtcttgaactcctgacctcaggtgatctacccacctcggcctcccaacgtgctgggattacaggcgtgagccaccgcgcccggccaagataatcctacttttctaggaataaagtgatcccactcctaagggtgatgtgactccagtttaactcattcatcttcatccctatatttccccatggaccttgattatggtgtagcttcacttggaaacgctcaagaaggaatgaaagataccatatgggaggcattgataatgagagctgtttattgccattcacctgcaaacactgtctgtgccgcctgttcatgcatatcagacacacaaacattcttcatttacttaaggtacatggagaaatgatgacatgctcacattttgggagaaattccccttctacttggatgggtttccttctttgttcaacagggccagaattttatctaaagggagtacaaaggccatgatgccttttccaggtaaaattctatatatcttgtccccttgtcctttatcacttttatggttaaatgaataagtaaatacataaaatgtgttttcagtataaataaatcatacagaaaataccaaataaatcacttgctgcaattaaatgtttggagatcattggctctaaggtgacacactattcttcacagtaatttagcaatgagcctactgtgacctctccatcaaaatggaatcaagtcacaatattgccttatctttctatggcttctcggtgacaacaatttgggtgactgcacagattttagtgtcagtaggtagagctgtcgctctgaggcaacaggattgaaccctagtccacttgggtgagattaggggtaagaagtagcagcaaactttgtcatgttaacccacctaaaaaatattcagcccttcatacccattggctggaaatctccagctccttaatctcagttcttcatattccaagaacctaagactgcctctctggtagagcaatcttggtagtgttcaaggcatcaacaaaatagcaggctctaaactgattctgtgatgtttttgcaaatggcaagatgccctttattagatagtctccataggggttctggatctttaattacttgatcatatttacggctctgtctttataataatactggccttcaccttttcaaggcccagtatcctggcaaaaacatcaatttggacatattatggaataggtggagatgagaatgccatatctgagtgtggtgcaattatttcagaattgttgtaaatatgctggaacattttgtgagaagaggtaaatgacagtacagaactggttgagacaagaaaattggaaaatgattggagcaaaaaatgaaaaggagctagaaaggaataaggcaggaagcaaggaataaaaacaacttgggtctgcttatccattagctgatgtgggggaaaaaacaacgtgggtcaggataacagtctcctttctccccccaaaaaaatattttaacaggggccagaatgacactgcttagtccataggtggcctaatagtggactcatttgatctaggcacataatgatatttttatcttagtatataatgagtggtaattaagctgtcactggcactgggaaaagatcaaaatgtgagtgtgcagttttcttcattcctcaccccataatggcagatgttaggagatattttgctgcacctctctatcctttgactcatcatcttactcactattcctgccttcttactggtggtatcttggcctttaaatgaagctgtttcctttggaccctagtgatccttagagttcagaggaaagaggctatgtaatatagtcagcaatatcatcacattcatcttattctcaactaatttttaaaagtacttacctaaagtatcaaagagctacagagcacattttaaggtgagctgtcatcttatttcttcacaaagaatgttttgagttgatatgacgatgtatcataagtgacaacagaatgcatgatccacagaatatttatttaaaactgactataactcttctaggctccaaaggtctgatttctttcaaagtagctgatgacattaagcactcttacattcattatttctctcatctgagcccccaacagccctgttaagtagaaatgacagggatcttcatctttattttacagggccacgtactaaggtgataaagccattactaaggtgataaagtaatatattattacttcccttgtccttagttttctcatctgtaaatcaagatgataattattttcctctcacagtgtaatgattttcaagtggtaggatggatatgatagttttattaaactgtaaagccctctataatcctgttaccatattcacttataaattccttaactttagttagaagtagcattggaaaaaataaaaagtatgactttctaagatgtgcaaaaagctgttcatagataagacactattgtgttcttttgataagtttgagccaacagaagtacctcaaataaatgccagctctcaattacagatgttcatcaagttcagaacctactgcaacctcttctctcgttttcttattttttttttttttttttttttttttttgagacggagtcttactctgtcgcccaggctgaagtgcagtggggcaatctcagctcactgcaacctctgcctcccaggatcaagggattctcctggctcagcctcccgagtagctggaattacaggcgcccgccactatgcccagctaatttttgtatttttagttagagacggggttttgccatagtggccagactggtctcaaactcctgaccttaggtgatccacccgcctcggcctcccaaagtgctgggattacaagcgtaagccaccgcacctgaccattacttttcttttaaaggatgttttatatgtaaagagttcaacttgattgtatagagcagcatataatgagttgaaggttgccctaccagtcttggggcgagtcagtccaccttgatggccccaccaaagactgaaccctagctctcagcccagacatctcaaaagcctgtgattgaatagcaggaccatgagctttgtactaactcaatgttaggtttgaatcctgattcccctcctgctaggcaggtgggcctgaaagagttacttaacttttactgagtctcagtttccttatatattaaaggagatagtaataactatcttgtaagaccattgtttgaattaaagtaataaatatatttaaagtgcttagtagaggatcactcaataaacattaatctttccttcccatattgtggacatatagtgtaaccaggtgagcttgtggatggatccttgtagaatcccccagtccccaactctgggagaaagtttttctgagagcatatctttaaaatggggcaggttacctacatcctatctgaatactaatgctagcactattatagatatacatgtgcagcacagacatcatttttaacagatgtgtttagttaagtaacagatttagaaagtgcagactttaatctatgttttctcctgagatttcatcaccatctgatttctttttttcttgctaaaaagtataattgtagcttgatttcccccaccccccagttatttccccaagaaataggggcctttttaaaaatttgaataagaagctggataagcatttgaaagacatgaggacagtggatacctgaagaggtaagaagttgaggactttaaagtaaaagccttaatgactaatatattttttcagaaggtcctgcttccaccatttctgcaaggaacagatgactctaaagatatcatatcaaggtctgctttctgcttgttgcataactggatggagtaataaccaagattgaaactgtcattggttaaaggagactaaatggagcaggtcatggaaattgaggtgtttctttctttccccaaggaggggctggagagaaaaagtagcagagacttttgtcatcagctttcaggggcagaaaacattggttcctctctcctctgacctgcctctccacctaaaaacctgaatggattctggattccacttcaggctgttttgagttttgatagaataagtttgttaagatgttggggaaaagcaaaatatggtcttccaggatagccctggtggggagaggtagaaaatggtgggataaaaagtaggattatactagggccatgtgaaaccatccacactgtagtggaggagcttgactgcatggcagaaggcaaggtttttcaatttatcctaaaccatatcccacaatgttccacggctctgtctccattcagcaaatatttgcagacactatataggctgtaggaactttatcattcccattgcttttggcaccacaaaatgtcttagagatcaacagaaaagatgaaggaaggacctgattgccccattcaggtagttctccccattcttgtagttctgcttagttgctttgagcactggtttctgtgtccccctccttgaattaccacaggatcctggggattccacttcacaatttaagagtatcctatcaggaattctttaaatggtactctgagtggtgaagagggagaagaagataagtactaccacttttgtggacccactatgagccaggtactgtacttctttacacatacacacacacacacacacagagtgagagttaaattttatttgtatgtaaaaattgtataaccatgtaagcctatgaggtaactattatttttattagacagataaggaaactggagcttggagagtttcagtgatttatccagcatcacatagctactaagtggaagacagagaccagaaagcagcctagtgatttcattcaatactgattaatttccctttctccccaccctcacctctacccagctccaaaagaagataacactacttaaatattagctattattatcattttcactattattattatattatataccgtatgcctttggaaccaaaataggtgtagagagaaagaaactaaactactaagccctgtactagacactgagagaatgtttagcagtaacaggtagctacttttagacaatatccctaaggttgatttaagactttttattccacagcccagattatacagctgaaatcagggatttcaaactaacctctaatgttagccaccaccaccaccttcatgctggagccattccctaggccaaaactacctcagtactgtcagtacccaaattcaagacctgaagatcgcgaccagtcatgagatactgggtggctaaggcaaagtacatttgttgtcttagaaacccagagcagccatatgccactaaataaatttatgaaatcaactttataagacatattgattataaatatactaaaacaaccaatttgataaaggtatagagtatgcaaattttgataaaggtatagagtatgcagatgtgtgggacgatagaatgttatataacaaaactggagctgcattgctaggctaaaaacaggttcttttattctctttgcctttattttttaacatatgcaacaatttaatctttgatgattaaaaaggttgcagagaattaaaatatattgctataagctattataaatatcagtctactgtatagtaggttcttattttcataaataaaaaactgaagctgagaaactaccacaagaccaaaagcttattttaatttttataagcaaaggtcaattctttgaacaaagtctaccccattgggctatgactgatagttaataagtaatcttatgaatttttctttatacataaagaacaaacatgggaaaatctgggctataatccttgacaagatatttcttacactgcttcttgcctaaagggttaaaaagtactagtatggttgcacatcatgcaatactgactttgcaaaaagggtttgtataactgtatatagattctccaagttggaaaactgaaaaatctaatttcaaaaatataagtaggcactgaacatatatatcaatatgccaatgacaaaaagaaacatacatatctatttactttctatttccagacacagcaaagataaactaattttgtaatgctttctacccactgtaggtattgttcacagattaaataaaacttttccaggaaaatatgccatatacataaagccaatcagatatacttcccagatatttaggaaaatccaatatagagaacagaatgaagaatgggtgaattcacaaagtaataagatataataaatcatctaaaatgagtaagaactagaattcaagtacaagattcaaatgaggttaagtgatagccagaaaaggtcatacaaagtaacatccaaatatcacctcagaagcttaacatacaaacaaatttcaagtcaggacagatacacacactaaatgaagaggggtttatgaacggggactaattttataagtggtacaagagtgaatattttgcttccctacacaatttctcctgcaacctcatagcagcagggatttggataacaaattcatagccaatgagaaacccctgtgtgtgtatttatattacctgtgtatataacaacaggggatataagtcttggtttgactatcttagggtggtacatacagtgtatcttgatcaggaccacatttataaatgatttttttatagtataatactgtaccaaggttgtcagggaggtccttttcatatacaatctctccaagtactgcagtccctcatctttcagtaactccagtggaaaatggtgcagattcctataatttaagaacaaattcttgtgcttttccagccttgccacagagttcgtcttacaaagttcggataccgtgactgaatatatcccatcagacacattgcagcagtacatctttacaaaattggtcggtttctcagcgctggcagagccagtgctccggagctcaagtggcactggaaggactctttgcctttatttctctgtagtttcttttcatagtgttggcatttgattttccttttaattttcaggttatatttgcacttaattggcactgtagcaggttcattgcatgttgtgtgccttctgcataccttgattgtaatcgaacctgggctagaagggaaattgaagagtacagcaggcaataaaatccagacaagtagagtgtcattttatccagctttcaaactctgtaccgagtcctggagatatgtggcagagccttctgaaaggaaacacaggtgttttgtttttgtttttgttttgatgggaaagaggtggtgccaaggtgctaagggcatgaaccctcatcttcctaggccagtttgcatgtatcttaattgctttggagacactatcatgattttggctgagaaaaaaaaaaaactatagatcagttctttaagattttcaaaaacctacagcattcctccagtgccctaagcctcttgttcctgacaaatctctctgtgctttataaaaacatgcccaacatgacttgagtccatacaaagaccatgctccttgttgctatgggcccatattaaaggctgtactttgtgtcagactgtacgaatgtgttctgtttttctttttctcacgcacatggctgggtagcctgagcgggacccagttttattagctttgctgtgttttcttttatgtcttttttaaagctcattgaattggtttaagatttgtacaagtgattttcttactgtcacatagagttaaaattatctagtccagcttctccatccaatgtttaaacctgttctttaatgttgctgaagttttgcccagccactgctttagtacttctattgatggggagctcactgttttccctatgctcttcttatagcacccgtttcatctttggacaaatctatcagtctacatgttgagctacagtcttcctccctcacgttactttccattgtggtctaactaaacacatttcatttcactcttttgtgatagctctttaaggatctgaagacagaaagcacatttcttaaattttctcaaaacatcagtttcggggaggctggccaagatggccaactagaagcagctaatgcgtgctgctttcatggagagaagtggcaagtagatacagcacctttaactgaaacatccaggtacatgcattgggatttatcagggaaacaatccaacccacagagaatggagaaaatcaaggcaggatgaccatccagccaggagtgacatggagccaggggaacctccctcacccagggaagtggtgaatgagtgagcaacactgaagacacatgctttttttcatggatctttgcaacccttgggtcaggagatcccttagtgaacccactccaccagggcctgcagtctgacacacaaagctatgtggagtcttggcagagcagctggtaaggcacacgtggagccctgggagctttagatatccgggcttcccagcaaaagaggctgcaactccagcaaacctggaggttagaccccccctcccatacatacctctagaaaaggggctgaatccaggaggctgagcagtgatggtctgcagaccctacttccatggaaccttgcaggataagacccactggcttggaactttaaccagccaccaatagcagtgttacacctccctaagacggagctcccagagggagggcaagctaccatctttgctgttattgccttcagtgcagccaccctttggtaaaccagtcagactgctttttttacatgggtccctcaccctacttctcctcactgggtgggacctcctgactggggtcaccagccacacttgccggggttttccagctgtcagtggttctgagcctccctgggatggagctcccaggggagggatgggtagccatctttgctgttccagttgactgactagagcagtcaactgccacagtacagcagctctacaaagaatcagccagactgccttttcacatgggtgctggatcccgtttctcttcactgggcagaatctcccaaccgaagcctacaaccatccttactggtgtgttcaggccagcaacaagtccatacctacctgggatggagctcccagagagagggacaggccgccatctttgctgtttcacagccttcactgtcgataccttaggtgctggaaaatctgaagtgattagggactggagcagacccccagcatactgcatctcagccctattgaaaagtggccagactgttatatgggtcctcaatcctatatttcctcactgggtgagtcctcccaacctgggcctccagccaccctctgctgggcctatcaagccagtagcagctctgcagctccctgggacagagctcccagtgggaggggcaggttgccctctttgctgtcttgcagccctcactctcgctgtctccaggctttggagagtccatgaggactaaagactggtctggacccctagcacagagaacccacctcatggaaaagtctgttctccatgcagttcgcagtcctcacttctcactagtcagggccactcgacctaggactgcagcacaaccaccctgcccctgcctgaccacttcaatcagaggcagccaagcagtgaaaggaagacccacacacagagatgagaaagaaccaatgtaagaactctggcaactcaaatggctagagtgtcttatgtcctccaaatgatcacactagttctccaacaagggttcttaaccagactgaattggctgaaataacaaatagaatgcagaatatgggtaggaaagatcattcagatttaggagaatgccaaagcccaattcaaggaaactaagaatcacaataaaatgatacaggagctgacagatgaaatagccagtataaaaaaggaaactaacagatctgatagagctgaaaaacacaagacaagaatttcacaatgcagtcacaactattaacagctgaatagaccaagctgaggaaagaatctcagaacttgaagactggctctctgaaataagacaaaaataaagaaaaaagaataaaaaggaacaaacaaaacctctgagtaatatggggttatgtaaagagggcaaagctacaaatcattggcatttctgaaaggaagggagagaaagcaaacaacttggaaaatatatttcaagatatcatacgtgaaaacttctccaaccttactagagatgccaacagtcaaatttgggaactacagacaatccctgcaagattcaacacaagatgatcatcccaagaaacatactcatcagacttcccaaggtcaaaatgaaagaaagaatgttaaaggtagctagagataaagggcaggtcacctacaaagggggcttcatcaggctaatagcagaaaccctacaagccagaagagattaggggcctatattcaacatttttttttttttttttggagacagagtctcactctgtcacccaggctggagtgcagtagtgcgatctcggctcactgcaacctctgtctcccaggttcaaacaattctactgactcagcctcctgagtagctgggactacaggtatgtgccaccacacctggttacttttttttttttttttttttgtattttcagtagagatgcggttttaccatgttgcccaggttggtctcaaactcttgaactcaggcaatctgcctgcctcagcctcccaaagtgctaggattacaggcatgagccaccacacccagtctcaacattcttaaagaaaaaaatcttcaaccgagaatttcatactcagccaaattaagcttcctcagcaaaggagaaataaggtccttttcagataagcaaatgcagaggaagtttattacaaccataactgccttacaagagatcttgaaaggagcactaaatatggaaaggaaaggctgctaccagccaatacgtaaacaaacttaagtacactgtccaatgacactataaagcaaccacacaaacaggtaggcataataaccagctaacaacataatgacaggatcaaatccgcacatatgaatactaatcttgaatgtaaatgggataaatgcctcatttaaaaagcacagagtggtaagctggataaaaagcaagacccaatgataagccatcttcaagaaacccaacttacatacagtgacacctacagtctcaaaacaaagggatgaaggaaaatctaccaagcaaatggaaatcagaaaaatgcaggggttgcagtcctaatttcagacaaaacagactttaaaccaacacagacttttaaaaagactaaaaagggcattacataatggtacaaagtttaattgaacgagaagtcctaactagtataaatatatatgcacctatcacaggagcacccagattcataaagcaagttcttagagacctacaaagagacctagattcccacacaataatagtgggagactttagcactccactgacagtattagacagatcatcaaggcaaaaagttaacaaagatatttaggacgtgaactcaacattggaccaaatggacctgatagacctctacagaatgctccaccccaaaacaacagaatatacattcttctcactgccacatggcgcatactctataatcaaccacacaatcagacataaaacaatcctcaacaaaggcaaaagaaccaaaatcatatcaaacacactctcaaaccacagcacaacaaagatagcaatcaggactaaaaaaaaactcacagaaaacagtgcaatagcatggaaattcaacaacctgctcctgaatggcttttgggtgaatgatgaaattgaggcagaatgaacaggctctgaaattgaggcaataataaaaaccctaccaaccaaaaaaagtccaggaccagatggcttcatagccgaattctaccagaggtacaaggaggagctggtaccattccttctgaaactattccaatcaacagaaaaagagggaatcctccctaactcattttatgaggccagcatcatcctgataccaaagcctggcagagacacaacaaaaaaagagtattttagaccaatatccctgatgaacattgattcaaaaatcctcaataaaatactggcaaaccgaatccagcagcacatcaaaaagcttatccaccatgatcaagtggacttcatccctgggatgcaaagctggttcaacatatccaaatcaataaacgtaatccagcatataaacagaaccaaagacaaaaacaacatgattatctcaatagatgcagaaaaggcctttgacaaaattcaacagcctttcatgctaaaaactctcaataaattaggtattgatgggacatatctcaaaataataagagctatctatgacaaacccacagccaatatcatactgaatgggcaaaaacgggaagcattccctttgaaaacgggcacaagacagggatgccctctctcaccactcctattcaacatagtgttagaaattctggccagggcaatcaggcaggagaaggaaataaagggtattcaattaggaaaagaggaagtcaaattgtccctgtttgcagatgacatgattgtatatctacaaaaccccattgtctcagcccaaaatctccttaagctgaaagcaacttcagtaaagtctcaggatacaaaatcaatgtgcaaaaattataagcattcttatacaccaaaaacagacaaacagagagccaaatcatgagtgaactcccattcacaattggcttcaaagagaacaaaatacctaggaattcaacttacaagggatgtgaaggacctctttaaggagaactacaaaccactgctcaacaaaataaaagaagacacaaacaaatggaaaaacattccatgctcatggataggaagaatcaatattgtgaaaatggccatactgcccaaggtaatttatagattcaatgccatcaccatcaagctaccaatgactttcttcacagaattggaaacaactactttaaagttcatatggagccaaaaaagggcccgcagtgccaagacaatcctaagccaaaagaacaaagctggaggcatcacactacctgacttcaaactatactacaaggctatagtaaccaaaacagcatggtactggtaccaaaacagagatatagaccaatggaacagaacagaggcctcagaaataataccacacatctacaaccatctgatctttgacaaacctgagaaaaacaagcaatggggaaaggattccctatttaataaatggtgctggaataactggctagccatatgtagaaagctgaaactggatcccttccttacaacttacacaaaaattaattcaagatggattaaagacttaaatattagacctaaaaccataaaaaccctagaagaaaacctaggcaataccattcaggacataggcatgggcaaggactttatgtctaaaacaccaaaagcaatggcaacaaaagccaaaattgatagatggtatctaattaaactaaagagcttctgcacagcaaaagaaactaccatcagaatgaacaggcaacctacagaatgggagaaaatttttgcaacctactcatctgacaaagggctaatatccagaatctacaaagaactgaaacaaatttacaagaaaaaaaaacaaacaaccccatcaaaaagtgggtgaaggatatgaacagacacttctccaaagaagacatttatgcagccaacagacacatgaaaaaatgctcatcatcactggccagcagagaaatgcaaatcaaaaccacaatgagataccatctcacaccagttagaatggcaatcattaaaaagtcaggaaacaacaggtgctggagaggatgtggagaaataggaatgcttttacaccgttggtgggactgtaaactagttcaaccattgtggaagacagtgtggcgattcctcagggatctagaactagaaataccatttgacccagcgatcccataactgggtatatacccacaggattataaatcatgctgctataaagacacacgcacacatatgtttattgtggcactattcacaatagcaaagacttggaaccaacccaaatgtccatcaatgatagattggattaagataatgtggcacatatacaccatggaatactatgcagccataaaaaaggatgagttcatgtcctttgtagggacatggatgtagctggaaaccattctgagcaaactatcacaaggacaaaaaaccaaacaccgcatgttctcactcataggtgggaattgaacaatgagaacacttgaacacaggaaggggaacatcacacaccagggcctgttgtggggtggggggagggggcagggatagcattaggagatatacctaatgtaaatggcgaggagttaatgggtgcagtacaccaataatgcatgtatacatatgtaacaaacctgcacgttgtgcacatgtaccctagaacttaaagtataataaaaaagaaagaaagaaagaaagaaattgaggcagaatttaagaatttccttgaaactgataagaacaaagatacaacatactagagtctctgggacgcggtgttaaaagagaaatttacagtgccaaatgcccacatcagaaagctagaaatatctcaaattagacaccacaactaaaagaactatagaagcaagagcaaaccaaccccaaagctagcagaagacaagaaataaccaaaatcagagctgaactgaaggaggtcaagacacgaaaaaccattcaaaagagaaatgtaaataggagttggttttttgaaaaaaaatattaagatagataagccactagccagactaataaataataaaggagagaagatacaaataaatacaatgagaaatgacaaagaggatgttaccactgacaccacagaaatacaaacaaccaccagagactactacaaacacctctatggacacaaactggaaaacctagaagagatggataaattcctggacacatacattctcccaagactgaaccagggaggaatttattttctgaacaaggaattagtaacaagctccaaaattgaatcagtaataaatagtctaccaactgaaaaattgcccaggaccaggtcgattcacagccaagttcttcaagatgtacaaagaagagctggtaacattcctaccaaaactattccaaaaaattgagggggagagacacctctctaactcattctatgaggccagcatcatcctgattcaaaagcctggcagagacacaacaaaaaataaaactttgggccaggcattgggggtcatgcctgtaatcccagcactttgggaggccgaggcgggcggatcacttgaggtcaggagctcacgaccagcctgaccaacatagtgaaacccatctctactaaaaatacaaaaaaaatcagctgggcgtggtaatgcctgcctgtagtcccagctacttgggaggctgaggcaagagaatcacttgaaccagggaggcggaggttgcagtgagccaagattttgccgttgcactccagcctgggcaacagagtgagactccatcttaaataaataaataaataaataaataaataaataaataaataaatcttagggccaataaccttgatgaacattgatgcatcaatcatcaacacaatacttgcaaactgaatccaggagcaatcaaaaagctaatacaccatgatcaactagacttttccctgggatgcaaggtaggttcaacatatgcaaatcaataaatgtgattcatcacataaacacaactaaagacaaaaaccccatgattatctcaatagatgcagaaaaggctttgttaaaattcagcatctcttcatgttaaaaattctcaataaactaggtattgaaggaacatacttcaaaataataagagccatctattacaaacccacagccaacatcatactgaatgggcaaaagctggaagcatttccattgaaaactggcacaagacaaggatgtcctccctcaccgttcctattcaacatattagaagttctggccagagtaatcagacaagagaaagaaataaagggcatccaaataggaagagaggaagtcaaactatccctatttgcaagtgacgtgattctgtgtctagaaaatctcatagtctcagcccaaaaattccttcagccaataaacaacttcagcaaagtctcaggatacaaaatcaatgtacaaaaatcactagcattcctatatgctaacaacatccaagctgagagccaaatcaggaacacaaacccattcataattgccacaaaaagaataaaatacctaagaatacagctaacaagggaggtcaacgatctctacactcagaattacaaaacactgctcaaagaaatcagagatgacacacacaaatggaaaaatagtccatgctcatggataggaagaatcaatatcattaaaatggccatattgcccaaagcaatttatagattcaatgatattcctatcaaattaccaaggacattcttaatagaactagaaaaaactattttaaaattcatatggaaccaaaaaaagagcccaagtagcccaggcaatcctaagcaaaaggagcaaagctggaggcaccaaggttacccaacttcaaactgtactacagggatatagtaaccaaaacaggatagtactggtacaaaaacagacacatataccaatgggacagaaaagggagtccagaagtaaggcctctcacctatagccatctaatcttcaacacagtggacaaaaacaagcaatgggtaaaggactccctattcaataaatgttgctgggataactgtctagatataggcagaagattgaaactgaacaccttctttacaccatatacaaaaatcaactgaagatgaattaaagacttaaatgtaaaacccaaaactataaaatccctggaagacaacctaggcagtgccattttggacataggaataggcaaagatttcatgacaaagatgccaaaagcaaccataacaaaagcaaaatttgacaaatgggacctagttaaactaaagagcttctgtacagcgaaagaaactatcaacagagtgaacagacaagctacagaatgggagaaaatttttacaaactatgcattcgacaaaggtctaatatccagcatctttaaggaacttcaacacatttacaagaaaaaacaaacaaccccattaaaaagtgggcaaaggacatgaacagacacttttcaaaagaagacaatcatatgaaaaaaatctcagcgtcactgatcattagagaaatgcaaattaagaccacaatgagatgacatttcatgccagtcagaatggctattattaagaagtcaaaaaataacagatgttggcgaagttgtagagaaaaataaatgcttatacactgttggtgggagggtaaattaatttgaccaatgtgaaaagtaggtggcaattcctcaaagagctaaaaacagacctaccattcaagtcaataatcccattactgggtatatatgcaaaggaatataaatcattctgttataaagacacatgcatacatatgttcattgcagcactattcacaatagcaaagacatgggatcagcctaaatgctcatcagtagcagataggataaagaaaatgtggtacatatacaccatggaataccataaaaaaagaacgaggtcatgtccttcgcagggacatggacagagctggaggccattattcttagcaatctagtgcaggaacagaataccaaataccacttgttctcacatagaagtgggagctaaatgatgcaaatacatggatgcaaataggggaacaacagacactggggcttacttgagggtggagggagggaggagggagaggatcagaaaaagtaacgattaagtactaatctttgtccctgggtgacaaaataaactgtacaacaaacccccatgttatgacctatataacaaatttacatatgtatccctgaacctaaaataaaagtttttttttaaatcagttttgagtcctcttgttctagactttttatctaaatgagttccaatttgtctatatcacttatcaaagtttattagaacatatattcattctgttcctgccatcttaatgacatcatgtttcccctgcttaatccttctttgtgtctctgtagattattaattttttatgttagatcattttaaaagatgattttaattaaaataatacctacaaccccttcttcccacccactctcctcttccccaagagacagacattctaatttggcatgacattatctggcctaacagtgtctggcatatgaagtgcctaaaaggtcatcttccattgttttagccttctggagtagttgaattaagttcaaactcagaatgtttttcaaatgttaagtctctctggggatgtttttcataacatcttcgaactggctaacacgactaaatgaaacatgctgcactggattaaaaggttatttccctagtgtgtcaagctaacagagaacatgaaacttcccatcaggcactgggcatctctggttgtcagtctagcaacattgtctccattaagttcctaacccccaccgctcagagaacactttagtcaagaaactacccttcacactgaatcttgagtggcagaaaggcaaagaaaagaagatgtaggaagagtcagaaacaagcaaaagaaataagggactctgtgagctaataacctgagtctaggtaatcaagaccaaagaccgatggaaacccattatttgaaattaaggaagaaacctcatacaggatcagagccaagcaaaaaatggacaatggtctaaaatgggcaaagagtaattctggtaagttagaatattgaaggacaggacaagagtctctattccatggagataagatacccgcaatttaccacattagaatggttacctaagaaagactgtggaaataaatcagaataactgaataatggcaaaagggaagcctttcttggatcactgatgaattgaagaatatgatgacatcaacctctgcacctgagaccaataaaataaataaaaccctaggccatcccatgcaaatagacaagttagttaggaaacaagaataacagtgctgtctagtagaactttctgtgataatgaaaatgttcggtatctgctctgtccaatattgtaaccactagccacaggtgattactgagcacttgaaatttttctagtattactgaagaactgaagttttaattaatttacatttaaatttaagtagctgcatatgactagaggctattatattggaggggacagattggatgttgcaagtgagcccaaatcctggcacagaaaaggtaagtgtacactgtagttgcaggaaacagcgttcatccttgccctctccaggacctgtttcgcccatcagtaggtgaacttgcagaaggctagcccctagaagttctcccctactgtggatttggctgctagatttgggaggagtcctgcagagctgactattgttcaagaaatgtgggcttcggaattgcatgtgcaatgggtgtttcctatgcagactttaatgagcacagcacccccagaatgccacgtgtatggctttgggcatcagccaggattggcttgagttgggtgctacctagtgaactatttcaaactatggtgctctgaggacttctttgctgccttgggtatgggtaacagtaatgagttgtgaggggtcagaatagagagttaatagtataaatgattgctaggctattacagaattctaactagaatggcaacatacttattcttaggcccaacccctcttcttttctgatattccactcttcttagccctgtatcctttcccttgctcctggatagcccattccttgtctcatgtggcaaataaaaggaatatgagaaaatgcttctaatgggggtggggggacatggccttattaacacgtgtgtttgggttcctgggtgcttttgtggaattattgaaattttcctttcctctgttgaataaaaattaaacagcagttgtaaaagtattgtacagatggtcaaagtcatcttaaagtactttccccatatataagtagccaataactatcatgtacccacaaaaattaaaaatttaggccaggtgcggtggctcacgcctgtaatcccagcactacgggaggccgaggcgggcggatcacgagatcaggagttggagaccagcctgaccaacatggtgaaaccccgtctctacaaaaatacaaaaattagtcgggtatggtggatcacgagatcaggagttggagaccagcctgaccaacatggtgaaaccccgtctctacaaaaatacaaaaattagtcgggtatggtggcacgtgcctgtaatcccagctactcaggaggctgaggcaggagaatcactggaacccaggaggcagaggttgcagtgagcgtgactgcactccagcctggatgacagagtgagactccatctcaaaaaaaaaatttttaatttaaaatttaccccagtggagttcacttactgatggaggatgcctgagtcctttgacctttggcagtgacaggtcttctggctgtgaaaaggtctaagcatttatcagcctatcagtttgagcatgactgctgggctccactacaagcatatctgcaaaaggagtgtgatgagggtgggatctgaaacagtagttttaccacttggcatggattgcctagcagttgtgtacttagtgaaagcaagtccagagttaagtgggaagtgcacttatcttcatggagtgatcagagatggatttatttatttatttatttttcctgtagggcccaagcctgtgaaccaaagggattttttttttcttggtgaaagaaattcacgttgaaccaatatctagaagacctatctggggatcaacaaggctaggagaatattttgaaagtaaaatcaaaatacagaaataaatatttgagccaatctaagacttgtcccactgagagatacctgctttgccaagtacatgcctacctctctaagattgtaagtgctttgaggctacagcttgtgtttctcacttctgttttcctcatggcatagtctaacatataaaacaggtatttaataaatgtgaaaaaacttaacatacatccacacccatgtgacagtcccagccttccagcaagctgtttgtattttgtttccacatagccaagagaggtaaggaagtggagtgctcaagtaagccccagattcacagaccttcttcagtgttgaactatgctgttcttcactgcttagaatatagaaagggtatcactgtttcaagtacacatgttaggatggcctgggaactaccctgatattaagaaggaaggccagagattttatggatggtaaaactgaggctcccagttacctgtaacagctacctcagtatctcatgggaaaactacagtgggaccaagattgtttcctgggccaggacagtagtatcactttttttaatgggatgttttgtatttgagtatgcattgtcttcaatttacttggaaccatttatgcattattcttgtgtacttacctaaaaatatctgatctgtagggaaatgaatagatagttctataattcttaggggttctgaaatatagtaattaatttgatgtttatctctttatggtcttgttttctgctttggaagttagaatgaagtcagaaatgagtaaaagaaaactatgatcacttggaattttatatatgtatatatatgaagaaaaagaaggctgggtgcggtgactcacgcctgtaatcctagcactttgggaggccgaggtgggtggatcacaaggtcaggagttcaagaccagcctggccaagatggtgaaactccatctctactaaaaatacaaaaattagccaggcgtggtgtcaggcgcctgtaatctcagttactcaggaggctgaggcaggagaatcacttgaacccaggtggcagaggttgcagtgagccgagatcgcaccactacactccagcctgggtgatagagtgagactccgtctcacaaaaaaaaaaaataaaaaaataaaaataaaaaaagagaaagaaaagaaaaagaaagaaagttgggccaggcacagtggctcacgcctgtaatcccagcactttgggaagctgaggtgggcagatcatctgaggtcagaagttcaagaccagcctggccaacatggtgaaaccccatctctactaaaaatacaaaaatgagccgggtgtggtggtgcatgcctgtagtcccagctactcgggaggctgaggcaggagaatcacctgaaccctggaggccgaggttgcagtgagctgagatcacaccactgcactccagcctgggcgacagagcgagactccatctcaaaaaataaaaaataaagaaacttttgtacttgtcatggtatccctagtccctctattctccccccaaaatttcaaatggtatcttaactggtcattattaaatagctgaatttattttagcacttccaaagaattcccagcttttttcatcttccaacttccagtcctttatattgcatcctgcttccatgatggaagaagaaagtcaccataatttttttgagtgtacatgaatgtcctgtgtgtgtgtgtgtgtgtgtgtgcgtgtgtgtgtgtaaggaggaaatgtgttgcttgggtgggtatgccttggggtgacaatacagagctctagaaccagaggctggaagagcagtgcctacttctcagatggattttggctttatctctacttttcacttctcctcttgggataagtaagaacagctttcttatttctgacagcatttcctccaataaagacaaacaaaaagttagtagccctctgattagtggttatttttattgataacttacattccacttggtaagtaacttggtgctatggggatatttctggactagaaggcaacatacatcccacatccaagaatgtgtatgtgttaccaaatcactatgtaacactggcaagtagtttcccctttctgggacttggttaccccacttgtaaaatggggagtttgggatgagactatcttccaagatccttccagccctgtggtttagtgattacatttctgaaaagaatgtaataacattttttaaaatgcagttaacaggataaattagtaataagaaaatagattagaaaccatatggagaaagtcaaaagataatttagcctaaagttattgcgctcaagcattaaatgtaactcagtgctgcctggcaacaaaagcactctttgattaggatatagtccttatataaatgcattctcagaaagggccaggctatagtggtgtggttcttcagaggactcgccatcttccacacacaaatgggtcttccaggttgatctctctgttcctaatataccattatactgcccatttggatctagagtcaaggagaaagtgactgtctttagaaagaaataccccacctgagaaacagtgattatactcttctgtcactctttcctcagatttgagaaagaaagcaggcagaagtcctgaaaataaaattctttcacaaaggcaaagggactcagatgtgtcagtgaagttgagctacctatagttataaggtttaaaagttaagactagtgaggaggctggctattcttgacttgaacctaatagtgcctctgcttgttctttctacccctaattccagtcttaatgaatattgtttcctggcatttgtatagtgctttaatatatacagtgcatttgtacatgctttctcattgattcatcgtcttatgcacctactcttcttgaaaatttctttagagtgatgtcacaaaaaatggtacagataaaaccggtacagagagaaagaaaagggaagggagacccaaatgttgaggcactgagctaggacacaaatgcagccactatcacttctgcctaggaacatgatggcaaagagggtccctcttagattggtggctgccaaaaatgaaggcaggtgatacatacggagccctgtcgccgccagcagcaccctacttgctacccctgacaggattggggtatgtgtgtataaaaatcagaggcatacaggaaaggacatgagatggaagggattaaagagttccctcaggctcatctcagtatcacacaaaacttaaatcagaatttattcttgcatgtcaattttttgtagtacatgtaattagtttcaatttttaaagacgaaaaaataggctgggcatagtggctcatgcctgtaatcctagcactttgggaggccgagacagccggatcacctgaggtcacaagttccagaccagactggccaacatggcgaaaccccgcctctactaaaaatacaaaaattagcttaggaggataaggcaggagaaccgcttgtacctgggaggcagaggttgcagtgaagcaagatcgcgctgttgcactccagccttggggatagagcgagactctggaaaggaaggaaggaaggagggaaggaagggaaggaagggaaggaagggaggagggagggagggaaggaaagaagagggagggagggaaggaaagaagaggaagggaaggaaggaaggaagaaaagagggagggagggaaggaaggaaggaaaggaaggaaggaaggaagaaaagagggagggagggagggaaggaaggaaggaaaggaaggaaggaaggaaggaaggaaggaaggaagggcgtgatggtagcctgtaatcacagctactcgagaggctgagtggcaggcggaggttgcagtgagccgagatcatgccactgcactccagcctgggtgacaaagccagactctgtttcaaaaaaaaaaaaagagagagagacagagagaagaaagaagcaagaaagaaagagacaaaaattaaatgaattctagattgttaggaactaaaagaacccttagatataatctagtttttctcccttattgtatagctagtaaaactaagtaccagagaagggagggagcttgtctgaggacacctagctaatgatcgtactctgtccattatacagtatcccctcttctatatgagttttttgtgcatatcttttgaattttggaattttttttttgagacagagtctcactttgtcctccaggcttaagtgcagtggcacgatcttggctcactgtggcttcaacctcccgggttcaagcaatcctcctgcctcagcccaccaagtggctgggactacaggcacgtgccaccatgcccggctaatgtttttgtattttttgtagagacggggtttccccatgttgcccaggctggtctcaaacttctgagctcaagcaattcgcccacctcagcctcccaaagtgctaggattacaggtgtgaaccaccacgcccagccagaattttggaatctttatcatgagagaggaaatatttaatagagtcataccatacttttgagatatatagaattctttacagtgtagctgtagtaatctcttcttgatgtctttctcacccttaatattgttaaaacttgtatcgttgctcatttaagcatgtttcctgtacttaacatcatcatacctccgtatttctagcttagggtcttaaaatcctgatagatatctgaaaatagaattagccaagcagagttatggattagaatgtgctccctgtactgttgctgattctgccatccattattctgactaaagctagactgggaagaatcagactagacagagctagctgggctagcttggaaaactgtctgtgggcctatttgctatagcagtaccatctccttgcttcattacagtccctaacccaacctgaagattccccatctgtaacagcttgcttgtcagttgctttctttccagtgtgacagctaaggtcctggtcagcttcattagacatgttgtacctgataatgggtcttcatactggccttgctttattcccaagaagatcctggcaccgatatttctgagactaccctggtctggaatccaaccacccatgattcttctttcacagtcatctattaactctttgatctgtcttttctctctatattctgactactgctcccttacctgtcacatctaaatcatctttcaggtctatacagcacacctatgtagttctacttacatctaacatctcctttccattcctatttcctcctcctgaattctaatctttttgacatctcacacctgaacattttttcctatcttccccccctctgtctctcccactttcactggtcctaatattcttcactactcaaaacccttcagcatcttcctgaattacaatttagttggcctccacagtatatttcagtttatctttccactatattttcttgtttgtacctatttcagccaaacattattccctaaattctctcccatcttttcctaccattcaacatcattgtttaaccagtttttataaagtacataccatgttataagcactatgtgagctaggccctgtggagttgggggtgttggtgcttagtcttttgggggtatcagatataaagtagtaaagcttgtataagatgataaacacagaggagataaaaattctttgagaatacagagaatgacagagactaattttgtttggagtggggaatcaaggaatgtgtcaaggaaaaactgagaagggaagagtacagagaggtgaaagggaggttgggaaaggggaagggaaggaatgggaaaaggggacagagattccaaacagagagaatatcaagtgcaagacacagggaagcaaaaacaaatggtttaatattaagggagtggagagggttagaatatttaggaacatagggggaagtgaacagaatgaaaagaggatacaactggagaaggtgaggattgattgaggagagtgttttgcaaagcaaaacaaagttttaaggtaccttgtcaacttgctatgattctatagcagttgtttagaagatagactggagtgggagggagacttgtagcatttcatgaaggtccttctgcctggaatacttttctctccgctgaacttccccatcctcacctccagaaaggtcatccttcaaggttcaccttaatgttgctgcttttagtgaagccttcccaaatctcccgcctctctagaattctagaattggagtaatttccctccatttgggattcccatagcaactttctgcccctctttcagtgtattatacttacaatttgtttgtagcttgctttccccctctagactctgagcatcttgagaacagagatctagcctcatttatctgtcttttctatgctgtacttgatagaatactgtgatcacaggtagtactaataattttgatgaattgatttaaactggtatcccagagattggcactactcaaactccaaaggctatattgccccagacccatagacaaaaacaggacttactttcttgccttgatttttttcaccagttgggaaaagccaaggacatcctcaacacaaatgttggtgtgggtcacctagactctgagaccttagacttcaaggccgctggggaagaggatagcagcctacaggatctatgagcctttctcaagcccagctgaggggaagggcagataggagggattgcttttccagtctaatggagcatttccttgcttcaaaataccatctccatgctaatgttattttaatgccattacactgtgtaatttactgtgatcagcaaagcaatttgttgtacattcttccaaaagtgttaatcaattttagctcaaaatagattttaaaaccccacctaatttactgtcctaaaatgctgatcagtgggggaaagctaaagcaagcccagagttgtttgtattgtaactgtaagaaattataattcctccccaaaattatttttataagcagccaaggtataagtaaataggtatgtagaaaaatatatacctttagttgtcctgtttatagctgagatttgaaaaatcataggaaaggactaaaggattgtctgctcaaggtctagcctactaattctggagaacaaaggcccaaattattgataatcactaagttaatatctgtgatactcagttttcccttttcaaaaaaagttatagactctaatagaaccaaacttatgaggtaattaattatacatccaacctcccatgtccccactctacctcttctttatcttttgccaaagtgtatctcctctctgttctcaaccttataagattccctttacttcagagtcataaatcttgggtgcttggccagatttttccattagaggcaatttatgttcttagggaaataacatcccagagtaaagttacagcagcactaatatgtcccctgacatagtgttcttgtcctgcctgaaaagactggataattggctagacacagttgctcatgcctgtaatccagcacttcaggaggctgaggcagttggatcgcttgagatcaggagttcaagatcagcctggccaacatggcgaaatcccatctctactaaaaatacaaaaattagctgggcatggtggtgcgtgcctgttaattccagttacttgggaggctgagacacgagaatcgcttgaactctggaagggccactgccctccacctgggtgatggaatgagactctgtctcaaaaaaaaaaaaaaaagtttggataattgttgatacttaaatgtattgttcctatatatatttcatggtacattaatttttactgataacagatgcttatctgtggcagctgttctgtattttcctacctgaaagggtatagaagtatagatcagtaacatgtggaaacttgtatttgtctagccctgttttagtcaggggttggagttggtaagaatcatggagatggcattttgtgttttaagaaaaaacacctagtctcttggtcaggaaacttggggggtttttttcatagatctctcattgtgttgttttacaaccttggctgtcatagtctctctttccataccttggacttcctggtgataaaaatggacttgcttgtagttaactatagacataagggataagaagacattaaattattgaaatctaaaagtaatttgccccttatcaagttcctgccaagatggacttagtggaggggcaaaagaggggtaaatgatacctgaagttctactgaactccaaaacaaaaatgcacagagtaatccatgatggcaatatgattccatctgatttatagggtcgtctttgaagcagaggcagctatccaatctgttcattcagttctactacaaatgagccctccttgacaaagggtggggacttggacattgctatccactcctctccatcttttaaaactctccagcccttttctgtgtaaatacaagtaagcatatattttctcttttccctggcacccatggtttattgcctatgcatcaaatcagatctcatataaaatgagaagaaaatgtggcaattctaatatataagtgttaggggaaacccagagtcatctaacatttttaaaactgagagactgcctaatacagtctttgtattttatagataagggaataggcccagatgggtaaaatattttatagattgaatcacgtggaactgttactgcttcctgtttctcaatgctgaacctactttttagagtatattgcatgcattaggataaatgactatacaattgagattcttataatagctgcttgactatcaataccatatgctttttaataaagggatagatactcagttggggagaaggtctagggacagggggagggctagatgttgtagtggcatgtggcagatacccccatctcatctcctatcattttgcacataaataccactcaggtaggtgggcaggagatgaagggctacagatagatatatgtcctatgacctaaaaatatcagatgatgctggggccttttcagaaaatctaatcttctttgtagtcacattttttaaaaatttgctgtgagtttggaggaatacttgtcaaagtccaagttaaagtcctggaagtcgagaaaccaaggaattctctaccttcttcatccttagcagtcaaattttaaggcacagaaagagaaaatctgaatatgatgtatatgtgtgtatgtatatgaattgccttgtttttgaagagcatctgatcatttgaaatagaaatgaggcaaacaaaaataaagttaattgccacacacaaacacacatacaaacacaccttatctcaggttagtcttgtctttgctttgtgtccttcttaatcaggcaaccatgattaggttaaatgcattactatttggaggaagggatacgtttgtctgcttccttggatttcagttttgaataatattgtggcacagaggtgatagaaggatctaggatgtatgaatgagtgtgagtttccaaactgactttatgtggtaggtataaattgtgaaacaaaaacaatagcagtgatgaagtcaatctggaaacaggtaaatcccagtgagccttttaagacccctctagctgaaataacctataaaacacaaaataaaacaaatttaatgactgatattatatatttgaaatgtgcaggttggacagcatttggacttggaatgaaacaataagaggttatattcatggataaccaacaagataaggctattgttgcctcagccaacggagaaaacactctgattaatggggtcaaagaaaatggtaagggaatttaattatagtatattaatatctctcctggtagtcctctgttattactatggattttcagtacccacaaagttgggacaggttgagtccaggatgcctctgaaatgaatgttaattgtaaactttattccaccaaatatctaacttggctataagagtctctaagaggcattgaatctgaccactttgccctcccaaatcatatctgccagatgaagatcctcaaaattcctagtgaattagaaatatgctgtgatgtgaggcttagaacttctagagtggccgggcgcagtggctcatgcctgtaatcccagtactttgggaggccgaggtgggcagatcatttgaggtcaggagttcgagaccagactggccaacatggtgaaaccccatctctgccaaaaatataaaaaattagccgggtgtggtggcaggtgcctgtaatcccagctactcgggaggctgaggcatgagaatcacttgaacccaggagatggagattgcagggagccgagatcacgccactgcatttcagcctgggcaatagagcaagactcaaaaacaagaaagaaagagagagagggagagagggagagagagggaggagagagaagagagagagagagagagaggagagagagaagagagagagagagagagagagaaaagaaaagaaaaggaacttgtagagtcactaggagcttccagaacatggatctggaggacaggcctgagcctcgtagctcaaaagtattaatgttccatctgagcattttccccttgaaagccttgactttccaattgatcaagcagtccaattcttttctcatttctgaggagagctttgcctttttctgaggaagaaactcggcctaaataattattatttttcatttgcatgaatgttcaatataaaatcagcgttgttctttaacgttgtagtttttatttgtaaagatagagatgtgaaggcttagcttatataataagatcaagtaccagaaactgatcaagggaaagagagttaatgagtctggtctaagactcttaattttattcctgtcatttctttcccttttttctagactcagaggaccaggatgtggcaatgaagtcatttgcagctctagaagctgctgcacctatccagcctacaccggtggcacaaaaagagaccctgatgtatcccagaggtctcctgcctctaccctctaagaagccctgtatgcagagcccgccctctcctttgggcctgattgaagcacccgaacatgctgctaatagtgcttctgtgaatgccatctccctcacatctggcattgcaaaaggcctgaacacatggtcacttcccaatgaatgtgagaaagctccatttgccataatggagcctgcaggcatgtcagctctgaatggggactgtctcatgcagccaagtcggacttgcttaggctgcttcatggaatccaaggatgcagtagatcctgagccagggatcagtctgaaagttggtgatctaaatagggattatgaaacgtgtgcagtctctgatatagggattcagtgtattaatgctggagaaaatatgaaatatggagagcagctgctctcagaccagctcctaggcttccccctgcataagtcaagggcaggagacagacgagaaactgagaaacctgacattgacttggaggatccggctcagaaaagctattatgaggcattactgttagacaagtgcaatacagaagaagctttgcttgcaaattccaatcaggattggggttacttcgagacttttattagtgaaagtaagattgaactgcttgacctctgttccaaaaatgagctgtctgtcaacctattctctgaagaagatgtggataactacatgtttgatgatgatgaatcaacactaggcagtgatgtctgctccctgaaaattcgatatgaatcctttcaggacaatgttcgagacaagactactcttttgatgcaggaagatgcccaattcaacttttttcccagcgtctttactacctgccccaagcgagagtctaagagtggggccctgaagcagagcagtgatttttcccaattcaaggtccctgatgtgagcatcatctggggggaggaagataaaaacttggacaagaagaaaggcaaagaggaaggacaggaagacaaaggtgtagagaagaaagatggaaaggataatggagaaaagcctgccttaaataaaccatgcagtgggactgaagtagagcaacttaagaatccaaagcagggccatcttgctaattccctggagacatcagggagtttcagtgatgatagttccttcattgagatctcatatgatgctatgggtgagatcaaggactgtagtcgctatatggctcgggacactaattctggcagctcctcctcccaacagaactatgggctgcgagccaagagaaaagtcagatacagtgaagattatctatatgatgttgactcactagagggtgaaaaagtaaatgagaggaaggaatggctgccagttggttccaaagaggaagatgatgatgaatggtgtcccaaaaagagaagaaaagtaacccgtaaggagccccctgttattatcaaatatatcatcattaatcgctttaaaggtgagaagaacatgctggtgaagttgggtaaggtggatgccagtgagacaacagtgaatttgagtgagaatcagctcaacaaatatgccaagctggcacccttgaaaggcttctggcaaaagaagaagaagcagagaaacaccaacacggactccatcaagacacctttttcccaaaagcaaagctttgaaccaggtagctttgaggtgtcatttctgccacctgctcgcaaacgaaaatctaaacttggcaacaggcacaggattcaaagaatcccatccattgaaatttcagcaagtagtaaacagatttcattatgtaatgatcagaggcacgctagtaatcataaagaagatggaggcctaaaaggtacactgaagtcagcacctctgggtgctcctagctgtgcaaatggatcacatttaaatgacatcacaggccctgactcagtgaaagtcaaagcccaagacacagagtttaaggggccagagaggaaagtgctcaataaaatcaaatttaaaagtgaagctaggttaaaatctaagaaagtcaaagctgctgggcaagaaagcaagccaattgttcaaatgagccctctcttggaaaaccaatcctcaaaggctaatttaaagaatgaagttattcctgggacatcaaacagttcccgtctatctgaatttcatgaggcaaaggctgctaagagttccacttttctaccaacgacatgctcttctgaaatgcctttatcatctgctaatgttaccactaatatacctgttatcccgggagggtatctgcagacattgttagatgcttctgacttgtcaaataacactagtatctcatacttcagccaccattctccagagcaaaatgaaggcagcctcactcaaaccgaaaaatcatttgtacccctccagcctacccaggactgtgtgctcacctcatcctctgactctgagctgcagcagtcatctcataacttcaaaatggaatcaagcaactatagaaatgtgtggcccaacaaggctacttctggcacccaggaattcatggctgaagtctcaagggagatagccccaacccaatccagtgaatttggagcctcccaagtagtctccatggaaaataacctcacacctacaacatacaatccaatctgtctcaatagtggtggcagtaattgcaacaaggtcctgtatgactccatgcaagatacccaactcccatctgatgactcttaccaattatgtcactttaataatggagagatctgctttcctttccagcaggggccagtcaatatggatgatggtcggctctttagctttgattcaatggccccactctctgtcagctcaagtaattattgctccttaagcttgaagtcctgtgaaaaggatggcgatgatgatatcactgatgacttcctggcccattgcagccctaagctggtgatccagcaaagcattgatgagatagcaccactaaaggagtccactgacctcctggatatatccaacttcacccctgacaaattccgccactcttccctttcagagatgtccccaccggacacccctagtctttcccctcaaattaccagatgtgagagtatgaagacactaggaacactaaaggggttccaagagggtgtcccaggaccattggacagtgtggaaaaaatcaagtgggactgcagtaccctttcacggcaggtccaaatggaggatggatttactttaaataatcaccagtttcagttccatatgttcaatgatgaggattctgtcagcctgctccaaaaaaacccttgcctgtcaacatttaatgatccatctggtcaaattagtaccaacaacaaagtgtcaaaatcaagaaagaaaagttcacccagcaagagtggggctatgaaccaaagctcttctcagaaaaacaccaggaaaaaatccctcaaaggtaacaacaaggggattgaaaaaccacctggcaaaaactcccgccaggtccctaagtccacaaagaaagggaaatacatggctgccatcaatggagagaaaatgcaaattggcattggccgtgggggaagccaaaccaacaccatatcctccactgggaagacattggctgaatgtatccaacatggtggccctatggcctctatgaagatgccaagtcaaaagggactttctggagattgggccttggggaaggagagcagcccaggctggagtgatatgagcatgggcaccaacaccaacagccttctggatgatgaccaacgggaatttcaggagccttcctatatcttgtccaacattgcctctggtatggcagatgtgcagagattcatgatggcctccatagagcccctttgggaacccatggagcaccatggggatcccaacatattctactcccctgagtccaatagtctaaaattaaaaaccctcaaaatattggctgggacaccacaggagtctaagaaaaagatcaacagtgggtcccaaggagccactaagaatcacaggtcaatcaagggtgtgagcaaaagcaatgggaaaacagcaataggtgatcctggtcgtgcaaacatgcctggttataacgaggactctcgctctaccttctttgataaaaagtatagtaacatgagcactttaggcaataacggaccgacacacaaaaagttgtatcgtcacaaatccagctccaaggccctgagagatgagaaatgtaagggaaagcacatggagcgagaacaggtccacaaggatgagtctgggacagcttcttttgaaaaactgaggtaatactgcaccagtatggctgagatgatgcacccttagctctcctactacctactaagcccgcagtccctcattttttccctcttgaaagcaaaaatttgcatgaaagaaactgtcccattcccttctttttcaaagtaaaaagaaaattttaaagtgcatgaaaatccctatacctttaagccacccaaaagattgggcaattttgttgtggcttggctagggataagctctaacaaagctatttcttcttctgctattcatcactagttactacatattaagaaaatagaattaaaatatgctcttgaatgatttttggaagtgaaaggctttgcagtaagacagattttgaaaaatagaatttaaaagtcatgtagacaaaaagccaagatcatttaaacaaaagagcattagctggaaaacaaaatctgaacatgtggcaaataggagggctttctagtgccccatgctatttgtatctttttctacatcatacggcatctagtatgatgttaacaaatttagcttgtatgatccctttgtgggacatacactaaaactaactcagatggcataaattgtttgatttttctgcagggattccgactacaatctcctaaaagcagaaacaaccttttgggttttacctgtgtttgaagaagagactcgcattttccagaaagacatttgatgtttgtgttttatttctttcaaaatatgccttgtggtatgtatgttgacatgtaagtgcttaaagaaaagaattttaaattgtgggaatacgtctttggagcaaactttaatctcatgttctatgtaaaagacttaaaaagtcatacagttgcacaagtagtttatgcactatttacccacaaggaaaaaattgaaaacattgtgccaaactacaaacaagtgactgtactgtatatatttttacttctatatcaacatttggttgtatttggggaagttgtccctgttaatttactagaaacattccagtgattcttgctattaaccacccccacttatgtggatagcacctgtagatcatggtggaaaaatatgttgtgttacacaatttaccaaaattaaaggatactgtttgaaatgtgccaaattttcttacctcatctcacagattcacccacagtttaaagctcattaattatttttaaatggatatatacacacccaaacatatatatgtatatgtttgtgtgtgtgtgtgtgtgtgtatatatatgtatatatatatatacacacacacacgttcttttaaagttttagactctactgtcctgtgtggaaacatgaacagctaaacaaggcaaaataaagattttcttgttccattgtgtaagggttaaaattttggaaaagtctgaaggccacaacagctaagtccatcagggacccaagtatatgcatttacagaacgttttacaaggaaacaaaacagctgctttcaaagtttgttttctaaaagcaaaatctgtagctgaaaattatttaaagtgcaaagttatattgctgatactttatatctcagttttatatattttataatagtctgggataaattataaaaatagctataaaatcaacactaatgataaatgaagtatatagaatgcttttatttaaatagtttcctaaatgttttattccagttttgtcaaaagtgcactcatatcatggctttagtgttctttcagtgtttaatcttgcaatgccaatgtcatttaaagaaaatgttaaggcatcccagttcaaccaaatttttcttcttatgagtaaagtacatttactatcagataagatgaacaatttgtggcaacaactgatttgggccatatacccttagtctgaggataaccaatatttgatgccacacactaaacttaaatctcaattttaagtacaaatttttaaatcacattttttattcagtactccccctactttttaaaaaaaatttcacagccccaacattcctcactactactttttcttcccttttattcaccacttgacttctaacatttgatctcttttctttgcacaattgaaggcctgtgcatctgatgactgatgcattatggcacagatgagataatggatgtgagagcgctttgtagatcataaagtgctatacagatataggggattaatattattaatattgttagttgttgtcgttgttactattcttattaatattgttactaacctattaacttgtgaatatataggctggggtgggagggtggagaataagtgggaagggaaaaaggggatttaacaaaaaaagggaagatgtttcaaaaggaaaattttaagcaaaatatgaacctacctagtcaatgccacctaaatgtattcacaaacagagaagcaacatttgaaagtagtcagagagaaatggaaggaagcctgtcatgtatataagtatatacacttcccggtccatgattcctttcaccagcctgctctattccttacagctgggtcgtaaaatgaacaagcctgtgttcttgatcatgtgtgttcccagcgtcagtctcttgtgtctgtggggatgagtgggtgaggagcattctgtgaggctggtacaggcccattcctaggctttaatgctctgtttgcagtgagccctggaaaattacttagtggaaaggcaccagatgaaacatgtctcctgccccatagctaccattcaaaagggaaaataaccaaactggaaaaccttcttctatttctctattctgatagctagctgtactaaatgctatggccagtccctagaaactggtctttgttttgtttttgtttttgtttttgatttttctgttttgcagctgaattttggcttggaatcaccaactctgcctgtattgtgatccccaagactccagacctcagagtcacctgctggcttagaggagtggagtgctttctatgtaatgaaaaggtggcaattaatgaaaaaataaagaaaatgttccattaatacaatgtgtttttataaaagtaaatatgggagcagttgtcccagttttttttcggtatcagttcagctttggagaatggggtgtgagtggggtaggacagcctgaaactgttggaaacaatttccttgtgagaacttgctatcataagtcctttggaatggatattctttcagttgctcctatggagcccattaagggccaattctagggcatagttcatccctttctccaaagagaattgttattttaaagtacctttttaattggcctgcagtgtattatatgtttttaatatataaattagtgacgcataaccagtcactttgtactgaaacataaaaagaaacagagtttgagaaatgagcaataggccgaggcagaagatgtttattctcttaattgcatttaatattcctctcagtacattgtgttctgagatgttcatcatttagcattttgttggtcctgtctctgctctcacagttctttttcttcctgtcataaccagctgccttagtagagtataaaaatagtgttttgccctatcactggtatctcaagtcagaaatatatattatccttggtctgaaattcctgattaccgctcccttctaaccttccccctctgagaagctgtttcctattaatgcctccctaacagagtcccatttaatctttactttcctggaaatggtaacctcccttattcttcttacttaatctcagaccttggtcttagaatttttcttttatggtctcatatcccacctgcccaaattgtcagggctcaacaatcttaggctgctttcttctggaagttcagaaggaaaccttcccattcttaattgcctttaattgctttggctattttcaaatctaattttttaattaaattttttttaatttttatagagtaggggtacaaggacagttgtgttacatggatatattgcttagtgttgaaatctgggcttttagtgtacccatcaccgaaatagtgtacattgtacccaataggtggtatttcatccctcaaatataattttaaacacacactcgtgcccacatggacaaattatatcacatgactgaggaaacttagaaattccttttccctgaagatctgttaagaataggtctcatctcctgccctggttaggtgctatattatatggagaagggtattgagactttgggggtcatgtttgggctgtgataactggcttgaaccagtgaccatcctttctgcctcgccaaggtctcttataccagcttcttcacatatgctgcttcctcccagctttcccttctgacttcttgttactctgcaactatgtgtcaaggccttaccttttcctgatgttttcaaacctcctgcattactttgatcatcacttcttcagccatctcactgaagtccttggtgctagctgggcttttgtgacaactttcaccttctctgaactttttccttgctgggaagcatctgcgtgtgtgagggggctacggagggaagtgtgtgtgtgtgtaagagagaggcaaaaggatgcttcaaaagctataaacaactctagcaagcatcctaagtcctatgtgaggttttgcagttctagtgaatttctgttttagtaggtttcaattagcatttactgcctaaaggagaaaaaccatatccaaggaccttttagccatgcttgctattaccaagctggaccagtgtgatgtagatccaacatgtcttcagcttacagatgctctcagaacagttccaagaattgaagagagctaagtttttatgctgaagaggagaatggagcactagctagtcctaactattgctagaaatagaaatgtttattttctcctttattattgagaaattatctaatttaaggagtaaccattttcatttagggatttttttaatgactgcccatcactacagaaatatgttctttttataaaataaaactaatgtgaggttggtttgttttctaatcataaaattcactaagcctatagttacatttagaagatttagtaccaaaatcaaacttttagtaacaaacaggaatcttgtcaacacaatgtaggccagggattttgtaaaggtttctcaaagacccaaataagggagaaaaaaattttagttgggctgtttaacttgggaaacactgtcatcagcttgagggtcctcagccagcatgtgattattttgatgacaggactcaggctaccctttaaggcacattttttactcagcattaaacactagctacagtcgtgaagcagagctcccattgcagctacatacttgagatgtactcttggtttcagaatcgtaactaagaggtaaggcattggagaaggacaatgtaaaagacagaggtttagaacaaagtttatggtgtgaatgaggctttcaaaatcagtatctgggtaaattgatactaaagacactgaagaaacactcatccacataagatggaaaggatgtctgtccatctaacaagctcaggggtttctgagtctcagaatgacatcccatttcaaaaagaagaaaagagatattgaaatcattctgcctgtttgagagatgactggttatttacagcacaaaaaaaggcttagaatgaaaactagaagaggccttttgtttttcactcccagtgaggagagtagaaatcttaagatgctctactgggctacctgtagcactgactggagtttgctgcctacagagttttgaatgtactagtccttagtttccatagaactgaatgcacctctttagtaagttgctgatttatggtgctaaagaaaatgattattcccatttttttcttcttccccaagccccttaagcatttaagaaaatttaaaataaaagcgttagaggccctttttatgaatgtaacctaagtttctgtttgacatatgacactgcaacttaaaaatgttaggaaattatttgcctttttttttcttttagagttaagctttataaataatctgtagaatcaattgaagtttaaagcttaaggatcactcttaagacgtctacaaaatcttgtatatttttaagtgtgccaatttgtaacatattttgtaagtgtatatttttcttagaaaagtgctgtgaagtgtctgtatgtgagagttttcctttttctgcaccactaggtgctaataaaaggatatttacttcaaagtttctggttttagaaaccacaatacaaagaaaaaaaatacacttttgttggaaattttgtaacacaaaacatgttgtgaaagagtgtagtgatcttgtgcaaaaaaaatgaacatttgtgagcttcttgctgttttatagattttcttgtaaattattcttgtaacacttctggttttgttgttcttgttgcgaaggtttcaaatatttgtgactgaatgtacggtgaaactgtcataatgttacctagctgagttttgttattgtttatgaaataaataaaaagaaaagtttaaaa

SEQ ID NO: 1169 - DNA, 191898 bp, mus musculus
gggaagaacctgggaaggaaaaccagtagcatcagcagcagcagcagcagccgccgccgccaccaccgccgccacagcagtagcattagcggcagtagcagcatttagcaatagctttaacagctatagcgacagtagcagccgccctcctctctccctctcgcggacggccgcagccaccgcacagagcgggctccaggcgccgagcgcgcagcccgctcgctaggtagctccagccggggcgagcgacagtgtaagcgaagcacggacccttggagcagccgggcagccgcggaggctctgagtttcagggccagagcccgacagctctgactccatctagcgcggcggcggcggagcctgagggagcgagcgaggagagaggcgcgtccacctggcgggcccagcgtatggagctgaggcagaggcggcggcggcggcggcagcagtagcagcggcggtggcggctaaggcagctcgaacagctgcggcgacggcgacagcccagccttgactgcgaccgcgctagctacagcgcctgctgcctgagcccgccagcgacgtgcgcctcgggagtcggcctgtgaggtgagtaggagcgctgccatacagcttcctggccttctcgccggctccccggctggctcggggtggcggccgcagggggtggaatgaactggggtaagtcgagctagacgagaaggaagggaaaacggaacggaggacgtctgtatgcgaatgtgtgtgtctgtgtatgagggagcgaggccgctagggcgagagatcccggctcgccctgacaggcactgcaatctaggaaaggcctctgtgcttgcgccgtaggaagggggttgcggggggaggggaagcgagcggaccggagccgccgcgcttacacgcacgcagctcggcagagtgccgcctcctttcggactggtgcagggtagagcctggccagggaatggggcatgggcatggcacgcttcggcgagagcgggaaaacccacgcggcggccgaggccgggcgctcggaccaaagccgcaaaggtgcgaagccgggcggccgtggcgaccacagagcgcccccaggacacgcgccactcggccgaggctgcggacaggtttaagttggaggccagaccgagcctcgcccagctcatctcctttgcggaaattggcttgtggccccttcgcgctctcggtggcggtcgaattgacgcttttctgtgtggcttctggcgcttctctctgccgcgccccgcagcacacgtcggctcgcgtcttgtacaccctgtagggcgggaaggccgtgagccggcgcggggagcggagtcccgctccgggaaagtgtggaaaccgcgctgctgagttggcgccgttccgctgaggaattcagcgatttcagcatgactgcttctgtctgtctgattcgtgagggaccgaatcacccgcgcaaggttttctgtctttttcgaagttaaaaaaaaattggcatccccatttcgacaacagcactcttgatttttatcaagcttctggttgcattttggaataagtgggtctcatattttgcttctggatcttggctcccagcatattgttgaatgctgtgcacagcactacatttagatatgtggcctttttctaatgttgcattttctagactgttatctgaaaagacatgatttgtgttgtagggctggcagggctgtttttaaaaatgtctaaagcactttaatcccgggatttgaatatatccttggttgtttttggtggaggagttcctggaatattttgcttggtgagaaaaggtgctgtaatggtcttctctgaactccttacgaccatttgtgttttggaggggtgaatctcccttacatcttttacacatgaggtaacatatgaccaaacgttttatttacagcagtgacgttcttatggctgaggagaatttacacttattgaaaaaatatttttagaagggaacaaaaaagtcctaagtaactgtcattttacatattaactgggaaaccggctaatcaaataaaactggctgagtgtctgaaactctatcccagtgaaatatgtggctgtgaatataattaaccatctgtctagtgagcaatttaaatttgggctggtacatttttattacagtgtctaatttctggaagacatacattttacccagcagtaacaacaaaaacgtatttgcttactaggtcaaaaatttactgtgtggtggtggtatttccctttcttcctccatgtctttcatagtccccacactgcgtaacctgggaggtcaaaaatgagcttcttgtttttgcaaatagcgtatttacaatagaggaactgaaactagccctggtggctagtgattagacatttttgtctcttagaaatactttccaatatttcacctccccgaaaatctagatagattgcatgcatgctagttaaaaaaatataattttttggtgcacatggggtagggtgattgaacaaaatttgtaagacttgaaatttctctatttactttctcttattctgatgaattctctacctggctgtcccaactggcccccccagacataaactcatacaaaaacacatgcttttttccttttagacagtttttaaggttaacagcattcagatctgtgattttaacaatatactgataaactgcttttttttgtaaatcgtaagtgtaaaataccatgacataaaaatacattgtacatatatttaaagttttccctatggtgtgattttagccagaaatttattactaggaaaaaagagggatagagtttgagtagagatgaaatggctccgggaagattagatttgagagaccttcaccaaatagctattgttaacataacataatttaaatgaaccacggattgattgtgcagtaagctagagaaagtcatttaaaggaaaatatttttaaagcaaatatttgcctaaataacagctctgataaattggtaacaattatgtaagtacatggcagaatttgacatatgtcaagtctgttaaataaatcaacctgttcagtgaataaatctttgatgcatcagtgctttttcacacacacacacacacacacacacacacacacccataacaccctgttgccaaagtcaaacaactgcagtactgccactttctgttttacttcaagtctgtcccttttccctctttttcttttttccacaatcttctggttacctgtaagctacctggtgagcagagagaactaaaggtgaggtggtgttgcctgtgtttaggaggtgggagaagatgagaaaagtgctaagtgttggagcacacaaagatgggttcatggatcctggacacggtcactatggaggtcctcgtctcacggaccaccatagtgtatttgcataggagaaggactggcctatccagagaagcattggttgcagtttctctgttcctaaatccagttctagtaaataatattttttcttctgtatatcccttagtaaggggagaaaaatagattctaaatggcattcgactgttacattatctttaatcttttatctgatggcacatatataagtgttcccggtaggagtaagcaaaaggagaaaagggccaaagtggatgaaagggaaggggaatgattgactaaggagtaggtcatttggcttccttgtttttcccatcttaagagatttttggtttggacattattcattttttttttcttttacttcctctgaaaagttggccaccagctccctaatggacagtttctccaccagagcaccttttcaaacccaaggtcatagggtcagacacaaagcacttgttacgttctctatggcacttctccagggctgcttgaaaacaaaacaaagaatatatacacctactacgtacccataagaattagaaaaacaaaaacaaaaacaaagagcaccagacaagtttgcatcacttggagctacctttaagttcacaccttttctcttgcccagaaaatttctttttaggcagaggtgaacattcgtgtcttctcaaacaacaagtggctctgtttgtaagtacatcacaaccttggggaaatctggtctggggtgtcgtcagttgggaaagtggagggttggggaaagctgccttttagtgatgatagagtcttttatggaccagctacaggtaggcgtgaggaccttcattgtctctgttcccttcagtccctcattgcccacagtgattcacaggcctctgctagggaacgtgctcattttggtctttttctgcaggtaagcactatgatctgatttctttccctaccatcttctctggtggaaaagaagctgaagtcttcatgaccaactattaatactatgtacacaattattacttttccaaagagcacttcaatatgtcatcttatttatccccagtgtgataattttgatgtaaacaattatctactgttttctctagcaccctcaagccccattaaaaaaattttcagcttctcaccctcagtagcccattttaagtgttataccactagcttaaacaagaagttcctcctgatgtttactctgaaggggtttagaggtttgagaccaagattaattataccttgggcctgagtgctaaagtagtgccaagtcatcctctgtcaagaacaggtgtaaagacttaaacgttagacctaaaaccataaaaaccctagaagaaaacctaggcattaccattcaggacataggcatgggcaaggacttcatgtctaaaacaccaaaagcaatggcaacaaaaaacaaaattgacaaatgggatctaattcaactaaagagcttctgcacagccaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccagaagacacatgaaaaactgctcatcatcactggccatcagagaaatgcaaatgaaaaccacaatgagataccatgtcacaccagttagaatggcaatcattaaaaagtcaggaaacaacaggtgctggagaggatgtggagaaataggaacacttttacactgttgctgggactgtaaactagttcaacccttgtggaagtcagtgtggcgattcctcagggatctagaactagaaataccatttgacccagccatcccattactgggtatatacccaaaagactataaatcatgctgctataaagacacatgcacacatatgtttattgcagcactattcacaatagcaaagacttggaaccaacccaaacgtccaacaatgatagactggattaagaaaatgtggcacatatacaccatggaatactatgcagctataaaaaatgatgagttcatgtcctttgtagggacatggatgaaattggaaatcatcattctcagtaaactatcacaaggacaaaaaaccaaacaccgcgtgttctcactcataggtgggaattgaacaatgagaacacatggacacaggaaggggaacatcacactctggggactgttgtggggttgggggagcgaggaaggatagcattaggagatatacctaatgctaaatgatgagttaatgggtgcagcacaccagcatggcacatgtatacgtatgtaacaaacctgcacattgtgcacatgtaccctaaaactgaaagtataataataataaaaaaaaagaacaggtgtagcaattcattttatttaggggaagttaaaacatttcctctatggaggactataagtagagtgaccatatgttgtggtttatgcctgttgctccagcatacttattttaccctcaaaaatgtcccagtttggaaaagaattttgtgatcaccttagtataagccacctttgaaagaaaccatgattctcaatttggggaggtgattatatttgcaaaacttgagggtataatgagctttggagacattatagtcccctaacccagctcaacctatctttttcctagttaagagatctttctggagaagaacccctgaaatgattcagggtttcggctcaacagaattggattattggctccaaaggcatctctcctaaatgcctgtttgtatttgcacatacacatgcacataaagaggtgatgtctgcatgctggaaaatggctgctctaactttcatgaaagactggtaagaattaataagtttaaagtttatcaggagaaacttaggtttagaagcaacatcctgaccatggtatttgtgagatacaagggcatagcaccaagagaagtgttaattcttttcagaataggtttgagaagtgcacaggcaactttctatttcaaatagtttgtatgtggtcattactcttatgtatatagtttttcaatttgccttttccataatggacacgatgatcttttcaactacctctcattcctcccagtatccatgattggctttcatcgatctagggcaggagttaaaagaaactatggcccacaggccaaatctggcctgccatggaaaaagaaataatgcagacaagaaaaaaaatggagccatttagagttgcttctgcaaacattttcaggcttcctcttcttaattgagcttcatttagttcaatgttaggatgagtccacatttcatgattatatttcagctcatatctagtgtttggagattgtccagagcctggtagagtggcagggggtgacccgaaaagtgaaatccacaaatggatttttttgtttgagtcaaaatgtcaatagctattttttctttcctgcctaggtgagtaatccaaattttgttgtgccactaaattctttatgccttcctccccaatatttgtcatgttattccagacatgcatatgatttattaacccagagactagatctcagcaaattgcttgaataggaacatgctttgtctttagttactaaataactggaacacatcctgaagatgtgctgttttactaagtagggaagtagaaaaagtgggtcatcaccatctagccaatagtccctaaccttggcatgaacccctgtgaaaattcagtgaatgccaaggatactctcttcagaaaagtgcatatttacacatgtaacacttgcatacattttcaggaagtccagccatatattgtgagtttaaacctccgtgctggcctttccctagctgttacagaattcttgttgtatggctgtcatggtcatggtagcttgaaatggaagccattaaatgtctctctcaaaaaacatgttattagtatatttatgggccacatccctcagctaccgtacaagcatttttctgattagccttcacagacatttttttattatgaagaagagccacttagcactcacttttacattaccattctcaccaaaaacgtcaagactagtttccccaaattattgacttgtcaactctctgattcttcaaaatgcctgttcagctttcacacaccccacacacaagttcatcattaatatataaaatatattccataaaagctcactcacatttcatctgcctctacctctctctgtttcatctgtttctctcactctatatatttctcttagccaaggttctgacaaatgtggggaactctttctagcaccaatcattaggtatggtgatggagtcagagagggagatggtgtctagacaccttcatggggaccttgagacacatgagctttttggagtattagacatcttggagagagttaatgtatttcatcctggatatctaacatcatatattaaaggcaaagttccttaagctctgcaaacacaaatatatgccacatctgcgccttgcagttgggatggtagtaataggtggtatattagtctgttctcatactgctataaagaaataactgaaactaggtaatttacaaagaaaagaggtttaattggctcatggtcccacaggctgtacaagaagcatggctgggtaggcttcaggaaactttcaattatggcagaagtggaagcaggcatgtcttacatggccagagcaggaggaagagaccaaaggaggtggtgctacacacttttaaacaaccagagctcatgagaactcactcactatcatgagaacagcaagggggaaatctgccccccatgacccaactacctcccaccaggcctgtcctccaacattggggattacaattcaacatgggatttgggcagggacacaaatccaaaccatatcaagtggtattcagattcatgaataaatgtttattgcttgttgtcttggtagtttagaatactgtagagcatgtgggttaatagaaccctaagactggaggggtccattaatgataattactgattcaattcagcaaacacttattgaacatctactctgtgctaagccctgagatattggggacagataaaagaataaaatgaatttttctgtctcatagggaattagctttgctcctggctgggtctttttaccatctgcatgaatttacccccctattttcctaattcaatgcattcttctattgtttctatgttctaccccttggtaaatgtcttagtctgtttcctgttgcttttaatggaatgcctgaaactgagtaatttataaagaaaaggaatttatttcttaaagttatggaggctgaaaagttcaaggtagaggggctgcatctggtgagggccttcttgctggtgaattctctgtagggtcctgaagcagtaccatggcatcacatggcaagggggctgaatgtgctagctcaggtctctctcttcctcttcttataaagctaccagtcccactcccgtgataacccatttatccattaacctattaatccattaatccatgaatggatcaatccattcaccttttaaaggctccacctctcaatactgccacatcagggattaaatttcaaaatgagttttggaggagacaaatcaaacctcagggagtttcttggcaaataggtatctctagctgggttgagacaagatttccagcccctatggcaaaaatgcttcttttcttatccttgcattagtttagcaggccccatttaatagggaataatgtgattgtttccctgtgattctgaggcaacatttctatcactgctatcattggtgatgtggaattgcaaatatcattagccgtgatgtattgactactgccttaaaattatagtatggagttgttgattctgactaatgaattgaatgtactctgcaaaaagccagctgtccatctttgagtgagttgatttttaacccctatttggtagctttagcagttttctactatggttgctgtaacaaatttccaaaatcttagtggtttaaaacaacaaatttatatttctacagttttgaaggtcagagattgtctgaactaggcactgactaggctataatcaaggtgtaggcagggctatatttatttctggggtctctgggtggagactccattttcttgcttttctggcttctaggggctgctggaattttttagctcatggtccccttccatattcaagccagagatgggagattgtttcctcacactgcatcacttaaatcttgcttccatcattacatttccttttctgactctcactcttctacctccctcttctgtttataatgacccctctacttatatttggtctatctggatggataatctgggataatatttccatcccaagatttgttgattttcaaccataattctatctgcaattttaattcctcttgtgccatgtaacctaacatattcacaggttctaggagtaggatgtgaacatctttgaaggcctttattctgcctaccacagtgacttgacttttttgttgttactttttattttggaataattatagaatcactggaagttgcaaggacagagaggccctgtgtatccttctcccaatgccccaatggttacattttgcataatagttctgtgtagttctgtatcactttatcacatgtgtatatttgtgttttttatttatttttagttttgtagaaacatggttttactgtgttgcccaggctgatcttgaactcctggactcaagaaatcctcctgccttggcctcccaaattgcttggattacaggtgtaagccagcgtgcccagccagcacacatgtatatttgtgtatccaccatcacaatcaagataaaatattatttcatcaccgctagagatctcttttgtgctacacctttatagtctttgtaattcacccccactcctttgccatatcaaacttgcaatcaccaatatattttccatatctaaagttttatcatttcaagatttttatataaatggaatcattgagtatgtgacttttgggggttggcttttttcactcagcgtaatgccctgagatctattccagttgttttgggcattaacaattcatttctttttactgttgaacagtattacatggtattagtgtatcacaatttatttaatcattcacctgtagggagaaattttggttgtctggagtttttggttattacaaataaaactgctatgaacattagcatacaggtgctttttgtttggttggttggttttgtttgtttgtttgtttgagtggggcggagactttctctgttgcccaggctggagtgcagtggcacaatctcggcccactgcaatctccacctcccaggttcaagtagttctcctacctcagcctcccgagtagctgggactacaggcgcatgccaccatgcctggtcaatttttctaatttttgtatttttagtagggataggtttcaccatgttggccaggctggtcttaaactcctgacctcaagtgatccacctgccttagcctctgattacagagttggaattacagtgctgggattacaggcatgagccactgcacctggcctagcatttttgtgtgaacataagttttcatttctctgggaaaagctcccaggagtgcaattgctgcattgtatggtaaatgtatgttttagttttttaaactaaaaactgattttgcagttttttcagaaactgaaaatctattttccaaagtgtctgtaagtacataacttattatagtctactagtatcaacattttacctgtttgagtaaattatagaaaccttacccctctttaagttcctttaaccttccccacttataattgccttactttctctacatatatctagaactacattagacaatgctacaatttttgcttcaaccctcaaacataattgagaaacccaatgggagaagcaaagtcaattatatttacccttttactctttctgttgttgtttctttctgaggtttctagatttcttcttttacattttttttctgttagagatcttcctttacttattcttttaatgcaggtttgctagcaacaaattatcttagttttccttcttctgagaatttattgatttcccattcattcctgaaggatattttcacctgatgtagaaatcctggttgacaggttgttgttgtttcctgaaagcatttgaaaaatgtgccatttctttctggtcttcatgggttctgatgagaaatctgctttcatttgaattgttttacacttgtagttagggtgtcatttctctcttgctgcttttaaggtttttttttttttctttagtctttagaagtttgactatgatgtgccttggcaaaatttctttgggttcatctggtttggtatatgctaagcttcttatgtctgaaggtttatgtcttttgccaagttttggaagttttcaagtattattccttcaaataatgtttctgtcctgccttctattcttcatggtttcttctgatgagagaaaacttagatcttgtttttgtagttctacaggtccccgaggcctgttcatttttctcgtctattttttctctgttgttcagactagatagtttctatcattatattttcaagttaagtgattcttttctccatcttcttcattctgttgtagagaccatacattgagtttttatgttttgattattatatttatgagactttctatttttcgtttgttacaagagtgtttctaattacttattgaaacatttttgtgatggctggtttaaaatctttgtcagataattctaatatctctttcatcctggttttgccacctatcaattgccttttttcattcagtttgagatctttctggtcattggtatgataagtgatttttatagaaatatatacgttttgtggtatgtcatgagactttggatcttatttaaactttctgttttatctggctttctctggcactgctctagctccaggacctccaattcctggggaagggagttgctgtcttgttactgccagatggtagtagaagtctgcttgcttgttgacagttggagggcaggacttctcattattgcttgttaggggttggaattcagccacatttcaagtgcttggtagccatgtatggttagtggctaccatattggataacatatatgtagagcatttctgtcactgctctaggaagactgaggttgggggagggagcagtaaaagagcttggcactacaggaattggggtttgggaaaactggcacagatggaataagacaaggatctagttattgtatctgaggtccatggctagggtttggttccaaaacctgaggtgctgtgagttctatctagagaaatatgggcacagagaactcatctggttaatatggatccagtagggcagagttagtatccatagtattaactaagttttgtcctctcagccattgtaaaagacatggtgtggcatgctgcagatcctagtaccactctatttgagtagagggaaagtcttccctattagatggcagttagtttgcttatttgtagcaacatacttgacctccatgactgaggtaaccattgattgaggaaacgttaacagaaaagagtgagttgtgaaaagggtattcatttagtttataggatctagggtttctttggcatcttggtggccttaatgttctaatccttgagacttccagcatgcttagccaggtggggagcatttatgtaagaactctgtccttcactgagctctgtgttgacttgttggcactttttgtccaagtcccaaagagttagtggaccctgttacacagcttctttgtacactgaaataactgttgccttctcaagtctctctttgcttagattagtgggggtgtacttaatgtagattcagtgttttcaatctccccttggggcagttcgttatattttcccttactggctctatgtgtgtatacatcctaatgtgcttgtatttatggactgcctgtgtactgtatctcttggcaagggaaaaggaatacctagtgtctattgaatatgtattgtttgtatagtatacaggtcacatgaccttttcccttagcaagacctgtatgtgcaaagctgtggctttgacatgttaagatatttcataacacagtcaaatccacttggctgaataggtgaaagaaaagggaattgagccagggctatagtgggatttttcacatctatgtcgtttgacttaaaatgaaacaaaaatacacactcatttgagaaagaagcagtttcagagttaggctgtaaagagaaaataaacatgctttataacccaaagccaaggtgttggttttaaaaccctagactatggctcacccagatccttccagtatgtgtatatgtggggaggaggtgagtgttgctggtctgctactcagagatatggagatggtatcatgggagcaaaatcccaatttgtcactttgtcttttaagaaggctccaaatatgccacttacttttttttctttgagaaggagtcttgctctgtgtagtggcatgatctcagctcactgcaacctccacttcccgggttcaagtgattctcctgcctcagcctcctgagtagctgggattacaggcacccgccacaacccctggctaatttttgtatttttagtagagacagggtttcaccatgttgtcaaggctggtctcaaactcctgacttcaggtgatcttcccgccttggcctcccaaagtgctgggattacaggtgtgagccaccacatccggctgccacttacttttgaagacagtggtcactagttgtgctgaggggccaaagggtcaggatactcttatacaaatctaagaagagaacctggaatcaccttttcttgccattgatcttaccattttcctataagccacagtattagtttgttttcacgctgctgataaagacatacctgggaagaaaaagaggtttaattagacttacaattccacatggctggggaggcctcagaatcatggtgggaggtgaaaggcactacttacatggttgcagcaagggagaatgagggagatgcaaaagcagaaacccttgataaaaccgtcagatcttgcaagacttattcactaccaccacaacagtatgggggaaactgcccccgtgattcaaattatctctgacaaggtccctcccacagcatgagggaatgatgggaatactattcaagatgagatttgggtgggcacacagagccaaaccataacattccatccctggcccctccaaatcttatgtactcacatttcaaaaccaaacacgccttcccaacagtctcccaaagtcttaactcatttcagtattaacccaaaagtgcacagtccaaagcctcatctaagacaaggcaagtcccttccatctatgagcctgtaaagtcaaaagcaagctagttacttcccagatacaatgggggtacaggtattgggtaaatacatctgtccaaatgggagaaattggccaaaacaaaggggttacagggcccatgcaagtccaaaatccagcatggcagtcaaattctaaagctgcaaaatgatctcctttgactccatatctcatgtccaggtcacgctgatgcaagaggtaggttcccatagtcttgggcagctccacctctgtggctttgcagggtatggcacccctgctggctgctttcacaggctggcactgagtgtggattttcctggcacatggtgcaagctttcagtggatctaccattctgggtctggaggatggtgggcctcttctcacagctccactaggcagtgccccagtagggactctgtgtgggggctctaaccccacatttttcttctgcactgccctagcagaggttctccgtgagggctccacccctgcagcaaacttttgcctgggcatccagcatttccatgcatcttctgaaatctaggtggaggttcccaaacctcaattcttgacacctgtgcacccacaggctcaacaccacgtggaagctgccaaggtttggggcttgtaccctctgaaaccatgggccgagctgtacgttggccccttttagcaacagctggagcagctgagacacaaggcaccaaattcctaggctgcacacagcatggagaccttgggcctatcccacaaaaccattttttcctcttaggctcctgtgtctatgatgggagaggctgccatgaagacctgtgatatgccctggagacattttccccattgtcttggggattaacatgtggctccttgttacttatgcaaatttctgcagccagcttgaatttctcttcaaaaagtgggtttttcttttttactgcatcatcaggctacaaattatctgaacgtttatgctctgtttcccttataaaagggaatgcttttaacagcacccaagtcaccttttgaatgccttgctgcttagaaatttattccaccagataccctaaatcattttgctcaagttcaaagttccacaaatctctagggcaggggcaaaatgccaccagtctctttgctaaaacataacaagggtcacctttgctccagttcctaacaagttcctcatctccatctgagaccacctcagcctggaccttattgttcatatcactgtcagcatttttgtcaaagccattcaacaagtctctaggaggttccaaactttcccacattttcctttttctgagccctccaaactgtgccaacctctgcctgatacccagttccaaagtcacttccacattttcaggtatcttttcagcaatgccccactctgctggtaccaatttactgtattggtccattttcatgctgctgataaagacatacccgagaatgggaagaaaaagaagtttaattggacttacagttccacatggctggggaggcctcagaatcatggcgggaggtgaaaggcacttcttaaatggtggtggcaagagaaaatgagggagatgcaaaagtggagacccctgataaaaccattggatctcatgaaacttattcactaccacaacaacggtatgggggaaactgcccccatgattcaaattatctcccactgagtccctcccacaacatgtgggaattatgggagtataattcaagatgagatttggtggggacacagagccaaaccatatcagccactgtggggtgggtggttgtgtgtgtgtgtgtgtgcacgtgcatgtgcacatttttctccctaattcagtaatgctttgttagctatacttacatggatttagcacctgaatgaacagaaaaacccatttgtttattgtcgaaatagtggggatgccatgacattgctgactgccatgatttgtgattcattaaggccaggatacttctagacaatcactgaaagttgaaaagcaggtaagtgaattaatctcttccctttgattttcacctttaatattataaccttagatatgacttcaatatcttccagcactgagtagaattggttaagggaaggccagagtggatgtagttaacaccaggaatggaattccttttgttttctgaaaattcagtttatagtttattagactgaagaatccacaggcctgcctcagacaaccaggccatatactagacaagagcactctcagattacactttgaaatgaaagcctattttggcataatatgcactgaaaggaaaagtgtgctcctaggtatgctctttactttgccttttggactgtcctcttgggtttcctcagcctttctctgatctgtatggctctaggccccactcccaataaccctctaggaggctctgttccatgtcatctacttatggcactgaaataccaggtgtcacatggtataaggtagtagtgaccacaaggggcccagaggaggatgtttgccgagggaagcagcctgtttccagatcctcaggtagagggtgtgctcaagcagctgagacagcctgaggtgggagaaggagcagtggatgataggtcagagctgccatttccattggttgttgagatggccagctgagggagacagttgtttgttcagtggtcctgaggaagtaaaatcatatactggtgttttttgattcaggcgacagattgatgttaagggaccataggcatttaggctgccaataataatacctgatcatcctatagctccttctaaaggactcaaaggactcctatattttatttcatttggcctcacaaacatcttcatggacttaggaaaggtaaatattgatagtcatgtaggacaagcttttctctctctctgggcctcagaattttcaaattgtgaaatggaggcttggtctagagatgatgatctctaaggtcgtttcccacagtaacagtttctatggtggcaacatcttccaggtggaggaattaagtctcagacactttaaagtgagttggacacaactacactctctatcaggtacagagtgatgattacaggcccaggccatgatcccttcccttagcttgccctattagtggtctctttgaacagtgaggtaaggggcgggggggggggtgctcttgcttctgaacacacaagggctttacttatctgtttcatttaacactctcccctcacctgaccaccttcccaaactacctcctgtcactcatcagcagggccttcaacttttcccttgatgttcctcgggattcatatcttgtttgactgtagctgttttcctggtgtattgtgtggctagatgcaaagtcattgctacccttagagagtaaagtctggaaccagcacttcagttacatcaggaaagagaggctgtgcctcctgggtgtggcagggggtcaaagtgagaagagacattcaaaaacatcatattataaggtgccctgaaaaagcaaggagggtctgtagattagggctggggaaaaaggactggacaaaggtatgatgggggaaatcagacagtgagttgatgaaagcaaatacattcaatgatcaattaatatgcagcaaagaggctaggatgcctgagatttctttggagttggaggataaacatggcatttatgactgtgacagggatttatcttgggagagggcagtaggggaaaaatgaaaagctttattttcagcaagttcagcttttgtagtaagatatttagcttaagaaatgcaagctaagtactgtgagggaataaattcagagaaccatattccccatatgattcctggaaaccagtaggaatttggctcaagaagggacggcagaaggtgatttgtggtgttataacagccgccttggaagccaagatggaaaatttgtccctgaaaggctaggcagttggaggagactcactggaaatttctgtccggagaaaataaatgaaccagagaagagcttaaaaacacatggtggagggtgaagtctgggacacccaggaacccatatcttgtaataggtccacttgttaaattcctggcttatggtctagaacaggattttgttcatttccttggaacaaaaaggtccccaggcacccagagcttctatcttatcccagtccacagcctcttacccgttctttcatttctcttttcttttcctttttttttttttaagagatggggtcttgctctgtcacccaagctggagtacaatggcacaaacacagtttactgcagccttgaattcctgggctcaagggatcctcctgcctcagcctcccaagtagctggcattacaggcgtgtgccaccatgcctggctaatttaaaaaaaaaattgtgtagagacagagtctcgtcatcttgcccaggctggtcttaaactcctaggctcaaacaatccttccacgtcagcctcccaaagtgctgggattacaggcatgagccaccctgcccagccttttttttcctatttctctcattttaagaataaattcatttatcatttatcaaaagaatccatgaaaatttcacaaatattgaaaaatagggaaaagaaatagttcaacgttttgtttttagaaattatttgtgtctttatttttgtttttgttttttgttttgttttgtttttgagacagatggagtctcgctctgttgcccaggctggagtgcagtggtgcagtctgggctcattgcagcctccaactcctgagttcaagcaattctcattcctcaacctcccaagtagctgggattacaggcacccgccatgatgcctggcaaatctttgtatttttagcagagacggggttctaccatgttggccaggctggtctcgaactcctgatctcaagtgatctgaccgctttggtctcccaaagtgctaagattacaggtgtgagccactgtgcccgacgtttgtctttattttgaataattataaaagtattgaaaagactaggaataatataagaaatacttggatctctacttggagaaataaaacattacagacaagttaaattatatcccctattttcagtcacattcctctccattcattttcagaagcaagcactaagataagcttggtatgtattcttccattttgttttatacttttgcatgaaagtatgtctctcctctcccctcttcccataaataatatatagagcttgtctgtgtgtttttaaaatttatgtaagtaataccttaatgtatgtgtcattctgcaacaagtttttttgttttgttttgttttgtttttacccaatatcttgttttggaatttattctattctcttttttacattccccttttctactcaaactgtaccctggagctgatgacatgtacattactttttcatatttttatgataaaaataatatgtaaccacattacaggaaagttggaaaatccaaccaattgatggctcttaggaccagagagctcagtgtcctactgtagacttgatttgcaaaggttctaggcagctgggctaacctagtggttctgcctgtaaaatactgaagagcaaaattggaagtctctagggacacttccttgcctgtctgttaccccattccatgaagtagtaaaacagaggcccagagaaggaaaatgacttaacaagggcacacattcattgaatattgtactcgagatttctggatccctgtcttgtacttgaaacgtttccaaggaaaaaaagagcggtggggagagagagagagggagagagggaaaggaaacctagaactgcaatttttcatcgtaaaaattatccattttaataaagcatgggaaatacagaagagtaagaaaaatgaagatatcaagaattgtccattttcctattttgaacttctgatcttttttcttgtacaacttttgtttctttgattgtaccctatcttgcttttttccacttaactttataatgtcataatgcacatctttttcaaaaagcagacttctacactgaaatcttgacagtaaatatttttaaggcacatatttgctatttagccatttaaaatggtataggcagggaattgtgtagagaggaaaacaatggcgtgggatattttccagcaagtttgttcctgtcctttggctagatctttttcttctaaaacaaaacaacaataacaataagatctaggtagacatttctaggattcctgctactaaagtattcattcagagaagtttcattactctctcaaatggcctagggtgtgaccaagggtcactctaatatactcccctccacttacaaggcaagggcaagtgttgcccttggggcccaaagggagccaattctggagctacctgggtcatggaagttgaccctgaggaaaagactgtggtagtttccccagtccatggagtgaggagtgaggtggggtgctcaatttttccagagcctgagcacaaagacagtgacagtcattaaaacttcttcagcacttactatgagaggcaagacatccattcccaacaaagccacaccacttcacacacacacacacacacacacacacacacacacacacacgattagaattgttgcctacagttttggttgcattgtttaattgtaatagtgcaaaagtgcatttaactatgaaggcttgctgggagaaaggaaagtgacggtttattattctagtcagttcaacatgtttgaaacagtgaagcaatgagagattaacctgctcgctcaaagtcacacagcaaaaaagtaacgatgctgagattaacaaataaaaaatgaaaacacccttattcttggtcttgggtcttgaaagctgggccttagcctgctgaagctcactgtacttctgctttaatcagtttaattcattgctagcttgcccttgccacctttgattctctttgcattggccaaataccaatttgcagtagttgttctgaagtgcttgccagtttcaatttttcaattccaggctctattctttctcacagggctagaaagccacaagtcacactagtggccagctgtatctatgacccaaacttgctcaggtctgtgtgtgtgtgtgtgtgtgtgtgtgtgtgtgtgtgtgtgtgtgtgtgtgtgtgtgtgtgtatgcctgagaatcagtgaggactccaggactgggaatgttcaaggttttgaattgaaataattgaacaaattcctctataaagaaaccttttcccctgccaaatgattttcttcttaatgatttctgcagttgattaacgtttagaaataggcagtgaagcctcagtgaacgtgtatttgctaggccatagggtgctcttgcttccaggttgtagaaaccaatgttgaaacaagtcccagctgtgtttacctccagattcaagtttcaatacaggggagctcctttccacatctattttccctccttcctgcaaaggcagctgagctaaagctgcccttaataaggagtggccttaggcactgcagtagcatttacccttcaaactgggcagacaacttctctgtggggagtctgagcctgccacacctatcacacaggctttgggaaatgtgaagtggcacttactgcaatctaacctccagagaacttgcctgcatgctggccagttgggctatgggaaaccttgccattttttgcctatccaaaggcccacacctaaacaggtctgaatgcaaatgcatgggtgaaaggggtaagcgaggggcactacagaaagctcacaactgtcctcagacccaggaggatggcaggccaagaagtccattattcatttgtttccagtgtctcaggtaagtgaagattgcagtcctcactggaaaagacaagaggggcaaggagatacatgagcccagaagagctacaatggacctcatttacagataagctagataggcacttcccagtctttttgtaccctccccaatccttctgttacctttttttgtaagacccaactttgaagagttgttttttctcctgaaaactgcacttattaaataatagcttttctgtgttcctatacatatgcatacataaaactgtaatatatatacatatatatgtatatatatacacacacataaacatacatgcatcagagctgatcagcacagagagccaatgttattctgcttggttgctataattccagggaaaggtaaaaacatttagctaactggggcagctgtatgaaaaaactctccattttctttaaagttctgaaatactgaaaatggtttgaggatcccatttattaccttttttttgttaagatgaccagggtcctcaggttggaaactactgatctagttaactcctcttccctatttttgagtcagaatgtaaggcaaattttggccaaatagaaagttagtctttgagctgggattaaaactcatcccactgggagccagtttgcatcccttcacttggtttcccctacgacatttctgagctataaatctgactcatccatgattaattttaaaaaatgtcctgaatgatacttttggcagtggtctttaatatatattaaaggcacatatggtggtttggaactgccttgagatttgagacaggacttcaatttctggtagaggtattaaaggagctctctccatttatttggagctgtaagtcatttgtagataaaatgtacttagggagtgcctactaagtgtgagatgctatcatagctgggagaagggaaggggtaggagtaacaatggaggagtgggttagtagaacagcccccatttcaggaaaactatattttattagggagatatatgtgcacaggactatttctatggcaaggcataaaacagcgcatgcctcagtagtaaattgcacatgtaacactttgtccagcagaattctctggaactgaaagatgtataatggaaccaagtaaaccagcaactgtaccatttctaactgtgaggagaaaacaagtggtgaaagttgtgcctcacaggtgctttgtgcaacaaattacaacaaaatttagaagcactaccatcctggctatttatatgtttatcattaaacctcacattgacatcttagctgcaattgttttctacctccaggaaacaacctaggagatcatctaaaccatctttatctgaaacattaattacttttgttagattatcttgcctagaaatatccatagacaggcagctacctctaaaggcaatccatgccagaaagcccattctttatattttcttttactatttttattgtggtaaaatacacataaaatttaccatcttaaccacttttaagtgtacagttgtgtggaattaaattcattcacactgttatgcaaccatcaccaccatccatctccagaattcttttcatcttgtgatactgaaactctgtacccattaaacaacagctccctattttcccttctccccagcccctggcagccagcattctattttctatccctatggatttgatgactctaaatacctcatgtaaatggaatcatacagtatttgtctttttgtaactggcttatgttcatcaccataatgttcttcagtttcatccatgttgtagcatgtgtcagaatttacttctttttaggctgaataatattctattgtgcatatataccacattttgtttatccattcatccatcaatggatacttgatttcctttcaccttttggctattgtgaatgacaatgggtgtacaaatatctcttcaagaccctgccttcaataattttgagtatatacccagaagtgggattgttgggtcatatggtgactatttttaatcttgtgaagaatttccacactgctttccattgtggttacaccattttaccttcccaccagtagtacacaagggtttccattttttcagatcctcaccaacatttgttgttttctgtttttcctttttctttttctttttctttttttttttttttttgagacggagtctcactctgttgccaggctggagtgcagtggcatgatcttggcccactgcaacctccacctcctgggttgaagcgattcccctgcctcagcctcccgagtagctgggactacaggcatgcaccaccacacccgtctaattttttgtattttagtagagacgggattttcaccatgttgtccaggctggtcttgatctcctgacctcgtgatccgcctgcctcaccctcccaaagtgctgggattacaggcgtgagccaccgcgcctggccctgttttttcaatagtagccatcctaatgggtgtaaggtgatatcttattgtggttttgatgtacatttccctaataactagagatgttgagtatctgctcttgtgcttatttgccattcatatatcttctttggagaaatgtctatttgactcctttgctcattttaaaacttagggtgttaggttttttgttattgagttataggagctctttatatattctagatattaatactttaccagatatatgatttgcaagtattttctttcattttctacattgcccttttacaatgttatttcacaataatgttgttcaatgcacagaagtcttagacttttatatactccaatttatctattttttctttggctgcctgtgctttgttctttccccccaagattactctggctattcagggtcttttgtggttccatgtgagttttaggattgtatttttctatttctgtgaaaaatgtcatcagaattttggtagggattgcattaaatctgtagatcactttgggtagtatggacattttaacaacattaattattctaatccatgaacatgggatatcttcctatttatttgtgttttcttccatttgtttcatcagtgtattatagttttccatgtacagatctttcacctccttggttaaatttattcttaacttattttattgtttttgatgctatcataaacagaattgttttcttaatttctttcttgggtagtccattattagtgtataggaatacaactggtttttgtatgttgattttgtgtcctgcagcttcactgaattcattgatcagttctaacagttttttttgggggacgatctttagggttttgtatatataagatcatgtcatcagcaaagagagacaatttaacttctttctttcctatttgatgccttttatttctttcttttgcctaatttttctggctagaacttccagtactatgttgaaaagaagtagtgagagtgggcgtccttgtcttgttcctgattgtcgaggaaagtatttcagcttttcattgatgagtatgatgttagctgtgggcttgtcatcattgggtttttgatagggattgcattacatttgtaaggtctctctggtggtatttacatcttaacattaagtcttccaatccatgaacgcaggatgtctttccatttattagtgtcttctttaatttctttcatcaacattttgtacttttctgtgtacaagtctttcttctccttgattaagtttattcctaagtattgtttgtgatggtactataaatggaattgatttcttcatttccttttctgattgtttcttgttagtttatagaaatgcaactaatttttgatgctgattttgtatcctgcaactttgctgaatttgttattagttataacagtcttttgtggaatcattaggatttttcctatttttaaaaaatagaacagtttattttagaacagttttacatttacagaattattttaatgataataaagaaaattcccacataccccacaccatcttctcctattattaacatattccaagagtgtggtacgtttgtcacaattaatgaactgatattgatatattataattaactaaagtctatactttatatttcttcagttttcttctaatgtcctttttctgttctgaaatcccatccaggataccatatgacatttagctatcacgtctccttaggctcctcttgactgtgacagtttctcaggctttccttgtttttgatgaccttgatagctttgaggattcatggtgaggtattctgtagaatgtcccttaattgggattcacctgatgtttttctcatgattagactggggtaatgtgttttgaagaagaccacaggaataaagtgcccttatcattacattgtattaaggatacatgctatcaacacgactttaacactgttgatgttgactgtaattatctggctaaggtagtgtttatcaggattctccagggtaaagttacatttttctcatttccataatgtactctctggaaataatcactttgggcagttcatactttaagactggggagttatgtgtcacctccttgaggatggagtatccacctacattatttggaattcttgtgcactggagatgtatctgttcctgctcatttatttatttgttcaatcatttatttatataagtatgtacacatgtatatcatgtatatttattttaaactttggattatagtccaatactgctttattttgtttctcaaattgtttcagctttggccattgggagctttttttggttgactcctgtgtccctttgacataccttcaccatgtggtttaatttgttttttcttttgagattgatttttgttttgccttctgccatgaaaaacttaagctctccagcatgtgacagcccttcagatttataaaaacatccaccattaccccctctagtgttctccagactaaacatttcccactcattcctttacacattcctcatgtgacagatttattgaccccttactcatctagcagctttcttctggaaacattccattttgtcagttacctgaaatacctcctttcactctccttaccctccacaacaattataaaatttaagagaaatcaaaggtagttcttctactagaaactatgtatgatagtaaatagtacccaggctgtgtcactgaatgaaaaaaattatccccatattagaattaagacccttagaaattagaggagaaatatgtttccattttgtgcagagcttactatttttcaaagctatttaggaaactattagtttgactctcctaacccatgtgggaggtaggtagggcagttagtggtatgcccagaaagccaaagcccagagaaggtgccttatccaaagtcaccatatgagttagacagactgggttctcttgactcttactccagtaaccttaaaattaggtttaaactttaactgtgtaggctaatttttgtttgtcagaccctcaaccattaatcagaattgccaatacattttcttttgagccgaacttagcctcccaatataatatgagatatgaaaggtaagtctgaaatgcaaacacttaagaaatgtttctagaaatcaaaatcatttttgtatgctagtagatatcaattgggtgatcaagccagaacttagaaagcatatggttagctttgggaacagaagtgtcaacagaacaaaaatgaatattttctaattgtccttgcttgctgcggatattaggcagctagctttgtgtctttttcagcacttatcaaattctaatggaaaggtgctgaggtgtggctaatcccaaacagtgtataatccccaaataatttatacagtaatatcctgtcacacatacacactccagtgcccagtctctgctcttctattttggaggttgcagagactgcactagatttggcagatggcaccagtttttattcctgggctgtctctgctcattcacacccagggtaaggaattagtgggagccttttcatgtattcctttataaactgagcaggagagaaaagaaagagctagaaaacttttctctcttactacctgaccactccttcaatcttaaaaccagttcgtgcaaaccagaaattgtagtatgtacagaatatttcaagtcacaactttctgggatgaatggtttccatacccaaagagcctcctgcctttaaggagtcatcagttgaaaagaaacagtcagatatctgtggcattacctactggccagagtgggatggagaaagtggtctgaagtttagttagcaaatgttgaatttcagggttgaggaaggggaagtatggtatctagataaggaagaaggcagcaaaggggctgagagcttttcaactttggtgacaaggatggggaggagtaagtgggaacagacactatccttacttggagagtggtggttgctgaggagaaggacttattgctttatattgaattttagcattaatactttctggatctctgagatggagagttgacagaagaacctaggaagcatgactaagtggttgaatctgctatggaaaaaggggaaacggggcaggcttttacttatttgaacctaggtactttgtttctttgccacctaaaagttctgggatgaactgaatgaggaatatgaattgagcagataagattccttttactggagaaaaactaagtcctttggaaacttgaacttttttctcattcaaattcatttctaggccttattcattcattctatgtttttttttttttttacacagtagccaccgcccccgcttcacacccctaccccctacccttcccagcctctggtaactatccttctactctctgtcttcatgacttcaattgttttgatttttaaatcccacaaataagtaagagcatgtgatgttcttggcaactttgtggaaaatgagttcactgtaggtgtgtggaattgtttctggattttttattctgttccattggtctatgcacctgttttttatgccagtaccatgctcttttagttactatacctctgtagtataatttaaagtcaggtaatgtgattcctccagttttgttctttttgcttaggaaggttttggctattctgagtcttttgttgttccatatacattttaggatttttttctatttctgtgaataatgtcattgatattttgatagagattgcattgaatctgtaaattgtttgagtagtatgcacattttaacaatattgattcttccaacccacaaacatggaatatctttccattttttggtgtccttttcaatttctcttatcagtgctttatatttttcattgtagagaactttcacttatttggttaattcctaggtatttaactttatttgtggctgttgtaattgggactactttttgatttctttttcagattgttcactgttggcatatagaaatgctattgttttttgtatgttgattttgtctcctgaaacatcaccgaatttgtttactatttctaacagttttctattggtttttccaaatataagatgatatcatatgcaaacaaggataatttgacttcttcctttccaatttggatgccctttctatctttctcttgtctgattgctctagctagggctgccagtactatgttgaataacagtgatgacagtgggcatccttgtagtgttccagatcttagaggaaaggctttctgtttctcccaattcagtgtgatactagctgtgtgtctgtcatagatggcttttattatgttgaggtatgttccttctttgagggtttttattatgaaggaatgttgaattttatcaaatgctttttcagcatagattgatatgatcatattgtttttatcctttattttgttgatatgatgtatcacattgattgatttgtgagtgttggaccatccttgcatcccagggataaatcccacttggtcatgataaatgatctttctaatgtattgttgaatttggtttgctagtattttgttgaggatttctgaatcaatatttatcagagatattggcctgtagttttctttttttgatgtgattttgtctggtttcagtatcagggtattactgacctcatagaataagtttggaagtattccttcctcctttattttttggcatagtctgagtaagattgataatagttgcttatagtagctactaatgatcctttggatttctgaagtatcagttgtaatgccgtctttttcagttctgattgtatttctttggctcttctctctttttaatttattttattttattttttgacagaatctcgctctgccacccaggctggagtgcagtgctgtgattggctcactgcagcctccgcctgccaggctcaagtgatcctctccctcagcctcctaagtaactgggactacaggtgcgtgccaccatgcccagatatatttttttttttgtacttttagtagagaagggttttcactctgtggcccaggctggtcttgaactcctggactcaagtgatctgcctgccttagcctcccaaagttctgggatttcaagcgtgagccaccatagcctggctctttttatctcagttagtctggctaatggtttgtctattttgcttaatttttcaaaaagtcaactgttttggaaactggaactttttaattctccctcacccacaaaaggattattcattgtaaattgaattaacatactcttccctagatggggtatctcagttaatgggaaagccaggtcatgactccaggtccaaatggccctgtctgatcctggtggttgggcagctttgcataaatttaggatgctataatttctgcaaagcgtcttatgattccaatattagactttcagaaaaaccttccacatcatccatgcactgtgtgtacatgtgtgctgaatatttttaaaatcttacaacttgcctaaatagagtttttccatctccatcttgggtgcttaatcacctcatcttcttttatctcttctttctctcctatgtttgttgaggaaacaagattaaatataacaatttttacattgcacacaaaataaaatggcttgtttagctgtgactttaaggccacgcatgagacagtctgtacaggacttacctccctcatcagaggaaccctttgagtctttaaaaaaggtgaggatgaaaaacaagaaaactcttttagattttcagctctccatttgctctgcagcatgagaactaagaagcaggtggcaaagatagacagtaaactagaaggaaacaaaacaaggtcattttcctccttgtaccttagcttcttgaatgataatttaagataccttcaattttctgttatctgaagtagtctgctttatggattacttagactcttgtttcttcatcctttaactgtttggtgtcacttcttccaaagctttttaaaatatattttctgattctactggaagagcagtcatagggtgtaggcatgtaggaggaaacaaaattatagggacagaaatcagtctattttctagtactttaattccttaagacctaagtcagtatccttatttttaaaaactactgtctagctccccatccttgcccatttctttttctatacatacatattctctctctctccatcctttccttctcagcaagtctggtagacagactagtctgatgcctcaaaaatactctaattcgtagaaagaaagtaaattctgcctctgacgttccattccccctgtggttttaattagggtaaattctcctatgctcactttgaaacatgccttgggatcttagggagatggcaggcagatggcgtattaatgcagggtgatgtttctcacttcatggtgcccatgcaacatttattgtcattaaaatagtgtcattcaaatgaggtggctgatgttggaaaatgaatgcaaagttgatcattgttctgtggatctgagctttgatgaagaaattgaattagaggcagcatttcaactctgtttaagtaataagtatatatgtatctataactcagtagtgaaacctttcagactgacaggagggcaaagcctctaagactatattagggtttacgggtataaaaatacgtgcctctcctgctttaccaggctgtggggagaatgaggaaaataatatctgtaaagtgacctgagcacccagaaagaaaaatttagatgttttattagacctacgcaagatctttggttagttccccagagccctgtaaagtcttggaagccctgtaacaaatttctcttttcccttgtcaggtttttgttttcccctggtgcccaggttaaagagaaattgatttctttccatcttgtgtttagcttttgtccctctgcattgaggctttgaattgagaatatttctttgggtctgtagggctgtccaatgatagttaggcttaaacattaaacaaccttacagaactaattaggctttattgcctgtggccaagtcaacgaattttgcttcatagaatttctgagagaaaaaaaaatacatatttaggacttggtaaaacttttcttaaaatgtctccttgtaaatgccagcgttgctgaccctgtgcaaatattttgtaatagcccggcttgagaacatcccccacatttctctgttgtattctttatgacttccctccaggttgagctgtgaaagggtgaggggaaaggagccatgtcggagaagtagaagagactgaatcaaatgtttagagaacatagcttgattaattcaaaactgaagccctggcctctctagtctcatgttccacagcaataatttctccttggccagaagcctaagcatctgtgtccaaatctcatactctttcctaaatggattcatcaagtcagaccttgagttgcttggttttttctgaaccaccccctaatttaagttaaacttaaaaatgggagccattaaatagcaaaacaaacaaatacaacaataataacaggacattatgtcctggccctcagaggtcaatttaatgtgattagcagcataaaacttcacaacgcctttcactggaagattaccagaagcaacatcattcagtatgttgccatgcactgccattctttcactttggcattatttattgattgtagcagaaacacaatatttgtacctcttaagcattttagtttcctttaggcttttctctagtaaatgtggaactgcatcattttgttaaactgttctgaagtctaaaaaaaaaaaaaaaccctcctgaatattgtttacatccctggttacaaaggccagtactgaggcggagctgctctgcctgctttgattcttatcaagggcaacactgtatgtgtgcatatgtatgtgtgtgtgttcacacaggagagggtagtaagtggagcaagagttttaaggaaggagcggggctggaaggaaaaaaactttcaatgaattgaaactgcataatgaaaagattctgaaatttaattacaaaaatggctctgttttttctctcacctcctcctcgctcccttttctcctctccatcctctccaaaagcactgaagtaaaatgagactgtcagatcaaagccacacacccactctaggtctgttttgagaaagggatttttttctccccttatttactttgtagcagtggcagcatgtctactgcaggatgcagtgacagtgtggagccttgtcactgttctgcttgatctcctcccgtgtgccactccctggtctggtgagcagggtcaaagtttcaaatgatgactgtggccacagttctcaccatctcttgtgttttcacacttggccattcagtatttaggcattgtccctctgacatatggcctgaaagagttgaagattaagtttccaagtttggaaatgcccaagcgtagccatggagggtgtatttgtcccatgtggctgcgggttctgttgagtatttttgcaaaaatattaaaatgtctacttaggatttaagaatatgtttgatgatatgtacataattcatagcgcattttagggcacacctgcattatttaatattggagtttctctttttaagtttttttatttttgtctaggactctttagagtgcctgtgcctgggttccttaatattctttcagaccagttgtcaatttccaagtgccttaaaatagagctattgggttttcttggccttttctggccctcattctcttctagttcatgatttttcctcaaaataaagttgtacctaattaataaaggtatataggtattcagttttaatactgtctataaagtatgactcatactttctctattaggaacatctttgttacattgaatgcatatctctcctgtagttggttgagagaaacatgtaggtctaggatcaaagtcctagaacaggatcagagtcactggaaatgcaaccaaaatggggatagaggctcatgggacaagaactggaatgtgtgttgtattgagctacagggagaaggaagaaactaagtaccgatttggtagagagaaagaggggcagagagagagagagagagagggagagagagaaagagaatgagagagaatgagagagagagagagagagagagagagacagattaggttaggattaggttaggaagaaccttgaaacatcagacaaaaagaagaaaactaaagcagactgaagagcagtgtgtctttgattatggctattcaccaaaccattcttattgctctttctgttattattaagctatctctgagatgtacacagtgtatatctcagtgcacaacagacctaccagtgtagatcttttaactcattcctttaatgaatttttatcactttcacagtccttattagctctctttttaatggtttttttggagcccataactagatatgccacctcaggaagaattttatcagtgctctgggaagatggatttactattttgagttgtatttgtacaccatgcaaccatgaaccacttagaaaccaccttagtgactcatactttctttatggtccattctgattctgaaatcctttgagtgttacatttctcaatctgattttaacaaggattaaaataaataagtaaataaataaaaagttttctaaggtttgcgaaacactattactgaaatttagaggacttgaggcctttaaatcaaacaatattttcattataatttgcctttccatccccatttggtcttgccacatctatgctgcgacaaaagaaaacctttagtacctaatatcggtacttggtgttcattcatctcactgtggttttcactttcaaagcacaatacattgcttccccatcccattccttttgtttctaccattctactttggccttggaaattaaatattgcatcctgtccctcacagcttatttctgcctctcaattttgcagatctgggcattaacggaaataataagcactttataattttatagtgctttataattttcaaggtattttcacatccattgtcttgagtgatcctctccacacctcactatataagcagggcatggattattaccccattctagctcaaggccatatagctaactaagggaagaaccaataaagtttctagatgaatttgtttcactacacttcttccaccatcagttccatggccaaatttttttcctgctactttttgaaaactgagtatatataggaattttctttttggtatataaattttgggaacaatgaactattcgtctaggtgagtaaaagtgtatgtctgcatccatttgtttatgtgaataatatgtgttcgctaaaacttgaaaatgtttgacatcattctttttgtttgtttgttttctttagtttttttattgtactttagattctgggatacatgtgcagagggtgcaggtttgttacataggtatacacgtgccatgatggtttgctgcacccatcaactcgtcatctacattaggtatttctcctaatgctatccctcccctagcccctcacccctcaacatgccccggtgtgtgatgttcccctccctgtgtccatgttttctcattgttcaactcccacttatgagtgagaacatgcagtgtttggttttctgttcctgtgttagttttctgagaatgatgttttccagcttcatccatgtccctgcaagggacatgaactcatccttttttatagctgcatagcattccatggtgtatatgtgccacattttctttttttttttgtttgtttgtttattattattattatactttaagttttagggtacatgtgcacaacgtgaaggtttgttacatatgtatacatgtgccatgtttgtgtgctgcacccattaaatcctcatttagcattaggtatatctcctactgctatccttcccccctgcccccaccccacaacagtcccaggtgtgtgatgttccccttcctgtgtccatgtgttctcattcttcagttcccacctatgagtgagaacatgccgtgtttggttttttgtccttgtgatagtttgctgagaatgatggtttcatccatgtccctacaaaggacatgaactcatccttttttatagctgcatagtattccatggtgtatatgtgccacattttcttaatccagtctaccattgttggacatttgggttggttccaagtctttgctattgtgaatagtgccgcaataaacatatgtgtgcatgtgtctttatagcagcatgatttataatcctttgggtatatacccagtaatgggatggctgggtcaatggtgtttctagttctagatccctgaggaatcaccacaccgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcatttcttcatgtgttttttggctgaataaatgtcttcttttgagaagtgtctgttaatatccttcgcccactttttgatggggttgtttgtttttttcttgtaaatttgagttcattgtagattctggatattagccctttgtcagatgagtaggttgcaaaaattttctcccattctgtaggttgcctgttcactctgatggtggtttcttttgctgtgcagaagctctttagtttaattagatcccatttgtcaattttggcttttgctgccattgcttttggtgttttcgacatgaagtccttgcccatgcctatgtcctgaatggtaatgcctaggttttcttctagggtttttatggttttaggtctaacctgtaagtctttaatccatcttgaattaatttttgtataaggtgtaaggaagggatccagtttcagctttctacatctggctagccagtttttccagcaccatttattaaatagggaatcctttccccattgcttgtttttgtcagctttgtcaaagatcagatagttgtacatacgcggcattatttctgagggctctgttctgttccattggtctatatctctgttttggtaccagtaccatgctgttttggttactgtagccttgtagtatagtttgaagtcaggtagcgtgatgcctccagctttgttcttttggcttaggattgacttggtgatgtgggctcttttttggttccatatgaactttaaagtagttttttccaattctgtgaagaaagtcattggtagcttgatggggatggcattgaatctgtaaattaccttgggcagtatggccattgtcatgatattgattcttcctacccatgagcatggaatgttcttccatttgtttgtatcctcttttatttccttgagcagtggtttgtagttctccttgaagaggtccttcacatcccttgtaagttggattcctaggtatttcattttctttgaagcaattgtgaatgggatttcactcatgatttggctctctgtttgtctgtttttggtgtataagaatgcttgtgatttttgtacattgattttctatcctgagactttgctgaagtagcttatcagcttgaggagattttgggctgagacgatggggttttccagatatgcaatcatgtcatctgcaaacagggacaatttgacttcctcttttcctaattgaataccctttatttccttctcctgcctcattgccctagccagaacttccaacactatgttgaataggagtggtgagagagggcatccctgtcttgtgccagttttcaaagggaatgcttccagtttttgtccattcagtatgatattggctgtgggtttgtcatagatagctcttattatcttgagatacgtcccatcaatacctaatttattgagagtttttagcatgaaaggctgttgaattttgtcaaaggccttttctgcatctattgagataaccatgtggtttttgtcattggttctgtttatatgctggattatgtttattgatttgcatatgttgaaccagccttgcatcccagggatgaagcacacttgatcatggtgggtaagctttttgatgtgttgctggatttggttttccagtatttcattgaggatttttgcatcaatgttcatcaaggatattggtctaaaattctctttttttgttgtgtctctgcccggctttggtatcaggatgatgctggcctcataaaatgagttagggaggattccctctttttctattgattggaatagtttcagaatgaatggtaccagctcctccttgtacctctggtagaattcagctgtgaatccgtctggtccctggactttttttggttggtaagctattaattattgccacaatttcagatcctgttattggtctattcagagattcaacttcttcctggtttagtcttgggagggtgtatgtgtcgaggaatttatccatttcttctagattttctagtttatttgcgtagaggtgtttatagtattctctgatggtagtttgtatttctgtgggatcagtggtgatatcccctttgtcattttttattgcgtctatttgattcttctcccttttcttctttattattcttgctagcggtctatcaattttgttgatcttttcaaaaaaccagctccagggttcactgattttttgaagggttttttgtgtctctatttccttcagttctgctctgatcttagttatttcttgctttctgctagcttttgaatttttttgctgttgcttctctagttcttttaattgtgatgctagagtgtcaatttcagatctttcctgctttctcttgtgggcatttagtgctataaatttccctctacacactgctttgaatgtgtcccagagattctggtatgttgtgtctttgttctcgttggtttcaaagaacatctttatttctgccttcatttcattatgtacccagtagtcattcaggagcaggttgttcagtttccatgtagttgagtggttttgagtgagtttcttaatcctgagttctagtttgattgcactgtggtctgagagacagtttgttataatttctgttcttttacatttgctgaggactgctttacttccaagaatgtggtcagttttggaataggtgtggtgtggtgctgaaaagaatgtatattctgttgatttggggtggggaattctgtagatgtctattaggcccgcttggtgcagagctgagttcaattcctggatatccttgttaactctctgtcacattgatttgtctaatgttgacagtggggtgttaaaatctcccattattattgtgtgggagtctaagtcactttgtaggccactaaggacttgctttatgaatctgggtgctcctgtattgtgcgcatatatatttaggatagttagttcttcttgttgaattgattcctttaccattatataatggcctgctttgtctcttttgatctttgttggtttaaagtttgttttatcagagactaggattgcaacccctgcctttttttgttttccatttgcttggtagatcttcctccatccctttattttgagcctatgtgtgtctctgcacgtgagatgggtttcctgaatacagcacactgatgggtcttgactctttatccaatttgccagtctgttccttttaattggagcatttagcccatttacatttaaggttagtattgttatgtatgaatttgatcctgtcactatgatgttagctggttattttgctcattagttgatgcagtttcttcctagcctgggtggtctttacaatttggcatgtgtttgcagtggctggtactggttgttcctttccatgtttagtgcttccttcaggagctttttagggcaggcctggtggttacaaaatctctcagcatttgcttgtctgtaaagaattttatttctccttcacttatgaagcttagtttggctggatatgaaattctgggttgaaaattcttttctttaagaatgttgaatattggcccccactctcttctggcttgtagattttctgcagagagatccgctgttagtctgatgggcttccctttgtgggtaacccaacctttctctctggctgcccttaacattttttccttcatttcaactttggtgaatctgacaattatgtgtcttggagttgctcttcttgaggagtatctttgtggcgttctctgtatttcctgtatttgaatgttggcctgctttgctagattggggaagttctcctggagaatatcctgcagagtgttttccagcttggttccattctgcccgtcactttcagatacaccaattagacgtagatttggtcttttcacatagtcccatatttcttggaggctttgtttgtttctttttattcttttttctctaaacttctcttcacacttcatttcattcatttcgtcttccatcgctgataccctttctttcagttgattgcattggtcactgaggcttgtgcattcgtcacgtaattctcatgccatggttttcatctccatcaggtcctttaaggtcttctctccattggtttttctagttatccattcatctaattttttttcaaagtttttaacttctttgccattggttcgaacttccttctttagctcggagtagtttggtcttctgaagccttcctctctcaactcgtcaaagtcattctccatccagcttcttccgttgctggtgaggagctgctttcctttggaggaggagaggcactctgatttttagagtttccggtttttctgctctgtttttttccctatctttgtggttttatgtacctttgttctttgatgatggtgacgtacagatgggtttttggtgtgtatgtcctttctttttgttagttttccttctaacagtcaggaccctcacctgcaggtctgttggagtttgctggaggtctactccagaccctgtttgcctaggtatcagcagtggtggctgcagaacagcggatattggtgaaccgcaaatgctgctccctgatcattcctctggaagttttgtctcagaggagtacccagttgtgtgaggtgtcagtccacccctactagggggcgcctcccatttaggctactcaggggtcagggacccacttgaggaggcagtctgcccattctcagatctcaagctgcatgctgggagaaccactactctcttcaaagctgtcagacagggacatttaagtctgcagaggttattgctgtcttttgtttttctgtgccctgtctccagaggtggagcctacagaggcaggcaggcctctttgagctgtgatgggctccacccagttcgagcttcctggacacttcgtttacctactcaagcctgagcaatggtgggcgcccctcccccaacctcactgccaccttgcagtttgatctcagactgctgtgctagcaatgagtgaggctccgtgggcgtaggaccctccgagccagttgtgggatataatctcctggtgtgctgtttgataagcccgttggaaaagcacagtattagggtgggagtgacccgattttccaggtgccgtctgtcacccctttctttgactaggaaagggaattccctgaccctttgcacttcccgggtgaggcgaagccttgacctccttcgactcacgcacggtgcactgcacccactgtcctgcaccaactgtccagcactccccagtgagatgaacccgttacctcagttggaaatgcagaaatcacccatcttctgcgtcgctcacgctgggagctgtagaccggagctgttcctattcggccatcttggctccaccccaccacattttctttatccagtctatcattgatggatatttgggttggttccaagtctttgctattgtgaataggaattttcttagcaaatatgaaaatttgctgagagaggaagtgtgcaaaatggtttggcaggaaatcacacatggaagggcccaactgggtcactttgtgtttgaacactacatgggagactatgttgaaatcctagatttcaacaatcctagattagaccatcacggaaaagactcactactaggtggcagaggccctttcctgttgctcagagggacttctagtcgtgaaaacccataacctcctccttgactgtgtactagaagcactgctaagtgaaactggttaattctgcatctatttttgtaatgtggcaatttacatgctgattggagccaggctgtgggaatgtttttggtctaaggccatggttctcatggtggagaattttgccatttaggacatttggcaatgcctggagacatttttagtcacaagtgggttggggggtgctactggcttctaatgggtagaggacacagatgcttccaaacctcctaaaattcacagggcagctcttccctacaccacacatacaaaaagaagtacctgacccaagatgtcaacagtacctggattgagaaacactggtttaagtgaagaagcctgggtctcagagaattatttgtatttagtctctgcctttttcccctgtatttgctctgtgtgtgtgtgtgtgtgtgtgtgtgtgtgtgcatgtgtatgtgtgtgtgtgtgttggaatttatccatttaagtaaatgtaggaaagccctcagagtaccttaagagtatcactgtgctatgaagaaatgattgtgctttacagtgaacttgaggggagattcacttggggtaccaggctccccaaaggttgtaggtacagcacacatgcctgaaaacacagaaacatctgccaacactcacctgggtgtgtctttttgtctctatctttcttttctctagcaatttccaaactttataggcctcaattcttacttgaggagtgagcagcaggggttactgtcagttttagggcatacatctggcgagaagtgcctcaaagctgtctgcagaagtgcttttggggtttgaggatggcttgggttctttcttttaaataggtggagctgagatgaaggatgagggacagtgttcatgatcgttgtttaggctcttctccaactgtcatatttcttatgtgtcaaaggatactgtgacaaacccagtcactgatgttgggaatgtgagggatctaaggagagagcagtgtatatgggaagaagaagtacagccatttgatgtgcagaaggaatgtctgagcatctgggtatgtgtttgcagttttgtattttggctccaattcaagcccctttcattttgtatgataaataatttcttttctacacctaatttccattgactaatggtgattaatcttcaactttgacattagagataacaagtgatgctcattccattaggctttaccaaaatgctggtatttgagtagaaacaaagactgggataacaattgcttgcattcattgtggccctaaagtaattgtgaacccttgtaaagcctctacttatggtgcacagaattgtaacgtttgtaatgtaggggtggggctctgagaattaccaaatgttataaccaagggcaggtgttggtaaagtcctggaaaactggccccagtttcctccttccctcttctcttaggccatcatcatgaagtcacatgaaattcatgagtggcacaatgctgagctacgagttccattgctggtgaaagagggtggttcagtctgtctgtggaagttatgtttgatttccacctctcctttgctcatccctctgactttgtgtggagtttctccactggggtgtagagagtgtttattcacaataagtgtaacgtaaggtgatgtggaaatgagtagtcctctaattatagagtgacttacataaaaactatgccattggaaatagatgcatttaagttcctaaaggtcaggaggtatggttgagcctggcagccattagcaaatgtgatacagttcaatggtgagtacttacgagtttatacatgtatacataatattggggatatgtcattggtatgttaattagagaatgcgtttgagtatcaatgtatgatcatttccccattatcgatgacaatggaaaaaagcagtagtacaaataatcccaagcgttaggtgattttaaaatattttctatcaagtttgagtgttttattatgatttttttaactgaggttcacctatatatgtcaacagactatggaaagtcatagtgaggttaaaaagaaaatatgaagtaattatatcaaatagtccacaaaggaaaacattctgaaaagtgaatagttcaattaggtggcctataaatgttaagaccagtgttcggcaacagctcagtttcagacccccattccaaatgtcagtacattcttgaaatgggagtggtctttactatgtatgctttgtacacctttcctgaaatttgcttccaggtgttcttgtatattaaataccacagccttgatctttaaatgatgacaaattgtccaaatgtattaacttttcccctttatttttctctttgctttattctcagtaacctcttttctctaattcttacattaacatataaataaaataattccagatgaattcatcatagatgataattataacgtgttcaggtgtggatctctttgaatctatcctacttggaatttgttgagctccttggatgtgtagattaatgtttgtcatcaaattttgaaagtttggctattattcaatacagtcatgcatcacttaaaaataggaatactttctgagaaatgtgttcttcggaaatttaacccttgtaccaacatcatagagtgtacttacacaaacgtagatgatttagcctactacacacttaggctatgtggtatagcctatggctcctaggctacaaacctcacagcatgttactgtactggatactgtagaaaattgtaacacagtggtatttgtgtgtgcaaacatatataaaaagataaaaaataatgcgagggaggagccaagatggccgaataggaacagctgcggtctacagctcccagcatgagcgacgcagaagacgggtgatttctgcatttccatctgaggtaccgggttcatctcattgggagtgccagacagtgggcgcaggtcagtgggtgcgcgcaccatgcgcgagctgaagcagggcaaggcattgcttcacacgggaagcgcaaggggtcagggagttccctttcctagtcaaagaaaggggtgacagacggcacctggaaaatcgggtcactcccacccgaatactgcgcttttccaacaggcttaaaaaacggcgcatcaggagattctatcctgcacctggctcgcaggatcctacgcccacggagtcccgctgattgcgagcactgcagtctgagatcaatctgcaaggtggcagcgaggctgggggaggggcgcctgccattgcccaggcttgcttaggtaaacaaagcagccaggaagcttgaactgggtggagaccaccacagctcaaggaggcctgcctgcctctgtaggctccacctctgggggcagggcacacacaaacacaaagacagcagtaacctctgccgacttaaatgtccctgtctgacagctttgaagagagcagtggttctcccagcacgcagctggagatctgagaacgggcagactgcctcctcaagtgggtccctgacccctgacccctgagcagcctaactgggaagcacacccgagcaggggcagactcatacctcacacggccgggtactccaacagacctgcagctgagggtcccgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgactctcctcctccaaaggaacacagttcctcaccagcaatggaataaagctggatggagaatgactgacaagctgagagaagaaggcttcagacgatcaaattactccgagccaggggaggacattcaaaccaaaggcaaagaagttgaaaactttgaaaacaatttagaagaatgtataattagaataaccaatacagagaagtgcttaaaggagctgatggagctgaaaaccaaggctcgagaactacgtgaagaatgcagaagcctcaggagccgatgcgatcaactgcaagaaacggtatcagtgatggaagatgaaatgaatgaaatgaagcgagaagggaagtttagagaaaaaagaataaaaagaaacgagcaaagcctccaagaaatatgggactatgtgaaaagaccaaatctacgtctgattggtgtacctgaaagtgacggggagaatggaaccaagttggaaaacactctgcaggatattctccaggagaacttccccaatctagcaaggcaggccaacgttcagattcaggaaatacagagaacgccccagagatactcctcgagaagagcaactccaagacacataattgtcagattcaccaaagttgaaattaaggaaaaaatgctaagggcagccagagagaaaggtcggttactctcaaagggaagcccatcagactaacagcagatctctcagcagaaactctacaagccagaagagagtgggggccaatattcaacattcttaaagaaaagaattttcaacccagaatttcatatccagccaaactaagcttcataagtgaaggagaaataaaatactttacagataagcaaatgctgagagattttgtcaccaccaggcctgccctaaaagagctcctgaaggaagcgctaaacatggaaaggaacgacctgtaccagctgctgcaaaatcatgccaaaatgtaaagaccatcaagactaggaagaaactgcatcaactaacgagcaaaatacccagctaacatcgtaaagacaggatcaaattcacacataacaatattaactttaaatgtaaatggactaaatgctccaattaaaagacacagactggcaaattggataaagagtcaagacccatcagtgtgttgtattcgggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcgaacctaatagacatctacagaactctccaccccaaatccacagaatatacatttttttcagcaccacactacacctattccaaaattgaccatatacttggaagcaaagcagtcctcagcaaatgtaaaagaacagaaattataacaaactgtctctcagaccacagtgcaatcaaactagaactcaggattaagaatctcactcaaaaccgctcaactacattgaaactgagcaacctgctcctgaatgactactgggtacataatgaaacgaaggcagaaataaagatgttctttgaaaccaacgagaacaaagacacaacataccagaatctctgggacacattcaaagcagtgtgtggagggaaatttatagcactaaatgcccacaagagaaagcaggaaagatccaaaattgacaccctaacatcacaaaggaactagaaaagcaagagcaaacacattcaaaagctagcagaaggcaagaaataatgaaaatcagagcagaactgaaggaaatagagacacaaaaaaaccttcaaaaaattaatgaatctaggagctggttttttgaaaggatcaacaaaattgatagaccactagcaagactaataaggaaaaaaagagagaagaatcaaatagacacaataaaaaatgataaaggggatatcaccaccgatcccacagaaatacaaactaccatcagagaatactacaaacacctctacacaaataaactagaaaatctagaagaaatagataaatttctggacacatacactctcccaagactaaaccaggaagaagttgaatctctgaatagaccaataacacgctcggaaattgtagcaataatcaatagcttaccaaccaaaaagagtccaggaccagatggattcacagccgaactctaccagaggtacaaggaggaactggtaccattccttctgaaactattccaatcaatagaaaaagagggactcctccctaactcattttatgaggccagcgtcatcctgataccaaagcctggcagagacacaaccaaaaaagagaattttagaccaatatccttgatgaacattgatgcaaaaatcctcaataaaataccagcaaaccaaatccagcagcgcagcaaaaagcttatccatcatgatcaagtgtgcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacatgtttcaaaataataagagctatctatgacaaactcacagccaatatcatactgaagggacaaaaactggaagcattccctttgaaaactggcacaagacagggatgccctctctcaccactcctattcaacatagtgttggaagttctggccagggcaatgaggcaggagaaggaaataaaatgtattcaattaggaaaagaggaagtcaaattgtccctgtttgcagatgacatggttgtatatctagaaaaccccatcgtctcagcccaaaatatccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaagctactttaaagttcatatggaaccaaaaaagagcccacatcaccaagtcaatcctaagctaaaagaacaaagctggaggcatcacgctacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagaaatggggaaaggattccctatttaataaatggtgctgggaaaactggctagccagatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattcaaccaaagagcttctgcacagcaaaagaaactaccatcagagtgaacaggcagcctacaaaatgggagaaaatttttgcaacctactcatctgacaaagggctaatatccagaatctacaatgaactcaaacaaatttacaagaaaaaaacaaacaaccccatcaaaaagtgggtgaaggacatgaacagacatttctgaaaaaaagacatttatgcagccaaaaaacacatgaaaaaatgctcatcatcactggccatcagagaaatgcaaatcaaaaccacaatgagatcaccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgtttcctcagggatctagaactagaaataccatttgacccagccatcccattactgggtatatacccaaaggactttaaatcatgctgctataaagacacttgcacacgtatgtttattgtggcattattcacaatagcaaagacttggaaccaacccaaacatccaacaatgatagactggattaagaaaatgtggcacatatacaccatggaatactatgcagccataaaaaatgatgagttcatgtcctttgtagggacatggacgaatgtggaaatcatcattctcagtaaactatcacaagaacaaaaaaccaaacaccgcatattctcactcataggtgggaattgaacaatgagaacacatggacactggaaggggaacatcacactctggggactgttgtggggttgggggatgggggagggatagcattgggagatatacctaatgctagatgacgagttagtgggtgcagcgcaccagcatggcacatgtatacataagtaatgaacctgcacattttgcacatgtatcctaaaacttaaagtataataataataaattaattaattaaaaaaaaaccaaaacaattttaaaaaaaataaaaactaaaaaaataaaaaataaaaaaataaggcattgcactacagcattatggcagctagtgtgtcagtaggtgacaggtatttttctactccattataatatttttaaaaaattgtttatttttaaatttttgttgacacatagtaggtatgtatatgtttatgggttacatgagatattttgatacaggaatgcagtgggtaataaccacatcagggtatatgggctagccatcacctcaagcatttatcctttgtgttataatttaattatactgttttagttatttttaaaatgtataattatgtacatttaaatatagtaaatattgtgactgtagtaaaacataatttactacagtcacaatatttactatatttactaagtgactatagtaaattactttttactatagtcagtctgatgtgctagcaaatactaggtcttattcattatttctgattttttgtaaccactaactgtcatttccccccaccaccccccacccacacactacccttaacatcctctgataaccatccttctgctgtctatccctatgtgttaaattattttgatttttagcttccacaaataagtgacagcatgtgaagtttgtctttctgtgcctggtttatttcacttaatagaatgacctccagttccatccatgctgttgcaaatgacaggatctcattctttttatggcccagtagcactccattatgtagatgtaacacatttttgttgcgggaagtcagggaccctgaacggggggaccggctgaagctgtagcagaagaacataaattttgaagatttcatggacatttagcagtttccaaagttaatacttttatcatttcttaggcctgtctttactgcagtctctgaacgtgaattgtgaagatttcatggacatttatcacttccccaattaatactcttataatttcttatgcctgtctttaatctcttaatcacattatctttgtaagctgaggatgtatgtcacctcaggaccctgtaatgattgcgttaactgtacaaattgtttgtaaaatgtgtgtttcaacaatatgaaatctgattgtgaaacaagggtgtttgaacaatatgaaaccagtgcaccctgaaaaaacagaataatagcaattttcagggaaaaagggaagataaccataagggctgactgcctgtggggtcgagcagaatagagacatatttttcttctcacagaaagcctatagatggatgtgcgagtaggagaaatattgctgaattattttcccagcatggagtaaccctcaggaaggaatgcattcctgggggtaggtctatagatggctgctctgggagtgtctgtcttatgcggttgagataggactgaaatacgccctggtctcctgcagtgccctcaggcttactaggattgggaaattccagcctggtaaattctagtcagaccagttgtctgctctcgaaccctgtttcctgttaagatgtttatcaagacaatgtgtgcacagtgggacacagaccttcatcagtaattctaatttttgcctctgccttttgatcttttattgccctttgaagcatctgatctctgtgacctactccctgttcgtacaccccctcccctttcaaaatccctaataaaaacttgctgattttgcagcttgaggtcaccatcatggtcctaccaatatgtgatgacacccccggaggcccagctataaaatttctctctttgtactctttttgtttatttctcagaccggccgacacttagggaaaatagaaaagaacctacattgaaatattgggggctggttcccccgatacattttctgtatctattcatctattgatggacaggtaggttgcatccaaatcctggctattgtgaatactgctgcaataaacacaggagtaccaatatctcttcgatgtaccattttcctttcttttgggtatacacccagcagtgggattgctagattttgtggtagctctatctttagttttttgaggaccctacaaactgttctgcatagcgattgtactaatatataatacattcccaccaacagtgtaagaggattcccttttctccatattctcaccagcatttgttattgcctgtcttttagataaaagccactttaactggtgtgagatgatatcttattgtagtttgatttgcatttctctgatgattgatgatgttgagccattgtacctgtttgccatttgtatgtcttgttttgagaaatgtctgttcagatctatggcccattttttattcagattattagatttcttcctgtaaagtcgattgagctccttatatattctggttattaatcccttgtcagatgggtattttgcaaatattttctcctgttctgtgggttaccctttcactttgttgattgtttcctttgctgtgcagaagcttttcagcttgatgtgaccccatttgtccatttttgctttggttgtcagtgcttgtggggtattactctagaaatccttgcacagactgatgtcctggagagtttcctcaaggtttttagtggattcatagcttgaggtcttagatttcagtctttaatctattttgatttgatttttgtatatgatgagagatggggggtcaagtttcctttttctgtatatggatatccagtttccccgcaccgtttattgaggatactctcctttctccaatgtatattcttggcacctttgtcaaaaatgagttcactgtggatgtatggattttcttgaggttctctattctgttccactgatatatgtatctgttttttatgacaatacagtgctcttttggttactatagctctgtagtataatttgagaaattaatataatgtgattccttcagatttgttctttttgctcaggatagctttggctattctgggtctgttttggttccagataaactttaggatttttttttctatttctgtgaataatgtcattggtattttgatagggattgcattggatctgtagatttatttgggtagtatagacattttaacattattgattcttgcaatccattaacatggatatatctttccattttttggtgtcctattcaattttttgcatcaacgttgtatagttttcattgcacagatatttcacttctttggttaagctaattcctaggtatttaattttatttatagctattgtaaatggaattattttctttatttcattttcagattgctgttggcatataaaaatatgactgatttctgcatgttgatagcatattctgcaactttactgaatttgtttttcagctctaattgttttttgtggagtcattagtttttccaaatataagatcatatcatctggaaataaggatattttgacttcttcatttccaatttggatgccctttagttctttcttttgtctgattgctctagctaggacttccagtaatatgttgaatatcagtggtgatagtgggcatctttgtcatgttccagatcttagaggaaatgctttccatttttcctcattcagtatgatactaacttttggtctgtcatagatggcttttattattttgacatatgttccttctatccccagttttttgagggtttttatcatgaaggtatgttgaattttgttaaatgctttttcagcatccatggaaatgatcacatgatttttgtcctgtattctattgctacaatgtatgatattgattgatttgcatatgttgaaccaccctttcattcctgggataaatctcagttataataaatgatctttttaatgttttgttgaactttgctagtatattgttgaggatttttgcatcaatattcatcagtcatattgttttatagttttcttttttgatgtgtcattgtctagttttggtatcagggtaatactggccttgtacaatgagattggaagtattttcttctcctctatttattggaatagttggagtagtattggtattagttcttctttaaatgtttggtagaactcagcagtgaagccatcagggtcattggctttgctttgctgggagactttttattatggcttcgaactcattacttttttttctaattttaatttaattttattttattttaagctctgggatacatgtgaaggatgggaggtttgttacataggtaaacatgtgccctggtggtttgctgcacctatcaacccatcacctaggtattaagccccacatgtattagctatttatcctgatgctcttcttcccccccaccccccaacaggccccagtgcatgttgttcccctccctgtgtccatgtggtctcattgtccagctccaacttataagtgagaacatgtgatgcttggttttctgttcctgtgttagtttgctgaagataatggcttccagctctatccatgtccctgcaaataacataatcttgttcctttttatgcctgcatagtattcaatggtgtatatataccacattttctttatccagtctatcactgatgggcatttgggttgattccatgtctttgctattgtgaatagtgctgcaattaacacatgcctgcatgtatgtttataatagaatgatttatattcctttgggtatatacccagtaacaggattgctgggtcaaatggtatttctggtttctaggtctttgaggaattgccatactatcttccacaatggttgaactaatttacattcccaccaacagtgtgaaagtgttcctatttctgcacagcctcaccagtatctgttgtttcttgactttttaatagtcaccattctgactggcataagatggtatcttattgtggttttgatttgcatttctctaatgatcagtgctattgagctttttttcatgtctcttggccatgtgagtgtcttcttttaagaagtgtccatgttctttgcccactttttaacgggattttctgtttcttataaatttgtttaagttccttgtagactctggatattagacctttgtcagatggagagattgcaaaaaatttctcccattctgtaggttgtctcttcactctgatgatagtttattttgctgtgcagaagctctttagtttaattagatcacacttgtcaatttttacttttgttgccattgcttttgatgtctttgtcattaaatctttgcctgtgtccaagtcctgaatggtattgcttaggttgtcttccaggttttatatagttttgggttttacatttaagtctttagtccatcttcagcatattttgtatatggtgtaaggaaggggtccagtttctatcttctgcacatggctagccagttatctcagcaccatttattgaataaggattcctttcttcattgcttgtttttgtcaagtttgttgaagatcagatggttgtagatgtgtggtcttatttctgagatctctattctgttccattggtctatgtgtctgtttttgtaccagtaccatgctgctttggttactgtagccttgtagtatagtttgaagttgggtggcatgatgtgatgcctccagctttgctctttttgcttaggattgtcatggctatacgggctcttttttggttccatacgaattttaaagtagttttttctacttttgtgaagaatgtcaatggtagtgtaatggtaatagcgtggaatctataaattactttgggcagtgtggccattttcatgatattgattctttctatccatgagcatggaatgttttttcatgtttgtgtcctttctgatttttttgagcagtggtttgtatttctccttgaagaggtccttcacttcccatgttagctgtattcctaggtattctattctctgtagtaattgtaaatgggagttcatttatgatttgtttctccccttgtctattgtttgtgtataggaatgcttgtcattcttgcacattggttttgtattctgagtgtattagtcctttctcatgctgctataaggacatacccgagactgggtagtttataaagcaaggaggtttagtggactcaatagtttcacatggctaaggaggcctcacaatcatggcggaaggtgaagggggagcaaaggcacatctgacatggcagcatgccagagcacatgttcaggggaactgccctatataaaaccaacaggctttttgagacttattcactatcatgagaacagcatggtaaaaacccactcccatgattcaattatgtcccaccaggtccctcccaccacatatggtgattatgggagctacaattcaagatgagatttgcgtggggacacaaccaaaccatatcattccacccttggccccttccaaatctcatgttctcacattttgaaaccaataatgccttcctaacagtcccccaaagtcttaactcattccaacattaacttaaaattcacagtccaaagtctcatctgagacaagacaagtcccttccacctatgagcctgtaaaatcagaagcaagttagttacttcctagatacaatgggtgtgcaggcattgggcaaatacaccccttccaaatgggagaaattggccaaaacaaaggggctgcaggctctatggaagtccaaaatccaatcaggctgtcattaaaccttaaagttccaatgtgatctcctttgaccccatgtctcacatccaggtcacactgatgcaagcagtgggatcccacggccttgggcagctccatccctgtggcttggaagcatatagccccctcccagctgctttcaccgattagctttgagtttctgtggcatttccgggaacatggtgcaagctgtcggcagatctaccattctgggttctggagtacagtggccctcttctcacagctccactaggcagtgccccagtggagattctgtgtggggacttccaccccatatttgccttccacagttctctagcagaggttctccatgagggccccaccccggcagcaaacttctgcctggacatccaggcatttccataccaccactgaaatctaggcagaggttcccaaacctcaatccttgaacttctgtgtacccacaagctcaacaacacatggaagctgccaaggttttgggcttgaaccctctgaagccatggcccaagctgtactttagccatggctagagaggctgggatgcaggtctccaagtccctaggctgcacataacagaggggccctggacctgacctaagaaaccatttttcccttctaggcctccaggcctttgatgggaggctctgccatgaaggtctctgacatggcctggagatgttttccccattgtcttggtgattaacattcagctccttgttatttatgcaaatttctgcaggaggcttgagtttctccccagaaaatgggtttttcttggcaggctgcaagtttttcaaacttttatgctcttcttccttttgaatgctttgcagattagaaatttcttctgccagataccctaagttatctctctcaagttcaaagttccacagatctctagggcaggagccaaatgccacccatctctttgctaaatcataacaacagtcactttccctccagttcccaacaaattcctcatctccatctaagaccacctcagtctggatcttattgtccatatcactatcagcattttggtcaaagccattgaacaagtctctaggaagttccaaactttcccacatcttactaccttcttatgagcactccaaactgttccaacctctacttactaagcagtacaaaagttgcttccacattttcaggtatcttaatagcagtactccactctactggtaccatttgactgtattagtccattttcctactgctatgaagaaatacctgatggccgggtatggttgctcatgcctgtaatcctggcactgtaggaggccaaggtgggcagatcacctgaggtcaggagttcaagaccagtctggccaacatggtgaaacccagtctctactaaaaatataaaaattagctggaggtggtggtgggtgcctatagtcccagctactcaggaggctgaggcatgagaattgcttgaacccaggaggctgaggttgcattgagccaagatcataccactgcactccagcctgggcaacaagagcgaaactccatctcagaaaaaaaaaaaagaaatacctgagactgggtaatttataaaggaaaaaggtttaatggactcacagttccccatggctgggaaggcctcacaatcatagtggaaggcaaaggaggagtaaaggcacgtcttacatggcagcaggcaagagcacatgtgtagtggacctgccctttataaaaccatcagatcccttgagacttatccactattataacaacagcatgggaaaaacctgcccccatgattcaattacttccaactgggtccctcccacatggggattatgagagctacattcaagatgtggtttgggtggggacacagccaaaccatatcactaagactttgctgaagttgcttattagcttaagaagctttggggctgagacgatggggttttctagatatagaatcatgtcatttgcaaacagacagtttggcttcctctcttcctatttgaataccctgtatttctttctcttgaccgattgccctggccagaacttccaatacgatattgagtaggagtgatgagagaggacatcctcgtcttgtgccagttttcaaatggaatgcttccagctttcatgaattgctcttattatattgatgtatatcctttcaatacctagtttattgagagtttttaacatgaagggatgtttaattttattgaaggccttttctgcatctattgagataatcaatgtggtttttgtctttagttctgtctatgtgatcagttatgtttattgatttgcttatgttgaaccagccttgcatccaaggaatgaagctgacttgattgtggtgaataagctttttgatgtgctgttggatttggtttgccagtattttactgaggatttttgcattgctgttcatgagagatattggcctgaagttttctttttttattgtatctctgccaggttttggtatcaagatgatgctggcctcataaaatgagttatggagaagtccctccttttcaattgtttagaatagtttcagaagaaatggtaccagctccactttgtacctttggtagaattcagctctaaatccatcttgtcctgggcttttatttattactacctcaatttcagaacttgttattggtctattcagggattcaactccttcctggttcagtcttgggagggtgtatgtgtccaggattttatccattttgtctagattttttagtttatttgcatagaggtgtttatattaaatagtattctctgatggttttttgtatttctgtggagtcagtggtgatatctttatcatttttgttgtgtttatttgattcttctctctcattagtctagctagaggtctatctattttattatttttttgaagaaaccagcctctggattcattgattgtttgaacagttttttgtgtctctatctccttcagttcactctgatcttggttattttttgtcttctgctagctttgaagtttgtttgctcttggttctctagttcttttagttgtgatgctatggtgctgattggagacttttttttttttttgagatgtagtcctgctctgtcacccaggctggagtccagtggcatggactcagctcactgcaacctctgcctcctgggttcaagtgattctcatgcctcagcctcccgaataggggggactacaagcacatgccaccacacccggctaagttttgtatttttttgtagggaccgagtttcaccatgttagccaggctggtctcaaacccctgacctcaagtgatccatccacttcagcctcccaaattgctgggattacaggcatgagccactgtgcctggctttctagctttttcatatgggcatatagtgctataaatttcccttttaacactgctttagctgcgttccagagattctgatatgttatctgtttgttctcgttggtttcaaagaactttttgatttctgccttaatttctttatttacccagtagtcattcaggagcaggttgttcaatttccatgtagttgtgtgactttgagtgagtttcttaatcttgagttctaatttgattgtgctgtggtctgagcgactgtttgttatgatatcagtccttttgcatttgctgaggaattttttactttcatttatgtgatcaattttagagtaaacgccatgtggcacagggaagaatgtatattctgttgtgttttggtggagagttctgtagatatgtatcaggtccacttggtgagctgagttcaagtcctgaaaatttttgttaattttctgtctcgatggtctgtataatattgacaatggggtgttaaagtctcccactattattgtgtgggagtgtaagtctctttgtaggtctctaagaacttgttttacgaatctgggtgcttctgtattgggtgtatatatatttacaatagttaactcttcttgttgaattgatccctttaccattatgtaatgtccctctttgtctttttttatctttgtcgttttaaagtctgttttgtcagaaactaggattgtcactcctgtcttttctgctttccattggctgggtaaattttcctccatccctttattttgagcctatgtgtgtctttgcacgtgagatgggtctcttgaatacagcaaagcaatgggtcttgactacccagcttaccattctgtgtcttttaatttgggcattagtccatttacatttaaggttaatattgttatgtgtgaatttggtcctttcatcatgatgctagctggttattttgcagacttgttgatgtagttgcttcatagtgtcattggtctttgtaattcagtgtgtttttgcagtggctggtattgatttttccttttcatatttagtgcttcattcaggagttcttgcaaggcaggtctggtggtgatgaattccctaagcattttcttgtctgaaaaggactttatttcttcttcacttatgaagcttagtttgatcagatatgaaattctgggttggaaattcttttctttaagaatgttgaatattagctcccaatctcttctggcttgtagggtttctgctgagagatccactcttagtctgatggacttctctttgtaggtgacatggcctttctctctgactgcccttaacatttgttttcattttgaacttggacaatctgatgattatgtgtcttggggttgatcttctcatggagtatcttattgggtttctctgggtttcctgagtttgaatgtttgcctgtcttgttaggttgtggaagttctcctggatgatattctgtagtatgttttccaacttatttccgttctgtctctgtctctttcaggtaccccaattagtcgtaagttcagtctttttacataatcccatagttctcagaggttttgttcattccttgttattctgtttcttctaatcttgcctgcctgtcttatttcagcaagatagtcttcaagctctgaaattctttcttctacttggtctattcagttactgatacttgtggttgcattatgaagttcttatgttgtgttttcagctctatcaagttatttgtgttcctctttaaactggttattctggttaacagctcttataatgttttatcatcgttcttagcatctttgctttgggttaggacatccttttttagctccgattttgtttatttgtgcgttctctctttttctgagttattctaactaaaggtttgtcagtttcatttatcttttcaaatagccaggttttggttttgttgatcttttgttattgttttctttatttcagtttcatttgtttctgctctgatctttcttatttcttttcttctactaattttgggtttggtttgctcttctctagttcattaagatgcatcattaggttgtttatttgaagttgttcttcttttttgatgtacacacttatagctataaacttccctcttagcactgctttggctatatctcattggtttttatatgttgtatttccataatcatttgttttcactctatatttgaattttttcttaatttattcattgaccattggtcattcaggagcatgttgtttaatttccatgtgtttgtatagtttccaaaattattcttatttatttctagttttattccattgtggtggagaagatgcttgatataatttcaatttttgaatgttttaagacttgttttgtgacctaacatatggtctctttgagaatgatattcatgtgctgaagaaaagaatatatattctgcagccattggatgaaatgttctgtaaatatctgttagagccatttggtctattgtgcagaataaatcagatgtttctttgttcgttttttgtttgggagatatgtccaatgctgaaagtgatttgttgaagtctctagattttattgtattggagtctatttctttccttagctgtaataatatttgctttatatatctgggtgctccagtattgagtgcatatatatttaaaattggtatatcctcttgttgaattaaccctttatcattttatactgactttcttataggtgaagtatgtttcttgtaggtcatagatcattgggcctttttaaaaatttattcaaccactccttatcttctgactggagagattagtccatttacagtcaatgttattatcaataagtaggaacttactctaccattttgttacttctctgctggttgttttgtggccttctctttcttccttctttccttcctgtcttgcttttggtgaaggtaattttcttaggtggtgttatttaattcctttctttttattttttgtgtatcaattatatgttacttgatttgaggttaccacgaggctttttaagctgacaacaacatagcattgtttccataaacaaacaagcaagcaaaatgtaaactaataaacactctaccccttaacttcatcctcccgctttttaactttttgttgtttctatttatatcttattgtattgtgtcttgaaaagttgttgtagttattatctttgattggctcattgtttagcctttctacttaagagtagtttacacaccacagttatggtgttataatattctagtttttcagtatacttactattaccagtgagttttgtaccttcaagtgattatttattgctcattaatgtccttttctttctgattgaagtactccatttagcatttcttgtatacaggtctggtattgatgaaatctcttagcttttgtttgtgtgggaaagtctttatttctccttcatgtttgaaggcaattttcacgggatatactattttagggtaaaagttattttctgtcatcactttaaatatttcatgccactctctcctggcctgtaaggtttctaccgaaaagtctgctgcaagatgtaatggagctttattgtgtgttgtttcttttctcttgctgcttttcggatccttctttatccctgacctttggaagtttgatgactaaatgctttgaggtattcttttggtaaaatctgttgggtgttctataaccttctcgtacttggatggtgatatctttctctgtttggggcagttctctgttattatctctgaataaactttctacctcacctctttctctaccttctctttaaggtcaattactcttagatttccccttttgagactattttctagattttataggcatgcatcattcttttctatttttttcttttgtctactcttactgtgtattttcaaataacctgtcttcattcttactaattctttcttctgcttgatcaattctgctattaaaagactgatgcattcttcagtgtgtccattgcatttttcaactccagaatttctgcttgatttttaattatttcaatctctttgttaatcttatctgatagagtgctgaatttcttctttgtgttatctttgaatttcctcaaaacagctattttgaactctctgtctgaatgttcacatatctgtttctccaggattggcccctggtgcctaatttagtttgcttggtaatttcatgtttctcctggatggattttaagcttgtggacattcatccgtgtctactaattgaagaattaagtgtgtattgtaatcttcgtagtctgcgtttatttgtacccatccttcttgggaaagctttccaggtatttaaaaggacttgcatgttgtgatccatgctgtatctgcatcagggggctccccaaacccagtaatgctgtgactcttgtagtcttatagaggtaccaccttgctggtcttggataagaatccacagaaattatctgcattaccagacagagagactcttgttttcttcccttactttcttccaaacaaatggagtctctctctttctgtgctgagctgcctggagcttgggatgaggtgacacaagtacctctgtggccaccaccactgggactccactgggtcagacctgaagccagcacagcactgggtctcacccaaggtcccctgtaatactgcctggctactgcctgtgttttcttaaggtcgcagagctctacagtcaacaggtggcaaatcgagtgacaattttgttcttcccttcagggcagcaagtttctctaggtcccaggcagctcttgagatgccatccaggccaggaactagagtcaaaaatcctagaaatctacctggtgttctattatattgcagctgagctggcactcaaatcaggcgacacagttcttcttcccactcttccactctattcttttcacaggcagaagagactcactccatggcttccaccagcacaggcccacagggagttctgccaggctactgccaatgttcacttgaagcccaagggctcttcaatcagcttgtggcaaatgctgccaggcctgggactcattcttcatggaagtcagcctccctttggcccagggcaggtccagaaatgccatccaagagccagggcttagaatcggagaccccaagagcccagttggttctctacacccctgtggctgagttggtacctaaagtgcaaaattccctttacttttccctctgtttttctcaagcaggagtctctcactatagccactacaattgagaatgtgctgggtctcacccaaagccagcacatctcagagtcttacccaaggcccacagtgtactacctgagtatcactactggttattcagggcccaagtgctctttagtcagcagatgatgggtccttccaggaccaggtccttcccttgaaggcaacgggtacccttctgtttcagaatgtgtctagaaatgttgttcaggagctagggcctggaactggggtgctaagactctgaccagtgccctattctgctttggctgagcagggagccaagatgcaagaccaagtcttctttactcttccctctcctctcctgaagaggaaggaaggggtctcttttggagccatgagctgtgcagcctgggatttgggtagtggtggtgcaagcactcccttcactgccctggcttgtgtatgttacatgccctccaagcccactagctctaagcccagctcagcatacatactcacctaggagttgcagttcttgtgtcctagaccgcctttcaaatttacttagagcccagagcactttagcagatgatggcaaagcttgccagaactcacattccaactgctgggaaatgggattcccttctagttagggctgctctacatgcgttctccatgggtaagtgtcagctgcattcagtgcagttttgctttccactgggacaaggcagcactgagtttaatgcagtctcacaattgcttcattctccttctcctaagcacagagattctctctccatgccacacagccactgctgggggaatgggggaggggtcatgtcagtggttcaagactgtctttcctaccctgtttagtgcctctttcagaaatattaagttaaaacaggtactgtgggggctcacctgattttcagctcttatgaaggtgcttttttgtgtgtagatagttgtcagttttggtgttcctgtgggataggagagatgatcagtagagccttctattcagccatcttgctctgccctctcccctccattataatcttatgtggccactgttgtatatgtggtctattgttcactgaaacattacgcagtgcattactgtattcttttcgtcctttttctctctcctccgcttctgggcatatcatcatgtgtatgttggggcactagatggttcccacagttctcttaggctctctttgtttttcttcattgtctgtgttccttagactggttaatctcaatcaatatatcttcaagttcactgatgctttcttctacctgctgaaatgtgcagtcatcttgctcttctagtgaatttttcatatgatttatacttttgagtctagaatgtctactttgtctttacaacttatgtgtctttattcatagtctgtatttggtgagacattgttttcctactttagttctttagacatggtttctttcagtttatgaacatatttataataactggtttaaagtgtttgtctagtaagttcaatatttgggcttcctcaggaacagtttctattgattgctttttttctgtgtttgggccatactttcttgttttttgcatgtttcataatggtgttttgttgaaaactagatattttgaataatacaatgtagcatatctgcaaatcagattcttttcctatctccccaggtctttttgttgctcctgtagtttgtttagtgactttcctgaactaattctgtaaagtctgtattcttttgtcatatgtgtccactgaaatctttgcttggttaggttagtggtcagctaatgaatgaacagagatttctttaagcacctggaaccaataaatctcccagtctttgtgaagggactctgtgtgcatgttggaagtatgccttcaatgctcaggcaggtagttgacagctttgccttagccttcacttcccacttgcttagaacctcagggtcagtcacaggtgggagcttaggcctttttcaggtatttcctgtgcatgcacccagcctcgagcaacaacacagccctacacatgcatgtggccatggagaattccaggaatatgtgagtttttcaaatcgccccatagaaatttcattcctcagctttaagctatttggttaacctattgttggccccatctattatgcattgcctcagacagccatgataatacacaattgccactgattgttttcagcaaatgccactggagggatagggatccagtttccttcttctacatatgaatatccatttttcccagcaacatgtattgaagagagtatttttccccaatgtacgttctttgtgccttcatagaaatcagttgactgtaaatatgggctttgtttctgggttctctgttctatttcatttatctgtgtgtctgtttttataccaatatcatgctgttttgggtactacagctttgtaatatattttgaagtcagatagtgtgatgcctccagttctgtaccttttgctcagaattcttttggctacttggactactttgagttccatataaattttagggttttttttccatttctgtgaaaaatgacattgatattttgatagggactgaaattattttttacattgctttgtgcagtatggtcattggaaaaatattaatttttctgatccatgagtatgggatgtatttttatttgtttgttttctgtttcatttctttcatcagtgttttgtagttttctttaaaagaggtcatttatctccttggttaaatataatactaggtattttatttttgtaactcttttttataactattgtaaatgggattgccttcttgatttcttctcagctagttgattatttatgtgtagaaatactactgatttgtgtgtgttgattttgtgttctgtaactttactaagagtttttggtgaagtctttaggtttttctagatacaagatcatgttgtctgcagaggtggatagtttgacttcctcttttccaatgtgaatgccttttatttctttctcttgcctgattgctttggctaggtacagaaagacctagccaagtggtgagtggtgaaagtgggcatccttttcttgctccagttctcagaggaaaggcttccagcttttccccatatcattacctgtgctctttattatgtttacatacggtctttagtatgttgagttatgttccttctatgcccagtttctgagtgctgttatcataaagggctgttgaattttatcaaatatttttcctgtgcctattgagattatcatattattgttgtccgtcattctgttgatttgatgtattgtgtttattgttttgtatatgttgaaccatccttgcatccctgggatagatcccatttgatcatggtgtattatctttttcatgtgctgttggatttgatttgctagtatgtagttaaggagttttgcatctatattcatcagggatattggcctgtagtttttgttgttgttgtatacttgtctagttttggtattagggcaatggtgcctcatggaatgaattagggagaaatccatttgcttcaatttttttgaatagtttgaggagaagtgatgttagttctttttaaatttggtagaattcaacagtgaagccatctggtcctgggcttttctttgttgagagactttattagtgattaaatctcattattcgttattagtctgttaaggttttctacttcttcctgattcaatcttggtaagttgtatgggtccaggaatttatttttttcctctaggtcttccagtttgttaatgtatagttgttcttaataggctctgatgatcttttatatttctgtgctatcagttgtaatatctccttttctatttgtgattttgagtcttctctctctttttttggttagcttaactagtaatacaggagttattaagaaattatttttaggcagctagaaagggtgaaaactcccagtgtaatttttctttaataaaaagcagtccccaaaccatttcttctctaacaggaagcagcctgagaagtcaggcatagatatgcaaactaggagcttttatatgtaaatgatggcagctgtacctggaagccaggtacattcaatgtggcatctcccatcctcttttgcttgtcactatgttaatgggtatcatggcagcctccaggtaaaaccgtgtgtacaggcatcatggcctccaccaggtggaggccgcatttgcataataaaagactagggtcagagggccagtctttttgcaagctatgtaaatggcacacctggtaaacccaatcccctgagccctatgtaaatcaatcactgcctcctcaagcctctgtacaaaaccgattatgttttgccacaaactagagaccctcttttgggcgacccactttttcagcatgaggaagctttttttctctttcttctttttctattaaactttccgctcctaaatccactccttgtgtgtgtccatgtcttgaattctttctcaactgtgacaaagaaccagggtatataccccagaaaatggagccatttcactagcagtttatcaattttatctttttttgaaaaaaaacttttcattttgttgatgctttgtaaattttttagtctctatttaatttagttctgctctgatctttattatttccttcctcctactaattttgggtttgatttgttcttgcttttctagtacttggggtgcatcattagactatttatttgaaatctctctgcttttttgatctagatgcttattgctataaacttccctcttagcagtgcttttgtgtgtcctgtaagttttggtgtcttgcgtttccattttcatttgtttcaggaaatttttaaaacattttttccttaactttttctttaatccagtggtcattcaggagcatgttgtttaatttccatgtgtttgtagtttccaaagttcctcttattattgatttagagtttcagaccattgtgatcttgatatgattttgattttttaaaaactgttgagatttgttgtgtggcctatatcttggagaatgttccatgtgctgatgagaataatgtgtattctgtagctgttggatgaaatgttctgtaaatgtctgttaggtccatttggtctaaagtgccgtttaaatccaatgtttctttattaattttctgtttagatgatctgtcttatgctgtgagcggagtgttgaagttcccaactattattgtattggagtctatctctccctttagatctaaaaatatttgctttacatatctgggtggcctggtgttgggtgcatatgtatttggaattgttatattctcttgctgaattgatctctgtatcattatatattgaccttctttgtttctttttattgttttcaagttaaagtatcttttgtcttatttaaacatagctacccttgctcatttttttatttcaatttgcatggaatatctttttttcatccctttactttcaatctatatgtgtctttacaggtgaaatgagttcttatagggattctatacataggtcatttttttttaaatccattcagcccatctatatcttttaagtggaatgcctcatttgtttacattcaagattattattaatatgtgagggcttattcctatcattttacttggtttcttgttgtttgtatatcttttgtgtctttctttctgtcttattgtttattcattatggtttggtggttttccgtagtcataacatttgagtccttttttgtccttgtttgtctgtttgctctaccagtggttttatacttttgtgtctttttgtgatagtagatagtgtccttttgcttccaggtgtaggactaccttaaacatttcttgtaggattggtcttatgctgatgaattccctcagctttggcttgtctgggaaagactttatcttttgtttatgaatgttaactttgctgggtatagtatccttggctggcagttattttttttttttcctttaagcactttgaagatgtcatcccattctcttctggcctgttaagtttctgctgagaaaccaactgttagtctgttaggggttcccttataagtggctagatgcttttctcttgctgtttttaaaattatctctttgtctttgacttttggcaatttgactataatacacagtggataagacctttttagacgatatgtatttggagatctctgagcttcctgtgtctggatgtctaaatctcctgctagacttgagatgttttcagctattattttgttcaataggttttctaccccctttgttcttctattcaccttttggaacactgaaggtcaagtatttggtcaatttgtggtctcctttatgtcatgtaggttttgttcatttttaaaaattatttctttaaaaaaaatttgactgactgggtgatttcaaaagacctgtcgtcaagtcctgaaattttttcttctgcttgatctagtctattgttgaagctttagaatgtatttttttttcattcagtgaattcttcagttccaggatttctgtttgtttctttttttaataatatctctttgataaatttctcattaatatactgaattgtttttctgatttttttgtgctgtttatgaggttctcttgtctctcactgaggtttttaatatcaacacttttaataatttttctaggatttcataaatctctttttttggggatcttttgctggagaataattatttttatttggaggtgtcatatttccttgctttttcatgtttcttgtgtccctccattgatatctgcacatctggtgtgccagttgcttcttccaaaattttggattttctttcatacgggaggacttttcctgaagatgtatctgttgtgttggctgggtagggcaccttggctttgattctgggtacgtgcaatagtgtattctctatatgatttcttcagttgtaaacagcttcagtagtgtttgtgatttcctcagtagcttagggtgtggttgttagtgaaggctgtggtgaagctttgctgggcactgggatgccaggtaggaatgtcatcaggcccactgtggtaatggtaggcctagcatacctgtcattgggcctcagggcaacataggctggcaacaatgttagttggtcctggcaggccaatggttgcacctccatgtggctcaggtgccagaagtggtagtggtggtcctcgggtccctgggcagtgggcttggaaagagtgatggcagtagcagtggcagaacaactctttggccccaaaatggtttgtgctggtgttagcagtggctgtggaaggctgggtgggccagtctcaggtctgcaagtcacacatgcaggtgagtgtcagctgctgtagttgtggcaggttgggtgggtctgtcctcaggcccctgggagaagtgctcaagtgctaatggtggtagatgagacagtgaaatccccaggcctccaggtggcatgctcagacactgggagtgggacagagctggaccaggtcatcctttcctcaatcctcagtcatatgtgtgggcactggctgtgttggcagagccagggtgattccaaagtttctagtggaatgcttggatgggaacagcagtgactgtgctgtggctctactgttggagcgtgcaaggttgctttcattggtagcagtaataggcaggaagctgtggagcacatgccttggtctcaggtggtagctgtaggcagggtagcctgtcctcagagtcactaccagtagctcacacttcagccctggcagcatcagccagcagtggcagtgactgcagatggagaaatctgtcttcagggagtgggaaaatgcaccctatagcagggtcacgccaacggcttatggttctgctctggatgcaccagacagcagtggtggtggctacagatggatgatgtgaattcagctccagggatgtggagatgcaaggcctgctgggctccagtgcaggatgcagcctggtggggcctggcctttcaaaatggagacatgctgcagcttcttaggagttggagggtgtgtgggtctcagtgtgatctccctctctggagcatgccatcatgcagtctccaggcagatccctatgttagtctcaggacccaagagggtggatgggctctttgaaggctgagattgcaggagtctgcagtgggaatgtggactgctgagggtttctcacatacccttttcctgcactggagagcctctctgggctcccacccaatctggctgagcagagtgcctttcttccctctccttccttgccttaggtgtttcctgtctcttctctgttgaattctagtgttgtcttttggatgatcaattcaaagtgtgattctaatactattttggttcctctttctggaggaggcaagtaccggatgcttccagtcagccaccttgaacagacatactggaagaccaagttgtaccatctttataggcagatgtggctgaagagatgaaatttatgccctctctccatcagtttgggctgctataacaaatcaccacagactggctggcttagaaacaacagaaatttatttttcacaattctggaggctggcaagtccaagatcaagaaatcagtagattcggtgtctggtgagggctcacttcctggttcacagactatgccttcttgctgtttcttcatgtggtggaagaaatgagagaactctctggggtctcttttatgaaggcactaatctcattcatgagtggtccactctcatgtcctaatcacctcccaaaggaccccaccttcaaataccatcacattggggattagatttcagcatatttattttggagggacacaaactgctcttttaatattcattttttttaccaagacctacttattaatttctcagctattttgatctttataggatattctaataagtgtttttatgttttaagtattaatcattgtagtgggctgaatagtggccctctaaaaggtctgtcaatgtcctaatccctggaacctgtgaatgttaccttatttggacaaagtgcctttgcagagcctccagaggagggtacagacctactgacactttgattttacagtctggcctctctaactatgagagaataaattactgttgttttatgccactgactttgttgtaatttattacagcagccatagaaaactaatacaattattaatgtgttttaaatccatggtgttttgagaatacaattcaaatacaggttcaatattaaccatctggcttccttgccagctagcttgaaattcatttgtttatcatggaggagtaggtcatttgtgttaattactagctcaactagtagttttgctaaaagtaattttcattttttaaataaacaaggacacattttttgaccaaggagaaaaatcaagcatagagaataatcataacctttgaatactattcaacaggagggatttttttgtctatgggaatacagaagaaaattggtaaacaagcagtctagaccagacataagctgtatgtcagtgattataaggcaagtaaataattgtgccttagaattgatcaattcagttagaagaagggggaggagtcagccaagcctctaactagatggtctgaccatttacttgactaaagagtcatttgatgagatgagtgagatgaatatttatgctcagcaagtgtctgacatagtatgtactcaaaatttaatttaatattattattattactatcattaattaactcacagccttgagttgacatggatactttttaaaaataatgaagaaggtgttaaagactgcatgctgccacttgaaaatgtccttgccaacaggcccttataattgaggtagagagacaacatatgtgggctgcgattacaaagtaataaatatttgctttaaaaaatcagtagttacatatgaaaattcatgctgtccctttccaaattggctactttaggaaacttacattattttcacaaaaccgatgttacttaaaagtgtttttgagatcatctccagaccctccagtatgttgcttagaacctactttgaaatgacagtcctttttcctttgagggtggagcagctatgtcatttggaactaagttcacattttctaggttaacgtctttaaagtagaatgcttatatgtatgcatgtacttgagtttgtcttcttttggggagaaactatatttattttgttatcaaggaatccacttctatgactcgtgaagcccaggctgagttaacagtgatgagttctagagggacctacttcccagtctgaattttctggtttcaattcatcttctctcttaacctgaactgaaaacccagacttatgaagcctcaatccttgccctcttattcctggaaaattgcaaagccaaatatgtaggaggctttttcagaagagaaaatgactttgtgttttcagaaaacaaacccttcactttgctttatgaggcagatagcagccccaaaccatgtacaggttgggtcctgcacagatcttaattggtttcttttctaaagatgaatttatgtcattacttaatgggcacaccccatatatcatcagcattaaaatgggacattttgaatattctagttccatccccttcacccagcatgggatccttgcctccaacagttctgaggaaaagagcttattactttataagacacactagtacattgtttgaatcagttatactgttagaaaaacctattatagttaaatgatacaagatatgggtatgtgcccaatatagcacatagaacatagtaaaatacatgatagatatttataacctgctcatgtagccctaaaatgtgcttccttcaaactctatcttctggagcaacaaaggttaattcttaattcttcttctatatgacaaagcttcaatcgtttaaaaatatatttacctaatgtgtccttgaaacatctcccctccaggccaagcaccctcaagttcttctgtcattctcatatgtcaggatttctagacaggatacacttgaaacaggtaataatactaaataatatatgataagggagaaataagtggtattgagagctagttaaatagtccatagacaggatatccataggctagagtggtcttgagaaggtttagtggtgggagtggaatttatgcaaggccttaaaattcaagtagaatttggaaggactgagaacagactagaatagatctcctaagtgaggtaaagggccttttaatttagtccagtacagtgataggtgtttttattatttgttctatcttcctggagatgaaggttttaaaacaaaccctaaacaaaaaggaggagataaaattaaagatggtttcactctttaaagctgggcccttcggcaagtagctgtactagttgagggtggctgggagaagaaccagtggtttctgacaaagtagagcctttagcattgggaaagaagatattaattacaatggatgctaatagtttctatttgaaaattattgtagtggtttttctgaaaacacaataagtaagcattaggtgggtaactaaatcactgctgataaagaatcttctttactactagtgtgggaagacagttgcataaggaaatgtgcttggtgcctccatttctgttatacctttctcaggagctgataattggaaatgttttaagagaggttataattagggcttgggggcttcatgtatagttttttttttaattctcttggatttttatgtttattttcaaggcaaataagttgtggctcacttgtaggaggaaagactcaacttttgtcagtgttcaaaaaaagttgccattatacattgtccacttaaattattgaattatatcacaaataggtttgtatattagagtagcactatgtatactgagagcagtagagcttgcttcacttgttattatttgactagccatataaacccatgtacttagcatctacactctccctttctttctttctcactgtctcctttgcaccctcccgtaaatataccttgagttcttgaactatatctattgtataccaacatgtttgaatcttttggttggggtttctaacccccaccccaaacaaagacatagaatatgagttatttgaacaatgagaatttgtttttttggaaacagcacctttatttttgtttatttttgatccatgtgtatcctcagagtagactattttctaaaaagggtaaacaacacacagtataacagtggcagtgcaaggtgtgtggggtattttttattccacaggggagactatgatggagtcatctttatttaagatggcttctaatactctatgtcactcctgccactcagcatgtattactgagtcatgcacctagtagatactcaaataaggtctaattcagggcttctgtttcctggagcctaggagcacctaatagttaagaagtgatatatgtacataatcattaattctctttaccaatagcttccctggttgggtttgtttagtaacattatttatttagctaaacccattgctctatatgtgaacactaatcaatcagggcaagccctagcccagttaaaaaatccatgtctagttagttttgttgaaaaaaatggtgttggatgtattaatagatataattaagggagtatcctagttctctcatgtttgtattgcttctcaccttgtacataggaggctctctgaaaatgcttgttgaattattgagctggattgcaggacttaagtatcacaattattagcattacctcttccaaaatgttttgcagttatggtacagttaaagccaaaagtatagagacgatttgttattatggtttagatgagtaacagaggctccttagctcacttaaagagaaatcaggcaagtcacctgtggactagaaatctcctcagtctctcctctctagcccccctgtattaggtgttcatgaggctcgccaggggagttgaggaggtttactgcaaacaactgttcttttttcttttggggtaaatggtggtgcaaggagtaaggggacctggaagatggagaaagtgttgaaaacccaaagcacaacccattagttttgagagtataatgattaatcatcatttaaaatcccaggttggctgggaaacatatttcagaatatcatccatgaaaatttccccaaccttgctagagaggccaacagtgaaattcaggaaatacagagaactcctgcaagattctacacaagaagatcatccccaagacacacaatcatcagattttccaaggtcaaaatgaaagaaagaatgttaaaggcagctagagagaatgggcaggtcacctacaaaggggttatcagtctaacagcagacctctcagctgaagccctacaagccagaagagactgggagcctatatttaatattcttaaagaaaaaaatcttcaaccaagaatttcatatccagctaaactaagcttcctaagtgaaggagaaataagatccttttcagataagcaaatgttgaggggattcattaacaccagacctgccttacaagagatcttgaaagaagcactaaatatcgaaaggaaaggctgctactggctaatacaaaaacacacttaaacacacagaccagtgtcattgtaaagcaaccacataaacaagccaacatcataaccagctaacagcacaatgacaggatcaaatccacacatatcaatactaaccttgaatgcaaatgggctaaatgcccaacttaaaaggcagagagtggcaagctggattaaaaaagcaagacccggctgggcacggtggctcacgcctgtaatcccagcactttgggaggctgaggcaggcggatcacgaggtcaggagatcaacaccatcctccctaacatggtgaaaccctgtctctactaaaaatacaaaaaattagctgtgcgtgttggcaggcgcctgtagtcccagctactcgggaggctgaggcaggaggatgatgtgaacctgggaggtggaggttgcagtaagccgagatcacaccactgcactccagcctggggaacagagcaagactccatctcaaacaaacaaaaaaaaaaagcaagacccaatagtatgctatcttcaagagacccatctcacacataatgacacttacaggctcaaaataaagggatgcatgaaaatctaccaagcaaatggaaaacagagcaaaaacaagggttgcaatcctaatttcagacaaaacagatttcaaacgaagaaagatcaaaaaagcctaagagcattacataatggtaaaggtttcaattcaacgagaaaatctaaccatcctaagtatatatgcacccaacacaggagcacccatattcataaagcaagttcttagaaacataaaaagagacttagattcccacacaataatagtgggagacttcaacactccactgacagtattagacagatcatcaaggcagaaaattaacaaaggtattcaggacctaaactcaacattggaccaaatggatctgatagaccatgacagaactctccacccgcaaacaacagaatgtacattattctcattgccacgtggcacatactctaaaactgaccacataattagacataaaacaatcgtcagcaactgcaaaagatccacattcataccaaacacactctcaggaccacagcacaataaaaatagaaataaaaactatgaaaattgctcaaaaccatacaattacatggaaattaaacagcatgctcctgaatgacttttgggtaaataatgaaattaagacagaagtcaagaagttctttgaaaagaatgagaatcaagatacaacatgccagaatctctgggacacagctagggcaatgttaagagggaaactaatagcactaaatgcccacgtcaaaaagttagaaagatctcaaattaacaacctaacatcgcaactgaaagaattagagaagtaagaacaaatcaactccaaagctcgcagaagacaagaaataaaaaaaatcagaactgaactgaaggaaattgagacatgaaaaatcaaaagatcagtgaatccagaagtttgtttcttggaaaaattaataagatagataggcctctagctagactaataaagaagaaaataagatacaaataaacacaattagaaatgatgaaggggatgttactactgaccccacagaaataaaaacaaccatcagaaactactatgaacacctctgtgcacacaaactagaaaacctagaagagatggataaatttctggacacatactctctcccaagactgagccagaaagaacttgattccctgaatagaccaataacaagctccaaaattgaatcagtaacaaatagcctaccaaccaaaaaaatcccagaacctgatagattcacaatagaattcaaccagattacaaagaagagctggtactattctcacagaaactattccaaaaagttgaggaggaagatctcctccccaactcatcctgtgaggccagcatcatcttgatttcaaaacctggcggagacacaacagcaaaagaaaacttcaggtcaatatccttgatgaacattgatacaaaaattctcaacaacagacttgcaaaccgaatccagcagcacgtcaaaagctaattcaccatgatcaaccaggcttcatcaccatgatgcaaggctggttcaacataagcaaatcaaaaaaatgtgattcatcacataaacagaactaaaaacaaaacccacatgattatctcaatagatgcacaaaaagcctttgataaaattcaacatccgtttatgttaaaaactctcaataaactaggtattgaaggaacatacctcaaaataataagagccatctatgacagtcccacagccaacaacatgcggaatggggaaaagctggaagcataccccttgaaaaccagcacaagacaaggatggcttctctcaccacttctattcagcatagtaaggggaagtcctagacagagccatcaggcaagagaaagaaataaaaggcatccacatagaaagagaggaagtcaaactatctctgtttgcagacgacatgattctacatcaagaaaaccccatagtcttggcccaaaacctccttcagctgataaacaacttcaacaaagtttcaggatacaaaatcaatgtacaagaatcactagcattcctataaaccaacaacagccagaccgagagccaaatcagaaagacaaattcattcacaattgccacaaaagaataaaatacctaggaatacagctatccagggaggtgaaatatctctacaatgagaattacaaaacactgcaaaaaaaatcagagaggacacaaataaagggaaaaacatcccatgctcagctgggaagaatcaatgtcattaaaattatcatactgcccaaagcaacttacagattcaattctattcctatcaaactaccaatgacattcttcacagaattagaaaaaactattttaaaattcatatggaaccaaaatagagcctgaatatccaagacaatactaagcaagaagaacaaacctggaggtatcacattatctgacttcaaactatactacagggctacagtaaccaaaacagcatgatactggtacaaaacaggcacatagaacagtggaacagaatagaaagcccagaagtgaggcctttcacctacaaccatctgatcttggacaaacctgacaaaaacaagcaattgggaaaagacttcctattcaataaatagtgacgagataactggctagccatatacagaagattgaaactggacaccttccttacaccatatacaaaactaacaagatggattaaagacttaaatgtaaaacccaaaactataaaaaccctggaagacaacctaggcaataccatcctagacataggaatggccaaagatttcataacaaagacaccaaaggcaattccaacaaatgcaaaaattgacaagtgggatctaattaaacttaagggcttctgcaccacaaaagaaactatcaacagagtaaagaaacaacctgcagctgagcatcccagcggagcatgggatgtttttccctttatttgtgtcctctctgatttttttgcaacctacagaatgggagaacatatttgcaaaccatgcatctgacaaaggtctcataatcagcatctatagggaacttacacaaatttacaagagaaaaacaaccccacttaaaagtgggcaaaggatatgaacagacagttctcaaaagaagacatacatgcagccaacaagcatatgaaaaatagctcaaaatcactgatcattagagatatgcaaatcaaaaccacaatgagatgccgtctcaccccagacagaatggctattattaaaaagtcaataaatactggatgttggcgaggttgtggagaaaaggaaacacttatacactattggtgagtgtgtaaattagttcaactattgtggaaagcagtatggtgattcctcaaagagctgaaagcagaactgccattcaatccagtgatcccatgactgggtatatacccagaggaatataaatcatcctaccataaagacacaggcatctgaatgttcattgcagcactattcacaatagtgaagatatggaataagtctaaatgtccatcaatgacagattggataacgaaaatgtgatacacatacaccatagaataccatgcagaaataaaaagaacaagatcatgtcttttgtgggaacatggatggagctggaggctattattcttagcaaactaacgcaggaacagaaaaccaaataccgcgtgttctcacttgtaagtgggagctaaatgataagaacttatgaacacaaagaaggaaacaacagacactggggtctacttgagggtgaagggtgggaggacagagaggagcagaaaagataactattgggtactgggcttaatacctgtgtgatgaaataatctgtaaaacaaactcccatgttacaacctcctatgtaacaaaccatcacatgtacccccaaacctaaaataaaagtttttaaaaatcccaatttgggcaattaaaaatgctacagttgtagttagaaggctcttctagtgataccacctaaggaagagtatgggtctgggatatttctctcatatctctaggaaaggaccaaatgtcatttttaagtaggcattgaatacctacaatatgaaaagttctgtgtggaatgcagtgatgaactggattcccaccctttttccacctactggtttatagtgttttaggtaaagataaataaaggaacaatggaaggcagaatgtattaactgttctaagtggtacaaggtgcgagaagaggaaagagtgatttgtaatgattcagtaagtgagattatcacaaggtaggggatgcatgtttacttttccagggtaattatttttaatggcaactgaacttagttcacactgacaattgacagcactcctttgagaaaaggataataatttatatcctaagtaaggactgagcagattactagaattttaccataaaactataaagaggaattaaaattgtaggcttatactcacatatttgcaggttttcattatatatttttctcattctatgttttctttataccataatgatgtacaaggatgataataaatgatgtataagaatcatgttttccttataactggggatggtagggtgcagtttgatggggagagatcttcagtttcagcaagactgagtggttaaagcagagccttaaaaaccaacaatttaaataaaaagaagggaccttggagcacagcaaaagctgtgtacactgcctgaagtttaaaaagacatccctgtattgttaccatatgttgttaatagcactcattcaaggaaaagcccattggcaaactggttgatgaggctggccagttcaaatatagaggaaacttcacagggagcataataaaatggtaatcaaaagatattattgtatgctttaaaaacctgatttaaaaaatcaaatttaatgtaaatttaccccactttgattcagttgcttcaaactaattttctatttaacttaatatctagtaatatcagaatttttctttggtaaaaagctcaatttaaaatgtttttaaattaaaagttgggggttctaaaccctttgctttccccaagttcagggtagttagaattatcacccagattgtttggatcaggttcgcccatatacaggcttagcacattgtacatacacacatacctacattaagtcatgaggattttctggattcaatattttattcttttaataaaaatttgtaattgctcagattccaatttattctggactgaaactagtttttccttcaggttcagggcttgtaagtccagggcacttgctgtttgaggcctatttttattatttcctccatccacaatgggcactatgttcttctttttcaccacttacttataaaagacacacatgcatgcacacacacatacatagaaacatacgtatttatagacaggaaactgctatgccgtttaaataagaaatcactgcgcctttctcataagctcagttttttttccttttgatgcctgatttattctttcttataagaatctgagctgttagttacatataacaattgtcccccttgatgactactttctgatagcctgaccctttcattttcagacctgtattgctgttcttgttttcttttactaacagtggtctcttctcttcagctcttctctggtgtttgcagttctgcctttgtagatgacaaagaatcttggaaaaaatgcagaaatggtaggaataaagaggagcaggacaagatagtgaagagattcttattctgctattcattactcttctgttggaggggctgaattgtaaaatgtgacaaaagcagggaacaggaaaattataatgatacggtcttctgttaggaggtaatatttacttattgggtaaccaaaatgagtatctggttagtgtaaggaagatgagaaagacagtccttatgtttgctggtatataaaactattgggaggggcagaacaagatggcagaatacaaacctgcaacgttagtactccccacaggaacaccaaattttaacaactatctgcacacagaaagcactgtcacaaaaaaacaaaaatcaggtgagcaatcacagtaccggactttatattgttgaaagaggtattgaggagggtcagagagacagtcttgaatcaccagatccacccctcccctatcccccagcagcagccatgcagcacagagtgtctgtgcactttcaggagggagagtgaagtgactggggacattatattgatttcagtgctacactgtcacagtggagaaaaaagccatgctgggctcagtcagcacctgtgcacagagggggcatttgcagcagccctagccagagagggatcaatcatccatcccatcagtcagaactccactctctcagcaagcctcaccaccacaggcaaaagagctctggggtcctaggtaaacttgaaaggcagtctaggacacagtgactgcaatttccaggtggcccttagtgctgggctaggctcagagccagaggactagggtggcacgtgacctagggagacaccagccagggcagctaaaggagtgcttgccccatgcctccccccaaccccaggcaatgcagttcacagcaacgaaattgtctccttccttctgcttaaggggaggaaaacaaagatgaaagaggacttcgtcttgcatcttggataccagctaagccacaatagggtagggtaccaggcagagtcgtgaggcccttattccagggcctaggtcctggacaacatttctagctataccttggtccaaaagagaaactgctgccttgagggaaggactcactcctggcaggattcatcacctgctaactaaagagctcttgggacctgaataaccagcaccaataccctagtagtatgctgtgggctttgggttctaagacgttctgaccacagatgtgatccagcacattcccagctgtgttgtctacagtaaacaactccttctgtatgagaaaagcagacagaaaagtaaaggggacttcgtcttgcaccttaggtaccaacttgaccaaagtggggtagagcaacaagcaggctcttgggttccctgagtctaggcctaggctcctggatggcatttctggacctgccctgggtcagaccatagccctgaagggtgagtcacaggcctggcagtattcagcacaagctaactgaagaggccttaggctttaagggaacattggcagtggccaggcagaagcccgccctcctccttcccccaccatgggcaagtggtggtgatggtgacagggagaggcctctctgcctgtggaaagaagaagaaagagtgggaaagactgcatgtcatggttttagcaccagcttagccacttatctatttagtaggatagaacatcaggctaatttctgatgtttttttaactccaatccctggcacccagacaacatctcctgaccagcttgtggcatggaggaacttgtcaccctgaagggaaggacaccaaacagtctgactttgccacctgctggttgtagagcccaaggacttgagtaaatgtgggtggtagccaggtagtggtttcagcagaccttgggtaagatccagtgttgtgctggcttcaggtatgaacaagtgcagtctcagggatggtggccacaggagtgcttccatcaccatacccccacctccagacagctcagctcagagacagagactgtttgtgagaaagtagggacaaaaaaaaacaagagttcctttctggtcatccagaaaattcttccagattttatttaagaccaccaaggtggtacctcttatgagtctgcaaaaaccacagaaatattgggcttggggtccagtctcttaaaatacttgtaaagcctcctcaagaaaggcagaagcaaataagcccagactgtgaagactacaataaatacctaactcatcaatgttcagacaccggtgaacatctacaagcagcaagatcatccaggaaaacatgagctcatcaaacgaactaaataaggcaccaggacctatcctaaagaaacagcgatatgtgacctttcagacagaattcagaatagctgttttgaggaaacttaaagaaattcaaggtaacacagggaaggaattcagaattctgtcagataaacttaacaaagagattaaaataattaaaaagaatcaagcagaaattctagagttgaaaatgaaattgacgtactgaagaatgaatgcatcagagtctcttagcagaactgatcgagcacaagaaagaattagtgagcttgaagacagactatttgacaatacacagtagacgaaagaaaaaagaatgaaaaacaatgaagcacacctacaatatctagaaaacagcctcaacagggcaaatctaagagctattgcatttagatgggggatagagaaacagatagaggtagaaattttattcagggggataatatcaaagaacttcccaaacctacggaaatatatcagcattcaggtacaaggttatagaacactaagcagctttaacccaaagaagactacctcaaggcatctaataatcaaacctcctaaaggtcaaggataaagaaaggatcctaaaagcagcaagagaaaagaaacaacataacatactatggaactccaatacctgtggcagcagtcttttcagtggaaaccttacaggccaggagagagtggcatgacatatttaaagggctaaaggaaacatattttaccctagaagagtatttctggtgaaaatatccttcaagcatgaagcagaaataaagaccttcccagagaaacaaaagctgggcatttcaacaccagacctgtcctacaacaaatgctacagggaattcttcaatctgaaataaaaggatgtcaatgagcaaaaagaagttgtctgaaggtacaaaactcactggtaataataagtacacagaaaaacacagaatattataatgatataattatggtattttaactacccttatcataagtagaaagatgaaatgatgaaccaatcaaaaataatatctacactacaacaacttttcaagacatagacaatacaacaagacacaaagagaaacaacaaaaagttaaaaagtggaaaggatgaagtttaagcgtagaacttttattagttttcttttcttttctttctttttttttttttttttgagatggagtttcgctcttgttgcccaggctggagtgcaatggtgcaatcttggctcaccgcaacctccgcctcctgggttcaagcaattctcctgcctcagcctcccgagtagctgggattacaggcatgcaccaccatgcctggctaattttgtatttttagtagagatggggtttctccatgtcggtcagactcccgacctcaggtgatctgcctgcctcggcctcccaaagtgctggaattagtcatgagccaccgcacccagccttattagttttctttttgtgtgtttgtttgtttacgtaatcagtgttaagttgttatcagttgaaaacaatgagttataaaatcgtatttgcaagcctctcagtaacctcaaatcaaaaaacatgcaatggatcacacaaaataaaaggcaaacaattaaatcataccaccagagaaaatcacctttactaaaaggaaaggaagggaagtaggaagagaagaccacaaaacaactggaaatcaagaaacaaatgacagaaataaatcactacttatgaataataccagtgaatgtaaatggactaaactgtccaatcaaaagatataaaatagctgaatggatgaaaatacaagaccccatgatccattgcctacaagaaacacatttcaactataaagatatacatggactgaaaataaagggatgaaaaaagatatttcatgccaatggaaacaaaaaaggagcaggaatagctataaacactctaagaagacacaaagaacatcattatataatgataaagggttcaatccagtgacaggatagaacgattgtaaatatatatgcaacaaacactggaacacacatatataaagcaaatattattagagctaaagagagagatagacctcaatacagtaatagctggagacttcaacactctactttcagcattaggcagatgttccagacaatcaacaaagaaacatggaacttaatcttctctatagaacaaatggacctaatagatatttacagaacatttcatccaaaggctgcagaatacatattcttctcagcacatggatcattctcagggatagaccatatgttaggtcacaaaacaactcttaaagcattcaaaaaattaaaataatgtcaagcatcttctctcatacaatggaataaaacaaaaaattaagaacaaaacgaattttggaaactatacaaacacatggaaactaaacaatgttcttcctaatgaccagtgagtcagtgaaaaaattaagaaggaaattggaaattttcttgaagccaatgataatggaaacacagcatacaaaaacatgtgggacacaatgaaaacagtactcagagggaagcttatagctataagtgactacctcaaaaaagaaaaagaacttcaaataaacaacctaccaatgcatcttaaagaattaaaaaagcaagagcaaaccaaacccagaattagaaggaaagaaataatgatcggagcaaagataaatgaaaatgaagaaaacaatacaaaaaatcaatgaaaccaaaccttggttttttttattttgttttcattttgttttgttttgagaagataaaattgacaaactgtaacccagactaactaataaaaaaagagagaaagtccaaataaataaaatcagagatgaaaatggagacatataactgataccacgggaatgtaaaggatcaccagtggctactatcagcaactatatgctaataaactgaaaaatgtagaagaaataaataaattttgagacacatacaacctaccatgtttgaaccaggaaaaaattcaaaacctgaacagaccaattacaagtaatgagatcaaaaccataataaaagtctcttagtaaagaaaagcccaggaactgatggcttcactggggaattattccaagtatttaaagaggaactaataccaatcctactcaaactatctggaaaaaaagagcaggagggaaactcattctgtgagggcggtattactctaataaccaaaacaaacaaagacacaacagaaaaagaaaactacaggccaatatctctgatgaatattgctgtaaaagtcctcattaaaatactagcaaactgaattcaacaatacattagtatgatcattcattgtgaccaagtgggatttatcccagggatacaaggatggtacagcatacacaaatcaatatgatacatcatatgaatggagtgtagcacaaaaaccgtgtgatcatttcagttgatactgaaaaagcatttgctaaaatttgaaattccttcatgataaaaattctcaaaaaactagggatagaaggaacatatcttgataaaataaaagccatatatgacagaccacagctagtattataatgaatgggataaaactgaaagtctttccttcacccaaaggattataaatcatgctgctataaagacacatgcacacgtatgtttattgcggcactattcacaatagcaaagacttggaaccaacccaaatgtccaacaacgatagactggattaagaaaatttggcacatatacaccatggaatactatgcagccataaaaaatgaagagttcatgtcctttgtagggacatggatgaaactggaaaccatcattctcagcaaactatcgcaaggacaaaaaaccaaacaccgcatgttctcactcataggtgggaattgaacaatgagaacacatggacacaggaagggggacatcacactccggggactgttgtggggttgggggaggggggcgggatagcattaggagatatacgtaatgctaaatgacgagttaatgggtacagcacaccaacatggcacatgtatacatatgtaacaaacctgcacattgtgcacatgtaccctaaaacttaaagtataataataattttaaaaaatgttcattatgggaaatttggaaaaatatataaaagttgaaggcataaaaaaaaagaaagtctttccttcaagattggaaaaaacaaggatgctgactgtctccactattatttaacatactagtggaagtcctagctagagaaaggtattaaaggcattcaaattggaaaggaagaagtcaaagtatccttgtttgcagatgatataatcttacatttgaaaaaaaacaacgatgccaccaaaaaactattagaactgataaacaaattcagtaaagttggatgataccaaatcaacatacaaaaatcagtagcatttctatataccaagagtgaataatctgaaaaaggaataaaaaagtaatctctttcataatagccaccaataaaatcaaatacctaggaattaatttaaccaaagaagtgaaagatctctacaatgaaaagtacaaaatgctgatgaaagaaattgaagaggacaccaaaaaatggaaagatattccatgttcatggattggaagaatcaatattgttaaaatgtttgtagtacccaaagcaatctgtagattcaatgcaatccttatcaaaataccagtgacatttttcacataatttttttttaaaacctaaagtttatttggaaccacaaaagtctcagaattgccaaggctatctggagcataaaggacaaaactgaaggaatcacattacctgagttcttcaagttatactatagagctatggtaaccaaaacagcaaggtactggcatgaaaacagacacattgatcaatggaacagaatagagaacccagaaataaatccatacacctatgatgagctcgtgttcgacaaagatgccaagaacatacaatggagaaaggactgtcttttcaatgaatggtgctgggaaaactggatatccatatgcagaagaatgaaacttgatccccatctcttgccatatactaaaatgaaatcaaaatggattaaagacttaaatcttagacctcaaactatgaaactactacaagaaaacattggagaaactctccaggacattggtctgggcaaaaatttcttgagtaatactccacaagcataggcaaccaaagcaaaagtggacaaatgggatcatatcaagttaaaaagattctgtacagcaaaggaaacaatcaacaaagtgaagagacaactcacggattaggaaaaaatatttgcaaactacccatctgacaagggatcaataaccagaataagaagctcaaacaactccataggaaaaaaaatctaataatcagatttaaaaactgacagaagatttgaacagacatttccaaaaagaagaaatataaatggcaaacaggaatatgaaaaggtgctcaacattattgatcatcagagatgatcaaaggtacaatgagaagatatcatctcaccccagttaaaatggcttttatccaaaagacaggcaataacaaatgctggtaagaatgtggagaaaagggaactctcctacactgttgtgggaatgtaaattagtgcaagcactgtggagaacagtttggaggttcctcaaaaaaatgcaaatagggctatgatatgatccagcaattccactgctgggtatataccctaaagaaaggaaatcagtatatcaaagtgatatctgcactcccacgtttgttgcagcactgttcacaatagccaagatttggaagcaacctaagtgtctatcaacagatgaatggagaaagaaaatatggtacatatacaccatgaagtactattcaaccataaagaagaataagatcctgccatttgcaacaacgtagatggaattggaggtcattttgttaagtgaaatcaaccaagcacagaaatacaaacatcacatgttctgtcacttgtttgtgggatctaataatcaaaacgattaaactcatggacataattgcacatttaaaaataactaagagtataattggattgtttgtaacacaaaggataaatgcttgagtggatggataccccatttaccattatgtgattattattcattgcatgcatgtattaaaatatctcatgtaccccataaacatatgtacctactatgtacccacaaaaattttaaaaatttaaaaacttggaatgtgtagaagaatggaggaaaattaatttgtcctgcttagacctattatgtatcgccttttctagataactgtgcaaggtgtattcccagcatgtgcaggtgttgtcggtcatgagtgctttagttttagatgcaaagcagtaaatgtggcccctaataaggtttgttgactgctgattccgtagcacaaatgagcaaagaagagattagataagggaagatttcagaggctgtagtgaaaatgaaattttctttgcttttttaaggctaggatgacaaaacctcaaagtaacactgctttcaagcagtgacttgttgccctgagtgatttcaacttaatttgttgtttcacggttgcctggtaggcaagaagaccactaaaaccagaagctatcataggctattttatcaataagatacagcatattcctattgcttaaagtctgctatttttgagaaggcatcctatgccaagaagcaagggactgacctgagattgcacagcaagttggtaacattcattttatgacaacaccaacctagacttccacttttttcttattgaaaccttggataggttgatcaattttatggttaattatatgataataagcatgaatattttaacttttactggatacctgtagcacagcaatagagttggagtctttgaagtgttgtagtacttggaactttatgtagtgtgtattcctacaactgctgtatcatgtattcaaacataatactccaaataccttccactgcagtttaagccctgttttcttttccaattccccttggagattattcgctcatcatactccctcctcttttccttttgtctcttcctaaacaaatgaacagcctttccaattaaataatgatttttctctctacaaacccacccatccaccttctttctctactccatgctgaaagatgccagtaatttagacccatcttcatcccttgtttccattatctttgtagtttgctttctctcttcttaactccttattgatgtggtatggggcatgctattttttccactacataattaggaaactatatgcaccaattttatgggatatctgttttcatctggctcctgtgctctccacccatgaaggcaacaagacaaaaatatcttgggaatcacttttctttctcacagggatggggtgggttggagaggggtcttttctgatttgtttctgctctatatccagtggtgtactagaattggtttgcattggcttttgacaactaattgtacacatctcttcccaacttcaagttcatgtttagtgattggtagcttgaaattgaccatggtggaattgtttaatccatggaaatcagcaaagctaacaaataagggctccccacccatcaggcttgttgttaaacatttaccagcatattactgcctgtttcaaaattagtcttgataagaaagtctatcttaagtacctgtccagttggaatcaactaggcaagaacctgggcaatgaaactaaggcatcatggtagatcagaggaatactatatctgttttggttctatgcttctgagttctcagtccaagaatacttatttaccctacctaggggatgaaatgacccaacaactggaatggagttgggcccacctgctggagcttgactttagctgtgggaattagaaggtggtagtgaggtggaaatcaggactgactgtacccttcagcagccagattctcttgttacatgtttcaggcctacctcccttgttgatttatcaagcaacttgctggtagaggttggtgcatctgacccttcacaagaactagatatgaaatatgcaaactagtatttacttcagctttagtgctgacaggcttgggggtcatttaggttgtctgagcctcagctgttcttgtcagtgaaagggaaaagctagagtggacattaatttgcatttatgtaaaagtgattacttataattagtgggtagataagtagaagctatagtctgtagtggcaaagatgtgacttagctttcttggcaaataagtccctgtaggtcaaggtctatgtctttgactaattttatactgtaccatatttggagagggatttattaagtatatttcaagaggaattaatcctcccaacaataaatttaatattagaatcataacacttcagaattgaaaggaacccttagaaattcatctagtccaatatcctttagtttaaaacatgcatggctataaaagtcaactcaaaatggaataaagacttaaatgtaagcctgaaactataaaattacttgaaaaaaacacagggggaaactacaatacattggtctgggcagtaattttttggatttgaccccaaaagtgcagacaacaaaagaaaaaaggacaaaggggattgtatcaaactaaaaactttcttcacagcaaaggaaacaattaacagtgtgaagaaacaacctacagattgggagaaaatatgtgtaagccatacattcgataaggggttattatccaaaatatataaggaactcagacaacttagtagccaggaaacaaatgacccaattaaaaaatggacaagaaacaatgcatctgacaaaggtctaatgtccagaatctataaggaatttcaacaaatttacaagaagaaaacaaacaaccccattaaaaagtgggcaaagtatgtgaacagacacttttcaaaagaagacatacatgtggccagcaatcatatgaaaaaaagctcaatatcactgatagagaaatgtaaatcaaaaccacaatgagatgccatttcatgctagtcagaatggctattactaaaaagccaaaaaataacagatgctggcaaaattttagagaaaaaggaacacttatacactgttgttaggagtgtaaattaattcaatcattgtaaaaaacagtgtggcaattcctcaaagagctaaaaacagaactaccattccagccagcaatcccattactgggtatatgaccaaaggaatataaattattctattataaatacacaagtacacctatgttcattgcagcatgttcacaatagcaaagacatgggatccacctaaatgcctatcagtggcagataggataaaggaaatgtggtacatatacactatatgcagccataaaaaagaacaagatcatggccgggtggtggctcacacctgtaatcccagcactttgggaggccaaggctggtggatcacgaggtcaggtgttcaaaaccagcctggccaacatggcaaaacaccatctctactaaaaatacaaaaattagccagacatgatggtgggcgcctgtaatcccagctactcgggaagctgaagcaggagaatcacttgaacctgggaggtgaaggttgcaatgagccgagatcatgcctttgcacttcagcctgggcgacaagagcaagactctgtcaaaaaaaagaacaagatcatgtactttgcaggaacatggttgctggaggccattatccttaccaaactaacacaggaacagaaaaccaaatactacttgttcttactgataagtggcagctaaatgatgcaaacacatgggcacaaagaggaacaacagacactgaggacttccagatggtggggggtgggaggagggagaggatcaggagaaataactaatgggtactaggttcaatacctgggtgatgaaataaactgtacaacgcaaccccatgacacgagtttacctatttaataaacctgcacatgtatctctgaacttaaagtaaaagtttttttaaatgggcaagggacctgaataggcaattctcaaaaggacttgtaaaaatggccaacagaaaagatatgaaaaaatgctcaatattgctaattgttagggaaagccaaattaaaaccacagtgaaatataacctcatattcatcaaaatagctattatccaaaagatgaaagttaacaagtattggtgaggatgtgaagaaaagagaacccttgtatactgttgataggaatgtaaattagtacagccattatggaaaactgaatagggattccttaaaaaactaggccgggctcgggggcttatacctgtaatcccagcactttgggaggccgaggtgggcggatcacgacgtcaggagatagagaccatcctggctaacacggtgaaactctgtctgtactaaaaataaaaaaaattagctgggcgtggtggcgggtgcctgtagccccagctgctggggaggctgaggcaggagaatggcgtgaatccgggaggcggagctttctatgagccaagatcgcaccactgcactccagcctgggcgacagagtgagactctgtctcaaaaaaaaaaaaaactaaaagcagaattaccatatgatccatcaatcccacttctgggtatttacccaaaatatttgaagacagtttgtcaaagaaatgtctgcactcccatgttcattgccaagttatagaatcagcctaagtgtccatcaaggaataaatggctaaagaaaatgtggtacatatacacaatggaatgctattcagcctttaaaaagaaggaactgctgtcatttacagtaacatagatgaacctggagttatgctaagtgaaagaagccaggcacagaaagacaaataccgcatgttttcacttgtggaatctaaaacaatcaaactcatggaatcagatagtagatggtggttacacaggctggggcttgtggggaatggggagatgatagtcaaaagacacaaagtctcaggtaagagaaatacaggtttttttgagatctattgcacatcatggtgattatagttaataataatatactgtgcatttcaaaattgctaagacacatacatcttagattttattgttccttggagagctgttgcatcttgaacagaacacttttttcatactgaatatagaaacttgccctgagacttgaatggtatgaggaccaactggaggggaagcaattaaactttggtcgagaagactgaatatttctctagatattcaaatacagtctctgaaatacaactctaaatgtatacagttgatataagttggttttcctttaatttttaattttgaaataatttaggacttacagaaaatttgcaagaataaattgtaaaacgaactcctgtatacaccttccccagatttcccaaatgttaacgttttttacatttactttatccttctctcccccatctattttctcattcatagtcttacacagtgttcattttgccctatctatctatctatctatctatctatctatctatctatctgtctttctctgtctctttctgcttctctctctttctctccttttttttctgaagcatttgagaacaaatacatagtgtccccaatactatagtgtatatttcctaaaaacaagataattctctttcataacaacggtactacaatcaaaatttggaatttcatcaattgtcacaattatgtttttatagaaaatgaaaagctcaaattgtgtttagcattcagatgtcacaatgttttagtgccctttaactcagaatagttcctcagtctgtcttttaaggcattgacttttttgaagagtatagaccagttatttttagcagctttatcaagatgtaattagcatactatacaattcactcgtataaggcatttaaggcatacagttcattgttctttagtatattttcaggactgtgcaaccatcaccacaatctaattttagaatatttttgtcctcgataaaagaaaatcattactcattagcagttactccccaccatttctgatcctaggtaaccactaatttactttctgtttttatatatttgcctattatggacatattttataaatggatctgtagcaatatgtggccttttgtgtctggcttcttttagttggcataatgttttcaaggttcacctatgttatagtgtgtacttcgttcctttttgcagcggaataatataccattgtatgggtatgctacattatttatttattcataatgtgaggaacatttaggtttttaacacattttggctattgtgaaaaatgctgctatgaacattcatgtacaagtgtttctgcggacatatgttttcaactgagtggaattgctgggtcacatggtaacctaactttataagaaattaccaaactgttttctaaagcagttgcaccattttacattcccaccagtcagagggaccaatttatctacatccatgccaacattattatcttttttataatagccatcatagtgggtatgaagtggtatctcattgtcatttttatttgcatttctctgctgaccagtgatgtgaaacatctttgcatgtgcatattggccatttgtatatcttctttgaagaaatgtctattcagactctttgcccatttttaattgatttacttgacttttttattgttgagttgtaggtattctttgtatattctagatacatgttccttatcagatatatgatttacaaataccttattacattctgtgagttgtttctccatttttggtggtgtcttttgcagcacaaaagattttacttttggaaataattttcttaaataccttattgaaacttcaaagaaaaaggttttaattttgaagttcaatttatctatttatacagttggtgcttgtgcttttgttgtcatatccaagaaaccattgtctaaccaagatcaagaagatttacttccatgttttcttctgagggttttgtagttttagctcttccgtttgggtctttgattcactttgtgttaatttttaagtatggtgtgaggaaggggtgcaactttattcttttgcatgtggatattcagttttcccagcaacatttgttgaaaagactcttctttccctcattgaatgatcttggcactcaaaaaaatcaactgagaccgggtgtgatggctcactcctgtaatcccaacactgggaggccgaggcggaaggatctcttgagccaaagagttccagacctgcctgagctacgtggcaaaacctcgtctctacaaaaaaatgcaaaaattagccgagcgtggtggtgcatgcctgtagtcccagctacttggtagcctgaggtgggaggatagcttgatcctgttaattagcttgattaaaccagaggtggaggctgcagtgagccaggattgagccacggcgctccggcctggttgacagaaatctttgtctcagaaacacacacacacacacacaattttcaaccccttaaaattttattaacttttttgtttttattattcctctgtccttgcttccagttaatcttgctacttaggtaaaagagggaaagggaggagattgaaaactaatgaattaaattaagttttgatgcagtcgatattattcattttctctctgtcccccatcttaggatactgaaaattgttcatctataggagtaatggaaaacctgatagtgctaaagaaatatcccatggcagaaacaaaggactttttcccctttcaggaatcattgacccaaaattcagtctgagacaaaataaaagtcaaaaagaacctatttgagttataggtttttgtgatttttttccctcataaaacctccacagggacaaactcacctgatttttaaaatatagaacaggagtcaaggtgagtataacaaataattgaaatgttctttacttttatgtcatgggtagttagaggatagagaagaaaaagaaaagggtgagagagagaaagaagataatgttggaaaggaatgggagaggtataagaagagagggcaggaaagggtccatctcagaagagacaaacagttgttttctactaaagtatgagagattttttttttctggacagcagcctggacaacatagtgagactctctctgcaaaaaaaattacttatttcttatttttttccttcaaagttttattttaggttgaggggacacatgtacaggttggttacattggtaaattgcatgtggctggggtttcagttgccaattatttcatgttcacccaggcagtgaacatagtactcgataggtagtttctcaatgttcaccctccttccaccctctgccctcaggtaggccccagtgtccattgttcccgtctttatgtccatgtgtttagctcccacttgtaagtgagaatatgtggtatttggttttgcattaggaaattaggaacagaaatgttcctgcattaatttgcttaaggtaatggcctccagctgcatccacgttgctgcaaaggacatgatttcattcttttttatggatgcatagtattccatgatgtacagcacagtttctttatccagtccaccgtcgatggacacctaggttgattccttatctttgctaagtgaatagtgctatcatgaacatactcatgcatgtgtcttaatggtagaatagttaatattcctttgggtatatacccaatagtgggattgctgggtcaaatggtaattctattttaagttctttgaaaaatcatcacattgattttccaatggctgaactaatttgcattcccaacaacagtatataagctttcccttttctccacaaccttgccagcataggttattattattattattattattatactttaagttctagggtacatgtgcacaatgtgcaggtttgatacataggtatacatgggtcatgttggtttgctgcacccatcaactggtcatttacattaggtatttctcctaatgctatccctcctccaaccctcaccccccaacaggccccagtgtgtgatgttccccaccctgtgtccaagtgatctcattgtccatttcccacctatgagtgagaaaatgtggtgtttggttttctgtccttgtgatagtttgctgagaatgatggtttccagcttcatccatgtccctgcaaaggacatgaactcatcctttttcatggctgcatagtattccatggtgtatatgtgccgcattttcttaatccagtctatcattgatggacatttcagttggttccaagtctttgctattgtgaacagtgccgcaataaacatatgtgtgcatgtgtctttatagtagcatgatttataatcctttgggtatatacccagtaatgggattgctgggtcaaatggtatttctagttctagaatcttgagggatcgctacactgtcttccagaatggttgaactaatttacactcccaccaacagtgtaaaagcatttctatttctccacatcctctccagcatctgttctttcctgactttttaatgatcgccattctaactggcgtgggatggtatctcattgtggttttgatttgcatttctctaatgagcagtgatgatgagctttttttcagatgtttattggctgcataaatgtcttcgtttgaaaagtgtcttttcatatccttcgctccctttttgatggggttgtttgatttttttcttgtaaatttgtttaagttctttgtagattctggatatcagccctttgtcagatgggtagattacaaaaattttctcccattctttaggttgcctattcactctgatgatagtttcttttgccgtgcagaagctctttaagtttaattagatctcatttgtctattttggcttttgttgccattgcttttggtgttttagtcatgaagtccttgcccatgcctatgtcctgaatggtattgcctaggttttcttctggggtttttatggtttttggtctaacatttaagtctttaatccatcttgaattaatttttgtacaaggtgtaaggaagggatccagtttcagctttctacatacggctagccagtttttccaacaccatttattaaatagggaatccttttcccatttcttgtttttgtaaggtttgtcaaagatcagatggttgtagatgtgtggtgttatttctgaggcctctgttctgttccgttggtctatatatctgttttggtaccagtaccagcagcattggttgttttttgacttttgaatgatagctattctgactggtctgagagggtatctcattgtggttttgatttgcatttctctaatgattagtgatgttgagcattttttcatatgcttgttggccacatgcatgtcttgttttgaaaagtgtctcttcatgttctttgcctactttttaatggggttgttttttgctcattgatttaagttccttatagatgctagatattagacctttgtcagatgcatagtttgcaaatattttatcccattctgtgagttgtctgtttactttgttaatagtttcttttgctgtgcagaaaatctttagtttaattaggtcccacatgtcaatttttgtttttgttataattccttttgaggtcttcatcatgaaatctttgccaggacctgtgttcagaatggtattttctgggtttttatagttttaggatttacatttaagtctttaatccatcttgagttgatttttgtatatggtgaaaggaagaggtccagttttaatcttctgcacatggctagccagttatcccatcaccattttttgaatagggagtcctttccccattgcttgttcttgttgacactgttgaagatcagatggttgtaggtgtgcggctttatttctaggttctttaacctgattccttggtctatgtgtctgtttttgtaccagtaccatgttttggttactgtaaccttgtagtatagtttgaaatcaggtagtgtgatacctccagctttgttctttttgcttaggatggcattggctatttgggctcttttttggttctgaattttataagttttttttataattttttttataatttttttttaattctgtgaaaaatgtcattggtggtttcataggaatagcattgaatctttaaattactttgggcagtatagccattttaacattattgagtcttcttattcatgagcatggaatgtttttcttatttgtttgtgtcatctttcatttctttcagcagtattttgtcatttttttgtatagatcttcaacctctttggttagctgtattcctaagtattttattaatttttggctactgaagcatggcagactgaaagttaatatttctactgtgtaaaatcacctagaagtaaagagaataagactattatgaggaaaatggaattgtaggaagattagagatgctagaattgtttatcccagagaagagaagactaggggaaggtggcatgattactgcctttatctaccttaaagccctaaaggaaaagagtaaatatacttctattttaaggcagaagctatagggaaacaaagtttttctcaacataggtgagcaatggaatgggatggtaggaaatctattttcaggaggcaaggatggtagtattcactaaagttactttaacatcgaatgcaactttagtttagatgattattaaggtcttcctgaccctttagtatatggactgtatttaaagaactttagtgtatttttttcactattcataaatgatggtttggaaagtgtttgttgccttgccttagtcttccggaagatgggtcatgattgtgcagtttgtgcaatggctagtgtagaatgggcctccttcaataggaaccggcagtttaagacttaggccatggcattaatgctatagtaaccttccattcttgtcgggctctttgaagtagctaaagaccaatggcataaaatagcaaattcaaattcaagaattgaatttctgtttagcttgctatttccaatactaattattcatttcacatagggcttttgtctaggttagaagccttacttaaaaaaaaaatctgaatctctcaagtccttttatttcacaccagtgaacttccatattctaatagtgcaaacgaagacaaaatagggtgagtggatgaataagaatcaatagtataaatggagaaatccgatttcaaattggactttcaagtgtattgaaatgcattgtgtaagaaatctatgtaagatgcttcttaatatgttactactcacagattataacatgatttaagttgttggaaaagtttaatagatcacagcagatggtatactatctcagacccattttcctgccaagtcctcaactgctgaagaaaaggagttacttgtgataggggtattttcctgtcatcccttcatacaaaagtaagaaatttcagggttaaggataactcattcaggaatctatgtttactgatgagattttaaaggaagtcatgccatgtgaaggggatgcacttaagcataaggattattgaaaagcattaaaatattaatctagcttttaaaagcaatgcttttatctctgagtgtaaagagagtgtttgcttattcattatcttttcattctaaatagaataaatcacttaagaattaaaaaagaagcaactcatctttttcaatctataaaggaaatggttgaataaattaactacaaaagccaatattttcatttctttttatatttactgggcttcaattttttatttagagacttaccttagattcttaatattcaaagatgtgttaatttaacctaacacatagataattttgctctaaataaaaacagcataagtgtgcattgtttttgatgacaggaatattcccagtataaatttgtgaggatctgtccacttgggaagactcaacttacacaaaaagaaaaacaatataaagtaactaagatatatgaggttcaaaggtagtacgtactctggagtttaaagaaagaaagaggttgttgtgagctaggttagtggagaaaactttttgagaaatgtaggatttcaacaagatggtaaaggaagaccaatacttaaggaaaagaatggaatttcctatgtagttaataagcagtgttaagttgtggacaggaatggaaatagtgtcatatgggggaaacagtaagtggaccagtttgttagagaacaagaattcatattaaaaagtagttgtaggccaggcacggtggttcctgcctataatcccagcactttgggatgccgaggcgggtggatcacgaggtcaggagatcaagaccatcctggctaacacgatgaaaccccatctctactaaagatacaaaaaattagccgggaatggtggcacgtgcctgtaatcccagctactcaggaggctgaggcaggagaatggcatgaacccgggaggcggagcttgcagtgagccgagatcgcgccactgcactccagcctgggagacagagcgagactccatctcaaaaaaaaaaaaaaaaagtagttgtagaaaatgttaaaatatactagggtcagatcatgaagtgctttaatgcaagtaggcagtaagaaccactggttttttaataggggaatgagaatatgtggaaaggaatatttttcaagagagtgttctgctggcagtgtggaaaatgttttggaggcacggagagcaactagaaagttcttgccttaacccaaatgtgacaatgagggaataacatagggtattgctagcatcgtattaataaaaagatgcaagagagataagacttggtagctgtactagatttaggggaaaaggaatagcttaaggatgactctcagtcacttagacttaaaacccatgatccattcctttgacagaaataagatagtgaccttaattctagctattctccagtgatcttgaaaggatttatttcaattagctttgatacataaaataaaaaattcatcattcacttttctgatgaagctggaaaattaatctaaataatgtaaaatataaatcactactttaattacatacctatgtgtcttctaaaaataaatcctacatctgtctgagttatgaagaatatgtattaagggtaaatcaaacaagtatacattctttacagaaatattgattaaattgactcttcctgattagtgatttaaattgacatgatttattccattcatgcaaagattctgtgccctctggggggtctgtctggaatagcaaagcagctcactgacagcagtgactggaatattgccaagctagtcccagagctcagcctactttgtttagaaattaagcaaatggaaagtttcctgaggttctcttacaatgcaagaatgtatggggtttcatttgtgaaccaacagggagttaaaaagcaggaagtcaattatatattaagtctcacattgttctgtaattgttttcatcaattatatttttagttgtatatttttggccaattcgcttgtgtcaattacatatacttccttatattgttgtcaaattgtttcatgtgcatcagtcatagcattcctatgtaaactggaaattccccagggatagggaccatgattctcttttgtttcccccaggaaatagcaagagacctggcacatgttttgagtgttgaactagaataaggtatttcagaatacttaagtctaggtctgtagtactattgtggatcccctaaaacactttagattccacaatagcactgtgaatgttgacttaaagcagtagcatgactttatattccttatagagttgtttccagggacactgttaatgtatacagtcattcaggatacaaactagaaagtagaaacatacacttatctttaaaatgagaggatctaactgattcatggcctgttcttggcttttccacttgtgtctaccaattaaactctttggactcaagagtttttctacctgcaaaatgggatagtaattcctacctcggcaacttgttgtgatgattaaatacaatatcatgtcaatatcctggcagtaccagttccttggagtgagaacaggtaacctgttgtccattttcttggaatgtgctacagggatgacaatgaatctttctgcaaatctattcagaaattctggttctgaggagtagtatccatgactgatatgataatactaaagttctgtcaagctctaaaattctgtgattataattttcattatcccttttcatgtgtattatatattgccatttagagtaaacaaaatgttttcccaaccccttatctcatttgaccctcacaactgaaagaaatgcatgaaaagctttagcttattcattgagtccttaatatatactacatgagtacatgtgttcaataaaaccactgagtattggtgatactggtaatacatcattgatacatacagatgaaaatttctgctttcatggaattcacatactggtggattgaaatctgagtgaagaaacctggattctagttctgttgtagctactagctcactagttgtgagagaaaatgtgtatatgggtattcatgtgtgcacatgctcttacctagatgctttcacaggatgcttattgtcttgaagagaacactggtttcaactttacccattgtcagagtttacaaaacacatttttaaaatgcgtacaattgcactgggctctgtttggtggcaactgtgggcagctcttggaaaagcttcttttctaaaggaaggacctggggacaattatttacccttttttatagcatgttttttttcttaatttccttttcttttattgaatattggatataggtatatcttttttgtgtgtagcatgttattttatatatctgccttatgttttgtttttgttttatttaaatgttggacttaatgcagagtaatgtggaggctctaaattgtttgcttccttttgtttaattaaggctatgccatctacttattccacctccttaaagaatctcaattaactaaaatatttcttttccaagtgttttctcacctctcttctttaacctcacatcatccctaggaattttgtgcctgttattatgatttctgtttgacagagaagaaactaaggtataaagaaagtaaacagctaggccagtattctctgggataaaaagcagtcaatgttactcttagacttgtgctttttttcactacagcaggttttccaagttcagcaccaatcacattaggagaaaaggctgcagttgcactgatcttggaatcaaaagatttggtctgtgcccctggttctgcctctcttatgaccttggacaagcatttaaggtctctgagatcctacaaaattgggtaaatgccagcttttcttgaaactgtctctcaaacttttctactcttcagatatctttctctaatatcatcttctttcctctgattttcttgtacttagcttttctttcttctatttttcttcctgagactttctctgtctgttgcagccctgactatcttttctggcctgcccctcctcctattggtatcatgttatcctatgtaatatttatctgatcagtttcttgcattatctttggatgaagagaaagtaagcctcatttggcatctttataaaggatacagtaccttaattgattacttgtcagaaagaatataaaatattaaacacgatgaagattaaagattccaaataagttggtaaaaatctattttactttaaggaactaacaaagaagtttatttaaataaatttttttaatgaagaggccatcaagctagggaaactatgtgttaatttggtgttgggagagatatatgtatatgtgtgtatagtttcaattaagtttggatagtgtttgtatatgatatataaattgtgtgtaccaaatgagttattgctagtgattaacagtgaataaaataacttctaagatgtgttagttactatttactgaggctgaatgctagaaatactgatagcatgaaactctatttcctaattattctcagagtccaattctgccttctgtctaatcttcactaaatcacagcagcatatttttcagcaaattgtgaaactcaggtaacctggttagaggagaaaagattaattgaatcacataaatattctctttgaagctagacttttcttcctcttatgttcagatgggaataaatcatatccacccaccccaccttacttagagagttttctccatgcctggaaggcaagggcaaagaacacagagatttcctgtctacagtcacttaggagtttagcatcctgggacactgtgaggaacaagggaatcttgttactgtgctgtagggagcccagaaagggggaacctagttttatgatgcaactggtttcctccccaagtttagggcatgtaggttcaaagaatgtaatagcctacaggctcagaaagatggctaggtaaatccagcttgtttagaagaatgattgacttttgcccacagcaggtaaactcagtctcgttcctgactgctagtctcttcagtctagactgtgtgacagttgctactagctaaggaatagagctacaagtgaatattttaagctgataaaggatttgggtttgtctgtaagattacgctaaatatgtgaattgtggttttaatgttagacataagagaataccatcaacaatgagaccttgaaatgcagacttcaactttacttcaagtgggacgttttcttatgttcttatgggaaggagccagtcccacgtcacatagcctacagatggaatgcggaaggaaagggaaaatggaaggggaagtcatatttggagatgagattggaaggtagacaatgtaagccttatcttagaagacctttattgccaggctgaggggatctaaacttcattgtatatacaaacaattggagaaagccttgtgatctggactgaaaaggtgtagaataatgcagctttagggtttaaacaagcctggctttgaagtcctctttctgatacttactatgggctcttagctatgttgccccttctttcaaatgcctcacttttctctcttgtagaatatggatagtagtaatttcccttgcatagctgttaatactaaatattgtaaatattaagtgagataatatatataaagtccagtgcctagcgttgtaggtactcagtgaatagtagctattatgagtaatccttggacctcattacagccctttgattccagtttggtaattgagctttagaagaaacaaatgaggttgctctctgtttagtcgttaagtcactttcaatttgtacagcagttggtaaccttcattcatattattccatttgatctttagaatgattcttcgaagttgttaagatcattgtacacaagaaaaacctgaggcccgtacaggaaatggattacttaaggtgacgtaacaatgtcagagctaggactagaacccagacagatttcctttttttttttttttgtagagggagggttttgccatgttgctcaggctggtccctcactccctgactcctaacctcaagcagtccacccgcctcggcctcccaaagagctgggattacaagcgtgagccacctcacccggcctagaacccaggtttcttaatgcttttactcccaattcagtgctcttactcttaactggagtttaggtaactttgacttttacttttttctgtcaaacctatggtagaccacattgtgtagcttttaaagttaaagctacttgaatgacaaaagattaggctacacagtaatttacataccaatgttgtatgttacttatggtaaatccactagaaagcccccatccctacatctccctatgttttatccttgaagtctagcatttattaaaacttaaatataaataaaaaggcttcttactcctgagataagctttctgcagttgtaatttgctaaaaaaatattctaattacaaaggattgcaactttcaagtagtacaaggatgattccatttataatttgcaatcattaatcttactctgtctagagaagaaaacacgtggaagtttccttttttcaagaataccaaagccatattaatatattttgtttcttcctcttggtagatcttgctctcatagaactattttgtaatcctatttaaaacccagttgtactaataacggtcctttgagtttcccgggttccactgtttattactcagctcttatttctgctcctttgcatgcagtaaaccaaacaccctcattattcagccaaataatgagtatctactgtgtgctaaacatcacacaagatgcaagtatgattgatactggactgtgttgaaacccaagtactctgggtatgggtgttggcaggggctgcagaagcagtttgtatcatagtaaactagaaagagcaatggatttggcatcaggaaacacgaattcaacctctagcatgtcatatgactcagtttcttcatctattaagtgaggctactaaactaaagtctttgcttagcaatttttgggccaacattggcccaaaattcttggttgggtgcatcaaaacttttaagctaaacattgtagttctgaaggtgaccagttcctctgcaggttttgtaaatgaataaagaaacacaatgcaaagacagttctctaatttgtctagggatttcatgttcagatttcctatgagtgcaggatcagccaggctccatgcttgacagattgcagctcatattccctaaagtagacagttgcctttgccttcatctgggcacaagacatggttctacaattttaattgcattatgacttttactttttatttttattcctaatggaaataatggtctgggtgtgacaagggaatgttaagacttatttttttttaagcagtgttttagtctgtgctgctataacagaataccagactgggtaattgagtaggaaaagaaattcatttctcacacttctggaggctgggaagtccaagatcaaggtgctgctctctggtgaggcccttcttactgtgtcttcacatggcagaagatcagaaaagagcagacccactcctgcaagctctttttataacagcactaatccattcatgagagcaaagcctagagccccaatgaccaaaacaccttttattaggccccacttcccaacactgttgcattggagattcagtttccaacacatgcattttggaaggaacaaaagcattgaaatcatagcatgcaaaaaccgcttccctcctccagccgttaaagctcctttccattccattttaagttgaagggatcatctttatttagaggtgagatagctttggaatgttatcagtaaaagctaatagagcctatatatgttaaagaaattgaatcaacaattaaccttccaaaacagaaagcaccaggcccagactggatcaccagtgaattctaccaaacttttaacgaagaagttataccagttctctgtaatcgcttccagaaagttgaggtagatggaatacttcctaacttattttataagaccagcattacactaataccaaagccagacaaagacattacaagaaaggaaaactacataccaatatctctcattaatacagatgtagaaatcctcagtaaaagattatcaaattaagtctaacaatgtacaaaaagaattatacctcacaccaagtagatttttttttgagacagagtctcactcactttgtcacccaggctggagtgcagtggtgcaatcttggctcactgcagcctctgactcctgggttcaagggatcctcctgcctcagcctcccaagtagctgagattacagtcttatgccaccacacctggctaatttttgaatttttagtagagacagggttgtaccattttggccaggctggtctcgaactcctgacctcaagtgatctgcccaccttggcctcccaaggtgctgggattacaggtatgagccactgcacccagccccaagtagaatttattctaggtttacaaggctggttcaacatttgaaatacaattaatgtaatccatcatattaacagaaaaaaatcataagattatatcaatagatgcagaaaaagcatttgacagaattcaacacctattcataataaaagctcctagcaatctaagaatggaggggaacttcttcaatttgataaaggacatttagaaaaaaacctacagctaaaagtatactgaatggtgagaaactacatgctttccctctaagactgagaacgagacaaggctattcactcctaccactcctattcaatattgtactggaagttctagctaattcagtaagacaaggaaaagaatgtcagcatggtggctcacgcctgtattcccagcactttgggaagccaaggtggaagaatcacttgaggccaggagttcaagaccagcctggccaacatggtgaaaccccatctctactaaaaatacaaaaattagctgggtgtggtggcacgtgtctgtaatcccagctacttgtgaggccgaggcaggagaatcgcttgaacctgggagatggaggttgcagtgagccaagatggcgccactgcactccagcccaggcgacaaagcaagactccatgtcaaaaaaaaaaaggctgagcactgtagcatatgcctatagtcccagctactcaagaggctgaggcaggagtattgcttcagtccaggagtttttggtatgatcacactactgcactccagcttagatgacagagtgagaccctcaaaaccaaaacaaaagaaaaacaataccatttacattagcatccaaaaaaggaaatacttaggtataaatctaacaaaatatgtacaaaatctatatgagggaaactacaaaactctgatgaaaaaaatcaaaggagatctaaataaatggagatatttcacgtacatggataaaaagactcgatgttgtcaagatgtcacttcttcccaacttagtctttagattccacacaatccaaataaaaatcccagtaagttattttgtggatatcaacaaagtaattctaaagcttatatgggcaggtaaaagatagaatatccaacataatgttgaagaggaaaaacaaaattggagggctgacactatgcaattataagacttactataaagctacagtaatcaaaacgttgtggaattggcaacagacaaatagataatggaacagaatagatacacaaatacagtcaactgatcttccagaaagctgcaaaggcaatgcaataaggaaaagatagacttttcaacaaatagtttctgggacaattggacaaccatatacaaataaatgaatcgagacacagaccttacacctttcacaaaaattaacataaaaagtatcatagacctaaatataaaattaaaactattaacctactagaagaaaacataggagaaaatctacgtgatcttgggcttggtgatgacttttatttttaaaaatagattttatttttttgattagtttttgatttacaaaacaaaataagcaggcagcacagagtttctatataccctgcacctggtttcccttatagtatgatacatttgttacaattaaggaaccaatattgaaacattattattaattaatagctatagagtagtcagatttcctgaattttttataatttcaacttttatttcagattcatagggtacatgtgcaagtttgttacatgggtatgttgcatgatgctgaggtttgggatacacttgtctcatcacccaggtactgagcatagtacccaatagttagtttttcaatccttgccccactccctccgtcccacctcttatagtccccagtgtctattgttgccaggtaataactttttagataaaacatcaaaggcgtgatccatgaaagaaaaaaaacggtaagttgaacttcatttgagtttaaaacttctgctctgagaaaaacactgttaagagaataaaataacaaaccacagagtgggaaaaaatatttgcaaatcacgtatctgataaaggactggtatccaaaaaatatatagaactgttaaagctcaacaataagaaaacacacagcccaatgaaaaatgggcaaaaaaaaaatgaatagccaaagcaatcctaagcaaaaagagcaaagccagaggcatcgccttacccaacttcaaactatactacaaggctacagtaaccaaaatagcatggtactgataaagaaaacaacaacaacaaaaacagacacattgaccaatggatcagaatagagagccaagaaatgaagccaaacacctgtaatctctgatctttgacaaagttgacaaaaataagcaaaggagaaaagactccctattcaataaatggtgcttggaaaactggccacatgcagaagaatgaaactggacccctacttattaccacatacaaaaattaactcaagatctcaaactacaaaaatcatagaagaaaacctaggaaaaacccatgtcaacatgagcactggcaaagaatttatggctaagacctcaaaagcaattgtaacaaaaacaaaaatttacaagtgggacctcattaaactaaagagcttctgcacagcaaaagaagctatcaacagagtaaacaggcagcctacagaatgggtgaaaatatttgcatactatgcatctcacaaaggtctaattcagaatctataaggaacttaaatcaacacgcaaaaagcaaataacccattaaaaagtgggcaagggaggggtggagcaagatagccaaatagaaggctttaccaatcattccccaccacaaggacaccaatttaacaattatgtacacacacacacaaagcaccttcataagaaccaaaaatccggcgagcactcacagtacatggttttaacttcatattggtgaaagaggcactgaaaagggcaggaaatacagtcttgaattgcagatatgacccctcctctatgtcctggcagcagccatggggcatgaagaatctggggtttgaaagagggagagcacagcgattgtgagacattgcattgaactcagtgcttccccatcacagcagaaagcaaaaccaggctgaattcagctgattcccacccacagagggagtatttaaattaatcctagtgagaggggaatcgcacatctagtggttggaacttgagttccagcaagcctctgcaacacaggctaaaatgctctggggctctaaataaacttgaaaggcagcctaggtcacaaggactgcaacacctaggcgaatccttgtgcagaactgggcgcagagccagtggactgggcagtactgagacaccagctggggtggttaaggaactgcttgcaacaccccaccctcaaccccagactgcgcagcttgtggctacaaaagagacccattccgtccacttgaagagaggagagggaagagtgggaaggactttgtctagcatcttggataccacctgagccatagcaggataaggcagcaggcagagtcatgaggcacctggatgacattttgaaacacaacctgggccaaaaggaaacctgctgccttcaagggaaggacacaatgctggcatgacccatcacctgctcaggaaagagcccttggaccttgaataaccagcagctgtacccaggtactatgccattggccttggatgagactctgagactagctggcttcaggtaagactcagtacattcccagctctggtggctatgggaagagacttcttttacttgagaaaagtggaaggaaaagtaatgcagactttgtcttgcaccttaggtgaggcttgcaaatactatcttttaacccattattttaagctgataacaagttaacactgcataaacaaacaaatgagcaaaaagaaaaccaataaaaactctattccttaacttcatctcccgagtttttaactttttgttcttttatatcttattgtactatctatatcttcaaaagttgttgtagttattattttttgatttgctcattgttagtcttctacttaatagtaatttacacaccacaattacagttctataatatcctgtctttttctgtatacttactattatcagtgagttttataccttcagatgatttattcttgctcattaacacccttttctttctgattgaagtactccctttagcatttcttgtaggagaaatctggtgttgatgaaattcctcagcttttgtttgtctggaaagtctttatttctccttcgtgcttgaaggatattttcaccagatatactactctagggtaaaagtgtgtgtgttttttttttccttcagcactttaaatatgtcatgccactctctcctgacctgtaaggtttccactgaaaagtctgctgccacactatttgagctgcattgtatattgtttgtttcttttctgtttctgcttttaggaccctttctttatcattgacctttcacagtttgtattatttatttatttatttatttatttatttttttgagacagagtctcgctctgttgcccaggctggagtgcagtggcgcaatctctgctcactgcaagctccgcctcctgggttcacgtcgttctcctgcctcaccctcccaagtagctgggactacaggcgcctgccaccacgcctggctacttatttatttatttatttatttttgtatttttagaacagacagggtttcaccgtgttagccaggatggtctcgatctcctaacctcatgatctgcccgcctcagcctcccaaagtgctgggattacaggcgtgagcccggcccacagtttgattattaaatgccttgaggtagtctttgggtcaaatatgcttggtcttctataaccttttgcacttaaatgttgatacatttctccaggtttggggagttctcgttattttccctttgagtaagctttctacctttatctctgtctcttcctcctctttaaggccagtaattcatatttttcctttcgaggctattttctagatcttgtaagtgtgcttaattgtttttcattcttttttcttttgtctcctctgactgtgtattttcaaatagcctgtcttcgagctcacaaattcttccttctgcttgatcaattctgctgtgaaagagtctgatgccttcttcagtatgccggttccatttttcagctccagaatttctactttattctttttaattattttaatatctctgctaaatgtatctgatagaattctaaatttcttctctgtttgcttgaatttatttgcatttcctcaaaacagctattttgaattctctgtgtgaaacgtcacatatctctgttgctccagcattggtccccggtgccttatttagttcatttggtgtggttatgttttcctggatggtcttgatatttgtagatgttcatctgtgaacattgaagagttgtatatttattgtagtcttcgcagtctgggtttgtttgtacctgtccttcttggaaaggctttcgagatattcaaaaggacttaggtgttgtcacctaagctctatctactttaggagacaccccaagcccaataattctgcggcttttgcagactcttagaggtaccgccttggtgatcttgaataagaatctgaaagaattctctggattaccaagcagaaactcttgttctcttcccttactttctcccaaacaaacagacactctctctctgttctgagccacctggagctgggggtagactgacacaagcaccccgcgtgaccaccaccactaggactgtgctgggtcagatctgaagccagcacaacactgggtcttacacaaggcctgctgtaaccactccctggataccacctatgttcagagtacctgggactccacaatcaatatgtggcaaaagcacccaggcctgtgtcctacccttcagggtggcgagctccccacaggacccaggcaggtccagaggtgctgtacaggtgccagggactagagtccaaaaccttagaagtctacctggtgttctgttgttgcagctgagctggcactcaaatcacaagatacagttcttcccactcttccctcccatttccacaggcagaggagcctcaccccatggccaccacaaccacaggcccacagggagtactgccagactagcaccaatgttcccttaggcccaagggctcttcagtcagcttgtggtgaatactacctggtttcagactctcctttcagggcagtgggctctgctctggcccagtgcaggtccagaaatgtcatccaagagccagagcctgtaattggggaccctgatagttggcttgatgctctatgcccctgtgggcaagatggtatctgaggtgcaagacaaagtccccttcacttttccctttgcttttctcaggcaggagtcttgccctgcagccaccaaagctgggaatgtgatgagtctctcctgaagccagcaagtctcagagacccatcaagaccttcagtgtagtaccagggtaactcaagggctcttcagttagcagctgatgaatgtcaccaggactgggttcttcctttcaaggcagcattttcccttctggccttctagacatctggtggatgtctagaaatgtcatccaccatcttgctctgacccctccttggtgtggccattttggaaggcagtttgacagtttcttacaaagcttatcatattcttaccatatgatccagtaatcatgctacttgtatttatccaaatgagtggaaaacttgcatccacaaaaaacctgcacgagtgtttatagtagcattattcataattgctcaaacttctaagcaaccgtgatgtcttctaataggtgaattgataaatacactgttatatccatgcaatgaaatattattcagcactgaaaagaaatgagctatcaagccacaaaaagacatggagaaacttgaaatgcatattgctacatgaaagaagccaatctgaaaggctacataatgtatgattccgactatacgacattctggaaaaggcaaaactatggcgacaaaaaaaaattcagtggttaccaggtgttttgggggaagagagagagggatgagtaggtggagcacagagcatttttagggcagtgtaactattctgtatgatgctgtaatagtggatacatatcattatacattcctcaaaacccatagaatattcaacacaaagagtgagtcttaatataaactatagactttagttaacagtctatcaacattagtttggggtgggggaaaagaaaaaaattgctaaataaataaaatttagtaataacttcactaaataaattctattgtatggcctatctatacaatagaatatatttttaattttaattttttaaaaatagaatattttgcagctattaaaaaaggatgatacattatggaaagacaaaactatagggacagaaaacaggttagttgttacttaagaactaggggagggattgactacaaaggggtagcttgagggaatttttgggatcacggaactgttctgaattgtgattgtggagtgattatcccactgcatgtgtctgtaaaaactcatagaactgtacaatgaaaaattatttttactatgcgtaatttttaaagtaaataaaaataggatggggaattttaaaaagctttttataaaaaaaaaagctagtagtagccttccaattgtgaaagttctcacagcacgcaagggcattattttcagttaacaaatgtttcacttagactcagattactcaggatagaagggtccttcaagatcactaaagcccctacatgcaccctcactttacagagggagaaacaggcccagaaagaagggagtttcccaaggttacatgcaaattagtggatactttgtgtagtttcagtcttttgacatttattgagaattattttgtggcctaacatatatggcttgtcttggagtatgtgtattctgctgctgttgggtctggtgttctttgtatgtctgttaggtcttattggtgtttaggctttctattttctcattgatcttgtatttagttgttctgtctatcattaaaagtggggttttgaagtctccagctattattatagaaatgcctatttctcccttcaatactatgagtttttgcttcttatattttgggcctctcttgttaggtacttaacaagagaggtgtttataattattatgtcttcttgatgaattgactcttttatcaatgtataatgttcctggatgggcacagtggctcatgcctgtaatcccagcactttgggaggctgaggcaggagtatcccttgagcccaggaggtcgaggttgcagtgagccgtgatcgtgccggtgcactccagcctggacaacagagcaagaccctgtctccaaaaagaaaaatgttctgttacttgttttgagagttcattattgttcattatttgagctagatccctcaatttgaggaagtatgtatttgtttgtgtatatgtgcatgcatgcatgtgctgctgaccagtgtggtaaatagcgtggggctactctacttggtctttaattccatggaaaatgagaaacttttttttaatttttaatttgatgtatgtatgtatgcatgtatttctttatttattttgctggcagctctaaaaccagcacaaattgggatcataagctccctattctaataagatcttgtagttgagaatgagtcaggggactcactgtgaaggagaccaggtctttattgaggcctttgtgaaaatctctgctacacacagataacaattgaaatccaatttacttcacactcaacaggaagtcttagttttattgactcaacaactagtcaataaaattaaaaagcattagtggccaggtgtgatggctcatgcctgtaattccagcactttgggaggctgaggtgggaggatcacttgaggccaggggttcaagaccagcctaggcaacatggcaagaccccctccctacaaaaataaaaaataaagcagtaccaatttgagaattttcttcattgttcccttgtttcactgtcatcttttttttttttttactttattcctttttctttctctggtttttctccaactgttctattttccctgttttctttacatctttccttttttcttctctacttccccttctctttaccctttcctcccatgtatctttctctctgatttctccttttctgtattattctctttaccctgtgactgttgcattactggacactggcagtgagactaaatattttaagttagcatcaatagggatatgttaatagaagacataactataattttgtttctttgtgggagaaatatacacattaaaataaaaggcctatactctattgccatctaattggagcttctgtgctggcagaaaatgcactggaaaaaaagtaaaccaaaattacttgataagaaaagcatagtagctaggcccaaatgtccaccttgctctttattagaattatctaaatacaaagatgaaagcaagactcttctccaagaaacaatctctgcaaaaagcccctttggcatcaaagctatgaactttacgggaaagccagagtttctcaggttgtgtgccatatggatagtttggcctattataagttttgattgagagaagaatgcaatataaaagcagctattgggtttaagcacagctaagtgtggtggttgcagtgatagtcttgagtgcctttctgagttaggcactcttttattattttgttttggttttttgttttggtttggtttttggtgtttttgagacaggatttcaaaccatgatggtttgctgaatagatcaacctgtcacctagttattaaagccagcatccattagctattcttcctgatgctctcactccctcaagaatggcattttgaaggtacttgggtttactggcaatgtgtccttgcttagccagtgtggctggatggccagggcttgacaagaagtaacatttcttggccatagaaattcaagtttttgttcactttctgttcttcttaaaccccacctttagattggctttcacgttgccctcatttcccggagaacactgaatacttcccaggaaaagaggcttatgccatgcacagttccatccttcttcttactgaacccatctctctgggattgctggtgattggaattcacatggaacattctacgttgagcttggtaaagcagctggttttgttaagaaagcccaaggaaagctttggcctctgttcccacctcccacacagtcaaaaagaagcccagtctaggtagagctgaaagggcatttgaacaccatctagttccactcctcatggtacagatggaaaattcaagcctgaagttgaaaaaaggaacttgcttaaggtcacacagttagataatggttaccttctgacttcagaagactgttctcctccctaattgtatgttaaggaagaatctgacagacatctgtttaaactattaactctgtgtgtgtgtgtgaacatggtttaatttttaaactttatttgagatgacttttgtacttacagaaaagttgcaaagctagtacaaagagttccaatataccgtttgcccagtttcccctaatgttatcatctgtacattactatggtacatttataaaaactaagaaatcaacactggtatattactattaactaaactccagacttcattcagatttcaccagtttttccattaattatcatttttctaaaatatcaggatccaatccaagataatacattgcatttaatcatcatgtgtccttagtcttctctggtctgtggcagtttctctgcttttccataacgttaagatttttaagagtactggtcaggtattttgcagaatgtccttcaatttgtggtagtttgatgtttttcttatgattgcactggggttatagattttggagaagaatctcacagaggtaaagttccattttcattacattatttcaaggcgcacataatagcctttaacaagacatcactactaattatcacatttaactttggtcatttggttaaggttgtgtttgccatgtttttgcagtgtaaagcaactactttttcctttttcattctctattctttggaagtaagtccagcccacacccaagctctacctccttgaaaggggagtatctacatacattatttagaattcttctgttaggacgatatgtcttttctccaccatttatgcatttatttgatcatttatttatgctgtatatgtgggctaatatttatttattttatactttgggctttaatccgatactaccttatctattttgttactcaaatgctcctgctttagccattaggaattatttcaggttggttcctgcgtccctttaaacacatgccctcttccttttatctttttagtacttgctaattttctggtactacaagatactccaggctcatcttgtgttttccctgacctagccctagaatgaaccatttatccaaataactctggttccttttattggaaaatgttatttagaaaccaagatctaggagtggtcatttttaccaagctatcattgcttccagactttctcagtggacataactgggtaatatatgtttgtttatgtactaacctttgtatacatatatatctataatcatttgtgtgtctatccattgtgtgtgtgtgtgtatatatatataatatatataatatatatgtatatatataatatatataatatatatgtgtatatatatatatattatatatgtatatatatataatatatatgtatatatataatatatatgtatatatataatatatataatatatatgtatatatataatatatatattatatataaatatatatataatatatataaagctaaacatgagtttatattgatgtctctaactctaatccaatactacagggttcattctagccttcctttctttttatctgtaacttccccctataacaatgacaaacttagcttccactacccaccatccatttacttacttgttcaaacccagtacattcaaaccagtctcacaattgttcatctataccaccatgacaacagctttatcaactacagtacagtgtttatgtatggttatttgtcttttatctttatactttctagctaaaacacaatttttcaaagttaaatcagcttcgtacccccttcctcagtgcacttatgtcacacatttgtaatacagttagattcatttgtcacagtctgcatttcatcctgggatcctctgacatctggttgatgtttgcatttgcatatgttaaggctcattctttgtaaattacaggtctataggttttgacaaatgcataatgtcatgtgctcaccaccccaataccatacagaagagttccatcactctcaaaattcctctgtgaatcccctctgttatcaaccagttcccccacccctaatattcagaaactactgataagtatcccatccctatagttttatattttccagagtgtcatatgaatggaataatacaatatgtagtctttgggtatggcttctgtctcctagcaaaatgcatttaagactcattcatgttgtgtgaatcaatagctccttttatgtaagtagttccttttaaacactgaatagtattccattgtaagaatacttgtttatccattctcttgttgaaagacatcttgattgtttttagctttgagaaattaggaataaagttgctagagacatccacaagcaggtttttgtgtggatgtaaattttcaattcacttgggtaaatacctagaagtgtatttgctgtatcatatggtaggtctaacttttaacacaattcctttccaagaagtctgggttgagtatgtatgtatggtgcagtagaatatctgttcctgagctggactgaaatagtgatcactctcacaccatattccatgtggacggaaaatagaatatcaatgggatgggaggagccaagatggccgaataggaacagctccagtctacagctcccagcgtgagcaacacagaagacggtgatttctgcatttccatctgaggtaccaggttcatctcactagggagtgccagacagtgggcgtaggtcagtgggtgcgcgcactgtgcatgagccaaagcagggcgaggcattgcctcacttgggaagcgcaaggggtcagggagttccctttccgagtcaaagaaaggggtgacggacggcacctggaaaatcgggccactcccacccgaatatggcgcttttccgacgggcttaaaaaaaggcgcaccacgagattatatcccgcacctggcttggagggtcctatgcccacagagtctcgctgattgctagcacagcagtccgagatcaaactgcaaggcagcagcgaggctgggggaggggcgctcgccattgcccaggcttgataaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcagactgacacctcacacggcagggtattccaacagacctgcagctgagggtactgtctgttagaaggaaaactaataaacagaaaggacatccaaaccaaaaacccatctgtacatcaccatcatcaaagaccaaaagtagataaaaccacaaagatggggaaaaaacagaacagaaaaactggaaactctaaaatgcagagcgcctctcctcctccaaaggaacgcagttcctcaccagcaacgaaacaaagctgggtggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaataagcaaagcctccaagaaatatgggactatgtgaaaagaccaaatctacgtctgattggtgtacctgaaagtgacggggagaatggaaccaagttggaaaacactctgcaggatattctccaggagaacttccccaatctagcaaggcagtccaaccttcagattcaggaaatacagagaacaccccagagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacatgcttaaagaaaagaattttcaacccagaatttcatatccagccaaactaagcttcataagtgaaggagaaattaaatactttacagacaagcaaatgctgagagattttgtcaccaccaggcctgccctaaaagagctcctgaaggaagcactaaacatggaaaggaacaaccggaaccagccgctgcaaaatcatgccaaaatgtaaagaccatcaagactaggaagaaactgcatcaactaacgagcaaaataaccagctaacatcataatgacaggatcaaattcacacataacaatattaactttaaacgtaaatggactaaatgctccaattaaaagacacagactggcaaattggataaagagtcaagacccatcagtgtactgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctgtgcaccaagcagacctaatagacatctacagaactctccaccccaaatcaacagaatatacatttttttcagcaccacgccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactgcatggaaactgaacaacctgctcctgaatgactactgggtacataacgaaatgaaggcagaaataaagatgttctttgaaaccaatgagaacaaagacacaacataccagaatctctgggacgcattcaaagcagtgtgtagggggaaatttatagcactaaatgcccacaagagaaagcaggaaagatccaaaattgacaccctaacatcacaattaaaagaactagaaaagcaagagcaaacacattcaaaagctagcagaaggcaagaaataactaagatcagagcagaactgaaggaaatagagacacaaacaacccttcaaaaaaatcagtgaatccaggagctggttttttgaaaggatcaacaaaattgatagaccgctatcaagactaataaagaaaaaaagaagaatctaatagacgcaataaaaaatgataaaggggatatcaccactgatcccacagaaatacaaactaccatcagagaatactaaaaacacctctatgcaaataaactagaaaatctagaagaaatggataaattcctcgtcacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggattagctggtaccattccttctgaaactattccaatcaatagaaaaagagggaatcctccctaactcattttatgaggccagcatcattctgataccaaagccaggcagagacacaacaaaaaaagagaattttagaccactatccttgatgaacattgatgcaaaaatcctcaataaaatactggcaaaccgaatccagcagcacatcaaaaagcttatccagcatgatcaagtgggcttcatccctgggatgcaaggctggttcaatatacacaaatcaataaatgtaatccagcacataaacagagccaaagacaaaaaccacatgattatctcaatagatgcagaaaaagcctttgacaaaattcaacaaccattcacgctaaaaactctcaataaattaggtattgatgggacgtatttcaaaataataagagctatctatgacaaacccacagccaatatcatactgaatgggcaaaaactggaagcattccctttgaaaactggcacaagacagggatgccgtctctcaccactcctattcaacatagtgttggaagttctggccagggcaattaggcaggagaaggagataaagggtattcaattaggaaaagaggaactcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcaggagtgaactcccattcgcaattgcttcaaagagaataaaatacctaggaatccaacttacaagggatgtgaaggacctcttcaaggagaactacaaactactgctcaatgaaataaaagaggatacaaacaaatggaagaacattccatgctcatgggtaggaagaatcagtattgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactgtactacaaggctacagtaaccaaaacatcatggtactgttaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactgactagccatatgtagaaagctgaaactggatcccttccttacaccttatacaaaaatcaattcaagatggattaaagagttaaacgttagacctaaaaccataaaaaccctagaagaaaacctaggcattaccattcaggacacaggcatgggcaaggacttcatgtctaaaacaccaaaagcaatggcaacaaaagccaaaattgacaaatgggatctaattcaactaaagagcttctgcacagcaaaagaaactaccatcagagtgaacaggcaacccacaaaatgggagaaaattttcgcaacctactcatctgacaaagggctaatatccagaatctacaatgaactcaaacaaatttacaaggaaaaaacaaacaaccccatcaaaaagtgggcgaaggacatgaacagacacttctcaaaagaagacatttatgcagccaaaaaacacatgaaaaaatgctcatcatcactggccatcagagaaatgtaaatcaaaaccacaatgagataccatctcacaccagttagaatggcaatcattaaaaagtcaggaaacaacaggtgctggagaggatgtggagaaataggaacagttttatactgttggtgggactgtaaactagttcaaccattgtggaagtcagtgtggcaattcctcagggatctagaactggaaataccatttgacccagccatcccattactggatatatacccaaaggactataaatcatgctgctataaagacacatgcacacatatgtttattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaacatcattctcagtaaactatcacaagaacaaaaaaccaaacaccgcatattctcactcataggtgggaattgaacaatgagaacacatggacacaggaaggggaatatcacactggggactgtggtggggtggggggagggggagggatagcattgggagatatacctaatgctagatgatgagttagtgggtgcagtgcaccagcatggcatatgtatacatatgtaactaacctgcacaatgtgcacatgtaccctaaaacttaaaagtataataaaaaataaaaataaataaataaataaataaataaaagaatatcaatgggatgtcttcttctcctacctggaagatgaagtttctgcaaatgaccattagatggcggggtacttgctggcactctgagctggaagtctgggagattgtgggagactgaaaattatatcactctacccccttcccttttcttggcaaagggatattctagccacactcaggaaataaaatacctgatttatgactcctggcatgtacctttatactgcttcaggaagttaggcttgggtttcatgttggcaagtatcccaacagctaaatttgtgtaatggtaaactttaggttagataatgagttttgacctgaaatggggtaagcaacatcatgtcatgtttgtgccccttgctgacctcattgcaaagtaaaggaagcatagaaccttgattcctgggttctaatgccagccatctattgtcccaactctcttggcctcatattcatcatctttaaaataaggataatacctgcccattcatgctcacagggctgttgtcagagatcaacctaagatacataatgtgaaatatattgaaggactttataagtttaacatcatacaaatatgaatgattattaatgatcaaaccaaatagaatatgaaatactattgatattaggtggcatcatacattaataaatctgacttaaaaatacaatctgtttaccttgatcaggagaggtagatatttagtctctgaagtgatgcagtattttcctcagaacttagtgggtgggtaatttattattatctacttgtttaatttttggtgtagcagttacagaaaatacttgattccagattgaacgattttatagggtaattcctcaccctcataaaatccacattatttcaatttaccaagtaaatactggcacattcagtagatgttactattttgggttccaactggtactcatgattgactctggtgctctggatccagatcctttggtatgtaccaggggacagcaaacctcagttatagaggtggctttacctttaccctagaaatcatctgcagttgctctggttcaaagcttaaaggaaggtttgaggagtgtactttcaaggtttgaggagtgtactctctcttcccagcagtgcagaaaccaataatcatcaaaacattgtcaccataactgttgtcaggtttttttcaaccttgcccttgcatctcagcacagctctctcgcccaaagaggtaagctggggaaaacagaatctactcattgtaatcttttcagcttatttatctgcatttagaaagtctcaaccctctgggctcccctgcctgtcagagtcaaaaagaaaggccccatgtgtatgtgtgggcctgtatgtaagaagtaaggcttgaaggcatccttggcatctgtcatgtgacacatgcaatggtttgtaatagagtcagggaatcataggatatgacctgaggtgggaggtccagtttctacccttcattttacaattggggaaactgaaacccagaccaaaaagtaacaactaattagctatgtaggtcttgctttattattactggtcacggagagtgcatcttaacagtagccaaagaaggtattgatcaagtagagaagggacactgtcattcccatagcttcaatcttttttttttttcttttttcttttgagatggaatctcgctctgtcgcccagactggagtacagtggcgtgatcttggctcaccacaacctccgcctcctgggttcacgccattctcctgcctcagcctcccgagtagctgggactacaggcacccaccaccacgcctggctaattttttttcttttttttttttttttttttgtatttttggtagagacagggtttcaccatgttagccaggatggtctcgatctcctgacctcgtgatctgcccgcctcagcctcccaaaatgctgggattacaggcgtgagccactgtgcccggcccatagcttcaatctttatttttctccagtggaaggggcttagcctaactgaaaacagttgatgtaatttagggcatgggagggactagtgataggggtgtgtgtgtgtgtgtgcacacacgcacatgcacatgtgctcacgtgtgtgtgtgtgtgtgtgtgtacaaccttgttttcagttatctacttctctttggcctctaaattctacatattttccccttctcctgtcagaatcatttagtcaatatgtgcctttttgagtttgtaagtggaggctaggttaaagagtgtccttagtttaggaatgtcatgtgctcatttggctaggtgtgtggtgattgtgtgtgggggaatgtgctggattcagaatagtaatagttgcttaaaactggaactttttaatgagggagaatggtctaccttttttcttgcagagctcagttttattaatgtgatatgctgtgtgctagtctgtgccagaaagtatctctgtaggtaattgatctgcctcttcttcctttctctttagatattcccttccatgtatgataaaaaccaatcttggtgtgtttatctcttttttaagcactttatcaagggttttttccagctcttgaaaagacaacttgtatacccaccctccacactacactgtacaaccaacccaacattctctgcatagacaatcagtcttcttttctgtgtgatataaatctatgaaaactcccacacattatagtacaactggacttgctgattccaaaccctgagcagaaaaaccctctaggaagccattgccaaggataagattgattgctacactggcaggtgcctgcccatttccctcgctcagtggaaaatctggcccaccatgacaaaaaatagctcatcccagggccttaaaacccaccgaatgagattttagtgttggggataaaagcaaggctgtagactaactcattcatttgctttagtgttctctataaaatataaaacatatatttcataaacaccaaatttcatgaaagcagatttatttcataagttttgtctattaccttatctaagcacagtctcttcctccaccattctcaggacatatggcttagtcagacagactacacagatgaatgcagagtgttgagtgacaaagccagccctttaggcgtttggagcacagcaaggttatgttggcaaggccaggtcagacaaggctataaactttgcctttcatctttaccctaataatgccactgaacaaacccaaccaggatctttctcaaatccatgtgtacagtttttatttgtcagagactaagcagaatgcctgggggaaggcatgcataatagaactaatcattctttaaagtgtaattttccttgcctatgcattcttgtagagtttcagtagagcccttgacaccctaagatagaagtgaactatgcaaagggggaatgagtggagataacttgaaaaaaaattttttttttagttttacatcctcctttttttcatatggactttagacataaacagttaatgtctgtcagagctaaaaggtacctctgataccattttatctaccccttaaccacaaaaaaagattatatagggagcagttcagtatagtagaaagaacatgggatttggaaagaactgaattctacttccagctcaagccatttgatctcagtttctttatatgtaaaatggaggtggtaatcctcataatgacattgtaaagcaatgtactggtggcccccaatactatccccaggttcactgatttgctagaaggactcacaggactcataaattgttacaatcaggctacagtttattatatcaaaaggacagaaagcagaatcaataatgggaaaacgtacatcagtcagagaccggaggataccaggtgcaagcttccaagagtcttctcccaatagagtcacacaggttgtgcttaatcctccaacaatgaagttcagaaacatatgcaaagtgttttctgccggggaagcgtacttgagcctgaaactccaggatttttattggggtaactagtgactgaaactccatatcccttggaaagaaagcatgcattcaccataaatcatattttttgcacaagatacctagacaggctgttacagcatggttgaaagggcatacacaatgcccttaccagttactagaatagagaacattctaagacctcagttcccaggagctggccaaggaccagtcacacaagtgggcccttctaaaaatgtatacgatttgagcaactcaagactgctgggttaactctttctttcacagataggtattaaattattgtatgtgtgtatatatatatatatataaaatattgcatatacatacacacagtataaagcagtacattaaatgtgagggattattatacatatgagtaaagagagctagagctattctggggtgtgattaagtgcagtaagaatggaagtatctaagacaactctccagggcaatgaatggggaagctgtaaacaatcccactgaggattttatttttctctatgattagagataatttcgtcaccactaccattctgtccctcatcagtttcacattgtactttcttatcatagctatatatttcttgggatttttgcataagccaaattgtttcactacgcactgtggagttttggcaaggatgtgatcctcttaaggaaagtgcagaattgagcctttgcagaaggcataggcaggtgcttcctagaaaaccctgagcaagtcccaatgaaagactatggttaattatactataatcgtggtaactaataccaacagtgaattttagtctgaattgaattgaagtgaatttatgtgaacctaaatactattgaaatacgattttgagctaaatactgcactagatgcccagcctagcccaatcattttataaaaatttgccctctaaggatgacggaaatgactatagaaaggaagctcaggcattgtatgctaggatgtggaggggaacatcctgaggaagtgcacatactcatacctaaaactactgaaagcatttgccaagggtagcctgtactgcctgaactcaggtggtaatggcaccaagtagactggagaacagcttgagaaagtgggcatatcttacagatggacaataaacctcctgatggaactttggtaatggagtatttgttaatagcattttagctgctgtaagcctctttgtctgctttatacccccagagctgctgtagctctccccaaactcatgaatggggcctaaggcagctgcctttattctgcatgtaagctagagctggctcatttgtctacctggtatgttcttttaccctttacgttggagccatgtcaatggttctcctcaaattgaccctctgctgccagactttattgagccctatctgagactttttctgagccctctgctccaggtggccctaaaaacttcatatacaatgtaatgtaggctctttaatgtgctagcagaaaatgacagagattaaatggtggccctgccatcaagggaactcattgcttcttttgaaataaagtatttggcaggttttgcctagaattgagggatggaatcactcctttccctaccttatcttttcttaaaacagctcctacatttcaccccatttaaaatactagcccttgcatttgtatcacattctatacttttctaacactttcttatttattattttattcttacatattttcattcatgctccgaggccaagctcagatgctattttctacagagagattaattttaacttcctctgacctcttaaggaactttccatgatgctctcgtggtttttaaccatttttcctatttttattctaattatttatatatatatcatttattagactctaagatcctcaatggcaagatctagataggattcatcaacaacttacatatagcaggcaagcaatgaataataaagatgaaatagaatagaaaacaaacaaatgcttgaagcttagataactgcctctcatttactctaattactggaaggcctagaacttgaatcttcttctagtcctgtactgctatcttaaattctccaccacactgcctcccttacccaggccagatagcatttactcttcagaaggaaggaaattagctaagtctctaataatcaggaaaggctttaaggaggaggtagaccttgacaaatgagtataatgttactaagtgaaatgcagagcgaagggtattccagaattagcagtgaaagcacataaagagggtgggaggaagaacatggtctgtagagtaatgaggccaagcctaagaaccagggcagcaagaattgtttggggcaagtcttgaaaaccatacagaaatgttggaatgtgttgtagcaggaagtaagggccccatacagaaggccttatatgaaggaagggtctgtagtagggaggacttagggctttctggtctactggctcttttggaagtttgaaatcatggcagggacctaagaccctgaacctcctgcctcttgatttggtcaactctgaatgtgaagtatattttattaagatattctaacttgctcactagcatttaatgttagttgccaaatttccaaacctgagctcaaagggaactctcttacaagtttgaaagcatttcagaactctttttcatggtaataaggattttgcctggcctagaagaagctgccaactccagaggtctctctggcactctaactcagagaagtttaaagtaaatgtagctcctgagagagagtatgagtccttaaaccaccaacccctcatccttttaaatctctgggtttatcctctgggaaacactgtcattcagctactgttttgttcaggtctctcaagttcttgcctaccatccagcccttcagatgtctgtgtcatctggttagttccctatattgtgaggacttaacaaattttcagtcagtcattcagtcagtcagttcctgtcttgtcctccagaatatcaaatattgaaaaaccactggcctcaactaaactgagctacaccacaccctggtaaaagggaaaatcttagtataaatttcacatacacctaaggctttcacatacatttcacatacacataaaccactggcctccactaaactgagctacaccacatcctggtaagagggaaaatcttagtataaatttcacatacacctaaggctttcacatacacataaatcactggcctccactaaactgaactacaccacaccctggtaagagggaaaatcttagtatacatttcacatacacctaaggctttcacatacatttcacatacacataaaccactggcctccacgaaactgagctacaccacaccctggtaagagggaaaatcttagtataaatttcacatacacctaaggctttcacatacacctaaggcttcacatacacctaaggaaacctaaggcttccctcttgttctttctccctcttctcctccttcacctctccctccactcttcctctgatctctctttttcaaacgttatggtttgttgttccataccaactgcacatttggcaatagacaaaaatacaaaactcctgccctcatcgatttatgccactaacctgattcagttctctctaaaggagatcgtagcaacctctctcaatattcatttccagctaacattctcttactatttctccggagagcagtgaaactttatcaaagtctactttgtaacgatgccaaaagctggcctctgaaagctaaaaggagaagagctagaatgtggtaagtgggagctgggccctagcaacagaactgtgggaggcagtgtggaataatggaaggaccataggtctgaagacctcattttggacttaacagttgcccaggctttctatattctcacacatttatgtacctttagggtaaggataatcactcatatttgtctcatctgacagtacctatcacacagctcatgttcaggtgagtccccagggcccccactgtgctgtactctcccttccctgcccaacttctctgcaccttggattcatgtcttgtttctaccacttcctagccttgaggctttggtaggtttcttaacttctctgactgagtttgtttcatcttccctagaagagataatacatgcttcatagctttgttgtacagatcaaataaaataacagatatgaaatattttatagcctataaggtgctgtgaaaattttaagatggggctaggcgcagtggctcatgcctgtaatcacagcactttgggaggccacagcgggccgattgcctgagctcaggagttagagaccagtctgggcaacatagcgaaaccccatctctagagaaaatacaaaaaaaaaaaaattagccaggcatggtggcacacgcctgtagtcccgggagggactgaggcaggaggattgcttgagcccaggaggtaaagcccagtgagccatattcatgccactgcactccagcctgggtgacagagccagaccccatctctaagaaaaaaaaaaaaaaacagtaagatggttttatcagattagtcaacaaatgtcaaaaggcacacaatttttattacatccatgaaccatgcctccaactagatcatgtggtatatagagttccaggcctatttatagacccacatttgcttaggttcagttcatctgaacactgattaaagttaacattaggaaagacaaaaacctaacctttatctgtgtttgatacaaagaccagtagcaattacatcacttgaatgtggttagattttattttcctttggtattttggtgaagttcccaaacgaatgcccaggaataattacagcagactggctttggcggaggaagtatataaaggcaattagtaaaatgtaacaaacttaaatgataattgaacctacattcccccagccatttccaagtataaactatataaatctgtgtcccagattcaccaaatgaaatatttttgagggaatcaagcagcaaggatctagtgatcccttattgcagcccagctatgtgtttaggggcagggtatggtggtagatgtaaaatcctaaaagcctgctttccaggagctcatattctggttgggtctacaaaacagaaaaattaagtcttttgttagaagaaatgaaacaatctaagacaaaatagcatcaggtgtcaaatagtgtggagcaaaaggcattcagaaaagtagaggtcaaggtgggctgggcctttcagcttaagaaagacagaggaagaaggcagggagatcttgcctatgttgggaaagtaagggcaggagcctctgagttggaaagaacatgtcaggtgttgtgcatggtgccacgtaagactgctgaggtatgatagagccagattatagatgtccctgaaggcctggcaaaggagacttgactgtatatagtaagcagtggtgactcattgtgagttcttgagccaggagactgctgaaaaagtagtgtgttaaaaagcagcatgcagggtgaattagaacagagacagacacctactaccagaaacccatttgttagcttccattgtaagatgtggtcgtagtcatggaagaggatgattgaaaacaagatatggccaaagaaaagagaacaataagaacactggggcttagaaggtcagattacgtcttactcaatcagtcagaactctggcatcataggtgattttagtgaaaaacatatctatttgttggaaacaaatttttaactttaaatggttagcttataggcttaagatataagttcccagagatgaattggtgaatggcgtctgaacttgacctatttgcagcagcaagaatgtgcaagaatcttctccaggctttctcagagctggaggacccagcatttgtgttaatgtgactgggttaaaatgaaagcctttgttgtctctgaaaagaaattgaggaagtactgttaaaagatgatgagatcagccgggcacagtggctcatgcctgtaatcccagcactttgggaggctgaggtgggcggatcatttaaggtcaggggttcaaaaccagcctggccaacatggtgaaaccccagctggatgtggtggcatgcacctgtaatcccagctactctggaggttgaggcaggagaatcacttgaacccgggaggcagaggttgcagtgagacaaaatgtaatgtaaggtaaaagtgagacaaaaatgtctattgtgacctgaacatattggcctataatgatggtaaagctgtgtcactctgagaaagttacttaaactctctgagaagctttagagcttctcatttataatatagtaatgctaattcctacctgcttcacagggtttttgtaagggttaaatgtatatcaacataaagtttctagcacacagcaggtaattgcaccactgcactccagcctgggcgagagagcgagatgaaagaaaaaagaaaagaaggaaggaagggaggaagggagaaagggagatgagatccatggaggaaggaaaggagactttattttcagaggagatacaatctgtagatccgggagtgcagcttcagtacaagccccacagaaggggcaaggagctggggtcagccatccatacataattgagttaggttgggaaaaatctatgaatatttataagaggaatcaggcaccatgcacagtgggtaaacatgtatgtagcatgcatttcatgttcactttggggtgaggttttagtattaaaatgaggtggaatttggctctttacatctaaaggtgaactacaggacacaaagttcatgcacagtctttataagttggttgaaactggctcaaggtctgcagccatttatcagtaaaaaatgttcataagacaggtcctctgtccaatcagagctgtggtgggactgcaaggcaggggcttgggatagagagtggaggtcagtggattcaataggttggcatcaggcagtctatctcggtcaactgggaaattttccagctgtagttgtttcagtaatgctttttgggagctggtttctgcttaattacaggggaaaaagcttatggcagttaataacacagaaatacttaactaagccccaatcctgctggccatgagattctgtttttggtgtgtctcattttagccacagggagtccattttatctgtctgttggggcatattttaacagtacaaaagacaaactgagcaaaacaccagcacaaaaagactgtaaactaaggggaaattacatggaaaacgagaaaaatattgaagtagcaatgtattcttatagttactcaggaaactgctgttcactttgacacacacatgcatctcttccctccttaaactgcctatatgtgattcgatagtacagtagggaaattatatttaacagtaatttattgtatatttttaaatatctagaagagaaaaattgtaatgttcccaacacaaagaaaagatgaatgttggaggtgatggatatctcaattaccctgacttgatcattacacattgtatacatgtatcaaattatcacgtgtaccccaaaagtatgtacaactatgatatatcaattttaaaaatttaaacagggtcaaaaatgtctattctgacctgagcatattggcctataatgatggtaaagctgtgtgactctgagcaagttacttaaactctctgagaagctttagagcttctcatttataatatagtaatgctaattcctacctacttcacagggtttttgtaagggttaaatgtatatcaacataaagtttctagcacacagcaggtaattgatagatgttaatatccttatcattagaggggataggtcaacttagtgttggaacttaaacttgcactcatctaaaagcagcaaacatttcccccagcttgttgtttaagtagtcgctaatgtgtagaatttaacccagccccatcagcagctgctaaaatagcagcctgggtttcagtttacttgactgcatacaactgggctaaggttatgttggagaaatggtcagtaactagtaagtctaacgtataactggtcctggggaaatgccatatttttaatcttgaaaagtcgactcattcattgttatataagataatcctacttcctttttttgtttgttttttttttttttttttgagactgagtttcgctcttgttgcccaggctggagtgcagtggtgcgatctcagctcactgcaacctccacctcccaggttcaagcaattcttctgcctcagcctcccaagtagctgagattacaggtgcccgccaccacgcccaggttattttttgtatttttagtagagacggggtttcaccatgttggccaagctggtcttgaactcctgacctcaggtgatctacccacctcggcctcccaacgtgctgggattacaggcgtgagccaccgcgcccggccaagataatcctacttttctaggaataaagtgatcccactcctaagggtgatgtgactccagtttaactcattcatcttcatccctatatttccccatggaccttgattatggtgtagcttcacttggaaacgctcaagaaggaatgaaagataccatatgggaggcattgataatgagagctgtttattgccattcacctgcaaacactgtctgtgccgcctgttcatgcatatcagacacacaaacattcttcatttacttaaggtacatggagaaatgatgacatgctcacattttgggagaaattccccttctacttggatgggtttccttctttgttcaacagggccagaattttatctaaagggagtacaaaggccatgatgccttttccaggtaaaattctatatatcttgtccccttgtcctttatcacttttatggttaaatgaataagtaaatacataaaatgtgttttcagtataaataaatcatacagaaaataccaaataaatcacttgctgcaattaaatgtttggagatcattggctctaaggtgacacactattcttcacagtaatttagcaatgagcctactgtgacctctccatcaaaatggaatcaagtcacaatattgccttatctttctatggcttctcggtgacaacaatttgggtgactgcacagattttagtgtcagtaggtagagctgtcgctctgaggcaacaggattgaaccctagtccacttgggtgagattaggggtaagaagtagcagcaaactttgtcatgttaacccacctaaaaaatattcagcccttcatacccattggctggaaatctccagctccttaatctcagttcttcatattccaagaacctaagactgcctctctggtagagcaatcttggtagtgttcaaggcatcaacaaaatagcaggctctaaactgattctgtgatgtttttgcaaatggcaagatgccctttattagatagtctccataggggttctggatctttaattacttgatcatatttacggctctgtctttataataatactggccttcaccttttcaaggcccagtatcctggcaaaaacatcaatttggacatattatggaataggtggagatgagaatgccatatctgagtgtggtgcaattatttcagaattgttgtaaatatgctggaacattttgtgagaagaggtaaatgacagtacagaactggttgagacaagaaaattggaaaatgattggagcaaaaaatgaaaaggagctagaaaggaataaggcaggaagcaaggaataaaaacaacttgggtctgcttatccattagctgatgtgggggaaaaaacaacgtgggtcaggataacagtctcctttctccccccaaaaaaatattttaacaggggccagaatgacactgcttagtccataggtggcctaatagtggactcatttgatctaggcacataatgatatttttatcttagtatataatgagtggtaattaagctgtcactggcactgggaaaagatcaaaatgtgagtgtgcagttttcttcattcctcaccccataatggcagatgttaggagatattttgctgcacctctctatcctttgactcatcatcttactcactattcctgccttcttactggtggtatcttggcctttaaatgaagctgtttcctttggaccctagtgatccttagagttcagaggaaagaggctatgtaatatagtcagcaatatcatcacattcatcttattctcaactaatttttaaaagtacttacctaaagtatcaaagagctacagagcacattttaaggtgagctgtcatcttatttcttcacaaagaatgttttgagttgatatgacgatgtatcataagtgacaacagaatgcatgatccacagaatatttatttaaaactgactataactcttctaggctccaaaggtctgatttctttcaaagtagctgatgacattaagcactcttacattcattatttctctcatctgagcccccaacagccctgttaagtagaaatgacagggatcttcatctttattttacagggccacgtactaaggtgataaagccattactaaggtgataaagtaatatattattacttcccttgtccttagttttctcatctgtaaatcaagatgataattattttcctctcacagtgtaatgattttcaagtggtaggatggatatgatagttttattaaactgtaaagccctctataatcctgttaccatattcacttataaattccttaactttagttagaagtagcattggaaaaaataaaaagtatgactttctaagatgtgcaaaaagctgttcatagataagacactattgtgttcttttgataagtttgagccaacagaagtacctcaaataaatgccagctctcaattacagatgttcatcaagttcagaacctactgcaacctcttctctcgttttcttattttttttttttttttttttttttttttgagacggagtcttactctgtcgcccaggctgaagtgcagtggggcaatctcagctcactgcaacctctgcctcccaggatcaagggattctcctggctcagcctcccgagtagctggaattacaggcgcccgccactatgcccagctaatttttgtatttttagttagagacggggttttgccatagtggccagactggtctcaaactcctgaccttaggtgatccacccgcctcggcctcccaaagtgctgggattacaagcgtaagccaccgcacctgaccattacttttcttttaaaggatgttttatatgtaaagagttcaacttgattgtatagagcagcatataatgagttgaaggttgccctaccagtcttggggcgagtcagtccaccttgatggccccaccaaagactgaaccctagctctcagcccagacatctcaaaagcctgtgattgaatagcaggaccatgagctttgtactaactcaatgttaggtttgaatcctgattcccctcctgctaggcaggtgggcctgaaagagttacttaacttttactgagtctcagtttccttatatattaaaggagatagtaataactatcttgtaagaccattgtttgaattaaagtaataaatatatttaaagtgcttagtagaggatcactcaataaacattaatctttccttcccatattgtggacatatagtgtaaccaggtgagcttgtggatggatccttgtagaatcccccagtccccaactctgggagaaagtttttctgagagcatatctttaaaatggggcaggttacctacatcctatctgaatactaatgctagcactattatagatatacatgtgcagcacagacatcatttttaacagatgtgtttagttaagtaacagatttagaaagtgcagactttaatctatgttttctcctgagatttcatcaccatctgatttctttttttcttgctaaaaagtataattgtagcttgatttcccccaccccccagttatttccccaagaaataggggcctttttaaaaatttgaataagaagctggataagcatttgaaagacatgaggacagtggatacctgaagaggtaagaagttgaggactttaaagtaaaagccttaatgactaatatattttttcagaaggtcctgcttccaccatttctgcaaggaacagatgactctaaagatatcatatcaaggtctgctttctgcttgttgcataactggatggagtaataaccaagattgaaactgtcattggttaaaggagactaaatggagcaggtcatggaaattgaggtgtttctttctttccccaaggaggggctggagagaaaaagtagcagagacttttgtcatcagctttcaggggcagaaaacattggttcctctctcctctgacctgcctctccacctaaaaacctgaatggattctggattccacttcaggctgttttgagttttgatagaataagtttgttaagatgttggggaaaagcaaaatatggtcttccaggatagccctggtggggagaggtagaaaatggtgggataaaaagtaggattatactagggccatgtgaaaccatccacactgtagtggaggagcttgactgcatggcagaaggcaaggtttttcaatttatcctaaaccatatcccacaatgttccacggctctgtctccattcagcaaatatttgcagacactatataggctgtaggaactttatcattcccattgcttttggcaccacaaaatgtcttagagatcaacagaaaagatgaaggaaggacctgattgccccattcaggtagttctccccattcttgtagttctgcttagttgctttgagcactggtttctgtgtccccctccttgaattaccacaggatcctggggattccacttcacaatttaagagtatcctatcaggaattctttaaatggtactctgagtggtgaagagggagaagaagataagtactaccacttttgtggacccactatgagccaggtactgtacttctttacacatacacacacacacacacacagagtgagagttaaattttatttgtatgtaaaaattgtataaccatgtaagcctatgaggtaactattatttttattagacagataaggaaactggagcttggagagtttcagtgatttatccagcatcacatagctactaagtggaagacagagaccagaaagcagcctagtgatttcattcaatactgattaatttccctttctccccaccctcacctctacccagctccaaaagaagataacactacttaaatattagctattattatcattttcactattattattatattatataccgtatgcctttggaaccaaaataggtgtagagagaaagaaactaaactactaagccctgtactagacactgagagaatgtttagcagtaacaggtagctacttttagacaatatccctaaggttgatttaagactttttattccacagcccagattatacagctgaaatcagggatttcaaactaacctctaatgttagccaccaccaccaccttcatgctggagccattccctaggccaaaactacctcagtactgtcagtacccaaattcaagacctgaagatcgcgaccagtcatgagatactgggtggctaaggcaaagtacatttgttgtcttagaaacccagagcagccatatgccactaaataaatttatgaaatcaactttataagacatattgattataaatatactaaaacaaccaatttgataaaggtatagagtatgcaaattttgataaaggtatagagtatgcagatgtgtgggacgatagaatgttatataacaaaactggagctgcattgctaggctaaaaacaggttcttttattctctttgcctttattttttaacatatgcaacaatttaatctttgatgattaaaaaggttgcagagaattaaaatatattgctataagctattataaatatcagtctactgtatagtaggttcttattttcataaataaaaaactgaagctgagaaactaccacaagaccaaaagcttattttaatttttataagcaaaggtcaattctttgaacaaagtctaccccattgggctatgactgatagttaataagtaatcttatgaatttttctttatacataaagaacaaacatgggaaaatctgggctataatccttgacaagatatttcttacactgcttcttgcctaaagggttaaaaagtactagtatggttgcacatcatgcaatactgactttgcaaaaagggtttgtataactgtatatagattctccaagttggaaaactgaaaaatctaatttcaaaaatataagtaggcactgaacatatatatcaatatgccaatgacaaaaagaaacatacatatctatttactttctatttccagacacagcaaagataaactaattttgtaatgctttctacccactgtaggtattgttcacagattaaataaaacttttccaggaaaatatgccatatacataaagccaatcagatatacttcccagatatttaggaaaatccaatatagagaacagaatgaagaatgggtgaattcacaaagtaataagatataataaatcatctaaaatgagtaagaactagaattcaagtacaagattcaaatgaggttaagtgatagccagaaaaggtcatacaaagtaacatccaaatatcacctcagaagcttaacatacaaacaaatttcaagtcaggacagatacacacactaaatgaagaggggtttatgaacggggactaattttataagtggtacaagagtgaatattttgcttccctacacaatttctcctgcaacctcatagcagcagggatttggataacaaattcatagccaatgagaaacccctgtgtgtgtatttatattacctgtgtatataacaacaggggatataagtcttggtttgactatcttagggtggtacatacagtgtatcttgatcaggaccacatttataaatgatttttttatagtataatactgtaccaaggttgtcagggaggtccttttcatatacaatctctccaagtactgcagtccctcatctttcagtaactccagtggaaaatggtgcagattcctataatttaagaacaaattcttgtgcttttccagccttgccacagagttcgtcttacaaagttcggataccgtgactgaatatatcccatcagacacattgcagcagtacatctttacaaaattggtcggtttctcagcgctggcagagccagtgctccggagctcaagtggcactggaaggactctttgcctttatttctctgtagtttcttttcatagtgttggcatttgattttccttttaattttcaggttatatttgcacttaattggcactgtagcaggttcattgcatgttgtgtgccttctgcataccttgattgtaatcgaacctgggctagaagggaaattgaagagtacagcaggcaataaaatccagacaagtagagtgtcattttatccagctttcaaactctgtaccgagtcctggagatatgtggcagagccttctgaaaggaaacacaggtgttttgtttttgtttttgttttgatgggaaagaggtggtgccaaggtgctaagggcatgaaccctcatcttcctaggccagtttgcatgtatcttaattgctttggagacactatcatgattttggctgagaaaaaaaaaaaactatagatcagttctttaagattttcaaaaacctacagcattcctccagtgccctaagcctcttgttcctgacaaatctctctgtgctttataaaaacatgcccaacatgacttgagtccatacaaagaccatgctccttgttgctatgggcccatattaaaggctgtactttgtgtcagactgtacgaatgtgttctgtttttctttttctcacgcacatggctgggtagcctgagcgggacccagttttattagctttgctgtgttttcttttatgtcttttttaaagctcattgaattggtttaagatttgtacaagtgattttcttactgtcacatagagttaaaattatctagtccagcttctccatccaatgtttaaacctgttctttaatgttgctgaagttttgcccagccactgctttagtacttctattgatggggagctcactgttttccctatgctcttcttatagcacccgtttcatctttggacaaatctatcagtctacatgttgagctacagtcttcctccctcacgttactttccattgtggtctaactaaacacatttcatttcactcttttgtgatagctctttaaggatctgaagacagaaagcacatttcttaaattttctcaaaacatcagtttcggggaggctggccaagatggccaactagaagcagctaatgcgtgctgctttcatggagagaagtggcaagtagatacagcacctttaactgaaacatccaggtacatgcattgggatttatcagggaaacaatccaacccacagagaatggagaaaatcaaggcaggatgaccatccagccaggagtgacatggagccaggggaacctccctcacccagggaagtggtgaatgagtgagcaacactgaagacacatgctttttttcatggatctttgcaacccttgggtcaggagatcccttagtgaacccactccaccagggcctgcagtctgacacacaaagctatgtggagtcttggcagagcagctggtaaggcacacgtggagccctgggagctttagatatccgggcttcccagcaaaagaggctgcaactccagcaaacctggaggttagaccccccctcccatacatacctctagaaaaggggctgaatccaggaggctgagcagtgatggtctgcagaccctacttccatggaaccttgcaggataagacccactggcttggaactttaaccagccaccaatagcagtgttacacctccctaagacggagctcccagagggagggcaagctaccatctttgctgttattgccttcagtgcagccaccctttggtaaaccagtcagactgctttttttacatgggtccctcaccctacttctcctcactgggtgggacctcctgactggggtcaccagccacacttgccggggttttccagctgtcagtggttctgagcctccctgggatggagctcccaggggagggatgggtagccatctttgctgttccagttgactgactagagcagtcaactgccacagtacagcagctctacaaagaatcagccagactgccttttcacatgggtgctggatcccgtttctcttcactgggcagaatctcccaaccgaagcctacaaccatccttactggtgtgttcaggccagcaacaagtccatacctacctgggatggagctcccagagagagggacaggccgccatctttgctgtttcacagccttcactgtcgataccttaggtgctggaaaatctgaagtgattagggactggagcagacccccagcatactgcatctcagccctattgaaaagtggccagactgttatatgggtcctcaatcctatatttcctcactgggtgagtcctcccaacctgggcctccagccaccctctgctgggcctatcaagccagtagcagctctgcagctccctgggacagagctcccagtgggaggggcaggttgccctctttgctgtcttgcagccctcactctcgctgtctccaggctttggagagtccatgaggactaaagactggtctggacccctagcacagagaacccacctcatggaaaagtctgttctccatgcagttcgcagtcctcacttctcactagtcagggccactcgacctaggactgcagcacaaccaccctgcccctgcctgaccacttcaatcagaggcagccaagcagtgaaaggaagacccacacacagagatgagaaagaaccaatgtaagaactctggcaactcaaatggctagagtgtcttatgtcctccaaatgatcacactagttctccaacaagggttcttaaccagactgaattggctgaaataacaaatagaatgcagaatatgggtaggaaagatcattcagatttaggagaatgccaaagcccaattcaaggaaactaagaatcacaataaaatgatacaggagctgacagatgaaatagccagtataaaaaaggaaactaacagatctgatagagctgaaaaacacaagacaagaatttcacaatgcagtcacaactattaacagctgaatagaccaagctgaggaaagaatctcagaacttgaagactggctctctgaaataagacaaaaataaagaaaaaagaataaaaaggaacaaacaaaacctctgagtaatatggggttatgtaaagagggcaaagctacaaatcattggcatttctgaaaggaagggagagaaagcaaacaacttggaaaatatatttcaagatatcatacgtgaaaacttctccaaccttactagagatgccaacagtcaaatttgggaactacagacaatccctgcaagattcaacacaagatgatcatcccaagaaacatactcatcagacttcccaaggtcaaaatgaaagaaagaatgttaaaggtagctagagataaagggcaggtcacctacaaagggggcttcatcaggctaatagcagaaaccctacaagccagaagagattaggggcctatattcaacatttttttttttttttttggagacagagtctcactctgtcacccaggctggagtgcagtagtgcgatctcggctcactgcaacctctgtctcccaggttcaaacaattctactgactcagcctcctgagtagctgggactacaggtatgtgccaccacacctggttacttttttttttttttttttttgtattttcagtagagatgcggttttaccatgttgcccaggttggtctcaaactcttgaactcaggcaatctgcctgcctcagcctcccaaagtgctaggattacaggcatgagccaccacacccagtctcaacattcttaaagaaaaaaatcttcaaccgagaatttcatactcagccaaattaagcttcctcagcaaaggagaaataaggtccttttcagataagcaaatgcagaggaagtttattacaaccataactgccttacaagagatcttgaaaggagcactaaatatggaaaggaaaggctgctaccagccaatacgtaaacaaacttaagtacactgtccaatgacactataaagcaaccacacaaacaggtaggcataataaccagctaacaacataatgacaggatcaaatccgcacatatgaatactaatcttgaatgtaaatgggataaatgcctcatttaaaaagcacagagtggtaagctggataaaaagcaagacccaatgataagccatcttcaagaaacccaacttacatacagtgacacctacagtctcaaaacaaagggatgaaggaaaatctaccaagcaaatggaaatcagaaaaatgcaggggttgcagtcctaatttcagacaaaacagactttaaaccaacacagacttttaaaaagactaaaaagggcattacataatggtacaaagtttaattgaacgagaagtcctaactagtataaatatatatgcacctatcacaggagcacccagattcataaagcaagttcttagagacctacaaagagacctagattcccacacaataatagtgggagactttagcactccactgacagtattagacagatcatcaaggcaaaaagttaacaaagatatttaggacgtgaactcaacattggaccaaatggacctgatagacctctacagaatgctccaccccaaaacaacagaatatacattcttctcactgccacatggcgcatactctataatcaaccacacaatcagacataaaacaatcctcaacaaaggcaaaagaaccaaaatcatatcaaacacactctcaaaccacagcacaacaaagatagcaatcaggactaaaaaaaaactcacagaaaacagtgcaatagcatggaaattcaacaacctgctcctgaatggcttttgggtgaatgatgaaattgaggcagaatgaacaggctctgaaattgaggcaataataaaaaccctaccaaccaaaaaaagtccaggaccagatggcttcatagccgaattctaccagaggtacaaggaggagctggtaccattccttctgaaactattccaatcaacagaaaaagagggaatcctccctaactcattttatgaggccagcatcatcctgataccaaagcctggcagagacacaacaaaaaaagagtattttagaccaatatccctgatgaacattgattcaaaaatcctcaataaaatactggcaaaccgaatccagcagcacatcaaaaagcttatccaccatgatcaagtggacttcatccctgggatgcaaagctggttcaacatatccaaatcaataaacgtaatccagcatataaacagaaccaaagacaaaaacaacatgattatctcaatagatgcagaaaaggcctttgacaaaattcaacagcctttcatgctaaaaactctcaataaattaggtattgatgggacatatctcaaaataataagagctatctatgacaaacccacagccaatatcatactgaatgggcaaaaacgggaagcattccctttgaaaacgggcacaagacagggatgccctctctcaccactcctattcaacatagtgttagaaattctggccagggcaatcaggcaggagaaggaaataaagggtattcaattaggaaaagaggaagtcaaattgtccctgtttgcagatgacatgattgtatatctacaaaaccccattgtctcagcccaaaatctccttaagctgaaagcaacttcagtaaagtctcaggatacaaaatcaatgtgcaaaaattataagcattcttatacaccaaaaacagacaaacagagagccaaatcatgagtgaactcccattcacaattggcttcaaagagaacaaaatacctaggaattcaacttacaagggatgtgaaggacctctttaaggagaactacaaaccactgctcaacaaaataaaagaagacacaaacaaatggaaaaacattccatgctcatggataggaagaatcaatattgtgaaaatggccatactgcccaaggtaatttatagattcaatgccatcaccatcaagctaccaatgactttcttcacagaattggaaacaactactttaaagttcatatggagccaaaaaagggcccgcagtgccaagacaatcctaagccaaaagaacaaagctggaggcatcacactacctgacttcaaactatactacaaggctatagtaaccaaaacagcatggtactggtaccaaaacagagatatagaccaatggaacagaacagaggcctcagaaataataccacacatctacaaccatctgatctttgacaaacctgagaaaaacaagcaatggggaaaggattccctatttaataaatggtgctggaataactggctagccatatgtagaaagctgaaactggatcccttccttacaacttacacaaaaattaattcaagatggattaaagacttaaatattagacctaaaaccataaaaaccctagaagaaaacctaggcaataccattcaggacataggcatgggcaaggactttatgtctaaaacaccaaaagcaatggcaacaaaagccaaaattgatagatggtatctaattaaactaaagagcttctgcacagcaaaagaaactaccatcagaatgaacaggcaacctacagaatgggagaaaatttttgcaacctactcatctgacaaagggctaatatccagaatctacaaagaactgaaacaaatttacaagaaaaaaaaacaaacaaccccatcaaaaagtgggtgaaggatatgaacagacacttctccaaagaagacatttatgcagccaacagacacatgaaaaaatgctcatcatcactggccagcagagaaatgcaaatcaaaaccacaatgagataccatctcacaccagttagaatggcaatcattaaaaagtcaggaaacaacaggtgctggagaggatgtggagaaataggaatgcttttacaccgttggtgggactgtaaactagttcaaccattgtggaagacagtgtggcgattcctcagggatctagaactagaaataccatttgacccagcgatcccataactgggtatatacccacaggattataaatcatgctgctataaagacacacgcacacatatgtttattgtggcactattcacaatagcaaagacttggaaccaacccaaatgtccatcaatgatagattggattaagataatgtggcacatatacaccatggaatactatgcagccataaaaaaggatgagttcatgtcctttgtagggacatggatgtagctggaaaccattctgagcaaactatcacaaggacaaaaaaccaaacaccgcatgttctcactcataggtgggaattgaacaatgagaacacttgaacacaggaaggggaacatcacacaccagggcctgttgtggggtggggggagggggcagggatagcattaggagatatacctaatgtaaatggcgaggagttaatgggtgcagtacaccaataatgcatgtatacatatgtaacaaacctgcacgttgtgcacatgtaccctagaacttaaagtataataaaaaagaaagaaagaaagaaagaaattgaggcagaatttaagaatttccttgaaactgataagaacaaagatacaacatactagagtctctgggacgcggtgttaaaagagaaatttacagtgccaaatgcccacatcagaaagctagaaatatctcaaattagacaccacaactaaaagaactatagaagcaagagcaaaccaaccccaaagctagcagaagacaagaaataaccaaaatcagagctgaactgaaggaggtcaagacacgaaaaaccattcaaaagagaaatgtaaataggagttggttttttgaaaaaaaatattaagatagataagccactagccagactaataaataataaaggagagaagatacaaataaatacaatgagaaatgacaaagaggatgttaccactgacaccacagaaatacaaacaaccaccagagactactacaaacacctctatggacacaaactggaaaacctagaagagatggataaattcctggacacatacattctcccaagactgaaccagggaggaatttattttctgaacaaggaattagtaacaagctccaaaattgaatcagtaataaatagtctaccaactgaaaaattgcccaggaccaggtcgattcacagccaagttcttcaagatgtacaaagaagagctggtaacattcctaccaaaactattccaaaaaattgagggggagagacacctctctaactcattctatgaggccagcatcatcctgattcaaaagcctggcagagacacaacaaaaaataaaactttgggccaggcattgggggtcatgcctgtaatcccagcactttgggaggccgaggcgggcggatcacttgaggtcaggagctcacgaccagcctgaccaacatagtgaaacccatctctactaaaaatacaaaaaaaatcagctgggcgtggtaatgcctgcctgtagtcccagctacttgggaggctgaggcaagagaatcacttgaaccagggaggcggaggttgcagtgagccaagattttgccgttgcactccagcctgggcaacagagtgagactccatcttaaataaataaataaataaataaataaataaataaataaataaatcttagggccaataaccttgatgaacattgatgcatcaatcatcaacacaatacttgcaaactgaatccaggagcaatcaaaaagctaatacaccatgatcaactagacttttccctgggatgcaaggtaggttcaacatatgcaaatcaataaatgtgattcatcacataaacacaactaaagacaaaaaccccatgattatctcaatagatgcagaaaaggctttgttaaaattcagcatctcttcatgttaaaaattctcaataaactaggtattgaaggaacatacttcaaaataataagagccatctattacaaacccacagccaacatcatactgaatgggcaaaagctggaagcatttccattgaaaactggcacaagacaaggatgtcctccctcaccgttcctattcaacatattagaagttctggccagagtaatcagacaagagaaagaaataaagggcatccaaataggaagagaggaagtcaaactatccctatttgcaagtgacgtgattctgtgtctagaaaatctcatagtctcagcccaaaaattccttcagccaataaacaacttcagcaaagtctcaggatacaaaatcaatgtacaaaaatcactagcattcctatatgctaacaacatccaagctgagagccaaatcaggaacacaaacccattcataattgccacaaaaagaataaaatacctaagaatacagctaacaagggaggtcaacgatctctacactcagaattacaaaacactgctcaaagaaatcagagatgacacacacaaatggaaaaatagtccatgctcatggataggaagaatcaatatcattaaaatggccatattgcccaaagcaatttatagattcaatgatattcctatcaaattaccaaggacattcttaatagaactagaaaaaactattttaaaattcatatggaaccaaaaaaagagcccaagtagcccaggcaatcctaagcaaaaggagcaaagctggaggcaccaaggttacccaacttcaaactgtactacagggatatagtaaccaaaacaggatagtactggtacaaaaacagacacatataccaatgggacagaaaagggagtccagaagtaaggcctctcacctatagccatctaatcttcaacacagtggacaaaaacaagcaatgggtaaaggactccctattcaataaatgttgctgggataactgtctagatataggcagaagattgaaactgaacaccttctttacaccatatacaaaaatcaactgaagatgaattaaagacttaaatgtaaaacccaaaactataaaatccctggaagacaacctaggcagtgccattttggacataggaataggcaaagatttcatgacaaagatgccaaaagcaaccataacaaaagcaaaatttgacaaatgggacctagttaaactaaagagcttctgtacagcgaaagaaactatcaacagagtgaacagacaagctacagaatgggagaaaatttttacaaactatgcattcgacaaaggtctaatatccagcatctttaaggaacttcaacacatttacaagaaaaaacaaacaaccccattaaaaagtgggcaaaggacatgaacagacacttttcaaaagaagacaatcatatgaaaaaaatctcagcgtcactgatcattagagaaatgcaaattaagaccacaatgagatgacatttcatgccagtcagaatggctattattaagaagtcaaaaaataacagatgttggcgaagttgtagagaaaaataaatgcttatacactgttggtgggagggtaaattaatttgaccaatgtgaaaagtaggtggcaattcctcaaagagctaaaaacagacctaccattcaagtcaataatcccattactgggtatatatgcaaaggaatataaatcattctgttataaagacacatgcatacatatgttcattgcagcactattcacaatagcaaagacatgggatcagcctaaatgctcatcagtagcagataggataaagaaaatgtggtacatatacaccatggaataccataaaaaaagaacgaggtcatgtccttcgcagggacatggacagagctggaggccattattcttagcaatctagtgcaggaacagaataccaaataccacttgttctcacatagaagtgggagctaaatgatgcaaatacatggatgcaaataggggaacaacagacactggggcttacttgagggtggagggagggaggagggagaggatcagaaaaagtaacgattaagtactaatctttgtccctgggtgacaaaataaactgtacaacaaacccccatgttatgacctatataacaaatttacatatgtatccctgaacctaaaataaaagtttttttttaaatcagttttgagtcctcttgttctagactttttatctaaatgagttccaatttgtctatatcacttatcaaagtttattagaacatatattcattctgttcctgccatcttaatgacatcatgtttcccctgcttaatccttctttgtgtctctgtagattattaattttttatgttagatcattttaaaagatgattttaattaaaataatacctacaaccccttcttcccacccactctcctcttccccaagagacagacattctaatttggcatgacattatctggcctaacagtgtctggcatatgaagtgcctaaaaggtcatcttccattgttttagccttctggagtagttgaattaagttcaaactcagaatgtttttcaaatgttaagtctctctggggatgtttttcataacatcttcgaactggctaacacgactaaatgaaacatgctgcactggattaaaaggttatttccctagtgtgtcaagctaacagagaacatgaaacttcccatcaggcactgggcatctctggttgtcagtctagcaacattgtctccattaagttcctaacccccaccgctcagagaacactttagtcaagaaactacccttcacactgaatcttgagtggcagaaaggcaaagaaaagaagatgtaggaagagtcagaaacaagcaaaagaaataagggactctgtgagctaataacctgagtctaggtaatcaagaccaaagaccgatggaaacccattatttgaaattaaggaagaaacctcatacaggatcagagccaagcaaaaaatggacaatggtctaaaatgggcaaagagtaattctggtaagttagaatattgaaggacaggacaagagtctctattccatggagataagatacccgcaatttaccacattagaatggttacctaagaaagactgtggaaataaatcagaataactgaataatggcaaaagggaagcctttcttggatcactgatgaattgaagaatatgatgacatcaacctctgcacctgagaccaataaaataaataaaaccctaggccatcccatgcaaatagacaagttagttaggaaacaagaataacagtgctgtctagtagaactttctgtgataatgaaaatgttcggtatctgctctgtccaatattgtaaccactagccacaggtgattactgagcacttgaaatttttctagtattactgaagaactgaagttttaattaatttacatttaaatttaagtagctgcatatgactagaggctattatattggaggggacagattggatgttgcaagtgagcccaaatcctggcacagaaaaggtaagtgtacactgtagttgcaggaaacagcgttcatccttgccctctccaggacctgtttcgcccatcagtaggtgaacttgcagaaggctagcccctagaagttctcccctactgtggatttggctgctagatttgggaggagtcctgcagagctgactattgttcaagaaatgtgggcttcggaattgcatgtgcaatgggtgtttcctatgcagactttaatgagcacagcacccccagaatgccacgtgtatggctttgggcatcagccaggattggcttgagttgggtgctacctagtgaactatttcaaactatggtgctctgaggacttctttgctgccttgggtatgggtaacagtaatgagttgtgaggggtcagaatagagagttaatagtataaatgattgctaggctattacagaattctaactagaatggcaacatacttattcttaggcccaacccctcttcttttctgatattccactcttcttagccctgtatcctttcccttgctcctggatagcccattccttgtctcatgtggcaaataaaaggaatatgagaaaatgcttctaatgggggtggggggacatggccttattaacacgtgtgtttgggttcctgggtgcttttgtggaattattgaaattttcctttcctctgttgaataaaaattaaacagcagttgtaaaagtattgtacagatggtcaaagtcatcttaaagtactttccccatatataagtagccaataactatcatgtacccacaaaaattaaaaatttaggccaggtgcggtggctcacgcctgtaatcccagcactacgggaggccgaggcgggcggatcacgagatcaggagttggagaccagcctgaccaacatggtgaaaccccgtctctacaaaaatacaaaaattagtcgggtatggtggatcacgagatcaggagttggagaccagcctgaccaacatggtgaaaccccgtctctacaaaaatacaaaaattagtcgggtatggtggcacgtgcctgtaatcccagctactcaggaggctgaggcaggagaatcactggaacccaggaggcagaggttgcagtgagcgtgactgcactccagcctggatgacagagtgagactccatctcaaaaaaaaaatttttaatttaaaatttaccccagtggagttcacttactgatggaggatgcctgagtcctttgacctttggcagtgacaggtcttctggctgtgaaaaggtctaagcatttatcagcctatcagtttgagcatgactgctgggctccactacaagcatatctgcaaaaggagtgtgatgagggtgggatctgaaacagtagttttaccacttggcatggattgcctagcagttgtgtacttagtgaaagcaagtccagagttaagtgggaagtgcacttatcttcatggagtgatcagagatggatttatttatttatttatttttcctgtagggcccaagcctgtgaaccaaagggattttttttttcttggtgaaagaaattcacgttgaaccaatatctagaagacctatctggggatcaacaaggctaggagaatattttgaaagtaaaatcaaaatacagaaataaatatttgagccaatctaagacttgtcccactgagagatacctgctttgccaagtacatgcctacctctctaagattgtaagtgctttgaggctacagcttgtgtttctcacttctgttttcctcatggcatagtctaacatataaaacaggtatttaataaatgtgaaaaaacttaacatacatccacacccatgtgacagtcccagccttccagcaagctgtttgtattttgtttccacatagccaagagaggtaaggaagtggagtgctcaagtaagccccagattcacagaccttcttcagtgttgaactatgctgttcttcactgcttagaatatagaaagggtatcactgtttcaagtacacatgttaggatggcctgggaactaccctgatattaagaaggaaggccagagattttatggatggtaaaactgaggctcccagttacctgtaacagctacctcagtatctcatgggaaaactacagtgggaccaagattgtttcctgggccaggacagtagtatcactttttttaatgggatgttttgtatttgagtatgcattgtcttcaatttacttggaaccatttatgcattattcttgtgtacttacctaaaaatatctgatctgtagggaaatgaatagatagttctataattcttaggggttctgaaatatagtaattaatttgatgtttatctctttatggtcttgttttctgctttggaagttagaatgaagtcagaaatgagtaaaagaaaactatgatcacttggaattttatatatgtatatatatgaagaaaaagaaggctgggtgcggtgactcacgcctgtaatcctagcactttgggaggccgaggtgggtggatcacaaggtcaggagttcaagaccagcctggccaagatggtgaaactccatctctactaaaaatacaaaaattagccaggcgtggtgtcaggcgcctgtaatctcagttactcaggaggctgaggcaggagaatcacttgaacccaggtggcagaggttgcagtgagccgagatcgcaccactacactccagcctgggtgatagagtgagactccgtctcacaaaaaaaaaaaataaaaaaataaaaataaaaaaagagaaagaaaagaaaaagaaagaaagttgggccaggcacagtggctcacgcctgtaatcccagcactttgggaagctgaggtgggcagatcatctgaggtcagaagttcaagaccagcctggccaacatggtgaaaccccatctctactaaaaatacaaaaatgagccgggtgtggtggtgcatgcctgtagtcccagctactcgggaggctgaggcaggagaatcacctgaaccctggaggccgaggttgcagtgagctgagatcacaccactgcactccagcctgggcgacagagcgagactccatctcaaaaaataaaaaataaagaaacttttgtacttgtcatggtatccctagtccctctattctccccccaaaatttcaaatggtatcttaactggtcattattaaatagctgaatttattttagcacttccaaagaattcccagcttttttcatcttccaacttccagtcctttatattgcatcctgcttccatgatggaagaagaaagtcaccataatttttttgagtgtacatgaatgtcctgtgtgtgtgtgtgtgtgtgtgtgcgtgtgtgtgtgtaaggaggaaatgtgttgcttgggtgggtatgccttggggtgacaatacagagctctagaaccagaggctggaagagcagtgcctacttctcagatggattttggctttatctctacttttcacttctcctcttgggataagtaagaacagctttcttatttctgacagcatttcctccaataaagacaaacaaaaagttagtagccctctgattagtggttatttttattgataacttacattccacttggtaagtaacttggtgctatggggatatttctggactagaaggcaacatacatcccacatccaagaatgtgtatgtgttaccaaatcactatgtaacactggcaagtagtttcccctttctgggacttggttaccccacttgtaaaatggggagtttgggatgagactatcttccaagatccttccagccctgtggtttagtgattacatttctgaaaagaatgtaataacattttttaaaatgcagttaacaggataaattagtaataagaaaatagattagaaaccatatggagaaagtcaaaagataatttagcctaaagttattgcgctcaagcattaaatgtaactcagtgctgcctggcaacaaaagcactctttgattaggatatagtccttatataaatgcattctcagaaagggccaggctatagtggtgtggttcttcagaggactcgccatcttccacacacaaatgggtcttccaggttgatctctctgttcctaatataccattatactgcccatttggatctagagtcaaggagaaagtgactgtctttagaaagaaataccccacctgagaaacagtgattatactcttctgtcactctttcctcagatttgagaaagaaagcaggcagaagtcctgaaaataaaattctttcacaaaggcaaagggactcagatgtgtcagtgaagttgagctacctatagttataaggtttaaaagttaagactagtgaggaggctggctattcttgacttgaacctaatagtgcctctgcttgttctttctacccctaattccagtcttaatgaatattgtttcctggcatttgtatagtgctttaatatatacagtgcatttgtacatgctttctcattgattcatcgtcttatgcacctactcttcttgaaaatttctttagagtgatgtcacaaaaaatggtacagataaaaccggtacagagagaaagaaaagggaagggagacccaaatgttgaggcactgagctaggacacaaatgcagccactatcacttctgcctaggaacatgatggcaaagagggtccctcttagattggtggctgccaaaaatgaaggcaggtgatacatacggagccctgtcgccgccagcagcaccctacttgctacccctgacaggattggggtatgtgtgtataaaaatcagaggcatacaggaaaggacatgagatggaagggattaaagagttccctcaggctcatctcagtatcacacaaaacttaaatcagaatttattcttgcatgtcaattttttgtagtacatgtaattagtttcaatttttaaagacgaaaaaataggctgggcatagtggctcatgcctgtaatcctagcactttgggaggccgagacagccggatcacctgaggtcacaagttccagaccagactggccaacatggcgaaaccccgcctctactaaaaatacaaaaattagcttaggaggataaggcaggagaaccgcttgtacctgggaggcagaggttgcagtgaagcaagatcgcgctgttgcactccagccttggggatagagcgagactctggaaaggaaggaaggaaggagggaaggaagggaaggaagggaaggaagggaggagggagggagggaaggaaagaagagggagggagggaaggaaagaagaggaagggaaggaaggaaggaagaaaagagggagggagggaaggaaggaaggaaaggaaggaaggaaggaagaaaagagggagggagggagggaaggaaggaaggaaaggaaggaaggaaggaaggaaggaaggaaggaagggcgtgatggtagcctgtaatcacagctactcgagaggctgagtggcaggcggaggttgcagtgagccgagatcatgccactgcactccagcctgggtgacaaagccagactctgtttcaaaaaaaaaaaaagagagagagacagagagaagaaagaagcaagaaagaaagagacaaaaattaaatgaattctagattgttaggaactaaaagaacccttagatataatctagtttttctcccttattgtatagctagtaaaactaagtaccagagaagggagggagcttgtctgaggacacctagctaatgatcgtactctgtccattatacagtatcccctcttctatatgagttttttgtgcatatcttttgaattttggaattttttttttgagacagagtctcactttgtcctccaggcttaagtgcagtggcacgatcttggctcactgtggcttcaacctcccgggttcaagcaatcctcctgcctcagcccaccaagtggctgggactacaggcacgtgccaccatgcccggctaatgtttttgtattttttgtagagacggggtttccccatgttgcccaggctggtctcaaacttctgagctcaagcaattcgcccacctcagcctcccaaagtgctaggattacaggtgtgaaccaccacgcccagccagaattttggaatctttatcatgagagaggaaatatttaatagagtcataccatacttttgagatatatagaattctttacagtgtagctgtagtaatctcttcttgatgtctttctcacccttaatattgttaaaacttgtatcgttgctcatttaagcatgtttcctgtacttaacatcatcatacctccgtatttctagcttagggtcttaaaatcctgatagatatctgaaaatagaattagccaagcagagttatggattagaatgtgctccctgtactgttgctgattctgccatccattattctgactaaagctagactgggaagaatcagactagacagagctagctgggctagcttggaaaactgtctgtgggcctatttgctatagcagtaccatctccttgcttcattacagtccctaacccaacctgaagattccccatctgtaacagcttgcttgtcagttgctttctttccagtgtgacagctaaggtcctggtcagcttcattagacatgttgtacctgataatgggtcttcatactggccttgctttattcccaagaagatcctggcaccgatatttctgagactaccctggtctggaatccaaccacccatgattcttctttcacagtcatctattaactctttgatctgtcttttctctctatattctgactactgctcccttacctgtcacatctaaatcatctttcaggtctatacagcacacctatgtagttctacttacatctaacatctcctttccattcctatttcctcctcctgaattctaatctttttgacatctcacacctgaacattttttcctatcttccccccctctgtctctcccactttcactggtcctaatattcttcactactcaaaacccttcagcatcttcctgaattacaatttagttggcctccacagtatatttcagtttatctttccactatattttcttgtttgtacctatttcagccaaacattattccctaaattctctcccatcttttcctaccattcaacatcattgtttaaccagtttttataaagtacataccatgttataagcactatgtgagctaggccctgtggagttgggggtgttggtgcttagtcttttgggggtatcagatataaagtagtaaagcttgtataagatgataaacacagaggagataaaaattctttgagaatacagagaatgacagagactaattttgtttggagtggggaatcaaggaatgtgtcaaggaaaaactgagaagggaagagtacagagaggtgaaagggaggttgggaaaggggaagggaaggaatgggaaaaggggacagagattccaaacagagagaatatcaagtgcaagacacagggaagcaaaaacaaatggtttaatattaagggagtggagagggttagaatatttaggaacatagggggaagtgaacagaatgaaaagaggatacaactggagaaggtgaggattgattgaggagagtgttttgcaaagcaaaacaaagttttaaggtaccttgtcaacttgctatgattctatagcagttgtttagaagatagactggagtgggagggagacttgtagcatttcatgaaggtccttctgcctggaatacttttctctccgctgaacttccccatcctcacctccagaaaggtcatccttcaaggttcaccttaatgttgctgcttttagtgaagccttcccaaatctcccgcctctctagaattctagaattggagtaatttccctccatttgggattcccatagcaactttctgcccctctttcagtgtattatacttacaatttgtttgtagcttgctttccccctctagactctgagcatcttgagaacagagatctagcctcatttatctgtcttttctatgctgtacttgatagaatactgtgatcacaggtagtactaataattttgatgaattgatttaaactggtatcccagagattggcactactcaaactccaaaggctatattgccccagacccatagacaaaaacaggacttactttcttgccttgatttttttcaccagttgggaaaagccaaggacatcctcaacacaaatgttggtgtgggtcacctagactctgagaccttagacttcaaggccgctggggaagaggatagcagcctacaggatctatgagcctttctcaagcccagctgaggggaagggcagataggagggattgcttttccagtctaatggagcatttccttgcttcaaaataccatctccatgctaatgttattttaatgccattacactgtgtaatttactgtgatcagcaaagcaatttgttgtacattcttccaaaagtgttaatcaattttagctcaaaatagattttaaaaccccacctaatttactgtcctaaaatgctgatcagtgggggaaagctaaagcaagcccagagttgtttgtattgtaactgtaagaaattataattcctccccaaaattatttttataagcagccaaggtataagtaaataggtatgtagaaaaatatatacctttagttgtcctgtttatagctgagatttgaaaaatcataggaaaggactaaaggattgtctgctcaaggtctagcctactaattctggagaacaaaggcccaaattattgataatcactaagttaatatctgtgatactcagttttcccttttcaaaaaaagttatagactctaatagaaccaaacttatgaggtaattaattatacatccaacctcccatgtccccactctacctcttctttatcttttgccaaagtgtatctcctctctgttctcaaccttataagattccctttacttcagagtcataaatcttgggtgcttggccagatttttccattagaggcaatttatgttcttagggaaataacatcccagagtaaagttacagcagcactaatatgtcccctgacatagtgttcttgtcctgcctgaaaagactggataattggctagacacagttgctcatgcctgtaatccagcacttcaggaggctgaggcagttggatcgcttgagatcaggagttcaagatcagcctggccaacatggcgaaatcccatctctactaaaaatacaaaaattagctgggcatggtggtgcgtgcctgttaattccagttacttgggaggctgagacacgagaatcgcttgaactctggaagggccactgccctccacctgggtgatggaatgagactctgtctcaaaaaaaaaaaaaaaagtttggataattgttgatacttaaatgtattgttcctatatatatttcatggtacattaatttttactgataacagatgcttatctgtggcagctgttctgtattttcctacctgaaagggtatagaagtatagatcagtaacatgtggaaacttgtatttgtctagccctgttttagtcaggggttggagttggtaagaatcatggagatggcattttgtgttttaagaaaaaacacctagtctcttggtcaggaaacttggggggtttttttcatagatctctcattgtgttgttttacaaccttggctgtcatagtctctctttccataccttggacttcctggtgataaaaatggacttgcttgtagttaactatagacataagggataagaagacattaaattattgaaatctaaaagtaatttgccccttatcaagttcctgccaagatggacttagtggaggggcaaaagaggggtaaatgatacctgaagttctactgaactccaaaacaaaaatgcacagagtaatccatgatggcaatatgattccatctgatttatagggtcgtctttgaagcagaggcagctatccaatctgttcattcagttctactacaaatgagccctccttgacaaagggtggggacttggacattgctatccactcctctccatcttttaaaactctccagcccttttctgtgtaaatacaagtaagcatatattttctcttttccctggcacccatggtttattgcctatgcatcaaatcagatctcatataaaatgagaagaaaatgtggcaattctaatatataagtgttaggggaaacccagagtcatctaacatttttaaaactgagagactgcctaatacagtctttgtattttatagataagggaataggcccagatgggtaaaatattttatagattgaatcacgtggaactgttactgcttcctgtttctcaatgctgaacctactttttagagtatattgcatgcattaggataaatgactatacaattgagattcttataatagctgcttgactatcaataccatatgctttttaataaagggatagatactcagttggggagaaggtctagggacagggggagggctagatgttgtagtggcatgtggcagatacccccatctcatctcctatcattttgcacataaataccactcaggtaggtgggcaggagatgaagggctacagatagatatatgtcctatgacctaaaaatatcagatgatgctggggccttttcagaaaatctaatcttctttgtagtcacattttttaaaaatttgctgtgagtttggaggaatacttgtcaaagtccaagttaaagtcctggaagtcgagaaaccaaggaattctctaccttcttcatccttagcagtcaaattttaaggcacagaaagagaaaatctgaatatgatgtatatgtgtgtatgtatatgaattgccttgtttttgaagagcatctgatcatttgaaatagaaatgaggcaaacaaaaataaagttaattgccacacacaaacacacatacaaacacaccttatctcaggttagtcttgtctttgctttgtgtccttcttaatcaggcaaccatgattaggttaaatgcattactatttggaggaagggatacgtttgtctgcttccttggatttcagttttgaataatattgtggcacagaggtgatagaaggatctaggatgtatgaatgagtgtgagtttccaaactgactttatgtggtaggtataaattgtgaaacaaaaacaatagcagtgatgaagtcaatctggaaacaggtaaatcccagtgagccttttaagacccctctagctgaaataacctataaaacacaaaataaaacaaatttaatgactgatattatatatttgaaatgtgcaggttggacagcatttggacttggaatgaaacaataagaggttatattcatggataaccaacaagataaggctattgttgcctcagccaacggagaaaacactctgattaatggggtcaaagaaaatggtaagggaatttaattatagtatattaatatctctcctggtagtcctctgttattactatggattttcagtacccacaaagttgggacaggttgagtccaggatgcctctgaaatgaatgttaattgtaaactttattccaccaaatatctaacttggctataagagtctctaagaggcattgaatctgaccactttgccctcccaaatcatatctgccagatgaagatcctcaaaattcctagtgaattagaaatatgctgtgatgtgaggcttagaacttctagagtggccgggcgcagtggctcatgcctgtaatcccagtactttgggaggccgaggtgggcagatcatttgaggtcaggagttcgagaccagactggccaacatggtgaaaccccatctctgccaaaaatataaaaaattagccgggtgtggtggcaggtgcctgtaatcccagctactcgggaggctgaggcatgagaatcacttgaacccaggagatggagattgcagggagccgagatcacgccactgcatttcagcctgggcaatagagcaagactcaaaaacaagaaagaaagagagagagggagagagggagagagagggaggagagagaagagagagagagagagagaggagagagagaagagagagagagagagagagagaaaagaaaagaaaaggaacttgtagagtcactaggagcttccagaacatggatctggaggacaggcctgagcctcgtagctcaaaagtattaatgttccatctgagcattttccccttgaaagccttgactttccaattgatcaagcagtccaattcttttctcatttctgaggagagctttgcctttttctgaggaagaaactcggcctaaataattattatttttcatttgcatgaatgttcaatataaaatcagcgttgttctttaacgttgtagtttttatttgtaaagatagagatgtgaaggcttagcttatataataagatcaagtaccagaaactgatcaagggaaagagagttaatgagtctggtctaagactcttaattttattcctgtcatttctttcccttttttctagactcagaggaccaggatgtggcaatgaagtcatttgcagctctagaagctgctgcacctatccagcctacaccggtggcacaaaaagagaccctgatgtatcccagaggtctcctgcctctaccctctaagaagccctgtatgcagagcccgccctctcctttgggcctgattgaagcacccgaacatgctgctaatagtgcttctgtgaatgccatctccctcacatctggcattgcaaaaggcctgaacacatggtcacttcccaatgaatgtgagaaagctccatttgccataatggagcctgcaggcatgtcagctctgaatggggactgtctcatgcagccaagtcggacttgcttaggctgcttcatggaatccaaggatgcagtagatcctgagccagggatcagtctgaaagttggtgatctaaatagggattatgaaacgtgtgcagtctctgatatagggattcagtgtattaatgctggagaaaatatgaaatatggagagcagctgctctcagaccagctcctaggcttccccctgcataagtcaagggcaggagacagacgagaaactgagaaacctgacattgacttggaggatccggctcagaaaagctattatgaggcattactgttagacaagtgcaatacagaagaagctttgcttgcaaattccaatcaggattggggttacttcgagacttttattagtgaaagtaagattgaactgcttgacctctgttccaaaaatgagctgtctgtcaacctattctctgaagaagatgtggataactacatgtttgatgatgatgaatcaacactaggcagtgatgtctgctccctgaaaattcgatatgaatcctttcaggacaatgttcgagacaagactactcttttgatgcaggaagatgcccaattcaacttttttcccagcgtctttactacctgccccaagcgagagtctaagagtggggccctgaagcagagcagtgatttttcccaattcaaggtccctgatgtgagcatcatctggggggaggaagataaaaacttggacaagaagaaaggcaaagaggaaggacaggaagacaaaggtgtagagaagaaagatggaaaggataatggagaaaagcctgccttaaataaaccatgcagtgggactgaagtagagcaacttaagaatccaaagcagggccatcttgctaattccctggagacatcagggagtttcagtgatgatagttccttcattgagatctcatatgatgctatgggtgagatcaaggactgtagtcgctatatggctcgggacactaattctggcagctcctcctcccaacagaactatgggctgcgagccaagagaaaagtcagatacagtgaagattatctatatgatgttgactcactagagggtgaaaaagtaaatgagaggaaggaatggctgccagttggttccaaagaggaagatgatgatgaatggtgtcccaaaaagagaagaaaagtaacccgtaaggagccccctgttattatcaaatatatcatcattaatcgctttaaaggtgagaagaacatgctggtgaagttgggtaaggtggatgccagtgagacaacagtgaatttgagtgagaatcagctcaacaaatatgccaagctggcacccttgaaaggcttctggcaaaagaagaagaagcagagaaacaccaacacggactccatcaagacacctttttcccaaaagcaaagctttgaaccaggtagctttgaggtgtcatttctgccacctgctcgcaaacgaaaatctaaacttggcaacaggcacaggattcaaagaatcccatccattgaaatttcagcaagtagtaaacagatttcattatgtaatgatcagaggcacgctagtaatcataaagaagatggaggcctaaaaggtacactgaagtcagcacctctgggtgctcctagctgtgcaaatggatcacatttaaatgacatcacaggccctgactcagtgaaagtcaaagcccaagacacagagtttaaggggccagagaggaaagtgctcaataaaatcaaatttaaaagtgaagctaggttaaaatctaagaaagtcaaagctgctgggcaagaaagcaagccaattgttcaaatgagccctctcttggaaaaccaatcctcaaaggctaatttaaagaatgaagttattcctgggacatcaaacagttcccgtctatctgaatttcatgaggcaaaggctgctaagagttccacttttctaccaacgacatgctcttctgaaatgcctttatcatctgctaatgttaccactaatatacctgttatcccgggagggtatctgcagacattgttagatgcttctgacttgtcaaataacactagtatctcatacttcagccaccattctccagagcaaaatgaaggcagcctcactcaaaccgaaaaatcatttgtacccctccagcctacccaggactgtgtgctcacctcatcctctgactctgagctgcagcagtcatctcataacttcaaaatggaatcaagcaactatagaaatgtgtggcccaacaaggctacttctggcacccaggaattcatggctgaagtctcaagggagatagccccaacccaatccagtgaatttggagcctcccaagtagtctccatggaaaataacctcacacctacaacatacaatccaatctgtctcaatagtggtggcagtaattgcaacaaggtcctgtatgactccatgcaagatacccaactcccatctgatgactcttaccaattatgtcactttaataatggagagatctgctttcctttccagcaggggccagtcaatatggatgatggtcggctctttagctttgattcaatggccccactctctgtcagctcaagtaattattgctccttaagcttgaagtcctgtgaaaaggatggcgatgatgatatcactgatgacttcctggcccattgcagccctaagctggtgatccagcaaagcattgatgagatagcaccactaaaggagtccactgacctcctggatatatccaacttcacccctgacaaattccgccactcttccctttcagagatgtccccaccggacacccctagtctttcccctcaaattaccagatgtgagagtatgaagacactaggaacactaaaggggttccaagagggtgtcccaggaccattggacagtgtggaaaaaatcaagtgggactgcagtaccctttcacggcaggtccaaatggaggatggatttactttaaataatcaccagtttcagttccatatgttcaatgatgaggattctgtcagcctgctccaaaaaaacccttgcctgtcaacatttaatgatccatctggtcaaattagtaccaacaacaaagtgtcaaaatcaagaaagaaaagttcacccagcaagagtggggctatgaaccaaagctcttctcagaaaaacaccaggaaaaaatccctcaaaggtaacaacaaggggattgaaaaaccacctggcaaaaactcccgccaggtccctaagtccacaaagaaagggaaatacatggctgccatcaatggagagaaaatgcaaattggcattggccgtgggggaagccaaaccaacaccatatcctccactgggaagacattggctgaatgtatccaacatggtggccctatggcctctatgaagatgccaagtcaaaagggactttctggagattgggccttggggaaggagagcagcccaggctggagtgatatgagcatgggcaccaacaccaacagccttctggatgatgaccaacgggaatttcaggagccttcctatatcttgtccaacattgcctctggtatggcagatgtgcagagattcatgatggcctccatagagcccctttgggaacccatggagcaccatggggatcccaacatattctactcccctgagtccaatagtctaaaattaaaaaccctcaaaatattggctgggacaccacaggagtctaagaaaaagatcaacagtgggtcccaaggagccactaagaatcacaggtcaatcaagggtgtgagcaaaagcaatgggaaaacagcaataggtgatcctggtcgtgcaaacatgcctggttataacgaggactctcgctctaccttctttgataaaaagtatagtaacatgagcactttaggcaataacggaccgacacacaaaaagttgtatcgtcacaaatccagctccaaggccctgagagatgagaaatgtaagggaaagcacatggagcgagaacaggtccacaaggatgagtctgggacagcttcttttgaaaaactgaggtaatactgcaccagtatggctgagatgatgcacccttagctctcctactacctactaagcccgcagtccctcattttttccctcttgaaagcaaaaatttgcatgaaagaaactgtcccattcccttctttttcaaagtaaaaagaaaattttaaagtgcatgaaaatccctatacctttaagccacccaaaagattgggcaattttgttgtggcttggctagggataagctctaacaaagctatttcttcttctgctattcatcactagttactacatattaagaaaatagaattaaaatatgctcttgaatgatttttggaagtgaaaggctttgcagtaagacagattttgaaaaatagaatttaaaagtcatgtagacaaaaagccaagatcatttaaacaaaagagcattagctggaaaacaaaatctgaacatgtggcaaataggagggctttctagtgccccatgctatttgtatctttttctacatcatacggcatctagtatgatgttaacaaatttagcttgtatgatccctttgtgggacatacactaaaactaactcagatggcataaattgtttgatttttctgcagggattccgactacaatctcctaaaagcagaaacaaccttttgggttttacctgtgtttgaagaagagactcgcattttccagaaagacatttgatgtttgtgttttatttctttcaaaatatgccttgtggtatgtatgttgacatgtaagtgcttaaagaaaagaattttaaattgtgggaatacgtctttggagcaaactttaatctcatgttctatgtaaaagacttaaaaagtcatacagttgcacaagtagtttatgcactatttacccacaaggaaaaaattgaaaacattgtgccaaactacaaacaagtgactgtactgtatatatttttacttctatatcaacatttggttgtatttggggaagttgtccctgttaatttactagaaacattccagtgattcttgctattaaccacccccacttatgtggatagcacctgtagatcatggtggaaaaatatgttgtgttacacaatttaccaaaattaaaggatactgtttgaaatgtgccaaattttcttacctcatctcacagattcacccacagtttaaagctcattaattatttttaaatggatatatacacacccaaacatatatatgtatatgtttgtgtgtgtgtgtgtgtgtgtatatatatgtatatatatatatacacacacacacgttcttttaaagttttagactctactgtcctgtgtggaaacatgaacagctaaacaaggcaaaataaagattttcttgttccattgtgtaagggttaaaattttggaaaagtctgaaggccacaacagctaagtccatcagggacccaagtatatgcatttacagaacgttttacaaggaaacaaaacagctgctttcaaagtttgttttctaaaagcaaaatctgtagctgaaaattatttaaagtgcaaagttatattgctgatactttatatctcagttttatatattttataatagtctgggataaattataaaaatagctataaaatcaacactaatgataaatgaagtatatagaatgcttttatttaaatagtttcctaaatgttttattccagttttgtcaaaagtgcactcatatcatggctttagtgttctttcagtgtttaatcttgcaatgccaatgtcatttaaagaaaatgttaaggcatcccagttcaaccaaatttttcttcttatgagtaaagtacatttactatcagataagatgaacaatttgtggcaacaactgatttgggccatatacccttagtctgaggataaccaatatttgatgccacacactaaacttaaatctcaattttaagtacaaatttttaaatcacattttttattcagtactccccctactttttaaaaaaaatttcacagccccaacattcctcactactactttttcttcccttttattcaccacttgacttctaacatttgatctcttttctttgcacaattgaaggcctgtgcatctgatgactgatgcattatggcacagatgagataatggatgtgagagcgctttgtagatcataaagtgctatacagatataggggattaatattattaatattgttagttgttgtcgttgttactattcttattaatattgttactaacctattaacttgtgaatatataggctggggtgggagggtggagaataagtgggaagggaaaaaggggatttaacaaaaaaagggaagatgtttcaaaaggaaaattttaagcaaaatatgaacctacctagtcaatgccacctaaatgtattcacaaacagagaagcaacatttgaaagtagtcagagagaaatggaaggaagcctgtcatgtatataagtatatacacttcccggtccatgattcctttcaccagcctgctctattccttacagctgggtcgtaaaatgaacaagcctgtgttcttgatcatgtgtgttcccagcgtcagtctcttgtgtctgtggggatgagtgggtgaggagcattctgtgaggctggtacaggcccattcctaggctttaatgctctgtttgcagtgagccctggaaaattacttagtggaaaggcaccagatgaaacatgtctcctgccccatagctaccattcaaaagggaaaataaccaaactggaaaaccttcttctatttctctattctgatagctagctgtactaaatgctatggccagtccctagaaactggtctttgttttgtttttgtttttgtttttgatttttctgttttgcagctgaattttggcttggaatcaccaactctgcctgtattgtgatccccaagactccagacctcagagtcacctgctggcttagaggagtggagtgctttctatgtaatgaaaaggtggcaattaatgaaaaaataaagaaaatgttccattaatacaatgtgtttttataaaagtaaatatgggagcagttgtcccagttttttttcggtatcagttcagctttggagaatggggtgtgagtggggtaggacagcctgaaactgttggaaacaatttccttgtgagaacttgctatcataagtcctttggaatggatattctttcagttgctcctatggagcccattaagggccaattctagggcatagttcatccctttctccaaagagaattgttattttaaagtacctttttaattggcctgcagtgtattatatgtttttaatatataaattagtgacgcataaccagtcactttgtactgaaacataaaaagaaacagagtttgagaaatgagcaataggccgaggcagaagatgtttattctcttaattgcatttaatattcctctcagtacattgtgttctgagatgttcatcatttagcattttgttggtcctgtctctgctctcacagttctttttcttcctgtcataaccagctgccttagtagagtataaaaatagtgttttgccctatcactggtatctcaagtcagaaatatatattatccttggtctgaaattcctgattaccgctcccttctaaccttccccctctgagaagctgtttcctattaatgcctccctaacagagtcccatttaatctttactttcctggaaatggtaacctcccttattcttcttacttaatctcagaccttggtcttagaatttttcttttatggtctcatatcccacctgcccaaattgtcagggctcaacaatcttaggctgctttcttctggaagttcagaaggaaaccttcccattcttaattgcctttaattgctttggctattttcaaatctaattttttaattaaattttttttaatttttatagagtaggggtacaaggacagttgtgttacatggatatattgcttagtgttgaaatctgggcttttagtgtacccatcaccgaaatagtgtacattgtacccaataggtggtatttcatccctcaaatataattttaaacacacactcgtgcccacatggacaaattatatcacatgactgaggaaacttagaaattccttttccctgaagatctgttaagaataggtctcatctcctgccctggttaggtgctatattatatggagaagggtattgagactttgggggtcatgtttgggctgtgataactggcttgaaccagtgaccatcctttctgcctcgccaaggtctcttataccagcttcttcacatatgctgcttcctcccagctttcccttctgacttcttgttactctgcaactatgtgtcaaggccttaccttttcctgatgttttcaaacctcctgcattactttgatcatcacttcttcagccatctcactgaagtccttggtgctagctgggcttttgtgacaactttcaccttctctgaactttttccttgctgggaagcatctgcgtgtgtgagggggctacggagggaagtgtgtgtgtgtgtaagagagaggcaaaaggatgcttcaaaagctataaacaactctagcaagcatcctaagtcctatgtgaggttttgcagttctagtgaatttctgttttagtaggtttcaattagcatttactgcctaaaggagaaaaaccatatccaaggaccttttagccatgcttgctattaccaagctggaccagtgtgatgtagatccaacatgtcttcagcttacagatgctctcagaacagttccaagaattgaagagagctaagtttttatgctgaagaggagaatggagcactagctagtcctaactattgctagaaatagaaatgtttattttctcctttattattgagaaattatctaatttaaggagtaaccattttcatttagggatttttttaatgactgcccatcactacagaaatatgttctttttataaaataaaactaatgtgaggttggtttgttttctaatcataaaattcactaagcctatagttacatttagaagatttagtaccaaaatcaaacttttagtaacaaacaggaatcttgtcaacacaatgtaggccagggattttgtaaaggtttctcaaagacccaaataagggagaaaaaaattttagttgggctgtttaacttgggaaacactgtcatcagcttgagggtcctcagccagcatgtgattattttgatgacaggactcaggctaccctttaaggcacattttttactcagcattaaacactagctacagtcgtgaagcagagctcccattgcagctacatacttgagatgtactcttggtttcagaatcgtaactaagaggtaaggcattggagaaggacaatgtaaaagacagaggtttagaacaaagtttatggtgtgaatgaggctttcaaaatcagtatctgggtaaattgatactaaagacactgaagaaacactcatccacataagatggaaaggatgtctgtccatctaacaagctcaggggtttctgagtctcagaatgacatcccatttcaaaaagaagaaaagagatattgaaatcattctgcctgtttgagagatgactggttatttacagcacaaaaaaaggcttagaatgaaaactagaagaggccttttgtttttcactcccagtgaggagagtagaaatcttaagatgctctactgggctacctgtagcactgactggagtttgctgcctacagagttttgaatgtactagtccttagtttccatagaactgaatgcacctctttagtaagttgctgatttatggtgctaaagaaaatgattattcccatttttttcttcttccccaagccccttaagcatttaagaaaatttaaaataaaagcgttagaggccctttttatgaatgtaacctaagtttctgtttgacatatgacactgcaacttaaaaatgttaggaaattatttgcctttttttttcttttagagttaagctttataaataatctgtagaatcaattgaagtttaaagcttaaggatcactcttaagacgtctacaaaatcttgtatatttttaagtgtgccaatttgtaacatattttgtaagtgtatatttttcttagaaaagtgctgtgaagtgtctgtatgtgagagttttcctttttctgcaccactaggtgctaataaaaggatatttacttcaaagtttctggttttagaaaccacaatacaaagaaaaaaaatacacttttgttggaaattttgtaacacaaaacatgttgtgaaagagtgtagtgatcttgtgcaaaaaaaatgaacatttgtgagcttcttgctgttttatagattttcttgtaaattattcttgtaacacttctggttttgttgttcttgttgcgaaggtttcaaatatttgtgactgaatgtacggtgaaactgtcataatgttacctagctgagttttgttattgtttatgaaataaataaaaagaaaagtttaaaa

SEQ ID NO: 1170 - DNA, 45904 bp, mus musculus; identical to SEQ ID NO: 191

SEQ ID NO: 1171 - DNA, 35829 bp, mus musculus
ggcagacggagcctgggctcccagcggcaaggtgaggcagagctgcgctcctcgctgaacgcgggccgagctcggcggctgcgggggagacgcgcaggagcccagaccgcgaccgagagcgggagctaggcgggcggcggcggcggagggggagcccgcgagccgccgggcggagagcccaagccgcgctgtcgccgcgcagggacgacttggccaacactcacacacactcacacacacccagcccgagcgggcgctcgcggcgaaccgtcaacatggcgctggggctcctgcccgagcgcgggcggcggcggcagcgcgggagctgctgagctcggccaagcccagtccagctgcgggagcccggaggatcgcacggggctgtcgccacctgcccggaggccccgagcccgccccgccccgcccccacccggcccagagcccacccctcggcggggccgaccccgagggcagccggctgccagcagacggcgagggagtcgagtgagcgcggcgccgcgagcgggctgcgggcagccggggaccgcaaactttgctgctcgccgcgcttctccggcccggctccttctccgctcgttaacgtcgccaaccccccccacccctcatatctctctccacccacccaaccgccccccgctccttctcgccgcctcgagtccgcttgggggaaaacttcaaagagccggatcgcaggctccctgcctactcccccaccggggatttcaggtcagtgcccggaacacctttcccccgggagaccgcggacgggtgggcgggcgggcgcgctgagggctgcagtcggccccctctcccggggccccctcccgcagcgtaccccgcgaagcttttgcctcgcgcttccctttggctgcttggctcgctttcgtttttatttcatagctatgttatttaaaatgcagccaacctaagcggccccgcgtgggcaccagggagggagggggcgcggctgggggcctggcgcctcccggtgggccaggaggagagcagggagttcgcagagtggaagtttgcagcctgtgtgtgtctgtgcgcgggagcgcggtcgccgctgagcgccgcgagtcgggcggaggggggggaggtgggctggaagctgggaagctgggttcggcgttagctcgcgagcaggaaggggagggcagcgggttgccgtctgctttctttttcgactcgggaaagaactgtaaaaacccccagccgccgccaccgccgcctcgtctcgcctctccgggggccggtcgttcctccaagtggaacgtcggcgtgtgcgtgcgcgagggtgtgtggcgagtgcctcgggccgagccgagctcgacctgccgccgctgccgcgcaactcgggaggggagtcccgttttttcttggcttgccccaaagcacgaatcacgtggattaaaaaaaaaaactactaagaaatcgagcagagcaaggggttccgacttggcccgcccgccagccaggtcagacgctttgttttgtaaatgttcttttaagattataatctgcgatccccctcccgctttccccctcctctccctccccgatgttcagcgtaggttttaagttatgagcccccaggggtgggtgtagaatgtgcttgtgcgggggcagcgtcgtggagggagggcgggggcgggcgagacctgggccctccgctgggcaatggggagtctggtgggtagccctgatgggcgtgtgaaagtctgcggccggaggaagttggtcccactcggagggcgtgtggcaaggaggctgtaggcgaagaggaacttgcgcaccggggcaagatcctcggccaaggcggggagggcgaggcgccgcggggcccgcgctcggagccggcgggcggctgcgccgcagagcctccgccaactcgggggctcgcggcggcggtgacgagcgcctgctgtttacggagagagccttggggcaccgtgtgtggagtagggcggccgaagtcacgcgtggtcccggcgggcttcccgccgctcgcacgctcgagtgggcccttcccggggtcccggagacggacgagtctggcagcgtgtaggccgtggccgggcgaggcgtaatttgctgttaatgaatcttttccagaaagtccgcgatctccagctagaggctgtgagtgcccgcgcgccagggcgcgcgccgccggcgtctggagggtgggggtggggggaatggaagagcgaagaaggaaggaggagggttatgtgtatttagaaacaaaccttaaaaagaaaccaacgcgcttcaaataggtattcgcacagcctcgctgcgtctagactagacagctcggggttttagctgtgttttcccccccttttttcgttttgagaagacgctagaggaggggtagtgtggtatttggttctaggggtagtcttttggagaaagatccttaaaatggcctgggagtaaagactaggaggaaatggcccaccccagaaggtggtgggtggtgagtgcagacagacttgggtatttctggccatctgacacttcctgtggcactggaaacggacaccgcgggccgaaatcaatccttacgaagtgttgggttcggttttgccaacagaattgcttgcgtggaaggcattttaattgtcagcctcaaagattcctgtacgtggacacttagggaatacgctcgttccttgaccctgcccactcctctctcgacctgttatctggtgtgggttttgcagtgttggttttcgtgtttattttgggcagggtttcagcgcgtagagcggagtggggggggaaggcgatgattaatatgccatccaggtttaatccgaggctggccttcagtgtgcgggtatacaccgccacgcacaccaattgccttggggtgtttaggggagcgcgcgggttttgggcagcaggcgcccggccggcaagtcgcggctggggctcggctggccccagcgctgtcctttgaggcgctgtcaccagtaggtgactgagagttaattaggaagtgttctccggatcaatgggctgcacagctcattagcgattctctccagccctttgcagggccgtcctggcctccgcctcccacacaggccggggcctcgctgtccaggctgcggggagcgccgctgggaagtggggaggggccggtagcgagggacggcggggaagcgagtgtaacttcgcggggcggcgcgttgcgtgcggcgcctcgaggcccgcgcagcccgctctttcttcctgcccgcggtcgcctccactgtgtctttaactcgctcccgctcgcgtcgctgcctggctgctcctccccgcctcccgcgcctatctcttgttctctaagcacgacgcctgtgctccccgcccagtttaggattagacaagataaaaataggactgcccagcgcgcggagctgtgactgtgccccggcagccgggctggtgggagcgcggggggccggagctggagaggacccgtggtgcgctcggagcggccagtgcctgtgggccccctacccccaccccgcaggcaccgtcacgctccccgggttctgtccgccgtgaaccgtgcgggccgggggacctgggcagggtctccgcgctctcgcgggtgttgttggtgtgccggtgatagatcggtctagacaggcatgcaggctccctcccggctgaaggactggaggggggggaggcgcggagatggcagcagactctgtgagctgcgagtgagcgagctagcctccgggcccagcgagctgggtggagggaaggccgtgggggtttctcttaaccctttaaaggccgtggtggggtagtgtaatagggaaaggggggcaaagagcctagtggaaattcctggaggcagagtagctcgcagtggggaggagctgtgagtctgggcctagggttttcctttctcttatgtgtgcacggtcacatcttggtgcatcgggctcgattcttccacaaaccaaacgcagctgctagatgatctagtttgaccaggtatttctcagtcggggagctgtgaacacacacaatgaacaccctcactttaaaaactgagtttggaagacagacgtagactcaatgttcccaaagagaattcatgcgggtgttcaaggacgggaaggtctgcacatagctgtagtcgggtggggcctctgactatgactgctgcagaccaaggacctgagcctgaaatgccccgccagcatgtacaggtatgcactgaagagagcaaagcggtctttgagttgtctctatataaatagacatacttttaaccaggaacttgtgaggagttagatatgtgcaaggagacagcctccaaagaggagctggacactgatgtgttgtgagatccatcgtttgtgtgtgtatatatatggctaatattaaattggtctaaaattttaatacacctctgcagacatttatctagttctttcttcagcttgaaatgggcggatgggttaccctatacataaataactcattactaacattccagtctcctcctccctcctcttcctttctttaagagtttgtgatcttaagggatcctctgtttacatttaaactgcaaacccatattggtctggcctgggaaagagccacattataggcaaagcaaaaagaatggaagtagtacgaatgctcagattaagatgtgcgcttgaatgacatgtgctgagacaaatcaagacacttgggctccgttgcccaaatggaacaagagatacataagagataaagaactggccaaggggaatgtaaacatgggtatgcaaatacagagatgtatagcgatattctgagagaaaaatcccagactttgttgagctggaaactggggcagaatttctgtaagtgcgttccagagacaatagcccatttaaaggtgtgaagagggtcacttggaaacacaaaaagcattcatatgcatacatccatgcttagatacacaggctgaatgacaaacactcctcaatgcctgacgaagactttcctgccgagtgagtgagaccgacttgggtacagaagagtgggccacacaaccacattcacacacttattcacagggaaataatgtgtctttggcttgaaggaaactgagggccacgctagcagcctaaaggatggatggtgtgcagtgaactaggattatctctggttatagtttctttcccttctaggggtgaggtggagtgggcagcgggttggtgacgagcaggtaggagcctttctgaagagattttgagttcctgaccttgagtggctggatcgtgtagccacaagaggggtagctttccactttgtggtcagtaggaatggctgttgcactgctggggtccaatttgctaaggtggagcagggcctcagtgggctgggaaggagaacaggaagaagtgcggcctctgggaggaataaaagggaggtatgctttctttcttttcttttttttttttcctctggaggagaccgtggcggggacagcctgtgttgggtggattagcaggcgcctcggtgaccccagacgcgcacgtaaactccggctagggtatggcttgcccgcggcgtcgatttgctgcggtccctctttgtctaagcccagccgggaattccagcttttattgggaagaccgcacttgggtggggcccgcgccgggcggagtggggcagggtccggtcgcgctgggcgggaggcttggagcccgcaggacgttccccggagctgcgggcagccctggcaatgccaccccggtggtttcctcgaggacaccgggcccggcggacccggagaggcgcggcggggcggggaacttcctgggtccatctcggccgccccgccccacccttctccctccggcccgaggccgaaaggagctcacaaggccctttgttaggccccgaggtcacactcgtgccccgggggccgccgatgggtgggagaaagcagtgctgcgggtcaagaggagcctccttattgcctcggtgccccagcccatcttctggatcgggcccggtgggggcctcgcccaaagctgggtggggaggcctgggccggccctgacccgccccggcttctttgccagtgtttatggccgacgggattccgtctgtttgcaaaaccggacgcgctgctgaggcctaggtggtagagccaggagaagccgccggggcgggagtaaatggtctccccccagccgccctggtggtagccgagccgcgttcgtcgcgcgcacttggccgggggcgtccactggtctccagccctgcccgacggctttctctggttgccctcaacgtgttcatcaggaagggatatcttactttttgttgggtggagttcattaacgatgcctttctgcgatatttctgtagaaggctcccttttggggcgcaagctcacctccatgtgtttacaatcgagggtctcagaaacgggggtcctcactccgtcattgttttagagctgtgtctcccacagccggcacccacgggctcggctctccatgattagagaagcggggaagtccactcggagaagatcctgacagcataaaaaataatttgtgatctaaaagacagtttccagtataatctcattatgcaccacagactcccgatgttattttgtggaaggcggacaatgatcaatttacattgacccggggctgggcgagcttttagatggtaattgccatattgatttgcatgcaaaaaggagacctgctaaaattaaagaccggaagctaaattaaactaaatttattgtctaggtgcaaaccaggggaactgttgggggatgggattgactcaggtcagggtgccaggggcagagcaggtgagaagccctggagcttcggaaggtcacaacttgggaagcgatctttgcccttgtgatttcatgtggggagggggaatgtgtttaaggaaaaaagttataaaaagacaattttgcattgaagtcactaggatctttcaatgctaataggaacttagagggagaggagaggtttatagggttataggggtcttccagcaccatttccggcgtcccccctccatttctattgttctgcctggccagacgctcgcagtcgtgctagggacaccaaaaacctcttgcatttgaagagttaaaaaataaataaaagcagcccgtcccccccttcccgccttgctctctctcccctcccccttcccggagcattagacttttcggagagagcgcaccgcgggcaggccaggaccgttggcgctgtagggagttcctccccggacgctgcggtcccaggcttggctggacggcgatcgcttcgggaagccgccctctccaggtggccacagtaggcgggggtggggtggggtggagcaaggcgtctgccctggccgccgtctagcggtgcccgggacttggggggaatcgcctccccggaggggttaggagggccagccccgccccgccccgcccctccccgaactgggtgggggccggggaggactggaaaccctgcccgttcgccaaggccggaaagtttaaaaaagagaaagaacgccacttgcagagggctggcctgcagccaggggtggccggcctgcgggggcgtgctcggctggctagcggggtgagcgccccggcgccgccgtctcccctccgtccctcccgccgccgaggcccctgcacactcggtcgcactgcggagccatttcgcacatccggagcttcagcgtctggaggagtaaccagtccagggccgggaagcccgagtgtccggtacccctgcctgtacccatcgagccgagccggaggtggctttggcaggctctgcgggtgtaggtagttcccggaacatctgaaagcctggggcagacccggaaattggggatagggtggggaggggatgttgggccctgaggtttgctgccggccgcttctgtaaagaaacgttggggaaaggacaagatagcctatcccccggcttgcgcttttgtgggggactctgggtggcccaatagaacatcttgctggcgtcttccatcttaattccctctcccacactactttgttccctggggtttttcctttaaatcctaggaaaggtagatggaggagctccctccaaagggcttttgctctatctagataatttgatttattgctttatgtggcgaaactggggtggcaagcctagctcctagtaccagtagtcagcacttttcccagagacctgaaaggagtcgacccaccttacccctgactattctggggtactggaggaagggaaaggggaggcttgttgagagcattggccttacaccagggtataacagtgtagggagatttgtaggatgtagggggaaatggtgaaagactttgagtggaccaggagatgacttagatacaggagaaactgggttcacggctcactgtagaccaagtaacataggtgttaaacactctttgcctcgttcttgggtacataaggcctaaggaagcttttcagaggagacagtatgtgaaaatcaggatttcaaatggcacaattagaccaataattggctcctctccgcaactccaggactgagtttgaccgtggcccattttttactagctgtgtgaccttgggggcaagttatttatggcctttgagccccagtaagttttttcatttgtaagactgggaataattatccacctttaggatctaaatagaatgcttggcacatagtaggccccaaggatgaataattgctttgaatgacttgtcatgttcctataggttgctcctccattccctgctgcccctgagaccccctgagacttgctaggcctgtgtcctgggacccaaggatgcagattaaatctcccctacgagggtattctaggtccaccttcctgggttcccctttccctttgttaccgtagtttgcattctgccttttaaaggattccatatgaaaagacttgcttctcccctccacccccaagtgggatcattatatggttaggaactcatttcagaaccgtcatctaggtacccttcggcaaggcttcctggcattatttcaggggggaaccacggtgcctagaggggcaagacctggttggaagaggtgagagggggtggcctggtgcagaggccagaggtgctgtggtttgtttgatagggattaagtccggatgttatgagggctcaatgtggttttcaataaagtctgccagggattgcttcttttatatcaatatgtatttaaaaaaattactagcatgagaagaaaaccagacctgtatggatccaggctggtagtaagctactgtgatcaggtttcctactcgactcccagaggggaagtcagtgtttgattgaagctacacttggttcttgactctcaggggatgcctgctctgaaacaggagccctccctccctttctctcctcctctccccctcctcctccctctttttcccttcttcccctaaaagcctttgtgctgaaagagcttcagtaggcacgaatccctggtccctctctaaagaatgccttacagcctttgctgacattgttttgtgaacagtgggttttaccaggccagcagtttccccccgattttagcgcacgattttaaaggtagtgtatggacaagatgcgccttactgcagtgattgcctcagtgtgtagcctgggctggggcttggaatctagagacgccttaacctttgccctaggggccctcctggagtggggggtgaaggtggggagctcgaggactgattgttttcgaggatctgtttgttttgtccagccaccgaggctgaaggtggagttgggcaagtctgagtgtatgttccagctttgggtctgattttaaacttggtttaattggagaaactcctaggcatttaacagttctgtacaaatgcaaacttgaaatagctcgaggcctacgtcatttaggaaagaataaatgaagtacagaaatgtccaaactatgtaaatcctagcgttgtctgccctcccataaacacatgacaagtgccaaggcatttccagtcaaaacacccatggaagcagcagcctccatcctttgtatttattattttattaacagcattttacacagcatttaacaagcacagcgtgcctgctttgcaccaggactctaagcaggcgaaagggtggaaaatggatggaggtgggggaggagtggttgctagaggacatcaactagagaaatctcatcagatgggtagggaaagcagcaccgggggtttatttctactggccacaaggaagacagacatagtgctttggaggaagaaatcctctctcccatcccaggaggaaagttgtacagctgtgatatgtctggtctcagctttgattccagagggtaaaacagggtatgtttcatgatactctgcccatcggttattggtgattttcaaagaataagtatttgtctgctatcgttattctatatcctggtggaaagtttataacgaaaagtaatgcctttcttaagtcataaaatgagccttgtatgcttatttaattaaaatctatttaaggaccgattaggcgtgtaatttgcactaataatgacgattatggaaatgttcaacttaaccaaaaatcataaaggagacattttgatcagtggggcggccagtaagtatttagtgagttgggcaatttccgaaagacaggaggcattccgctgagggctgcagaaagcacagacctgtctggcctctgtgacatggcatggagaggggcagacctccctgtcccggccccggccccagcccggccagaccccactttgctgagcatggaaaccaaccctgcgagtctccacaacctttattctcgtgatgcttcctcgagcttccagaaggagtaaactctcggagagggctgatgagccacacggaaatctctgcgaaatggcggtgctcttttgctttaacaaacagcgctgacaaacgcatgcttccttggctagccttggctggatcccggaggggtagggggagaaggggtcccttgttccggagaaacctgccagctgctgggcttggtgtgaaggcagcaaaggcagacacaatgctgctgttgttggtttgatctctaactgtggattgttagtctggctttaactatgtggtaaggggggaatgtgaaggctgtttacagcgagtgcaaataatgtgacagctgttggcgcgcgagcagcgctgcgcctcctcagcacttacacaaagcgcgcactatgcaggcccatggacgagctgcagaggtggcggccagtttctggccagcgcatccccagatgagagaaagctccacggcacacccgccctccatccccaacacacatctttatgacttcccaggattggggtggggtgcaggatggtttgtatgttgtggtttagggaacttgtggtgaggcagaggtggcgggagaaggcccacggggccgtgagtgtcaccgtgttggtggggtttggccaggatccgttgaactgggtcctcagctgtttatggctgagtttttaagatttgtgaaaataactttcagccctaagtaagcttgttggaaagaatgtgttattaactgaaagctttctggaaattgcagaggctctgaaggccgttgttcccctctgaaatggccctgttattcagacaagttagagacaggcgggtgctgtgttctgtgcactcgacactgtttccagcttggaaatgcaagtgtgcaggttcagtaccctaaggggggtgtattttggggggaagggaggacagattggcttttgattacccacatcccttaaccttttcttccaagccttcccgttttcaagagcacatttgccttcaactgcagcacgcaaaggtgccgtcctgaagcctgcccacagcaccacctactctgacttcatcaactagatgcccacagcaacaggctttctttgagttcctggtaccccgccaggccctgcagagaggcgccagggtgggagggagagcagttggtggtggcagttacccactaggccagtcctggaggttcatggctggcccaagcaggtggacttaggatggccaagaatgtggacctgcctctggaccgtcctggggcaagctgggtgtaaaaattcactcctctcccccatgagtcccaaggttgaagccttccaagccctggcacctgcctggtcctccttgggttttggaagatcatttagggctgactttggtctctgggtgtacagcctacaggatatctgcaaatctacttcattctctcctgtcccccccaccctcagcacctcccctccctaagtctactctctaagttttaacatggacttctacatctagttgggtttccgatggggagctgggagatgcttctggagtgagacatgaacttcggtgccagttctataaattggtctctttttatgacgtgtgccattttctgtaggaatgttgcttgcaaaacgagtttcgccttggaggaaaggcggaaagataaacaagcctgcaacgccaaaacactggcagtctttccctccttccagctctcttaaagcagccgggctgtatttccaggattagacttgtgcatgtgaggagggactcgcgttggctttttttcccccaagcaaatgcaaattagagaaaaataattttctttcaacgatatgcaatgtattagtcacttgttatcgtgctccgaggcaggcctcatttgcgcgtctgccagctcgctcacatctgctcagcgctgttcggggcattttaaccttggcggtgtcgtgtctagtcccatggatcaaggaggagtaattaagccctgaacagctacaaaaattcgtgggcccccatctataccatagttgttccatggctttgttttgggtgctctgagttccatgactgagtagcagacatgggattcctattgttccttgtaaagaaggtgggtgcccctctccttctctgaccctcatcccagcctttctgggactcccaggctctgcacaatcagtgagagactcgcttgcagattgcaggacccctgcattttacacatcttttatgcattaaaagttcctttgtgcttcctgtgtatactaatgatagctgttgttattagccttacggtatagcttgttcccttcggtggtggtggtggtgggggggggtggcggcgacggcgtttgtgttttactcctacaaagccctggtggaaacaaaagtgcattgacacagcctttggaggcatggtgtggaacatttattctggatttgcccccaggttgtgtagattcccaagtggggacccagttctgcagggactagatcaaagggggcaagtggtttctttttgcgtggagggaagatagtaaggagggattcctggcttttgacttgggtttctgttgccgggtggcctcctgtgaagggacacctgtttctaaatttgccctctcttgaatacacacgtggtttcctgactccccgtgtggcaaaaccatgaaggaaagtgaaaagaacaaaaagccggtggggtggcctggacagattatccggggagacgggcaagtgtcccccgttggcctgtgagagagaggttgggggcacctgaccccgggccatgggctctgcctggaggaggggagtgtagcggacaatccaggttcggcagcgaccctcagggtcaacccctgcagattccaccccggaccccaacgcccgagattcgcacccctcccacgttacagtaggcgacgcttggctcacatctttgtaaggggaagcgtccagaggagcagcgctctagtatgatcggaagggaacccagaacgatggcgaggaggggtctgccgtgcccattccccgggtgggctcggcggcgtttcccgggaggtctcggattctccctgcgcccacccaaagtttcttttcgtcagattcgttgatggggagagaaggtgcggcggggcctcgggaaggggcaccatggagagcgtgccaggccgcagggtccgaggggttacctagggtcgggaactgggaaggtcgggccgcctccggggaggctgctggagttcctggaaggcctggcgggggcgcgccgcgagggcgtgagtgtgtgccgtggtgcggccccgcgcgctgggacctccgccgaggagcggggaggaggagcgggcgagccccgagcagcacgggtgtgtgtggtgggagagaaaatccctttgttgccgaccgatcgcgctccgggctgaagcgcctcagcccggggagggggcgcccctccccctttcttcttcgccggggccaagttcactcccagcccaggtggctctccgctcagaccccgacgccccgggaggaggccgggaaggttctgggtgctggaatggtctgggccggcgagtttccccttccccctcccccttactaatgcaaaacttggaggtgtgggcggggacgcccgtgctggctacggctaaggctgtggcttggagtgtgccaagaggcagcacctgggccggctggatcacttccctcacccccaactctctcgggggagggggtcgggaggggtgggaccgggccagccacctccctcgaccacacccctggaagcctgcggttttgcctcccagggacctggggggcagccttggggtatcttactctccagcagacccggaggacccatcccacactgcacatccggaagagctttttcttctcatctcccactcccacacaccccacccccacccctcacatcctaaaataggaacttcttcacccctcccttccttgacacccggagcacagcgctgctgctgtgacgcagtctctgtttggagcaaccccaggaagggctggcgggtggtgagctttgggcttctgtaaaatctacacagttctgctgaagttccctccctgctctgatcccctctctgttgctgcctcagcctcccccgcaggatgaggtggtagtgccccaaagaaactgtgttgtgattctggggcttattacacagtgtgtttattggagtcgggtactatttagcggggttaaacgtggccagcgccagctattgccaggcaaaactcaagtccatagtgcagcttaatcctttggaaaacacagtgccaaatatttacagaggggaccaaggttggagaggttcagccacctgcccagagacacgcggtgagtgagggtgggagccgggaggctgtggtgaccatgttctccacagagaaccagccatgcagtagcgagacccctcccctgaagagtcctctgccagaggaccccagcacactggctgggaatgcctgcctggccacctgagctggaagcccttgcgaacctctccagttcttctggctgttaactgctggatagctgccggtgggggcaaggggaacctagtgagagagatcccaagaaaagaccccgagatgggccaccctcaatgcctgtgtggacagcagggaggcgtgagcagagttagtttggtggccatgctttccaaattgtcagtgccacttgacaagtgtaatgtgcagacttttaactgatcggcgcctcaagggtgggggcagtggaaagtggccctagtgcaagagggggccagggttgggggtggggaaggaaaggggccaaggcttgggacctgtggtctgccctcacatcttttcacagagggtgggtgtgtccctactcagggatgccaaggttggagtgatggcttatgatcttggtccctcgacgccccccttctgccaatcaggccttctcccccgtgtccgggccaagctcaggtgctctcatcataacccttggctgaagagcgaatgactactcagagtctgtccagggtgacccaagctctcctatgtgttccacttccttggtgctaagagctggagaccatgcagtatgcagtgtgcacgcctgcttctcacaagccaggtctctccacttggccctgggtgttcctgcaggcagctggaacagttcccagtctgttctttagagacccacaccctccccatctgacctcttctcagctgtctttcctctccatccctatccagcacctttacccacttctctccactactagaaaaaggggttaaaccccagatccaaggtgcagcttcgcagctcacagtggaacaggttggtgcttgtaaagtgcttttcatgagtgacttcacacatcttggcacttctggaagcatagcctgcatttggaagaagtggggggtggaggtgggcattgaaaaataaaagcaaacgagcttcatctatagctgcaaagcaccctgaggctctgtttgtcattgaaatcaggtcatttgccctctccacagtgttccgctgccaagggtcagcaacatcagtttcgaagcacttggccttagaggtaaaaaagtccccagctatttcaacagcagcttctagaagtttgatgtccctatactttgcctcccagtctctttttgtttcttaccccagtgtccccttcgttgtacatgacagagaaaccagggtgggctgtaggtaatggtgacccctgttcttcagtagaggcttggtgtgagccgtatggcctttgcaaaggaggtccctgcttttgtaggtttggactgctctttgtcacccaggaggagggcctcctgtgagccagggccattgctcattggccctttccactcctctccatctttggccaggaacccgaagagttaaaagtctttagcttgttgcaatgaaattatggctggcagtggcgccgctgtttgttcaacagacctccacttttaaacagttcacaaaaagttcatggggcagctaaagattataagtgtgtgtgtgtgtgcgcgtgtgtgtgtgcgcgtgtgcgtgcgtgcacgtgtgtgcgtaagtccacagcaggatccaacaatgtgttccccccttttgcttttatgttcagccccatcctccaccccttccctcccaaaacacacacacacacacacacacacacacacacacacacacacacacacacgacagtgaaccgctctgctagcctcaaccctccatctgaccctgtgcatttgagaacactttgttctggtggctggtatcatttatctgtgcgccattaatatggaaagccccaaaggaggagccctggagaaggggagatgctttgaaagcacccagtaggcccaggtgcctgtaaaccgcagtcacctttctgctaagtccaggtggactttgctgaagaaaggctctttgaagggaagcagctgctggccttttcggggctgggcctcagtataatgattctgtttcccaagaaggtgccgggaggtcctttgcacaaggtgtctacttaagggaggtgggtaagaggcaggttttttgtttgtttgtttgttttttgagttttgctcttgttgcccaggctggagtgcaatggtgcgatctcggctcaccgcaacctccacctcccaggttccagcgattctcctgcctcagcctcccgagtagctgggattgcaggcacgcaccaccacgcccagctaattttgtatttttagtagagacggggtttctccttgttggtcaggctggtctcaaactcccgacttcaggtgatccacccacctcggcctcccaaagttctgggattacaggcgtgagccatcatgcccggccagaggcagcttttttaaaggggaggccaatttttaagaatggggacaccagaagattgaggttcattaggcacacgcttcttccctcatccttttcttgggggtttggttgagtgaccctttggctcatgatgtaatttctgtatttcatcatggcacagtgagggggtggcatggtgcagtcccactgctgcagcccgatgaccgggacacactggcaccggggaatgatgttccaccttctctattatcctacccagaatgtcttccttttgttagaaagggcagcaggggccggagaggggacactgccactgcacaagggaatgtgccttgtggtctgcccagccctagtggtggccttccccacttgatttgtgtatttgcaagatggaagaaaagcccacgaacccttatagaaccttccccaacagccgagtcggtcctttgggggcgctgtggctagtcaactggaagagccgctgtctggagacacttcctagggaaatagctttccagaaccccatcatgcctgatgcctctgcagatttctgcctttttcttgggccctttacctctcttccagcctcattgttgagctctaactgtacgtggtgtgtcgctgcatgtggattttggttaacagacgttgttctatggggatgggggcccatgggggatgctggtggacaaaagacctagttaggacaaagaaatgagaaagtacagaccggctttgggattccatcccccaggtgtccccttaactcccaccctcagtcactctcacagaagagtccccggacctggtgcctccaacccaaccgacctggcagtctgctccgtgtgctaaagtgtaaaagcaagcatttgcatattttttcctgctaacaaaggaaatgtgtcgacttagggaacatttgggctttcggaaactgtgtgggtgggtgtgtgagggaggagaaaaaagttcccctgatgatctgcacaccaattatttcacacccaggtttgggtcccgtggaaaaatgccatggccggtctggacaagggacactgagatgtgtttgtgagcagggaattgccgagggccatcggtcccaggcattaaaggctcccctacttattaacccagcatttaacagcaggatatgggctgaagcgcagtcaaaagaaacggctcaacctccaaagagcaattaaaatcctgcacgaggataaatcacgcgccgtgataatcctgttaataaaatgcagcttgtcctgacccttcactcatgcagcaaactagaatgtgatgtgggtgggggcggtgggcagaggaggtaaaggggggtgggtggtggtctgagctcctctgccttggcaacctcccgctcccggaacgtggaaaatgggtggcttctgccggctccccatgtgccagcggcttggagcccatcagccagggctgctaagacttctgtgctcgctaatgatttctcgtccccagtgagcaggcgtcattgaattactcagccgcctctctctgcagcttccaggcaaaaccacccgggttagctgcttaatctaatccagggctctggtggggcggctcaccagcccaccgactctttttcacacttgatctgtaagttgcacacacgacagccttggaaattcagccctagaaacgcaggtagtttgagagctggacctgccgctcacctcactgtggtgccttccacccttcttgcacccttttggccccaggaaagatcagttgtgtgcctcccagtgatgcagcatccctgaacctattgtcagagcctccccttgttgaatcaagtcttctttaccttctttaacaagtggcaagaatgaatgaccactgtacactttcagaggaaagggagtgggcgggtgctgtggtgtgccctgaatgtgttctgtgccttggatgaggctacctgtttcgaattaaacttcttccccagccccagcacctcctaccagggaagctgcatgcccctccgctgtcccttcgagtcaggtgtctgtccttggctcccagaccactgtagacagcaggcacagcctgccttccccatctgcatcctttatgaatcacctagaaagaggccttctctagcgccctgtttggctctcctttactgaacctcctgggattttttttctttccttttaacagactagacgcttgaagcaaagctgccatcccagaagacgacatgctctcagcaacccccctgtatgggaacgttcacagctggatgaacagcgagagggtccgcatgtgtggggcgagcgaagacaggtgaatgcgcccatctgggccgggcctgagtggagcccacgcccatgctgaagcccccctcaacttctcacagccaccgtgggcccaaaaggggtgggagagaaagagcttcccgcctagtaggccgctcttgatttacagttttaacaggcaacctggctcagtgaagcattgccgccctttaaaagattagcccctaaagcggcctttcagtgcactttcgtccttaatttattatttcatatttatgaaggagaattaatcccagtctatatactgctttaactctaaatgtcaggagtgtgggcccaggtggagcagcattctatgtgcttttaaaacaaatagtttgctcagtaataaatggggagagagccaccgttttccttcattgaagcccaggatctctcattgtcctctgctgcctgttcccagaggccactggcgcctgcttttggtcgtcagacagctctgttatgcttcctaatcagtaattttggagttgtggggtggaggcagctaagcagtagatgattgaagctgctcttcggggtaatgaggaaacttttcctctgccgcttgtcagcgatttttatcctggggatttggaagttggcaccaagcactttctttatcgatgctctctgataacaagtcccagggcagccgcagcagcctggcacagatgtgcagcttccttttcagcctggaacagctgacatttgtatgatactagtgtgtatccccctgtcattttgacaaaggcagtcaaatatggcttttttatcaccatggaaaccagtttcgtaggacatggtccctaactttgttttggaaaaagttttgaaagcctaccctcctgggtaacacggaagtggttgatgacacgaccagccttccagccccctttggtatttggctgtgttaccacttcatgtctaccctccaggagagtttataagggttggctgggacagccgagctccgattggcctacttggcctctagagaaaaaaatctcgagggagaagtagttgtgcttaatttctggcttacctaccttggggacatcatatttgtgattcatgtcctcacacatgaaagctttgcgtttcctttgtttttcctggtcaagttgaatcaccatttgggggcgactttcaatatgggccattgacagctggtgggggcggagggttaaggacagttttaaaaattgggttagtagaaactggtctgttctggggagatctgtgaaagatggattcagtgaggaatgctttcatgaagttggtgtatctttttaaataggaaaatccttgtaaatgatggtgacgcttcaaaagccagactggaactgagggaagagaatcccttgaaccacaacgtggtaagagattaatagcttctgttgatgccatatctgcatatcagtgatctgtaatcaatcgtattaatttgcatgcccttaaagggtggggaatgggggaggggtggcagttcagagcagggctgagttggaggcctctgcgagaggacaaggcccccacccaagctcttccagtcttgccttcctgcctcgccacacatgtccctgtcccctagtgactggtgggatgtgtactctcttttcttccataagctggatgccacatcagcgctcccagctggataaatttccagcctccaagtagccccttagggtttacctttccagtaaaatacgaaacacaggactgtcacttcagacacaagggagaggaagtcaaaagacacaaccacagtttgacccatggcctctatattgatatagaaatgaggctgctaaagtcctctgttcctgttgtcccatcgaagatcgtttcttgttctgttaagtcatgccttcctgcacccaggggaaatgaagcgaacacccacccccaagcctgacaggcccagggagggttagtgtgaattctgtaccccatgagggtgatgctgagagttttggagttggtgtcctagttgtagcaaagaatttttgctgagaaggtaaaaatcttcagacttttttatttttattttttaattttaatttttttagagacagagtctcgctgtgtcgcccggcctggagtgcagtggcgcagtcttggctcaccgcaacctccacctcccgggttcaagcaattctcttgcctcagtctcccgagtagctgggactacaggtgcacaccgccacacctggctaatttttttgtattttagtagagatggggtttcaccatgttgcccaggctggtcttgaactcctgagctcaggcaatctgcccgccttggcctcccaaagtggtaggattacaggcgtgagccaccgcgcctggccaaaatcttcagacttaatagatgactgaattaatatatgggcctcaagtccaaagggaccaatgttttccctgcttccaggatactagttgagaggtgagaaggcaggcagcaaaggggtttggataagggggtggggaaacagaccccccacccccgccccgccggaagcctgtctttaaccctttgtgcttggatgttaaggctgatggcatgttgaactagttggcagtgtctttgggtgctgctgccttgaaggagtatcccagtaacacccatgttgttcttctgcaaaggtggatgcgagcacggcccataggatcgatggcctggcagcactgagcatggaccgcactggcctgatccgggaagggctgcgggtcccgggaaacatcgtctattctagcttgtgtggactgggctcagagaaaggtcgggaggctgccacaagcactctaggtggccttgggttttcttcggaaagaaatccagagatgcagttcaaaccgaatacacccgagacagtggaggcttctgccgtctctggaaaacccccaaatggcttcagtgctatatacaaaacaccgcctggaatacaaaaaagtgctgtagccacagcagaagcgctgggcttggacaggcctgccagcgacaaacagagccctctcaacatcaatggtgctagttatctgcggctgccctgggtcaatccttacatggagggtgccacgccagccatctaccctttcctcgactcgccaaataagtattcactgaacatgtacaaggccttgctacctcagcagtcctacagcttggcccagccgctgtattctccagtctgcaccaatggggagcgctttctctacctgccgccacctcactacgtcggtccccacatcccatcgtccttggcatcacccatgaggctctcgacaccttcggcctccccagccatcccgcctctcgtccattgcgcagacaaaagcctcccgtggaagatgggcgtcagccctgggaatcctgttgattcccacgcctatcctcacatccagaacagtaagcagcccagggttccctctgccaaggcggtcaccagtggcctgccgggggacacagctctcctgttgcccccctcgcctcggccgtcaccccgagtccaccttcccacccagcctgctgcagacacctactcggagttccacaagcactatgccaggatctccacctctccttcagttgccctgtcaaagccatacatgacagttagcagcgagttccccgcggccaggctctccaatggcaagtatcccaaggctccggaagggggcgaaggtgcccagccagtgcccgggcatgcccggaagacagcggttcaagacagaaaagatggcagctcacctcctctgttggagaagcagaccgttaccaaagacgtcacagataagccactagacttgtcttctaaagtggtggatgtagatgcttccaaagctgaccacatgaaaaagatggctcccacggtcctggttcacagcagggctggaagtggcttagtgctctccggaagtgagattccgaaagaaacactatctcctccaggaaatggttgtgctatctatagatctgaaatcatcagcactgctccctcatcctgggtggtgcccgggccaagtcctaacgaagagaacaatggcaaaagcatgtcgctgaaaaacaaggcattggactgggcgataccacagcagcggagttcatcatgcccgcgcatgggcggcaccgatgctgtcatcactaacgtttcagggtcagtgtcgagtgcaggccgcccagcctccgcatcacccgcccccaatgccaatgcagatggcaccaaaaccagcaggagctctgtagaaaccacaccatccgttattcagcacgtgggccagcccccggccactcctgccaagcacagtagcagcaccagcagcaagggcgccaaagccagcaacccagaaccgagtttcaaagcaaacgagaacggccttccaccaagctctatatttctgtctccaaatgaggcattcaggtccccaccaattccctaccccaggagttacctcccttacccagcccctgagggcattgctgtaagtcccctctccttacatggcaaaggacctgtctaccctcacccagttttgttacccaatggcagtctgtttcctgggcaccttgccccaaagcctgggctgccctatgggcttcccaccggccgtccagagtttgtgacctaccaagatgccctggggttgggcatggtgcatcccatgttgataccacacacgcccatagagattactaaagaggagaaaccagagaggagatcccggtcccatgagagagcccgttacgaggacccaaccctccggaatcggttttccgagattttggaaactagcagcaccaagttacatccagatgtccccaccgacaagaacctaaagccgaaccccaactggaatcaagggaagactgttgtcaaaagcgacaagcttgtctacgtagaccttctccgagaagaaccagatgctaaaactgacacaaacgtgtccaaacccagctttgcagcagagagtgttggccagagcgctgagccccccaagccctcagttgagccggccctgcagcagcaccgtgatttcatcgccctgagagaggagttggggcgcatcagtgacttccacgaaacttatactttcaaacagccagtcttcaccgtaagcaaggacagtgttctggcaggtaccaacaaagagaacctagggttgccagtctcgactccattcctggagccacctctggggagcgatggccctgctgtaacttttggtaaaacccaagaggatcccaaaccattttgtgtgggcagtgccccaccaagtgtggatgtgacccccacctataccaaagatggagctgatgaggctgaatcaaatgatggcaaagttctgaaaccgaagccatctaagctggcaaagagaatcgccaactcagcgggttacgtgggtgaccgattcaaatgtgtcactaccgaactgtatgcagattccagtcagctcagccgggagcaacgggcattgcaggtgagcccccccacctgaatttcagttactttaccagttgtcagttttttaatgtgtaaacaggattgggggagtatggtagggcagggcaccaggcagatttggtgaatgaagcttgtggtaatttgaatatatgcaatgtggccagtaagagaacgtgagtggtagcactgaggcgtgtctggatgctttaagttattctgtagattataagggaactccactcaattgctgataaccgatgttttaattattgtgaagggtatctaaagactgcatgacgtttacctatcaattgctttgatttctctgcctgtaagatagcaaatatacctagaagtgctgcttagaatgccttacttgatacctggtagagatgtgtagcagccgcatgtctgtgggattcatgcaaatttttcaccaaaaagaaaggaaaaaaaaaagaaaaaaggttgcttaaagggatagagtatgtatttaacttgctagtgaattatgatagatgttgtataggaatttccttaagatattttacttttaattaaaagatgaataaagccaaattgttttgcaatgttaagaaaaaaattggtttatgcttataaaaatggatgaagttatctaaatgatccattgagtgcccattttaattacatagatggaaggattacaagaggacagtattttatgtctacccgctgcttactgtgaggtcagttcttcaaatttttattactagaatcttacataaaccttttgagttaaatttcatttccaaatatacaaagggaagtttgtgggccatggtcgtctttattcattgtgtattttgtttcttttctgttgtgtttttgttttgttttctttgcgttgtgttttcgttttgttttatttaccttcaaaagagaatgtctgtctgtatgcaatagtgtatgtgtggatatacatacacatcgcatatatatctatatacacatgactttatgaataaagaatgtgtgactacttatatatagatactcttaagttttatctgttaaactttaaaatatctgagttacatctcataagctgtggttggttttgggcacttttctttgaaaatactttcctttaagataaggcaaatgaaatagcttttatggtaaggtgttgtttttttttttttccatctccgttctctttctagcgtgcaatgatgcgcttctcagagttggagatgaaagaaagagaaggtggccacccagcaaccaaagactccgagatgtgcaaattcagcccagccgactgggaaaggttgaaaggaaatcaggacaaaaagccaaagtcggtcaccctggaggaggccattgcagaacagaacgaaagtgagagatgtaagtaaacctgagcagtttgcttgtgttggcctcaggtccggttggcatctgcttggagaaatgggctgcttttgccatgcatggaatgaagggccgattgtccttatgaatggtggcaaccaggaacgaggcgtctgtgaaagatagtttcctgggacacatctttttttccaaagaagcactggttctagagttgataacagtctaatataacgcagtgtagcagaggtatggcagtaggaaattaggtgcagggacaggttatattttgtagcagtggaatgacacttcccagccatctcctgccccacccctgtggtgacagtctgatgtggaatgaagagtccttatattctccctccaaaggcatagatgttgttgaagtaggatgaacatggtgaagtcaccataaagatgagcgttacgatttaccgtggggggtgggggagaattggccacagaatcccaaggcagcctggcatgcatgagggggctcttcccaccggacagagggcagcttgcattttggagggcaagtgatgtgaagagaaggctagtatcttcctcagtacactccctttggtccttacagcaggtcccccaccccaccaacagggttgactttgggatttgctcacgagtcttctagggtgctaagatgtgttggcagcaagtggaggtcttcctctttatttcttaaatatgcaagcttgaagctttaggtctgcttgcaacatgagaaacctcactgggcgaaggggaattagggtgtctgggtgaactaactggaggagtaggtgcaaagtcctcctgacacaggacacttggaagtgttgggtatgtttgagagctccccaccatgggccgtcggaggtttgacattcacaacacagttcatcggtgcctgacagagtttgggaagaatgtgtgatcagggagagtgtgcttcttgatactcggagcgcacacccctccctccacttccagctcatccctgggagcagactaaggccacctgccaggatcctgggtaagctaaaccaggactgatttgttgtaagtcattgctgaagaaagtagtttctgctgctaataggtggtggccttactcaagtggcagggactcaatgtacctgaagttgctcactcttcctcaaagagtggctacagggcagtgggaggtccaagccactcttgggtgaagtggcaaagaaagccttcctcctccctgatgattgctgccaactcgcagcccccactctgagttgcctcaacaccagctcttgggaaggttgtcagagggacctgggagaagtgggcaaggccgagttgatggggaaggtgcttctaaaagagggagtgccatacataagaatccctctttgttctgagtagatggctgggggcctggaggaagggacaggaacttagccagcttccagccttcttgcccttgctgtggtttttgagtaacatggccagaccctccgttcacatctgagtaactcggtgtggccaatggggagcagggcccaagccccacatgatgtagaaaggcctccctttccctttctgtaagtccctccaagcttcataccaacaggctgtgttcttggagcacccaggacagggccctgcaagccataagtcaccacgtagtgctcctcaggtaatgagccatggcagggagagcagaagaagagttgggggaaggtgaaggctgctttttaaatactagggccaaggaagagctggggcaccataggtttgtggttgatcaagaggaggaacctagaggaaatgttgtccttgctgctgccactgccatctcatccagggtacagcatgcgctggatccgtttggcttcaaattcactgagctatctcggccatcacgtctcttcatgggtgtcactgtggcccagagccaagctgtgagcatatggaaactggggtggggatttggggcaggcaggggtcacaaagagggtacaggatgcctccccgaagcctctcccctccactcctacagcaccagtagcttctgagatggcaggtgccgcctgtgcggcctcagctgcctgcgtgtgggtgcatcttgttgggagggcttgtttaaaaaaactgaattaactggacaacaccgtggttaggattttcattgactcttagtgatagtatgggttgctgagtttttcatttagaaattgaacaaatgagttaggagtgtccccaaactcctaaggaatgataagtggcattttgaagatggggtagggaacacggaggtgttgggcccttcctttttgtttttagttttattatttttattgattgatttacttttgttgatacatattagatgtgcatattagcccttccttcttgaatttgggtgtctgtctcccttggtagccacttggcttgtgtggacctaggactcactcagtggcaatgcctgagcgggagctggagaaagcgttgagtgaaagtgaaagggtttcatgggacttcttggctcaggaaacttctcttccaggacagcagcccctatgtactttgtaaactactttgagtttgggcagacagatgactaccaatgcctctgctgctggagagggtagaagttataacatggttggcctctgctagaggtgatgttgcctgcagagggagtagatgtcatgggcagtcctcaaaaatctcagtcctctgccatcctgtttagggcttactgggcgtggttataacagtggtgaggttgctttgttgccacggtgacttgtaaatgttgccatggcgatgcttccaggaggtattgcaatggcatagccatggtaaattatgggatgtatgtgctgtgccttataggaccatgatgcaaggagaaagtggtagacggtgtaggactcagccatgttcacatctgcctagatctcatgaccaaaggcacatggcattccactcacagaagggctgtaagtagttgcaatggaagaggaccctgatggttaggacccctatctatcccttcatctctgtctatgcacccatctcctttgccctcaagagtaatttctgtgggtactggtaagaatagccccatttgagggaggtccaagtgaagtgtacaggaaagtgacctggagcctctccctcatagctgtttgccatacgtatcttcggcagtcaaggtgggtgttctttgggattattactggcccatggagggaaaccctagcataaggtttgggggccttcactgaggggaattgggatgtttgccttgagaggctcaggggttgaaggaaggacaataggcctcatttgcggaaagatctcgtttgcggaaagatcttcttgagagcggacaagaagcatctacactgcgtgtgggcaggcatgattgcagtgaaccccagatgcagcagtggagggctcccgataatagttctggactattcaggaggcagaagggggccctgtccggctgaacggggaatggtggggacttggaggaggcatgtgtgtttcgcaccccttatcctagcctgctggcttccccatgaatggggagcagaaggtggtgtgtgcaggggagccctccccacccccactgggcagcttttcctagatggggagccccagagaagacagatggcaagacctccccatatctaatgggggtgctccctagcagagagactaggtccccagttagtcactgcctgttgatgccagtctgtgaaataagtgattacaagtcttctaggtggttttctgtggacaaaatatactggcagtttgggcataaggccaggtaggtgagatataaactcatttcactattaggaagtttgcagtgaaggtcaaaactccaatggaaaactttctccctgagaaagatgccttagacttggttgagattgttacaaatacaggtggctgtgtgagacctggagttcaaatggaagctgtggaagtcaaatccaaagcactagggttgagagattcttaatctgatggggatttgatgggggggggggggtgtctctgggaagggtgccaagacagggcagttcgttctgggtggggccccacactggctaagctgctgcctcattttgacccaggaaggcattgtgacattacctagtcacctctgctttcaaaccacttggctcaaaccctctctcctacctaaagggaggggaaatgagtacactttaaaagtataaaagtaaccttgcatgtggcgcttcgtaacacagtctttacatttttacattgcacccccagcccctcccacagggctttcaggggcggctgattggctccagaaagtcaaatagtatataactaggacaatcagttcacatcttaaactttcataaatatcagggctaaaaatcaagctggtctggggatcatagcgtccttttgtaagtaatttctccagccttaccctctgccctgctgcaccgtgtttatgaagcccaccgggggaggtggcttgcagtaatagtcccactttacaactcaagggggccaaactgtaaagtggcgctgttactgccagagtggttaagacacagagcaactcgagtcgcagcccaccctctttgcgtccccaggccaagctgagcacagtggtcaccacttctgcatagtgtaagttttgggcagcttgtgtgttttctcctgttgctgctgtgacataacaccaccttggccatgtttttggacgcccatccgttgctggttgtacctacagagacctggggtggtattccatggtgggggcttgggtgccgaatcccagtcccagccatccctgtccatacagtgcactgtcgtgagtgaggatgaggaggaacggttggggagattctaccattcctttgcaagaatagatgcagccccatctgttcccccttagaacacccttgaagagaaggtgaatgggtccttgcaccattgagagcacaggctagccaacacccctgtaaagctcacccccacagctgactgccgtgaaccgctggcaatgcccccgagagaagcgggtgagcggtgctggtcaggagtgggagtaatatttgaagtgggttggggagaggaagaatgagatcagcggatgaggcgtgtgcttatttcatctagaaattgacttgtgtgcctcagctcagagttaccaagacaccagactcataaccctggtgatgagagggatcatttcagcgggccaagggctgacaccttaacctcgcagtggtcattaagtagttatcatttatattcattgtgtattagaaaaattgtgaccagcaaagcagttaatgagctatttcttgggctagagcaaaaataggaagtgatgttgggctgaggtgattcaaggaaaagccccaaggcccgtgataggccgagcacagggttcctggaacgagcggttttgcaagcgctggcctggcatgggaaggacacaccaacaatgaggagatgtctgtcgatgcttgcctgtgacagagggtgtgaagaggagtgtcagctggggtggccagcatccccaagggggtccctttgtgttggacaggaaatgggaacagcccaacccattggtttcacatctgtgcatccagcaaatcgagttttttgaagttttctctgaactcgtgtatgtgttaggaaaccttgcctttggctttgccacgcccctcttcccagcagcctgggtctgcctgggttccctgcctccctctggcctggactgtaggcccagagccccccaggagtgagggtcacttctgcccatcaaggacctaggctttctttcaacactcttgtctccagtccattttcatctccccggttggcctaggtgaatattggtgttatcccttcgatagatgacattttggggatatttggtcactttatcctatcagcctgccatttatttcaaaataatgacctcagcaaatgtttccataaagatttttaggtcagccccagcttggttgcatcttctgctgaaaggactatagtgctttaaaaaacgtagcattgacgccccatctttcttggttccctcttgcccccaaccataagaagggagaaggagaaagtcaggagtgtgacatgcacctcactctgctttacttgccactcgtcttcaatgtaccctccctctggaaagttctgtttctgagggttttgtgctaaccatgtgtgaggaccccagtctccaaagaagcagctgtcaatagcagattaccttgggcatggtggtcccacgcactccccagatcctgccttctcatggcgaccttcgggcttcattaatgccctcttgtctcccctcccccaggcgagtatagtgttggaaacaagcaccgtgatccctttgaagccccagaggacaaagatcttcctgtggagaagtactttgtggagaggcagcctgtgagcgagcctcccgcagaccaggtggcctcggacatgcctcacagccccaccctccgggtggacaggaaacgcaaagtctcaggtgacagcagccacactgagaccactgcggaggaggtgccagaggaccctctgctgaaagccaaacgccgacgagtctctaaaggtgagccctgtctgcttcgcccgcctgccggggggtgggcctttgcatgcggccacagtggatggacaggagatgtggatgtgcggcgcgctgcccccgtagacagagtcggtgaggggaagccgtgggggcgcagcagtggagcggacctctccattcccacactgcctcgtgaggttcccaccctggagcccccggggggagccgcccacacctcccctcccccaaagccagaacccagatggccaaagatgattaggccccttcccaaaagcagagaccagtgaccacaccccccctcccccaccccattagtgatgcgtaagacagtttgttcccccccggggggctttttgattaatttgtagttatttctccattagatgactggcctgagagggaaatgacaaacagttcctctaaccacttagaagacccacattatagtgagctgaccaacctgaaggtgtgcattgaattaacagggctccatcctaaaaaacaacgccacttgctgcaccttagagaacgatgggagcagcaggtgtcggcagcagatggcaaacctggccggcaaagcaggaaggaagtgacccaggccactcagcctgaggccattcctcaggggactaacatcactgaagagaaacctggcaggaaaagggcagaggccaaaggcaacagaagctggtcggaagagtctcttaaacccagtgacaatgaacaaggtatgcgggggccaccccttgagtgttcaccccgctcctggagggtgggtcatccactctctgtaggaaagggcttttgaggagatcttagaaggccatagcaattgacttcaacgaagatgtggcaggcagggagttctctcttgatgtccttgcccgtggttgcacaggaaggaagtctgaacaccttcattccagcctcaggctgtctccagtctctgggtcctgagcaacccagacccagtgggtagggggcaggaaagcaggaagagccagcttctgtcctctcttccgggccctttgaagcaacttgccacttggcgttttgtgggttaacttaggtgccgtttgaatgtggtataattaaaatattaatgctttgaaaacataattggtgtatctttaaaaactgaagccgctccagtgatcagtgttaacaatgggcttttcttcctgcactggctacaactgtgtaacgcccgcttcttctcccgtctcccatccgcccgccaccccgtcaccccctccgtatttaggcttgcctgtgttctccggctctccgcccatgaagagtctttcatccaccagtgcaggcggcaaaaagcaggctcagccaagctgcgcaccagcctccaggccgcctgccaaacagcagaaaattaaagaaaaccagaagacagatgtgctgtgtgcagacgaagaagaggattgccaggctgcctccctgctgcagaaatacaccgacaacagcgagaagccatccgggaagagactgtgcaaaaccaaacacttgatccctcaggagtccaggcggggattgccactgacaggggaatactacgtggagaatgccgatggcaaggtacctcttgaccccggcttccctctggggcctgtgcgaacacatccccgcctgcctgcttcccagcttgaggggacaaagctttccttttcctggactcctcccccacaccacacgtcactcccctgtcctagaggagcatgtcttctgggtggcagcgaagtttcaaactagtaagaatgaaatcccttcccccaaaccctcctttgacaggcaccccccacccccaaaaaaagataaggaataaagtgcctctctccacgcaggtttgtcacgtggggaggaggaggggaagcagcggctgttagaaggacacgggcttaaccgtgtgcgctgcttggttttatgataggtgactgtccggagattcagaaagcggccggagcccagttcggactatgatctgtcaccagccaagcaggagccaaagcccttcgaccgcttgcagcaactgctaccagcctcccagtccacacagctgccatgctcaagttcccctcaggagaccacccagtctcgccctatgccgccggaagcacggagacttattgtcaataagaacgctggcgagacccttctgcagcgggcagccaggcttggctatgaggtgtgt

SEQ ID NO: 1172 - DNA, 35829 bp, mus musculus; identical to SEQ ID NO: 1171

SEQ ID NO: 1173 - DNA, 34561 bp, mus musculus
cggcgtgcggcggcagacggagcctgggctcccagcggcaaggtgaggcagagctgcgctcctcgctgaacgcgggccgagctcggcggctgcgggggagacgcgcaggagcccagaccgcgaccgagagcgggagctaggcgggcggcggcggcggagggggagcccgcgagccgccgggcggagagcccaagccgcgctgtcgccgcgcagggacgacttggccaacactcacacacactcacacacacccagcccgagcgggcgctcgcggcgaaccgtcaacatggcgctggggctcctgcccgagcgcgggcggcggcggcagcgcgggagctgctgagctcggccaagcccagtccagctgcgggagcccggaggatcgcacggggctgtcgccacctgcccggaggccccgagcccgccccgccccgcccccacccggcccagagcccacccctcggcggggccgaccccgagggcagccggctgccagcagacggcgagggagtcgagtgagcgcggcgccgcgagcgggctgcgggcagccggggaccgcaaactttgctgctcgccgcgcttctccggcccggctccttctccgctcgttaacgtcgccaaccccccccacccctcatatctctctccacccacccaaccgccccccgctccttctcgccgcctcgagtccgcttgggggaaaacttcaaagagccggatcgcaggctccctgcctactcccccaccggggatttcaggtcagtgcccggaacacctttcccccgggagaccgcggacgggtgggcgggcgggcgcgctgagggctgcagtcggccccctctcccggggccccctcccgcagcgtaccccgcgaagcttttgcctcgcgcttccctttggctgcttggctcgctttcgtttttatttcatagctatgttatttaaaatgcagccaacctaagcggccccgcgtgggcaccagggagggagggggcgcggctgggggcctggcgcctcccggtgggccaggaggagagcagggagttcgcagagtggaagtttgcagcctgtgtgtgtctgtgcgcgggagcgcggtcgccgctgagcgccgcgagtcgggcggaggggggggaggtgggctggaagctgggaagctgggttcggcgttagctcgcgagcaggaaggggagggcagcgggttgccgtctgctttctttttcgactcgggaaagaactgtaaaaacccccagccgccgccaccgccgcctcgtctcgcctctccgggggccggtcgttcctccaagtggaacgtcggcgtgtgcgtgcgcgagggtgtgtggcgagtgcctcgggccgagccgagctcgacctgccgccgctgccgcgcaactcgggaggggagtcccgttttttcttggcttgccccaaagcacgaatcacgtggattaaaaaaaaaaactactaagaaatcgagcagagcaaggggttccgacttggcccgcccgccagccaggtcagacgctttgttttgtaaatgttcttttaagattataatctgcgatccccctcccgctttccccctcctctccctccccgatgttcagcgtaggttttaagttatgagcccccaggggtgggtgtagaatgtgcttgtgcgggggcagcgtcgtggagggagggcgggggcgggcgagacctgggccctccgctgggcaatggggagtctggtgggtagccctgatgggcgtgtgaaagtctgcggccggaggaagttggtcccactcggagggcgtgtggcaaggaggctgtaggcgaagaggaacttgcgcaccggggcaagatcctcggccaaggcggggagggcgaggcgccgcggggcccgcgctcggagccggcgggcggctgcgccgcagagcctccgccaactcgggggctcgcggcggcggtgacgagcgcctgctgtttacggagagagccttggggcaccgtgtgtggagtagggcggccgaagtcacgcgtggtcccggcgggcttcccgccgctcgcacgctcgagtgggcccttcccggggtcccggagacggacgagtctggcagcgtgtaggccgtggccgggcgaggcgtaatttgctgttaatgaatcttttccagaaagtccgcgatctccagctagaggctgtgagtgcccgcgcgccagggcgcgcgccgccggcgtctggagggtgggggtggggggaatggaagagcgaagaaggaaggaggagggttatgtgtatttagaaacaaaccttaaaaagaaaccaacgcgcttcaaataggtattcgcacagcctcgctgcgtctagactagacagctcggggttttagctgtgttttcccccccttttttcgttttgagaagacgctagaggaggggtagtgtggtatttggttctaggggtagtcttttggagaaagatccttaaaatggcctgggagtaaagactaggaggaaatggcccaccccagaaggtggtgggtggtgagtgcagacagacttgggtatttctggccatctgacacttcctgtggcactggaaacggacaccgcgggccgaaatcaatccttacgaagtgttgggttcggttttgccaacagaattgcttgcgtggaaggcattttaattgtcagcctcaaagattcctgtacgtggacacttagggaatacgctcgttccttgaccctgcccactcctctctcgacctgttatctggtgtgggttttgcagtgttggttttcgtgtttattttgggcagggtttcagcgcgtagagcggagtggggggggaaggcgatgattaatatgccatccaggtttaatccgaggctggccttcagtgtgcgggtatacaccgccacgcacaccaattgccttggggtgtttaggggagcgcgcgggttttgggcagcaggcgcccggccggcaagtcgcggctggggctcggctggccccagcgctgtcctttgaggcgctgtcaccagtaggtgactgagagttaattaggaagtgttctccggatcaatgggctgcacagctcattagcgattctctccagccctttgcagggccgtcctggcctccgcctcccacacaggccggggcctcgctgtccaggctgcggggagcgccgctgggaagtggggaggggccggtagcgagggacggcggggaagcgagtgtaacttcgcggggcggcgcgttgcgtgcggcgcctcgaggcccgcgcagcccgctctttcttcctgcccgcggtcgcctccactgtgtctttaactcgctcccgctcgcgtcgctgcctggctgctcctccccgcctcccgcgcctatctcttgttctctaagcacgacgcctgtgctccccgcccagtttaggattagacaagataaaaataggactgcccagcgcgcggagctgtgactgtgccccggcagccgggctggtgggagcgcggggggccggagctggagaggacccgtggtgcgctcggagcggccagtgcctgtgggccccctacccccaccccgcaggcaccgtcacgctccccgggttctgtccgccgtgaaccgtgcgggccgggggacctgggcagggtctccgcgctctcgcgggtgttgttggtgtgccggtgatagatcggtctagacaggcatgcaggctccctcccggctgaaggactggaggggggggaggcgcggagatggcagcagactctgtgagctgcgagtgagcgagctagcctccgggcccagcgagctgggtggagggaaggccgtgggggtttctcttaaccctttaaaggccgtggtggggtagtgtaatagggaaaggggggcaaagagcctagtggaaattcctggaggcagagtagctcgcagtggggaggagctgtgagtctgggcctagggttttcctttctcttatgtgtgcacggtcacatcttggtgcatcgggctcgattcttccacaaaccaaacgcagctgctagatgatctagtttgaccaggtatttctcagtcggggagctgtgaacacacacaatgaacaccctcactttaaaaactgagtttggaagacagacgtagactcaatgttcccaaagagaattcatgcgggtgttcaaggacgggaaggtctgcacatagctgtagtcgggtggggcctctgactatgactgctgcagaccaaggacctgagcctgaaatgccccgccagcatgtacaggtatgcactgaagagagcaaagcggtctttgagttgtctctatataaatagacatacttttaaccaggaacttgtgaggagttagatatgtgcaaggagacagcctccaaagaggagctggacactgatgtgttgtgagatccatcgtttgtgtgtgtatatatatggctaatattaaattggtctaaaattttaatacacctctgcagacatttatctagttctttcttcagcttgaaatgggcggatgggttaccctatacataaataactcattactaacattccagtctcctcctccctcctcttcctttctttaagagtttgtgatcttaagggatcctctgtttacatttaaactgcaaacccatattggtctggcctgggaaagagccacattataggcaaagcaaaaagaatggaagtagtacgaatgctcagattaagatgtgcgcttgaatgacatgtgctgagacaaatcaagacacttgggctccgttgcccaaatggaacaagagatacataagagataaagaactggccaaggggaatgtaaacatgggtatgcaaatacagagatgtatagcgatattctgagagaaaaatcccagactttgttgagctggaaactggggcagaatttctgtaagtgcgttccagagacaatagcccatttaaaggtgtgaagagggtcacttggaaacacaaaaagcattcatatgcatacatccatgcttagatacacaggctgaatgacaaacactcctcaatgcctgacgaagactttcctgccgagtgagtgagaccgacttgggtacagaagagtgggccacacaaccacattcacacacttattcacagggaaataatgtgtctttggcttgaaggaaactgagggccacgctagcagcctaaaggatggatggtgtgcagtgaactaggattatctctggttatagtttctttcccttctaggggtgaggtggagtgggcagcgggttggtgacgagcaggtaggagcctttctgaagagattttgagttcctgaccttgagtggctggatcgtgtagccacaagaggggtagctttccactttgtggtcagtaggaatggctgttgcactgctggggtccaatttgctaaggtggagcagggcctcagtgggctgggaaggagaacaggaagaagtgcggcctctgggaggaataaaagggaggtatgctttctttcttttcttttttttttttcctctggaggagaccgtggcggggacagcctgtgttgggtggattagcaggcgcctcggtgaccccagacgcgcacgtaaactccggctagggtatggcttgcccgcggcgtcgatttgctgcggtccctctttgtctaagcccagccgggaattccagcttttattgggaagaccgcacttgggtggggcccgcgccgggcggagtggggcagggtccggtcgcgctgggcgggaggcttggagcccgcaggacgttccccggagctgcgggcagccctggcaatgccaccccggtggtttcctcgaggacaccgggcccggcggacccggagaggcgcggcggggcggggaacttcctgggtccatctcggccgccccgccccacccttctccctccggcccgaggccgaaaggagctcacaaggccctttgttaggccccgaggtcacactcgtgccccgggggccgccgatgggtgggagaaagcagtgctgcgggtcaagaggagcctccttattgcctcggtgccccagcccatcttctggatcgggcccggtgggggcctcgcccaaagctgggtggggaggcctgggccggccctgacccgccccggcttctttgccagtgtttatggccgacgggattccgtctgtttgcaaaaccggacgcgctgctgaggcctaggtggtagagccaggagaagccgccggggcgggagtaaatggtctccccccagccgccctggtggtagccgagccgcgttcgtcgcgcgcacttggccgggggcgtccactggtctccagccctgcccgacggctttctctggttgccctcaacgtgttcatcaggaagggatatcttactttttgttgggtggagttcattaacgatgcctttctgcgatatttctgtagaaggctcccttttggggcgcaagctcacctccatgtgtttacaatcgagggtctcagaaacgggggtcctcactccgtcattgttttagagctgtgtctcccacagccggcacccacgggctcggctctccatgattagagaagcggggaagtccactcggagaagatcctgacagcataaaaaataatttgtgatctaaaagacagtttccagtataatctcattatgcaccacagactcccgatgttattttgtggaaggcggacaatgatcaatttacattgacccggggctgggcgagcttttagatggtaattgccatattgatttgcatgcaaaaaggagacctgctaaaattaaagaccggaagctaaattaaactaaatttattgtctaggtgcaaaccaggggaactgttgggggatgggattgactcaggtcagggtgccaggggcagagcaggtgagaagccctggagcttcggaaggtcacaacttgggaagcgatctttgcccttgtgatttcatgtggggagggggaatgtgtttaaggaaaaaagttataaaaagacaattttgcattgaagtcactaggatctttcaatgctaataggaacttagagggagaggagaggtttatagggttataggggtcttccagcaccatttccggcgtcccccctccatttctattgttctgcctggccagacgctcgcagtcgtgctagggacaccaaaaacctcttgcatttgaagagttaaaaaataaataaaagcagcccgtcccccccttcccgccttgctctctctcccctcccccttcccggagcattagacttttcggagagagcgcaccgcgggcaggccaggaccgttggcgctgtagggagttcctccccggacgctgcggtcccaggcttggctggacggcgatcgcttcgggaagccgccctctccaggtggccacagtaggcgggggtggggtggggtggagcaaggcgtctgccctggccgccgtctagcggtgcccgggacttggggggaatcgcctccccggaggggttaggagggccagccccgccccgccccgcccctccccgaactgggtgggggccggggaggactggaaaccctgcccgttcgccaaggccggaaagtttaaaaaagagaaagaacgccacttgcagagggctggcctgcagccaggggtggccggcctgcgggggcgtgctcggctggctagcggggtgagcgccccggcgccgccgtctcccctccgtccctcccgccgccgaggcccctgcacactcggtcgcactgcggagccatttcgcacatccggagcttcagcgtctggaggagtaaccagtccagggccgggaagcccgagtgtccggtacccctgcctgtacccatcgagccgagccggaggtggctttggcaggctctgcgggtgtaggtagttcccggaacatctgaaagcctggggcagacccggaaattggggatagggtggggaggggatgttgggccctgaggtttgctgccggccgcttctgtaaagaaacgttggggaaaggacaagatagcctatcccccggcttgcgcttttgtgggggactctgggtggcccaatagaacatcttgctggcgtcttccatcttaattccctctcccacactactttgttccctggggtttttcctttaaatcctaggaaaggtagatggaggagctccctccaaagggcttttgctctatctagataatttgatttattgctttatgtggcgaaactggggtggcaagcctagctcctagtaccagtagtcagcacttttcccagagacctgaaaggagtcgacccaccttacccctgactattctggggtactggaggaagggaaaggggaggcttgttgagagcattggccttacaccagggtataacagtgtagggagatttgtaggatgtagggggaaatggtgaaagactttgagtggaccaggagatgacttagatacaggagaaactgggttcacggctcactgtagaccaagtaacataggtgttaaacactctttgcctcgttcttgggtacataaggcctaaggaagcttttcagaggagacagtatgtgaaaatcaggatttcaaatggcacaattagaccaataattggctcctctccgcaactccaggactgagtttgaccgtggcccattttttactagctgtgtgaccttgggggcaagttatttatggcctttgagccccagtaagttttttcatttgtaagactgggaataattatccacctttaggatctaaatagaatgcttggcacatagtaggccccaaggatgaataattgctttgaatgacttgtcatgttcctataggttgctcctccattccctgctgcccctgagaccccctgagacttgctaggcctgtgtcctgggacccaaggatgcagattaaatctcccctacgagggtattctaggtccaccttcctgggttcccctttccctttgttaccgtagtttgcattctgccttttaaaggattccatatgaaaagacttgcttctcccctccacccccaagtgggatcattatatggttaggaactcatttcagaaccgtcatctaggtacccttcggcaaggcttcctggcattatttcaggggggaaccacggtgcctagaggggcaagacctggttggaagaggtgagagggggtggcctggtgcagaggccagaggtgctgtggtttgtttgatagggattaagtccggatgttatgagggctcaatgtggttttcaataaagtctgccagggattgcttcttttatatcaatatgtatttaaaaaaattactagcatgagaagaaaaccagacctgtatggatccaggctggtagtaagctactgtgatcaggtttcctactcgactcccagaggggaagtcagtgtttgattgaagctacacttggttcttgactctcaggggatgcctgctctgaaacaggagccctccctccctttctctcctcctctccccctcctcctccctctttttcccttcttcccctaaaagcctttgtgctgaaagagcttcagtaggcacgaatccctggtccctctctaaagaatgccttacagcctttgctgacattgttttgtgaacagtgggttttaccaggccagcagtttccccccgattttagcgcacgattttaaaggtagtgtatggacaagatgcgccttactgcagtgattgcctcagtgtgtagcctgggctggggcttggaatctagagacgccttaacctttgccctaggggccctcctggagtggggggtgaaggtggggagctcgaggactgattgttttcgaggatctgtttgttttgtccagccaccgaggctgaaggtggagttgggcaagtctgagtgtatgttccagctttgggtctgattttaaacttggtttaattggagaaactcctaggcatttaacagttctgtacaaatgcaaacttgaaatagctcgaggcctacgtcatttaggaaagaataaatgaagtacagaaatgtccaaactatgtaaatcctagcgttgtctgccctcccataaacacatgacaagtgccaaggcatttccagtcaaaacacccatggaagcagcagcctccatcctttgtatttattattttattaacagcattttacacagcatttaacaagcacagcgtgcctgctttgcaccaggactctaagcaggcgaaagggtggaaaatggatggaggtgggggaggagtggttgctagaggacatcaactagagaaatctcatcagatgggtagggaaagcagcaccgggggtttatttctactggccacaaggaagacagacatagtgctttggaggaagaaatcctctctcccatcccaggaggaaagttgtacagctgtgatatgtctggtctcagctttgattccagagggtaaaacagggtatgtttcatgatactctgcccatcggttattggtgattttcaaagaataagtatttgtctgctatcgttattctatatcctggtggaaagtttataacgaaaagtaatgcctttcttaagtcataaaatgagccttgtatgcttatttaattaaaatctatttaaggaccgattaggcgtgtaatttgcactaataatgacgattatggaaatgttcaacttaaccaaaaatcataaaggagacattttgatcagtggggcggccagtaagtatttagtgagttgggcaatttccgaaagacaggaggcattccgctgagggctgcagaaagcacagacctgtctggcctctgtgacatggcatggagaggggcagacctccctgtcccggccccggccccagcccggccagaccccactttgctgagcatggaaaccaaccctgcgagtctccacaacctttattctcgtgatgcttcctcgagcttccagaaggagtaaactctcggagagggctgatgagccacacggaaatctctgcgaaatggcggtgctcttttgctttaacaaacagcgctgacaaacgcatgcttccttggctagccttggctggatcccggaggggtagggggagaaggggtcccttgttccggagaaacctgccagctgctgggcttggtgtgaaggcagcaaaggcagacacaatgctgctgttgttggtttgatctctaactgtggattgttagtctggctttaactatgtggtaaggggggaatgtgaaggctgtttacagcgagtgcaaataatgtgacagctgttggcgcgcgagcagcgctgcgcctcctcagcacttacacaaagcgcgcactatgcaggcccatggacgagctgcagaggtggcggccagtttctggccagcgcatccccagatgagagaaagctccacggcacacccgccctccatccccaacacacatctttatgacttcccaggattggggtggggtgcaggatggtttgtatgttgtggtttagggaacttgtggtgaggcagaggtggcgggagaaggcccacggggccgtgagtgtcaccgtgttggtggggtttggccaggatccgttgaactgggtcctcagctgtttatggctgagtttttaagatttgtgaaaataactttcagccctaagtaagcttgttggaaagaatgtgttattaactgaaagctttctggaaattgcagaggctctgaaggccgttgttcccctctgaaatggccctgttattcagacaagttagagacaggcgggtgctgtgttctgtgcactcgacactgtttccagcttggaaatgcaagtgtgcaggttcagtaccctaaggggggtgtattttggggggaagggaggacagattggcttttgattacccacatcccttaaccttttcttccaagccttcccgttttcaagagcacatttgccttcaactgcagcacgcaaaggtgccgtcctgaagcctgcccacagcaccacctactctgacttcatcaactagatgcccacagcaacaggctttctttgagttcctggtaccccgccaggccctgcagagaggcgccagggtgggagggagagcagttggtggtggcagttacccactaggccagtcctggaggttcatggctggcccaagcaggtggacttaggatggccaagaatgtggacctgcctctggaccgtcctggggcaagctgggtgtaaaaattcactcctctcccccatgagtcccaaggttgaagccttccaagccctggcacctgcctggtcctccttgggttttggaagatcatttagggctgactttggtctctgggtgtacagcctacaggatatctgcaaatctacttcattctctcctgtcccccccaccctcagcacctcccctccctaagtctactctctaagttttaacatggacttctacatctagttgggtttccgatggggagctgggagatgcttctggagtgagacatgaacttcggtgccagttctataaattggtctctttttatgacgtgtgccattttctgtaggaatgttgcttgcaaaacgagtttcgccttggaggaaaggcggaaagataaacaagcctgcaacgccaaaacactggcagtctttccctccttccagctctcttaaagcagccgggctgtatttccaggattagacttgtgcatgtgaggagggactcgcgttggctttttttcccccaagcaaatgcaaattagagaaaaataattttctttcaacgatatgcaatgtattagtcacttgttatcgtgctccgaggcaggcctcatttgcgcgtctgccagctcgctcacatctgctcagcgctgttcggggcattttaaccttggcggtgtcgtgtctagtcccatggatcaaggaggagtaattaagccctgaacagctacaaaaattcgtgggcccccatctataccatagttgttccatggctttgttttgggtgctctgagttccatgactgagtagcagacatgggattcctattgttccttgtaaagaaggtgggtgcccctctccttctctgaccctcatcccagcctttctgggactcccaggctctgcacaatcagtgagagactcgcttgcagattgcaggacccctgcattttacacatcttttatgcattaaaagttcctttgtgcttcctgtgtatactaatgatagctgttgttattagccttacggtatagcttgttcccttcggtggtggtggtggtgggggggggtggcggcgacggcgtttgtgttttactcctacaaagccctggtggaaacaaaagtgcattgacacagcctttggaggcatggtgtggaacatttattctggatttgcccccaggttgtgtagattcccaagtggggacccagttctgcagggactagatcaaagggggcaagtggtttctttttgcgtggagggaagatagtaaggagggattcctggcttttgacttgggtttctgttgccgggtggcctcctgtgaagggacacctgtttctaaatttgccctctcttgaatacacacgtggtttcctgactccccgtgtggcaaaaccatgaaggaaagtgaaaagaacaaaaagccggtggggtggcctggacagattatccggggagacgggcaagtgtcccccgttggcctgtgagagagaggttgggggcacctgaccccgggccatgggctctgcctggaggaggggagtgtagcggacaatccaggttcggcagcgaccctcagggtcaacccctgcagattccaccccggaccccaacgcccgagattcgcacccctcccacgttacagtaggcgacgcttggctcacatctttgtaaggggaagcgtccagaggagcagcgctctagtatgatcggaagggaacccagaacgatggcgaggaggggtctgccgtgcccattccccgggtgggctcggcggcgtttcccgggaggtctcggattctccctgcgcccacccaaagtttcttttcgtcagattcgttgatggggagagaaggtgcggcggggcctcgggaaggggcaccatggagagcgtgccaggccgcagggtccgaggggttacctagggtcgggaactgggaaggtcgggccgcctccggggaggctgctggagttcctggaaggcctggcgggggcgcgccgcgagggcgtgagtgtgtgccgtggtgcggccccgcgcgctgggacctccgccgaggagcggggaggaggagcgggcgagccccgagcagcacgggtgtgtgtggtgggagagaaaatccctttgttgccgaccgatcgcgctccgggctgaagcgcctcagcccggggagggggcgcccctccccctttcttcttcgccggggccaagttcactcccagcccaggtggctctccgctcagaccccgacgccccgggaggaggccgggaaggttctgggtgctggaatggtctgggccggcgagtttccccttccccctcccccttactaatgcaaaacttggaggtgtgggcggggacgcccgtgctggctacggctaaggctgtggcttggagtgtgccaagaggcagcacctgggccggctggatcacttccctcacccccaactctctcgggggagggggtcgggaggggtgggaccgggccagccacctccctcgaccacacccctggaagcctgcggttttgcctcccagggacctggggggcagccttggggtatcttactctccagcagacccggaggacccatcccacactgcacatccggaagagctttttcttctcatctcccactcccacacaccccacccccacccctcacatcctaaaataggaacttcttcacccctcccttccttgacacccggagcacagcgctgctgctgtgacgcagtctctgtttggagcaaccccaggaagggctggcgggtggtgagctttgggcttctgtaaaatctacacagttctgctgaagttccctccctgctctgatcccctctctgttgctgcctcagcctcccccgcaggatgaggtggtagtgccccaaagaaactgtgttgtgattctggggcttattacacagtgtgtttattggagtcgggtactatttagcggggttaaacgtggccagcgccagctattgccaggcaaaactcaagtccatagtgcagcttaatcctttggaaaacacagtgccaaatatttacagaggggaccaaggttggagaggttcagccacctgcccagagacacgcggtgagtgagggtgggagccgggaggctgtggtgaccatgttctccacagagaaccagccatgcagtagcgagacccctcccctgaagagtcctctgccagaggaccccagcacactggctgggaatgcctgcctggccacctgagctggaagcccttgcgaacctctccagttcttctggctgttaactgctggatagctgccggtgggggcaaggggaacctagtgagagagatcccaagaaaagaccccgagatgggccaccctcaatgcctgtgtggacagcagggaggcgtgagcagagttagtttggtggccatgctttccaaattgtcagtgccacttgacaagtgtaatgtgcagacttttaactgatcggcgcctcaagggtgggggcagtggaaagtggccctagtgcaagagggggccagggttgggggtggggaaggaaaggggccaaggcttgggacctgtggtctgccctcacatcttttcacagagggtgggtgtgtccctactcagggatgccaaggttggagtgatggcttatgatcttggtccctcgacgccccccttctgccaatcaggccttctcccccgtgtccgggccaagctcaggtgctctcatcataacccttggctgaagagcgaatgactactcagagtctgtccagggtgacccaagctctcctatgtgttccacttccttggtgctaagagctggagaccatgcagtatgcagtgtgcacgcctgcttctcacaagccaggtctctccacttggccctgggtgttcctgcaggcagctggaacagttcccagtctgttctttagagacccacaccctccccatctgacctcttctcagctgtctttcctctccatccctatccagcacctttacccacttctctccactactagaaaaaggggttaaaccccagatccaaggtgcagcttcgcagctcacagtggaacaggttggtgcttgtaaagtgcttttcatgagtgacttcacacatcttggcacttctggaagcatagcctgcatttggaagaagtggggggtggaggtgggcattgaaaaataaaagcaaacgagcttcatctatagctgcaaagcaccctgaggctctgtttgtcattgaaatcaggtcatttgccctctccacagtgttccgctgccaagggtcagcaacatcagtttcgaagcacttggccttagaggtaaaaaagtccccagctatttcaacagcagcttctagaagtttgatgtccctatactttgcctcccagtctctttttgtttcttaccccagtgtccccttcgttgtacatgacagagaaaccagggtgggctgtaggtaatggtgacccctgttcttcagtagaggcttggtgtgagccgtatggcctttgcaaaggaggtccctgcttttgtaggtttggactgctctttgtcacccaggaggagggcctcctgtgagccagggccattgctcattggccctttccactcctctccatctttggccaggaacccgaagagttaaaagtctttagcttgttgcaatgaaattatggctggcagtggcgccgctgtttgttcaacagacctccacttttaaacagttcacaaaaagttcatggggcagctaaagattataagtgtgtgtgtgtgtgcgcgtgtgtgtgtgcgcgtgtgcgtgcgtgcacgtgtgtgcgtaagtccacagcaggatccaacaatgtgttccccccttttgcttttatgttcagccccatcctccaccccttccctcccaaaacacacacacacacacacacacacacacacacacacacacacacacacacgacagtgaaccgctctgctagcctcaaccctccatctgaccctgtgcatttgagaacactttgttctggtggctggtatcatttatctgtgcgccattaatatggaaagccccaaaggaggagccctggagaaggggagatgctttgaaagcacccagtaggcccaggtgcctgtaaaccgcagtcacctttctgctaagtccaggtggactttgctgaagaaaggctctttgaagggaagcagctgctggccttttcggggctgggcctcagtataatgattctgtttcccaagaaggtgccgggaggtcctttgcacaaggtgtctacttaagggaggtgggtaagaggcaggttttttgtttgtttgtttgttttttgagttttgctcttgttgcccaggctggagtgcaatggtgcgatctcggctcaccgcaacctccacctcccaggttccagcgattctcctgcctcagcctcccgagtagctgggattgcaggcacgcaccaccacgcccagctaattttgtatttttagtagagacggggtttctccttgttggtcaggctggtctcaaactcccgacttcaggtgatccacccacctcggcctcccaaagttctgggattacaggcgtgagccatcatgcccggccagaggcagcttttttaaaggggaggccaatttttaagaatggggacaccagaagattgaggttcattaggcacacgcttcttccctcatccttttcttgggggtttggttgagtgaccctttggctcatgatgtaatttctgtatttcatcatggcacagtgagggggtggcatggtgcagtcccactgctgcagcccgatgaccgggacacactggcaccggggaatgatgttccaccttctctattatcctacccagaatgtcttccttttgttagaaagggcagcaggggccggagaggggacactgccactgcacaagggaatgtgccttgtggtctgcccagccctagtggtggccttccccacttgatttgtgtatttgcaagatggaagaaaagcccacgaacccttatagaaccttccccaacagccgagtcggtcctttgggggcgctgtggctagtcaactggaagagccgctgtctggagacacttcctagggaaatagctttccagaaccccatcatgcctgatgcctctgcagatttctgcctttttcttgggccctttacctctcttccagcctcattgttgagctctaactgtacgtggtgtgtcgctgcatgtggattttggttaacagacgttgttctatggggatgggggcccatgggggatgctggtggacaaaagacctagttaggacaaagaaatgagaaagtacagaccggctttgggattccatcccccaggtgtccccttaactcccaccctcagtcactctcacagaagagtccccggacctggtgcctccaacccaaccgacctggcagtctgctccgtgtgctaaagtgtaaaagcaagcatttgcatattttttcctgctaacaaaggaaatgtgtcgacttagggaacatttgggctttcggaaactgtgtgggtgggtgtgtgagggaggagaaaaaagttcccctgatgatctgcacaccaattatttcacacccaggtttgggtcccgtggaaaaatgccatggccggtctggacaagggacactgagatgtgtttgtgagcagggaattgccgagggccatcggtcccaggcattaaaggctcccctacttattaacccagcatttaacagcaggatatgggctgaagcgcagtcaaaagaaacggctcaacctccaaagagcaattaaaatcctgcacgaggataaatcacgcgccgtgataatcctgttaataaaatgcagcttgtcctgacccttcactcatgcagcaaactagaatgtgatgtgggtgggggcggtgggcagaggaggtaaaggggggtgggtggtggtctgagctcctctgccttggcaacctcccgctcccggaacgtggaaaatgggtggcttctgccggctccccatgtgccagcggcttggagcccatcagccagggctgctaagacttctgtgctcgctaatgatttctcgtccccagtgagcaggcgtcattgaattactcagccgcctctctctgcagcttccaggcaaaaccacccgggttagctgcttaatctaatccagggctctggtggggcggctcaccagcccaccgactctttttcacacttgatctgtaagttgcacacacgacagccttggaaattcagccctagaaacgcaggtagtttgagagctggacctgccgctcacctcactgtggtgccttccacccttcttgcacccttttggccccaggaaagatcagttgtgtgcctcccagtgatgcagcatccctgaacctattgtcagagcctccccttgttgaatcaagtcttctttaccttctttaacaagtggcaagaatgaatgaccactgtacactttcagaggaaagggagtgggcgggtgctgtggtgtgccctgaatgtgttctgtgccttggatgaggctacctgtttcgaattaaacttcttccccagccccagcacctcctaccagggaagctgcatgcccctccgctgtcccttcgagtcaggtgtctgtccttggctcccagaccactgtagacagcaggcacagcctgccttccccatctgcatcctttatgaatcacctagaaagaggccttctctagcgccctgtttggctctcctttactgaacctcctgggattttttttctttccttttaacagactagacgcttgaagcaaagctgccatcccagaagacgacatgctctcagcaacccccctgtatgggaacgttcacagctggatgaacagcgagagggtccgcatgtgtggggcgagcgaagacaggtgaatgcgcccatctgggccgggcctgagtggagcccacgcccatgctgaagcccccctcaacttctcacagccaccgtgggcccaaaaggggtgggagagaaagagcttcccgcctagtaggccgctcttgatttacagttttaacaggcaacctggctcagtgaagcattgccgccctttaaaagattagcccctaaagcggcctttcagtgcactttcgtccttaatttattatttcatatttatgaaggagaattaatcccagtctatatactgctttaactctaaatgtcaggagtgtgggcccaggtggagcagcattctatgtgcttttaaaacaaatagtttgctcagtaataaatggggagagagccaccgttttccttcattgaagcccaggatctctcattgtcctctgctgcctgttcccagaggccactggcgcctgcttttggtcgtcagacagctctgttatgcttcctaatcagtaattttggagttgtggggtggaggcagctaagcagtagatgattgaagctgctcttcggggtaatgaggaaacttttcctctgccgcttgtcagcgatttttatcctggggatttggaagttggcaccaagcactttctttatcgatgctctctgataacaagtcccagggcagccgcagcagcctggcacagatgtgcagcttccttttcagcctggaacagctgacatttgtatgatactagtgtgtatccccctgtcattttgacaaaggcagtcaaatatggcttttttatcaccatggaaaccagtttcgtaggacatggtccctaactttgttttggaaaaagttttgaaagcctaccctcctgggtaacacggaagtggttgatgacacgaccagccttccagccccctttggtatttggctgtgttaccacttcatgtctaccctccaggagagtttataagggttggctgggacagccgagctccgattggcctacttggcctctagagaaaaaaatctcgagggagaagtagttgtgcttaatttctggcttacctaccttggggacatcatatttgtgattcatgtcctcacacatgaaagctttgcgtttcctttgtttttcctggtcaagttgaatcaccatttgggggcgactttcaatatgggccattgacagctggtgggggcggagggttaaggacagttttaaaaattgggttagtagaaactggtctgttctggggagatctgtgaaagatggattcagtgaggaatgctttcatgaagttggtgtatctttttaaataggaaaatccttgtaaatgatggtgacgcttcaaaagccagactggaactgagggaagagaatcccttgaaccacaacgtggtaagagattaatagcttctgttgatgccatatctgcatatcagtgatctgtaatcaatcgtattaatttgcatgcccttaaagggtggggaatgggggaggggtggcagttcagagcagggctgagttggaggcctctgcgagaggacaaggcccccacccaagctcttccagtcttgccttcctgcctcgccacacatgtccctgtcccctagtgactggtgggatgtgtactctcttttcttccataagctggatgccacatcagcgctcccagctggataaatttccagcctccaagtagccccttagggtttacctttccagtaaaatacgaaacacaggactgtcacttcagacacaagggagaggaagtcaaaagacacaaccacagtttgacccatggcctctatattgatatagaaatgaggctgctaaagtcctctgttcctgttgtcccatcgaagatcgtttcttgttctgttaagtcatgccttcctgcacccaggggaaatgaagcgaacacccacccccaagcctgacaggcccagggagggttagtgtgaattctgtaccccatgagggtgatgctgagagttttggagttggtgtcctagttgtagcaaagaatttttgctgagaaggtaaaaatcttcagacttttttatttttattttttaattttaatttttttagagacagagtctcgctgtgtcgcccggcctggagtgcagtggcgcagtcttggctcaccgcaacctccacctcccgggttcaagcaattctcttgcctcagtctcccgagtagctgggactacaggtgcacaccgccacacctggctaatttttttgtattttagtagagatggggtttcaccatgttgcccaggctggtcttgaactcctgagctcaggcaatctgcccgccttggcctcccaaagtggtaggattacaggcgtgagccaccgcgcctggccaaaatcttcagacttaatagatgactgaattaatatatgggcctcaagtccaaagggaccaatgttttccctgcttccaggatactagttgagaggtgagaaggcaggcagcaaaggggtttggataagggggtggggaaacagaccccccacccccgccccgccggaagcctgtctttaaccctttgtgcttggatgttaaggctgatggcatgttgaactagttggcagtgtctttgggtgctgctgccttgaaggagtatcccagtaacacccatgttgttcttctgcaaaggtggatgcgagcacggcccataggatcgatggcctggcagcactgagcatggaccgcactggcctgatccgggaagggctgcgggtcccgggaaacatcgtctattctagcttgtgtggactgggctcagagaaaggtcgggaggctgccacaagcactctaggtggccttgggttttcttcggaaagaaatccagagatgcagttcaaaccgaatacacccgagacagtggaggcttctgccgtctctggaaaacccccaaatggcttcagtgctatatacaaaacaccgcctggaatacaaaaaagtgctgtagccacagcagaagcgctgggcttggacaggcctgccagcgacaaacagagccctctcaacatcaatggtgctagttatctgcggctgccctgggtcaatccttacatggagggtgccacgccagccatctaccctttcctcgactcgccaaataagtattcactgaacatgtacaaggccttgctacctcagcagtcctacagcttggcccagccgctgtattctccagtctgcaccaatggggagcgctttctctacctgccgccacctcactacgtcggtccccacatcccatcgtccttggcatcacccatgaggctctcgacaccttcggcctccccagccatcccgcctctcgtccattgcgcagacaaaagcctcccgtggaagatgggcgtcagccctgggaatcctgttgattcccacgcctatcctcacatccagaacagtaagcagcccagggttccctctgccaaggcggtcaccagtggcctgccgggggacacagctctcctgttgcccccctcgcctcggccgtcaccccgagtccaccttcccacccagcctgctgcagacacctactcggagttccacaagcactatgccaggatctccacctctccttcagttgccctgtcaaagccatacatgacagttagcagcgagttccccgcggccaggctctccaatggcaagtatcccaaggctccggaagggggcgaaggtgcccagccagtgcccgggcatgcccggaagacagcggttcaagacagaaaagatggcagctcacctcctctgttggagaagcagaccgttaccaaagacgtcacagataagccactagacttgtcttctaaagtggtggatgtagatgcttccaaagctgaccacatgaaaaagatggctcccacggtcctggttcacagcagggctggaagtggcttagtgctctccggaagtgagattccgaaagaaacactatctcctccaggaaatggttgtgctatctatagatctgaaatcatcagcactgctccctcatcctgggtggtgcccgggccaagtcctaacgaagagaacaatggcaaaagcatgtcgctgaaaaacaaggcattggactgggcgataccacagcagcggagttcatcatgcccgcgcatgggcggcaccgatgctgtcatcactaacgtttcagggtcagtgtcgagtgcaggccgcccagcctccgcatcacccgcccccaatgccaatgcagatggcaccaaaaccagcaggagctctgtagaaaccacaccatccgttattcagcacgtgggccagcccccggccactcctgccaagcacagtagcagcaccagcagcaagggcgccaaagccagcaacccagaaccgagtttcaaagcaaacgagaacggccttccaccaagctctatatttctgtctccaaatgaggcattcaggtccccaccaattccctaccccaggagttacctcccttacccagcccctgagggcattgctgtaagtcccctctccttacatggcaaaggacctgtctaccctcacccagttttgttacccaatggcagtctgtttcctgggcaccttgccccaaagcctgggctgccctatgggcttcccaccggccgtccagagtttgtgacctaccaagatgccctggggttgggcatggtgcatcccatgttgataccacacacgcccatagagattactaaagaggagaaaccagagaggagatcccggtcccatgagagagcccgttacgaggacccaaccctccggaatcggttttccgagattttggaaactagcagcaccaagttacatccagatgtccccaccgacaagaacctaaagccgaaccccaactggaatcaagggaagactgttgtcaaaagcgacaagcttgtctacgtagaccttctccgagaagaaccagatgctaaaactgacacaaacgtgtccaaacccagctttgcagcagagagtgttggccagagcgctgagccccccaagccctcagttgagccggccctgcagcagcaccgtgatttcatcgccctgagagaggagttggggcgcatcagtgacttccacgaaacttatactttcaaacagccagtcttcaccgtaagcaaggacagtgttctggcaggtaccaacaaagagaacctagggttgccagtctcgactccattcctggagccacctctggggagcgatggccctgctgtaacttttggtaaaacccaagaggatcccaaaccattttgtgtgggcagtgccccaccaagtgtggatgtgacccccacctataccaaagatggagctgatgaggctgaatcaaatgatggcaaagttctgaaaccgaagccatctaagctggcaaagagaatcgccaactcagcgggttacgtgggtgaccgattcaaatgtgtcactaccgaactgtatgcagattccagtcagctcagccgggagcaacgggcattgcaggtgagcccccccacctgaatttcagttactttaccagttgtcagttttttaatgtgtaaacaggattgggggagtatggtagggcagggcaccaggcagatttggtgaatgaagcttgtggtaatttgaatatatgcaatgtggccagtaagagaacgtgagtggtagcactgaggcgtgtctggatgctttaagttattctgtagattataagggaactccactcaattgctgataaccgatgttttaattattgtgaagggtatctaaagactgcatgacgtttacctatcaattgctttgatttctctgcctgtaagatagcaaatatacctagaagtgctgcttagaatgccttacttgatacctggtagagatgtgtagcagccgcatgtctgtgggattcatgcaaatttttcaccaaaaagaaaggaaaaaaaaaagaaaaaaggttgcttaaagggatagagtatgtatttaacttgctagtgaattatgatagatgttgtataggaatttccttaagatattttacttttaattaaaagatgaataaagccaaattgttttgcaatgttaagaaaaaaattggtttatgcttataaaaatggatgaagttatctaaatgatccattgagtgcccattttaattacatagatggaaggattacaagaggacagtattttatgtctacccgctgcttactgtgaggtcagttcttcaaatttttattactagaatcttacataaaccttttgagttaaatttcatttccaaatatacaaagggaagtttgtgggccatggtcgtctttattcattgtgtattttgtttcttttctgttgtgtttttgttttgttttctttgcgttgtgttttcgttttgttttatttaccttcaaaagagaatgtctgtctgtatgcaatagtgtatgtgtggatatacatacacatcgcatatatatctatatacacatgactttatgaataaagaatgtgtgactacttatatatagatactcttaagttttatctgttaaactttaaaatatctgagttacatctcataagctgtggttggttttgggcacttttctttgaaaatactttcctttaagataaggcaaatgaaatagcttttatggtaaggtgttgtttttttttttttccatctccgttctctttctagcgtgcaatgatgcgcttctcagagttggagatgaaagaaagagaaggtggccacccagcaaccaaagactccgagatgtgcaaattcagcccagccgactgggaaaggttgaaaggaaatcaggacaaaaagccaaagtcggtcaccctggaggaggccattgcagaacagaacgaaagtgagagatgtaagtaaacctgagcagtttgcttgtgttggcctcaggtccggttggcatctgcttggagaaatgggctgcttttgccatgcatggaatgaagggccgattgtccttatgaatggtggcaaccaggaacgaggcgtctgtgaaagatagtttcctgggacacatctttttttccaaagaagcactggttctagagttgataacagtctaatataacgcagtgtagcagaggtatggcagtaggaaattaggtgcagggacaggttatattttgtagcagtggaatgacacttcccagccatctcctgccccacccctgtggtgacagtctgatgtggaatgaagagtccttatattctccctccaaaggcatagatgttgttgaagtaggatgaacatggtgaagtcaccataaagatgagcgttacgatttaccgtggggggtgggggagaattggccacagaatcccaaggcagcctggcatgcatgagggggctcttcccaccggacagagggcagcttgcattttggagggcaagtgatgtgaagagaaggctagtatcttcctcagtacactccctttggtccttacagcaggtcccccaccccaccaacagggttgactttgggatttgctcacgagtcttctagggtgctaagatgtgttggcagcaagtggaggtcttcctctttatttcttaaatatgcaagcttgaagctttaggtctgcttgcaacatgagaaacctcactgggcgaaggggaattagggtgtctgggtgaactaactggaggagtaggtgcaaagtcctcctgacacaggacacttggaagtgttgggtatgtttgagagctccccaccatgggccgtcggaggtttgacattcacaacacagttcatcggtgcctgacagagtttgggaagaatgtgtgatcagggagagtgtgcttcttgatactcggagcgcacacccctccctccacttccagctcatccctgggagcagactaaggccacctgccaggatcctgggtaagctaaaccaggactgatttgttgtaagtcattgctgaagaaagtagtttctgctgctaataggtggtggccttactcaagtggcagggactcaatgtacctgaagttgctcactcttcctcaaagagtggctacagggcagtgggaggtccaagccactcttgggtgaagtggcaaagaaagccttcctcctccctgatgattgctgccaactcgcagcccccactctgagttgcctcaacaccagctcttgggaaggttgtcagagggacctgggagaagtgggcaaggccgagttgatggggaaggtgcttctaaaagagggagtgccatacataagaatccctctttgttctgagtagatggctgggggcctggaggaagggacaggaacttagccagcttccagccttcttgcccttgctgtggtttttgagtaacatggccagaccctccgttcacatctgagtaactcggtgtggccaatggggagcagggcccaagccccacatgatgtagaaaggcctccctttccctttctgtaagtccctccaagcttcataccaacaggctgtgttcttggagcacccaggacagggccctgcaagccataagtcaccacgtagtgctcctcaggtaatgagccatggcagggagagcagaagaagagttgggggaaggtgaaggctgctttttaaatactagggccaaggaagagctggggcaccataggtttgtggttgatcaagaggaggaacctagaggaaatgttgtccttgctgctgccactgccatctcatccagggtacagcatgcgctggatccgtttggcttcaaattcactgagctatctcggccatcacgtctcttcatgggtgtcactgtggcccagagccaagctgtgagcatatggaaactggggtggggatttggggcaggcaggggtcacaaagagggtacaggatgcctccccgaagcctctcccctccactcctacagcaccagtagcttctgagatggcaggtgccgcctgtgcggcctcagctgcctgcgtgtgggtgcatcttgttgggagggcttgtttaaaaaaactgaattaactggacaacaccgtggttaggattttcattgactcttagtgatagtatgggttgctgagtttttcatttagaaattgaacaaatgagttaggagtgtccccaaactcctaaggaatgataagtggcattttgaagatggggtagggaacacggaggtgttgggcccttcctttttgtttttagttttattatttttattgattgatttacttttgttgatacatattagatgtgcatattagcccttccttcttgaatttgggtgtctgtctcccttggtagccacttggcttgtgtggacctaggactcactcagtggcaatgcctgagcgggagctggagaaagcgttgagtgaaagtgaaagggtttcatgggacttcttggctcaggaaacttctcttccaggacagcagcccctatgtactttgtaaactactttgagtttgggcagacagatgactaccaatgcctctgctgctggagagggtagaagttataacatggttggcctctgctagaggtgatgttgcctgcagagggagtagatgtcatgggcagtcctcaaaaatctcagtcctctgccatcctgtttagggcttactgggcgtggttataacagtggtgaggttgctttgttgccacggtgacttgtaaatgttgccatggcgatgcttccaggaggtattgcaatggcatagccatggtaaattatgggatgtatgtgctgtgccttataggaccatgatgcaaggagaaagtggtagacggtgtaggactcagccatgttcacatctgcctagatctcatgaccaaaggcacatggcattccactcacagaagggctgtaagtagttgcaatggaagaggaccctgatggttaggacccctatctatcccttcatctctgtctatgcacccatctcctttgccctcaagagtaatttctgtgggtactggtaagaatagccccatttgagggaggtccaagtgaagtgtacaggaaagtgacctggagcctctccctcatagctgtttgccatacgtatcttcggcagtcaaggtgggtgttctttgggattattactggcccatggagggaaaccctagcataaggtttgggggccttcactgaggggaattgggatgtttgccttgagaggctcaggggttgaaggaaggacaataggcctcatttgcggaaagatctcgtttgcggaaagatcttcttgagagcggacaagaagcatctacactgcgtgtgggcaggcatgattgcagtgaaccccagatgcagcagtggagggctcccgataatagttctggactattcaggaggcagaagggggccctgtccggctgaacggggaatggtggggacttggaggaggcatgtgtgtttcgcaccccttatcctagcctgctggcttccccatgaatggggagcagaaggtggtgtgtgcaggggagccctccccacccccactgggcagcttttcctagatggggagccccagagaagacagatggcaagacctccccatatctaatgggggtgctccctagcagagagactaggtccccagttagtcactgcctgttgatgccagtctgtgaaataagtgattacaagtcttctaggtggttttctgtggacaaaatatactggcagtttgggcataaggccaggtaggtgagatataaactcatttcactattaggaagtttgcagtgaaggtcaaaactccaatggaaaactttctccctgagaaagatgccttagacttggttgagattgttacaaatacaggtggctgtgtgagacctggagttcaaatggaagctgtggaagtcaaatccaaagcactagggttgagagattcttaatctgatggggatttgatgggggggggggggtgtctctgggaagggtgccaagacagggcagttcgttctgggtggggccccacactggctaagctgctgcctcattttgacccaggaaggcattgtgacattacctagtcacctctgctttcaaaccacttggctcaaaccctctctcctacctaaagggaggggaaatgagtacactttaaaagtataaaagtaaccttgcatgtggcgcttcgtaacacagtctttacatttttacattgcacccccagcccctcccacagggctttcaggggcggctgattggctccagaaagtcaaatagtatataactaggacaatcagttcacatcttaaactttcataaatatcagggctaaaaatcaagctggtctggggatcatagcgtccttttgtaagtaatttctccagccttaccctctgccctgctgcaccgtgtttatgaagcccaccgggggaggtggcttgcagtaatagtcccactttacaactcaagggggccaaactgtaaagtggcgctgttactgccagagtggttaagacacagagcaactcgagtcgcagcccaccctctttgcgtccccaggccaagctgagcacagtggtcaccacttctgcatagtgtaagttttgggcagcttgtgtgttttctcctgttgctgctgtgacataacaccaccttggccatgtttttggacgcccatccgttgctggttgtacctacagagacctggggtggtattccatggtgggggcttgggtgccgaatcccagtcccagccatccctgtccatacagtgcactgtcgtgagtgaggatgaggaggaacggttggggagattctaccattcctttgcaagaatagatgcagccccatctgttcccccttagaacacccttgaagagaaggtgaatgggtccttgcaccattgagagcacaggctagccaacacccctgtaaagctcacccccacagctgactgccgtgaaccgctggcaatgcccccgagagaagcgggtgagcggtgctggtcaggagtgggagtaatatttgaagtgggttggggagaggaagaatgagatcagcggatgaggcgtgtgcttatttcatctagaaattgacttgtgtgcctcagctcagagttaccaagacaccagactcataaccctggtgatgagagggatcatttcagcgggccaagggctgacaccttaacctcgcagtggtcattaagtagttatcatttatattcattgtgtattagaaaaattgtgaccagcaaagcagttaatgagctatttcttgggctagagcaaaaataggaagtgatgttgggctgaggtgattcaaggaaaagccccaaggcccgtgataggccgagcacagggttcctggaacgagcggttttgcaagcgctggcctggcatgggaaggacacaccaacaatgaggagatgtctgtcgatgcttgcctgtgacagagggtgtgaagaggagtgtcagctggggtggccagcatccccaagggggtccctttgtgttggacaggaaatgggaacagcccaacccattggtttcacatctgtgcatccagcaaatcgagttttttgaagttttctctgaactcgtgtatgtgttaggaaaccttgcctttggctttgccacgcccctcttcccagcagcctgggtctgcctgggttccctgcctccctctggcctggactgtaggcccagagccccccaggagtgagggtcacttctgcccatcaaggacctaggctttctttcaacactcttgtctccagtccattttcatctccccggttggcctaggtgaatattggtgttatcccttcgatagatgacattttggggatatttggtcactttatcctatcagcctgccatttatttcaaaataatgacctcagcaaatgtttccataaagatttttaggtcagccccagcttggttgcatcttctgctgaaaggactatagtgctttaaaaaacgtagcattgacgccccatctttcttggttccctcttgcccccaaccataagaagggagaaggagaaagtcaggagtgtgacatgcacctcactctgctttacttgccactcgtcttcaatgtaccctccctctggaaagttctgtttctgagggttttgtgctaaccatgtgtgaggaccccagtctccaaagaagcagctgtcaatagcagattaccttgggcatggtggtcccacgcactccccagatcctgccttctcatggcgaccttcgggcttcattaatgccctcttgtctcccctcccccaggcgagtatagtgttggaaacaagcaccgtgatccctttgaagccccagaggacaaagatcttcctgtggagaagtactttgtggagaggcagcctgtgagcgagcctcccgcagaccaggtggcctcggacatgcctcacagccccaccctccgggtggacaggaaacgcaaagtctcaggtgacagcagccacactgagaccactgcggaggaggtgccagaggaccctctgctgaaagccaaacgccgacgagtctctaaaggtgagccctgtctgcttcgcccgcctgccggggggtgggcctttgcatgcggccacagtggatggacaggagatgtggatgtgcggcgcgctgcccccgtagacagagtcggtgaggggaagccgtgggggcgcagcagtggagcggacctctccattcccacactgcctcgtgaggttcccaccctggagcccccggggggagccgcccacacctcccctcccccaaagccagaacccagatggccaaagatgattaggccccttcccaaaagcagagaccagtgaccacaccccccctcccccaccccattagtgatgcgtaagacagtttgttcccccccggggggctttttgattaatttgtagttatttctccattagatgactggcctgagagggaaatgacaaacagttcctctaaccacttagaagacccacattatagtgagctgaccaacctgaaggtgtgcattgaattaacagggctccatcctaaaaaacaacgccacttgctgcaccttagagaacgatgggagcagcaggtgtcggcagcagatggcaaacctggccggcaaagcaggaaggaagtgacccaggccactcagcctgaggccattcctcaggggactaacatcactgaagagaaacctggcaggaaaagggcagaggccaaaggcaacagaagctggtcggaagagtctcttaaacccagtgacaatgaacaaggtatgcgggggccaccccttgagtgttcaccccgctcctggagggtgggtcatccactctctgtaggaaagggcttttgaggagatcttagaaggccatagcaattgacttcaacgaagatgtggcaggcagggagttctctcttgatgtccttgcccgtggttgcacaggaaggaagtctgaacaccttcattcc

SEQ ID NO: 1174 - DNA, 34561 bp, mus musculus; identical to SEQ ID NO: 1173

SEQ ID NO: 1175 - DNA, 83948 bp, mus musculus
ctgcggtgctagacagctgagagaacagacacagacctgtcggaaggtcctctgcaggtcccccttccgctctgccgatcgacttccgcctcgggcagtcaacatgtacgttgcggctgtctggcgaagctgcttctgagcgtttgcggaggcgcagcttcccctctgcggggccgccctgcttcccccccatccccgcctccccccgcccctcgctcctgtccctggggtcggcggacttctcgctacatgggggcgggcttccgcggtcggcgcacggcttcctgttctgaggcggcccggcggtaggcggtggcgactctgcccgctcccgtttcggcgcggtgaccgagcgcccgggaggctcgaggaccgcatcgtgtgccgttgcgccaagcccggtcctgcgccgccatggccccagtgcagctggagaaccaccagctggtcccgcccggaggcggcggcgggggcagcggcggacccccgtcagccccagcccctcctcccccgggagccgccgtggcggcggccgctgcagctgcggctagcccgggctaccggctgagcaccctcattgaatttctgctgcaccgggcctactcggagcttatggtgttgacggacctgtaagtgccccgaaacccctgcctgttccccagccccccttcccgcccaaccggctgagacgtttgcacctccctctccccgagaggctgctgtgttctccgctggactgcttagtctagaatttttgaactcctggggttcagcagaggtggagaagaagctttgtatctggggtcttcctggcaacgatgcaacagagacttgttaattttgcgtgttgttacacttccactgaaaattgtgtgaaatttttgtccgagttcccaacagaactctcttgatttcttggctggaatacataatattcgagcttttagaaaaaactctatagatgggaaatttgtattacagcctcttgacgatacgttttaaatgtaagctgttattgcttctaagttaatgcaggagctacatacgttgtgtataaaatacaaatttgaattcaaagtactttttttctggaacttttgagtgtttgaggtcttaatgaagttagtgtgagtaaaatttttttgtaagtagtctgttatttcttggagtatgaagggggtttataaatcacctagttacccatgaaatgccttggggcatgattaagttgttaatcccttcagaataggatcagaatatactaacgaatttcagtgtgtgaagaaaaggcaccgtaacattttgggactctgttgtacatcttataacccaggttcagaaaaagttaatcagaattttattttttatctattgcaagacttcagatcagggttatcaattgagatacattagtatgcagatattaggctctaaagcgtcacagtaatttgtttttagagactgataacagatacttgtttgcagatgactgaaagagtaggctctacttaactcctgtaaaacgtcattctcagttttgatgtattgtacttttttgaatgggacagaaaaaagtagtgttaaagaagcctacccatggctaatgagaaatttaaatcgctgtcaggtttagggactattataatgatatacctctctgcaccatttattgttggatttcataaaaatccaagaatatccatgagaaagtttcatgtatgtgcctatatagagctgtgggaaaaaaaatgttgaaaactgctgctatcggtggtgtaatttgcttttccataggggatttgtagaaattccttgaattgtggttgtctttttactattttaggacttggcttatgaagagaggaacatctgttttattgccgtagaataagtatgtagttatagtcccacaccctttatgtgatggttcccatatttgtatctccagcacagacctctctgatgaactccagactctatatccagatgcctacatttcagtatcttgatgggcatttcaacatagcaactccagcaccaaactcctgattccactgtcctccctcctgcagaaccttctttgctatctcactagtctctccattcttcctgttgttgctcaggccaaatattttggaataactcctggctcctctctcttcacatcctacatacatcagcaagtcctgttatctttgacttcagagtctgaccatttctcaacacttccaccaagtgctggtccaagccacctaatccttcacctgtgtactgcaatagtcagttcactggtatctctgtagttcccttgccccttctatagtttcttctccacaaaatagccaggatgattcttttaaaatttctctgcttagaacccttcgatggttccccatctcactgagattaaaaagtgttgataattgccaggtgtggtggcttatacctgtaatcccagcactttgggaggctgaggcaggggagggggtcacttgagcccaggagttcgagactctgtctctaccaaaaatagaaaattagctgggtgtggtggcccaagcctgtagttccagctacttggaaggtggaggtgggaggattgcttgggcccaggaggttcgcttgagcccaggaggttgaggctgcagtgagcatgttcgcaccactgcactccagactgggtgacagtgagatcctatctcaaaaaaaaaaaaaaaaatattgataatcatctgtatagtgaccataaaatttatagtccaaaccgggacacttttgagcataatggggctgatgataataatgtcagaacaagaggcataaaccaggactgtcttgggcaaaccagaaaaccagaacatgtggtcatcttacctttaaggccttacatgatgtgccttctctgttccttaaccttttttttttctccaacctcttaaccacttttggtttgtcccttacctctttaactgcatgtcctgaaactctcctctttgcttatcctgttccgaccacattacccttcctgatgtttcttttttatttttgagacagggtctcactctgttgcccaggctggagtgcagtgtggcacagtcatgctcactgcagcctctcgacatgggctcaactgctcctcctgcctcagcctcccaaatagctggaactacaggcatgcgccaccacgcccagctaatttttttatttttggtagagacaagagtctcactatgttgcccaggctgatcttgaactcctgggcttaagcagtcctcccacctctgcctcccaaacctttttttttttttgagacagagtctcacggtgttgcccaggctggagtgcagtggtgtgatctcggcttgctgcagcctccgcctcccgggttcaagtgattcttgtgcctcagcctcccgagtagctgcgattacaggcatgcaccaccacacctggttaatttttgtatttttagtagaaatgggatttcaccatgctgaccaggctggtctcaaactcccaacttcaggtgatctacccgccttggccttccaaaatgctgggattacaggcgtgagccgctgtgcccagcctccaaaccttcttgatgtttcttgttagtgcctagcacactgccatcttagagcctttgctttttccctagaaatctgtgtgaattgctttctcattagtcctttaggtccttgtttacatacaatttatcagaaagattttctctgaccacctataaaatagtactctgccccttcactctgtccttcttacttgctgctttatttttctttacagcacttattgccacctgacattattagtttgttgtccattcccaccccatgaggacagagattttgatttgtttgtgactttccctggtgcctagaacaatgcctggcacacagggcttaactaagtatttattgatttaatacatgaatgaatgaatgtttagaattgtcataaatcaatatatggtttgatagaagaaataataactagtgtttgataactcagtagggtgactagtttgcaagaatctactgtacatttcaaaatagctagatgagaataattcagatgtttccagcataaagaaaaaacaaatatttaagatgatggatatcacaagtacactgatttgatctttacaaattatataaatgtatgaaattatatgtactgtgaaactgtacatgcttaatgcatcaataaaaatattgttcaaaaagaattgtaaaccatgggaaatttaataggaaaagttatttttgttcttgatacacaggtatacaacttttttcacttttgattgtggtaattattaattaattagtttgggaacttaccatggaagttcctaaatagtgtattttccctaaaaactgtcaggattaatatgttaatgtagagccagtgttcgaggtatactttatgagtctttagggaaacagttacttcagtaatatgtgatgcttgtgtgtgaactattgaaggtaaaaaggacaaccttggcaacttaggtggttttgttttggtctcagatttctgggttttttccttctgcttgtccacctcccttccccctcaacatacatgctctcatcctagagtttactctctgccttgactttttagagacctaggttctactctttattttttttttttgagacagggtcttgctctgtcacccaggctggaatgcagtggcacaatcatggctcactgcagccttgacttccagggctcaggtgattctcccacttcagccttccaagtagctggactacttgccaccacacttggctaatatgtattatttgtagagatggggttgccatgtgtgcccaggctggtcccaaactcccggactcaagcgatctgcaccccacccccccgccaccaagcctcccaaagtgctgggattacaggtgtgagccaccgtacctgacccccccgcccccttttttttaaacttcttttaattcagaaaatgccaggatctcagtcatgtaatcttgtcttattgtgctttggtgtaaataagtttctatgccttacttcccaacatttgcattttagaacttttactctaaatggtagctttcttatccataaaagaatttcaaatagattaggaggaataggggaaaggggaggcaggcagcaaagcctgtcttttgtccctgaactgatactaccgctgacatgagatggttcttttagggtctctgaggcaggtaggaggagtgggaacaatgattcctgttctttctacccccagaaactctgctccccttctccccttatagatacccatcgttctcattctccccctcccttgaggtgaaaacaagggctgtggcttctcaaggagtgttctcaagaggtttggcttgtagaggaacttgccagtagctgcctttatttgcagtcttctaacagggccttaatttctgcttcatctctccggtctgctggcccttccagcccccacctagttccctttatcattctgaccataactttaacttccatctcaccgtctaccctaagagtaggaggtaactataagccagagatcattttaatattttctcctccttgtactttgaacctctggaagtagttttagtttttctgttcctgtggcacgtgggtgggagacaatctaaatggctgggtgtgtgtacttcaagaactgattagctgtgggagaggcatgagagttgtttaggccattgaatcttggactgtgggatagaggttaacagaatgtggcaattcaggaggcattaaggatctttctaggcatcagtggatgtgaatgttaaatggtatagcttatctgggaagaagttgacattggttgctggctatcagtattggaggactagcaaaaagaaacttaaaaatcctgttggagctgtttaaaagcaataaaaatttttcatctaaccaccatgcagcataattactgtaaaacccttgacatacactggtccttttgtatgcttagcttccagttttgtccaccataacacaatgtggagggattattgcttggaaacaggtatccattggatacagggaggctggcaaccaagtagtaagttcttctgcatctgtgaccattttggtcttaaaataatcttttctctgacaccctatgatatagtgtgctaatgtgggacttgggctttttaaatgtttaaggttcatgcaatacattttgaagtattttgaatggagaaaaatgttcttttgttggtttttgccttataaccatactgctggaaactcataaatctaaaaaagagtaggtagctacatgagcctgtagtagctgtttacccagtttttctgaaacattaacgtatttaatagagtcaaagtaaagactattatcacattagaatgaaggtatgcatgtatctaatccgttttttttttttcttcttagactgccaaggaaatctgatgtggaaaggtgagtatggaaaaaaaaaacccttaaagtctctttattgatcaatctatgagtgttggtgtgtgggtatgggtggtgtagggctgtggattggaaacctaggcccaaagagtctagaatgatttttcacaccatgtatttagggagtcctgggaaatgtaatttcctcacccttaacaatacttgttgtgagaccagttctaaatcttctgttctacaaacctttattgagtgactgacctggtcaagtccctaagggtgatattaagataaagaaggtatagtctgtaaaggaagatgctgaggagcagcagactggctttagaaagttgactgccacgggcatagtggcgggcgcctgtagtcccagctactcaggaggctgaggcagaataattgtttgaacccaggaggtggaagttgcagtgagccgaggtcacgccactgcactctagcctgggccacagagcaaaactttgtctcaaaaaaaaaaaagaaagttggctgctaatttatcacttgcaacaatgatgctattaagtatctttagagagttgacatttgcctactgctcctactgttacatagttaacattttggttcagttggagcttggagcttaagatttaacttaaggctaaaatgtttccagaggccaaaggaacaagcgaaattaaagtttcaaagaaatcatttgatggagatttaaattgtaactaaagtatatggtacttgaccgtatctttggcactacttatgctccttggttgatttttttttttttataccaaatcacttggcaactttttagcatttcttaatggcaacactccattgccaaccccaacttaactttttgatcgaattagagatcaagaaggtagaagtgaaagagacaactagggcaacctgtgttatggtttggctggtcagtattaaaggaggaaaacgttaagtcaaggatttgttctgtccgctctggggtatgaagggaaactgggcctttgaaaaactgactcatgttgcctagcacttgagacaacatggtgtcagaaaaccatgttactatagtttacaaagggggacatctccattgtagtagaggactgcatttgggaaaccgaattaatgatagacaagtgtgtttgctctgtgagaggagcagagaccttgcatcctctataagccattgctgagttagagtgaaaggtactgaggttcccagccctgagatctgctggatcttaatgtgtgtttaacatttctgctatgtctcagtcttgtcttatgatccttcgtagacactggcaaagagtcataattatgcccttgattcttctctttatagtaccactaatcatattgctggccgatttttaagagagccttttagggtgcttgtgggctatgtgtgctctcagtaggagctagcctctagccttcagtcaggattgtacttcagcaagaacttttactttggtgcattgcgtcatggtggtggtattggcaagatgcagagatgtggactggatctgcaggtcattgaacagctgtactaagattaataggtcagagtctacttggagggaggttggtgtcctgctgggtctggtcatcggtcctggcttgttgaatatttttttcagtgttttaaagtaaaccataaaagatatgattatcagttttatagctgctatgaagttgagagatctagctaacacgttgattgacattagtaaagcttttgggattttaggatgagataaaagtactgatgagtattaggggaaaagtaataatagtgagtataggataaaactagatatggacagaccttttatttttagtactcaacataatttctttagctttgcttggatattttttaatgtatccaagtttgtcattgaaattagtttggtaaagagttacatagttaagttctttaattgctcaatctttcatgctggtgcaggatgggaactggtgcccttttgtagaatgaatacagtttcaggctttggtaaagatcagtttcaattcctttcacttaccaaaagggttactaattacttactaattaaattactcctaatttcagttatgaacttataattcataactcctcatttaatcccttctgtgaagcagtttacttctaccaccatatactgaatttagtatatttttgtaaacaacttttattacaatataaaattaattttaaaatgtgacttattgctaaaacattctattgggtttattgctctgaggtgaaaaagcatatgcagataatatacaaaatgtgacaatagttcatatttagataaatattttaggtggctcattttgtagtggttgtaagcaaaggctgatttatttatttatttatttttgcttagctgaaataaattgtgaaatactgtttctaatatgttggttcattaagagttgttttattttataggaaaatagaaatagtgcagtttgctagccggacacgccaactcttcgttcgattattagctttagtgaaatgggctaataatgctggcaaagtggaaaaatgtgcggtgagttaaactttttattttactttgtataaaataacttttcgaatgttatgatagacatagttttacattttagctttaacttatccctgctgatttgagtgacatgtgaataatcatatttctgaatgataatgtatatttctgcagaaacttagtatttgtttatggacacctgatcagaaagaagaggagatagctggagacatcattacgtgaggagactttaaatatgagactggaactaaagggggaaaattgttagtttatattcgtgctattccttagaatttgcaaggttctcccttaaattttgcttatgaattcttgacatcctgtgagaatggcagagttggtttttttttttttttccagttttacagatgacaaaatgataaggttcctagaagttacatggcttcttcaaggtcacagaggctgataacagcatttttctgtttgtttatctactaattctctaaacctctaataagcacagggtatagggcacagaggatggaatcttcaataaggaatagtccctgccttcgagaacctcatggtcttttgactgttgaatcactctttggaatgcaaagtgacatgcagtgcagtgtaccaaagatgctaaaatctaccaaaaataaagttttatgctatgttcaagaagcgttaaggagtaaaaacttgattgtttttcagattgttcactattggcatatagaaatactactgatgttttgtatgttgattttgtattctgcaactttactgaatttatcagttctaatagttttttggtggggtctttaggcttttccaaatataagatcatatcatctgcaaacaaggataatttgacttcttcctttccaatttggatgccctttctttctttcttttgtctgattgctctagctaggacttccagtactatgttgaataatagtggtgaaaatgggcatccttgtcgtgttccagatctgagaggaagggctttcagtttttctccattcagcatgataattagctgtgggtccgtcaaatatggcttttattatgttgaggcatgttccttctatacccagttttttgagggtttttatcatgaagggatgttgaatgctattacatgtgttttcagcatcagttgaaatgatcacatggtttttgtttttcattctatagatatgatgtatcacagtgattgatttgtatattttgaaccatccttgcatccctgggataaatcccacttggtcatgatgaacgatctttttaatgttttgttcaatttggtttgctagtattttgttgagaggatttttgtattaatattcatcagatgtattggcctgtaattttctttttttgatgtgtctttgtctggttttggtatcagggtaatactggccttgtagaatgagtttggaagttttccctcttccactattttttggaatagtttaagtaggattggtattagtttgtctttaaatgtttggtagaattcagtagtgaagccataaggtcctgggcttttatttgctgggagacaaattataattaatataatgaattatagctccattcttgttacttgttattagtctattcgggttttgaatttcttcatggttcagtcttcacaggttgtatgtgtctaggaatttatccatttcctctagattttccaatttattgtcatatagttgcttacagtagccactaatgatcctttgaatttctgtggtattagttgtaatgtttcctttttcatccctgattttattcatttgggtcttctccctttttttctttgtgagtctgggtaaaggtttgtcaattttgttcattttttcagaaaaccagcttcttgtttcattgatcttttgcattgttttcttcatttcaaattcatttatttctgccctgatatttattatttcttctaattttggtttcaggtttctcttgcttttatagtctttaagatgcatcattaggttatttatttgaagtttttcttcttttttgatgtaggcacttataactataaatttatctcttagtgctgcatcccataggttttggtgtgttgtgtttccattatcatttattacaataaatttttaaattttcttcttaatttgttcattgactcaccgttcatttgggagtgtattgtttccgtgtgtttgtatggtttccaaaattcctcttgttgttttctagttttattccattgtggtcagagaagatgcttgatattatttcagtttttctgaatgttttaagacttgctttgtggcctaacatatggtctgtccttgagaatgatctgtgtgctgaggagaagaatgtgtatcctgcagcctttggataaaatgttccataaatatctattaggtttatttgttccacagtgcagattaagttccatgtttctctgttgagtttctgtctgggagatccgtccaatgctgaaagcggggtgttgaagtctccagctattattgtattgacattttgttctttaataatattagtatttggtttatatatctgggtgttccagtgttggatacatatatgtttacaatcatatccttttgctgaattgactcctttatcattaatgaccttctttgtctcttttcatagtttttgtcttgaaatctattttgcctaagtatagctactcctactcctttttggtttctgttgacatataaatcttttcccatccctttattttcagtctatgtatgtgtgtctttataggtgaagtatgtttcttataggcaacggatcattgagtcttgttttttaaaatctattcagccactctgtgcctttttattagagagttttgttcattacattcagtgttattattgataagtagagatttactcctgccattttgttgttttctcattgttttgtggtcttctcttttttccttccttcttgtcttcttttaatgaaggtgattttctctggtgacatgatggaatttcttgttttttattttttgtgtccattgtatttttttttttttttttttttttttttctgagacggagtctcactctgttgcccaggctggagtgcagtggcgcagtcttggcccactgtaacctctgactcccagattcaagcgattctactgcctcagcctcctgagtagctgggattacaggtgcatgccaccatgcccagctaatttttgtatttttagtagagatggggtttcgccgtgttggccgggctggtcttgaacttcggacctcaggtgatccacctgcctcggcttctcaaagtgctgggattacaggcgtgagccaccgcgcccggcccattgtatggtttttgatttgaggttactatgaggcttgcaaatactgtcttttaacccattattttaaactgatgacaacttgacactgattgcataaacaaacacacaaaaagaaaactaatgaaaactctgcagtttaactttatctccctcctttttaacttttttgtttctctttagttcttattgtcttcaaaagttctgtatcttcaaaagttgttgtagttacgatttcctgttggtttaccatttagtctttctactgaagataggagtagtttacatagtacaattacagtgttataatattctgtgtttttctgtgtgctcactattaccagtgagtttgtaccttcagatgatttcttcttgcttattgacatatttttctttcagattaaataactccctttagcatttcttgtaggacaggtctgatgttgatgaaatctctcatcttgtttgtcagagaaagtctttatttctccttcatgcttgaaggatgtttccaccggatatactatcctagggtaaaagtttttttccttcagcactttaaatatgtcatgccactctcttctggcctgtaaggttttcactgaaaagtctcctaccaaacatattagagagcaccattgtatgttatttgtttcttttctcttgctgcttttaggatcccatctttatccttgacctttgggagtttgattattagatgccttgagtcgtctttgggctgaatctgcttggtgttctataatcttcttgtactttaatgttggtatctttctctaggtttgggaagttttctgttgttatccttttcaataaacttactgcccttatctctctttttctgcctcctctctaaggccagtaactctgagatttgttcttttgaggctgttttctaaatcttgtaggtgtgcttcattcttttttgttcttttgtcttttgtctcttctgactgtgtattttcaaatagcctgtcttcaagctcactaattctttcttctggttgatcaactctgttattaagagattctgatgcattcttcagtatgccgattgcatttttcaactctagaatttctgcttgatttttaaaaaaattatttcaatctctgttaaatttatctgataggattctgaattcattgtctgtgttttcttgaatttctttgagtttcctcaaaacagctattttgaattttctgtctgaaaggtcacatatctctgtttctcctggattagttcctggtaccttcttttgttcgtttggtgaggtcctgttttcctggatgatcttgatgcttttagatctgggcctcaaagagttaggtatttattgtagtctttgcagtctgggcctgtttatgtctgtccttcttgaggaggctttctagatattcaaaggtacttaggccccaagctcaataatgctgtggtttttgccgactcatagaggtactgccttgatggtcttggataagatctggaagatttctctggattaccaaccaaaggctcttgttctttttccttagtttcttccaaacaaacaaagtcttgctctttgtgctgagccacctggaactgggggtatggtgatgtaagcacccatatggccaccaccactaggactgtaccagctcagacctgaagtcagcacagcactgggtcttgcccaaggctcagtgtaaccactggttacactggtaacctggctaccacttaccttcactccaggccctagggctctatgatcagcaggtggcgaagccagtcaggtttgtgttttttgggatggcaagtttccccaggctttgggtgagcccagagatgctgtctggtggccagggattagagtcaaaaaccttagtaatttgcctgatattcttttcttactgcggctaagctggcactcaaaccacaatacgaattccttcctgcttttctctcccctttccacaggcagaggagcctccccctttggccatcaccggctcatgggaggggttctgcaaggccaccactgatgctcacttaaaatctaagggttcttcagtcagcttgtggtgaatactgccaggcctgggactcatctttcagggcagtgggcttccctctggctctggggaggtccaaaaatgcagtccaagagcctaggcctggacttggggaccccaagagcctgcttggtgctctaccgcactttggctgagctggtacctaaggtgcaaaacaaagtcccctttacttttccccctgcttttctctaacagaaggagtctttcaccatagccaccacagctcggaatgtgcttggtcacacctgaagtcagcacatttcagagcccaaggtccacggcatactacctgggtatcgccgctggttattcagggcccaagggctcttttattcagcaggcgatgaatcctgccagggctgggtcctttccttcaaggcagcaggttcccttctggcccagggtgtgtctttgtcatctgtgagctagagcctcgaataggggcctcactactctgcccggtaccctgtcctactgtggctgagctggtatccaagatgcaagacaaagtcctttttactctttgctctcctctcctcaagcagaaggaaggagtctcttttgttgtcaaaagctgcgctgcctggggtttgtggaagggtggtggaagcactcccttaggccccccagcgggtgtatccctaggtcatgtgccacctagtcctctggctctgagtccagcctagcactaggagttgcctaggaattgcagtgcttgtgtcctagacagcctttcatgtttacctaggactccagagtactttggccaacattagcaaggcttgctgagaaactcaagttccaaccgctgcgatgggcaattctctagccaaggctggtccaaatgctccctctggcccagcacagctttgctctccactatgacagggcagtactgagttcagtgtaaagtcccccagtcactattctctccctcccttaagtgcagggcctctgttggggtggcaggggaggggtggtgtcagggattcaagactgcctctcctgccctcctcaatgcctctttcagtgatatgaagttaaaaccaagtactgtgattgctcacctgatttttggtttttgtaacagtgcttttctgtgtgcagatagtaaaaatttcgtgttcctggagagggggtgactggtgttggcttgtattccaccatcttgctctgaccctctcagcatttttgttttctgaatgtagatacagatgtgtttatgtcagggataaagtccatcaatgagaattagagggattgttcatgtttcagcacttctgttctcaacctaatgattatttaactagtttgttagagattcttgataatgatctttagccatgccagatgtgttatgagtgtatagatccatagtttatggaactctgactaatggtaaaacaacctggataatgttttgcctaagaaaaagataaaatatctctcattctcctagatatttttttcagtagctttactgagatataatttacataccatactattcacccacttaaagtatacaattcagtggtttttgttatattcacagatatgtgcaaccatcatcacagtcaattttagaacattttaatcacctcagaaagaaaacctgtgccctttagttaccaccccagctctcctctagccctaagcagccactaatgtactttgtttcaatagatgtgcctattctgaacatttcatataaatggaatcaaatgtgttgtgttgtgattggcttctttaacttagcatttttttttttagtgtagtattttcaagattgattcatgtggtagcttgtgtcactacattcctttttatggctgaattgcatggatatactacattttgtttatctgttcatcagttaataggcatttgggttgtttccagttttggattattatgactaatgctgttgtagatagtcatgtccaactgttgggatgtatgcttttatttctcttgactgtatacctaggagtgggatggctaggtcatatggtaactctttgttgaactttttgtggaactgccagactattttacaaagtggccacaccattttacatttccaccagcaatgtatggaagtttagtttctccacatctatgccaacactggttgttacctgactttttgagtctagccatcctagtaggtatgaagtggcatctcattaaagttttaatttgtattttcctgatgaccagagatgttgaacctgttttcatgtgcttattggccatttgtgtatcttgtttagagaaacatttatttggtgttaaattctaaaggagattattattaaacatattcacagctggtgtgtgaatacctaaaaataacatggattagttctttgtgaactaagactatgtgaatggattcactaatcagttactcaaaactcaagttttatcttttatttatttattttaagacatgaagtctcactctgtcacccaggctggagtgcagtggtgtaatcacagctcactgcaacctcaaacttctgggttcaagcagccctcccacctcagcctccctgagtacctgagaccacaggcactcacactactgtgcccatctaatttttaaaaagtttttatagagatggggtcttacttggttgcccaggctggtttcgaactcctggcttcaagcagtcttcccgcctctgcctcccaaactgctggggattacaggtgtgagccaccacacccagccaagttttatctttattaattgtatttctaagttcaaggaatgtagctgaagctagtgtattttgagttcagtgaagtagtttagagagtgtttcattaattgtttatgtttaagtggagtgataggggctggataaactgtggcatcccagtagggttgatgcatgtctttctgccggggaggtctttggtactctttgagcttgaccttggtctgataagcatttttacagtgacctgagttaagggagatgtgagatggcctaaatctgagtaaaagccagttaaaaagttgagaatgtattagcagtgtcatgactgttaataagaagttagtgttggtggcattgatagaaattcattgtactagtcatagaaggtagcatttttactggaccatgctgtatattgggtctaactaagaattagaagaaatatttttgttgttgttgtttcagctcttctgattattgactttctttgggcaagtgtcttaacctaagcctcaattttctcatctctaagatcatagtaattatctggttgtacttcctagagttgcaaaaatcaaataaaatgtttgaaaacactgagaaattgtagagcactgtgtttgtgtgatgttggtattaattctgggtactatgttttaagttggccactgacagcctgtttgaaggacatgagagagaaaactttaagtgttgttctagaatagaactagaagatggccgggtgcagtggctcacgcctgtaatcccagcactttgggaggctgaggcgggtggatcacctgaggtcaggagttcgagactagcctggccagcatggtgaaaccccgtctttactaaaaatacaaaaattagctgggggtggtggtgcactcctgtaatcccagctactcaagaggctgagccaggagaattgcttgaacccgggaggtggaggtcgcagtgagcagagatcatgccactgcactccagcctgggcgacagagcaagactctgtctcaaaaacaaaacaaaatgaaacaacaacaacaaaaaaaccatgaactagaagataaaggttttagggaggtagtttttagctctgtgatgagctctactagtttaggtatccttatgaaatgcattgggtagaaaactgatggaaaggatttctgtattgggcatgaagttgacctgtatctcataatgggtgttttggagtgttttctatgttctttctaggcactgttctaaaggttttttatgtgttaactcttttttttttcaattgatatatcatagttgtacatattttgagggtacatgtgatattttgatacatgtacatagtgatcaaagcaggataattgggatattaattacctcagacatttttctttgtgttgggaatgttacagttcttctcttctggtcgttttgaatatacaataaattattgttaattataatttccctactctactattaaatactggaacttattccttttaactatatttttgtaccaacttttcttcatacctcctccccccttcccagcttctcctaaccagcattctactctctacttccatgttatccacttttttaactcccacataggagagagaatgtgcaatacttgtctttctgtgcctggcttatttcacttaccatagtgaccttcacttccatacgtgctgttgcaaacggcaggctttcattcttttttatggctgaatagtattccattgtgtatatgtactgtattttctttattcatctgttgatggacacttgggttgattctgtatcttggctattgtgagtagtgctgcagtaaacctgggagtgcagatatctttttggtatgctgatttcctttctcttgaatatatatatactcagcagtggaattgctggatcatatggtaattatatttttagttgttagtggtttttttttttttttgagacagggtctcattctgtcacccagactggagtgcagtggcacagtcatggctctttgcagcgtcaacctcctgggctcaagtgatcctccctagtagctgtgagaccacaggcatacaccactatgccaggctaatttttttgttttttaattttttgtagagacagggtctccctatgttgtccaggttggtctgcaagtcctgggctcaagcaatcctcctgcctctgtctccccaaatgctaggattacatatgtgagccaccacacacagcctatttttagtttttttttgaggaacctccatagtgttctctgtagtggctgtagtacttcacattcccaccaacagcgtgagggttccccttcttccacatcctcacaagcatctgttattttttgtctttttgataatagtcattttaactggggtgagatgatatctcattgtggtttttatttacatttccttgatgattagtaatgttgcattttttcataataccttttggccatttgtatgtcttcttttgagaaatgtctattcaggtattttgctcattttttaaatggagttatttggttttattttgctattgagttgagttccttatgtattctggatattaatcccttgtcagatggatattttgcagacattttctcccattctgtgggtggtctcttcacactgttgattatttcttttgttgtgcagaagctttttagcttgatataatctcttttgtttatttttgcttttgttgtctgtcctttttttttttttttttttttttttttgagacggagtctcgctctaccgcccaggctggagtgcagtggcacgatcttggctcactgcaacctccgccttccgggttcaagcaattctcctgcctcagcctcccgagtagctgggactacaggctcgtgccaccgcgcccagctaattttttgtatttttagtagagacagggtttcatcatgttagccagaatggtctcaatctcctgacctcgtgacctgcccaccttggcctcccaaagtgctgggattacagacctgagccaccgcacccagcccaggccaatgtcttagagcatttttccaatgctttcttctagtagtttcatagtctcaggtctcatgcttaagcctttaattcattttcagttcatttttgtatagtgtgagagatgggggtctagtttcattcttttgcatatgatggttatcgagttttcccatcaccatttattaaagaaactgtcctttccccagtgtatgttcttggtgcttttttggaaaatgagttggctatgtgtggatttctgtgttctctattttgcattatctcttaatacagagaacaactttatgagattgggaatcatgatcacctccattttacagttgaaaaaagctgaggcacaaagaggttaagttacttgcccaaggttacaagactggtaagtagcagagttaaaatggagaacaaggcagtctaggtctaggagtccatgcttttaactccttcattaccaaccaactctggaagtctgtaagaggaaaaaaccattttattctacttatttttcctaactttgatattatgtgtgtgtaatgttaaggatggagaaatgaattagaaagcttttacttaaagtgacagaaaattattgctcttaatatcaaatactagtgtattaaatatttcttcttcaagttactggagaatatttgaagaactactttgaaatatggaaaactgatactaattccccttgaagtttactttggaatgatttaacaatatttagtgtgaaaaggagatagttttcagggatgcttaatacatttaccctttactttaaagatgatttcaagctttttagatcagcaagccatcctgtttgtggacactgctgatcgcctggcctcgttagctagagatgctctggtccatgcacgcctgcctagttttgccatcccatatgccattgatgtactaactactggatcttacccacggctgccaacctgcattagggtaagttctttgcttgcccccatgttcctaaaaactaaaggttttggcactggattggattgtattattaagtagcccagcaaaaaacattgttaaaacaaacagtacatatagtttgctttttttctctgtaactaaagttgtgcttttttgaaataagttggggccagatgtgagtagatatcaaaatgggtgaaggttttatttttttttcccccagggatgcgcggatgtgcagacataacatctatttcagatgtgaaaatgctacatgctagttgctttttgaaagtgttttaaacttttattgttttggtagtttactgacttggtgccatattgtattttatacttgtaagaacttgtggaagctatcaagtgatatttagttggtttataaatagagcattaagggaggtcatgttgtattatgatcttagctaaatgactagaatcattgttgctcttatgcatgatagtaatggccattgtttttgtaagtagactgcagaaatgagtgttaagattctcttaggtaaagtacgcaacactgtataaagacaggaaaagattgaaaaaaaaaatccccgtttgtacattatttaaaaatcacttaaatttttttgcaggacaaaattattcctccagacccaattaccaaaattgaaaaacaagccacactccatcagctgaatcagattcttagacatcggcttgtaaccacagatcttcctcctcagttagcaaatcttacagttggtatgtatctgaaatttatttttttaagagttgatggccaggtgcggtggctcatgcctgtaatctcagcactttgggagactgaggcaggcagatcacttgaggtcaggagtttgagaccagcctggccaacatggtgaaaccccatctctactaaaaatacaaaaattagctgggtgcggtggcccgcacctgtaatcccagctattcgggtggctgaggcatgagaattgcttgaacctgggaggcagaggttgcagtgagccaagattgcaccactgtactccagcctgggtgacagaatttgcatgttagaatattttcctaaacagctttttgggttttattcaaggaaaaatagcatcatgaagatttgactgacagttttatggtgtttgattctacgacttgccagctgtatcatttctctttagtacctagaaatacagtgctggtatttgcagcttgggagtggggctggaaagagagaagagtccccagagttgtgcctcaagaaaatattgttcatttatgttagaagagttgcctttcatttcttgacctggaagctggctacttcttattcaggaaccattgaattgttggaaccttatgaaagaaccttcaatctatttaaaaatttttataagtaagactgaaaattctaggtcaggaggaagattctcattttctagcaaagtacacttctttttcttcatctttttcttctaaaagcaaatggccgggtgaagtttcgtgttgaaggagaatttgaagccaccttgactgtgatgggagatgaccctgatgttccatggcgtcttctcaagctagaaattctagttgaggataaggaaacaggaggtaaatcataagtagtgatttaaatcataagtattagtttaaatgtttgattttttatattattgaaatattcccggctggggatgatggctcatgcttgtaatcccactactttgggaggccaaggcaggtggatcgcttgagctcaggagtttgagaccagcctagacaatatagcaagaccctgtctctacaaaaaatttaaaaattagccgggcgtggtggtgtgttcctgtagtcccagctacttgggaggctggggttgggaggtgggaggatcacctgagcccagggaggttgaggctgcaatgagccatgatcatgccactgcactctagcctgggtgacagagcaagatcctgtctctctatatatatattcctgcaaaataataaatgcatgcagcaatttatcctgtaatttgaagcaagttttataattgtaactgcctgttgaccgtggaagtttcagtgtttctcagagtacaatgtcaagtttctgtagataatttcagtgctttttaaaaaaattcattgttattatgtgcttccttagttggtatagtgacacacttgtacacctatttaattaactgctttcttttcttctgccaacggaagatgggcgagctttggttcatagcatgcaaatcagcttcatccatcaactggtgcagtctaggctctttgctgatgagaaacctcttcaggatatgtacaactgcctacgtatccttctgaaatttgagacatatatttgtaaggattttgtggtacctctcccacatttttcatttgtccttagtcttgaactgtagcagcctacattccttgcccccatctcccccaccctttttgaggtgcagatagggctggagaatagtgaagaatagtgatatgtttgtaataaaccaaatttaaaattttactgttgactttgcaggtaaaagcaaaaagtgattagttaaaaatagtcttgtttgaggctgggcacggtggctcatgcttgtaatcccagcactttgggaggctgaggcgggtgtatcacttgaggtcaggaattcaagacctgcctggccaccatggtgaaaccctgtctctactaaaaatccaaaaaaaaaaaaagaagcctggtgtggtggcgggcacctgtaatcccagctactagggagcctgagacaggagaatcgcttgaacccaggaagcagaggttgcagtgagccgagatcatgccactgcactccagcctggatgacagagcaagactccgtcacacacacacacaaaataataataataaaaaagtactgtttggtgaaaaaaatagtactatttggtcaatccatgttctctaaactatgatgaattaagacacaacccagactttatggttttatattggtttaaaattaaatataaaacctttttctgaaattatgctataaattataatactttttacgatgaggcattggagaaataatcatttcagaaattttcttcagaaatttttctccaggttttcaataagagaaccttccttaaatgaagttctcctggacttgattgactgttggtgtaatgtattaattttacttaacaacatctatcagattctttctgtttatcacttcagttagaagtgttacattcccaaactctaatgttaatccgagaacggtggggagaccttgtgcaggtggaaaggtatcatgctggaaagtgcctctccctttcagtttggaagtaagtaaaatcagttctggtgggttcgtgctatgactgtaaatactctttttatttctctttttctctcatacatctgatttaatatacagttgacccttggacaacacaagcttgaattgtgtgggtccacttatatgcagatcaatttgcaagatgtgaaacctgcgtatagggccaaccttccctatacgtgggttctgctggctgaccgcaggactgactgcaggacgtgagtttgcgtggattttggtattgggacgggaatcctggagccagtctcccaagtataccaaggaatgactgtataccaatagctatgcacctctagtaacatgcttttgtgtagtaaggtcccatagtattatgtagaccacataggacatccatagttgacacctgtcttagaacatgttttaaatacatagacatttacctgtttgtactaagacttactattcttaaaaagtttgagaggttagtttactttgggtttataccaaatagctaaaagaccgttaggttagaaaagaccattaggttagattgttgggtatcattttttaaaacatgcatgcttatcacagttttccactttgaattgtgcctgttaaaaactttctttgggagaaaattcctattggactgtttgtaactctcaattccctgtttgaactttacttgattcctgtttttctccccaccccggcatcttattatcccaaatgacccccattttctgtaaaggagtcagaggtgagtagatactacttagaagacaggtagtttttgttttggggttctttttcatgtgtgcatatgttttatttttaaattatatgtcttttttaaatgcaataaatcaaatattgtattggattacagaatagctatcttcccattattattccctccacaaacactgggggcctgccgtattccaggctgtggctaaactgcacaatggattgtctctattttattctagaagttaacagactgtgttgaaaaaaattcttcatttcatttttttctttagtcaacaggttcttgggagaaaaactggaacagcatctgttcacaaagttacaattaaaattgatgagaatgatgtctccaagcctttacagatttttcacgatcctcctttgccagcttctgattccaaattagtagaaagagccatgaaggtaaaagatctcaatatattttcatattggtttaaatgaatgtaacttgccatttatccttaaactcttagcacaaatttttaaaaatatctaattcttcctaaaaccttttatgaaacttattttaagtaaatgttacacttcttacatttgtttttttaaaacatctgatactataatatataatttttaagatattctttcatattttataatttagatcagataccattttaattttaaggtctggcattagagcaccataactgatttgtaatatcttctcctattacttaccaaaatgttaactatagtttttaagctatcaattgtaagttaatttttaactcaataccatattagttaatttttaactttaagtttgctttctattagggttaacacttaatcagtgtgattccaaaaggaaatattttgaagcacagtaatctactcttgggcttttaaagtaaaaatgtttaaattgcacatttgaatttgttgttcttatttatgcagatcgaccacttatcaatagaaaaactcctgattgacagtgtccatgcaagagctcatcagaagctccaagaactgaaggccattcttagaggcttcaatgccaatgaaaactgtaggttcttttaaattgacatttgtttttcttttgtttaaactagaatccagttttatttgatgagaatcttaatatgactttttcttgatattttgcttttattgtggaagctggtatttctgcattttaacttgtgatctgccaaacttatgctaatttttcccttgttacttatttagcttggccttatttttgaaatatttgtgtattggatttccttaaaactttatgaaatggggctgggcatggtggctcacacctgtaataccagcactttgggaggccgagatgtaaggatcacttgaggccaggagctttagacaagccagggcaaaaaatgagaccccgtctctatttataaaattttttaaataaaaaagaaaaactttatgaaacatgagctaacattttaatatgaaccttatttttaaacttttttctagtgataaaacagcattccaaatatttataatatacttgtaaaatatgcccctttgagtgaagcagaattcatcccttgtctttttaaaaaatttttaaaaattattaacagttcaaataaggaatgcagatacatggacatagtgaaaaatcttccaagtttaattacctagtaagtatattcagagctttgagggacagtcatttagaaagtaaaccctttcattctgggaatataggttcgcaacatcataatgggcatatttactatccctgccccaattgtttttggccataattaccttgtgcccacagtgcacagtctttaattaagttagatgacgtaagtgaagtgccttataagtaggaagtcttaatagtgctagtaacgaaggtgctgccttttgtcatcacagagctcagctcaatccattatacttaaagaagcagcttcttaggtatgtactagtaactctggattaaaatcactttgacagaaatagattttaaaaaattgcctgaaggaaagacagaaagttagaaaaataagtgtgtatttagaatacatactcattcaaggaaagtgaaaagatagaggtgaaagaggggatctaagataaaccaaagcattagcttatatttttaaagagactaaggagaggggcagcctaacttaacaaaaatgcaaatatgggccttaaaaaagaaataaaggatctgccagaaatttggtgaatgtattggttagatgtgtcttgggggtgcctgtccattagccctatcagggtttaacattagctttatcagtacttcattatcttaatttaattaaaagcttcagtagaaggccctcccctttaatccctcaagcaaagatgttaaatacagacctaaaaattatgattggaaagtataattgaaactctcactggaattagaaaggctactaaccaccactgccttttcgtctttttttcttaacagctttattgagatataattcacatataattacctcattcaatggtttttactgaaagagttgtgcaactatcaccacaatttgattttagaacattttaatcatcccagaaagaaaccgtgtacccattagcagtcacaacccattcactcctctcccttcctgcctcccttttggcaatcattaatctactttctaactctatagatttgcctatttggacatttcatataaatggaatcataatgtgtggtctcttacatactgtttttaacacattttttttgaggttcacagcatgtttcaatacttcattcacttttattgtcaaataatccattgtatggctataccatcttttgtttatccattcatcattgttgaacattggggttgtttttcttttttggctattgtggataatgctgctatgaacattcatgcccaagtttttatgtggacgtaagttttcatttctcttggctgtacacctaggagtgtaatggccgggtcttgtaactgtttaaccttttgacgtgtttaacaccactttacaatctaaccagcaatgtgggaaggtttcattttctccacatcctcaccaatacttgttattgtttgcattcttttacgtgaggatatgcagttatctcagtaacatttgttgaagactattttctcctgtttaattgtcttgtcacccttgttgaaattccccttttgttcttttttaagaaatggagtctcactgtgttgcccaggctggtctctatctatctatctatctatctatctatctatctatctatctatccatctatgtatctattttaagtccatggcctgctgaacaggctggtcttatgctcctgggctcaagcaatcctaccacattggcctcccaaagtgctgggattacaagcatgaaccaccatgtccaactcttttgttcttaaagaagactttaagtattttgcaatcttaatttttctaatttttcaaaacttcgtttgttgagattccagaaaatagggagtttgtaatcttttgataggctctggtttactttagtatcatctgtaagcaaggcttagtaagttaaaaaacagaacaaaaacttagtaagttaaaaaacagaaacaaaaaactatgattgccaagggatagttaaattactttgaaaaataaactcaaagcatacgtttacataggaatggttttgtgtgctgttcacctaggttctgaagatttctaaagagaaatttagagaaatcttcagaacccaagtgtaaaattcctttttgtagaaatgttagagatctgagttcagctgtctgctcttgaacaagtcatttacactatttgggccattctcctcatctgaaatttgaggatattataatagtccaggctcttcctagatcttaaactctagtaggaatgtgctacaccagtggttttcaagccctaggtgttttgtagagtcccaggtgttagagaagggtgacttagggactataatttggaaggaagggagaagcttgcatgcggggttgatctcctcagttctgctttaatcaggacagttctagaaatgaggactgctagaggaaagggtctgccgacccaccatcttagggcatgtgctttaacttgttctttaaattcatgtgcatgcatttatactctccatgtagtcttacttgatccttttttgtgatgggcgagcatgctttattaagatccttactgggatgagggactacatagtctattcttagaatcccttagcgcagtcacccttaaatcagctggcttttcttctaacacctaactggaataacccaaggaaatgagtagctcagagagtggagcatttcaagggaaggctaggggaaggcatagacttcaggttttgagcagctcaggcatgtggtttcgtgggggtagaaatggtttaggggagaggaggcaggactttggagataagttccaaaaaagcagtgcaaggtactaaaggtaacttgagatatggcccagttggcagcattgcctaactcttgaaagccagggtgctgctcccttatgttgtactctacccttcagcacttataatcagggcatcatgatcagtttggaagctatgaaccacacacagccattcctaattgagcttagttgccgctcttcactcttcacactttatattctgtctgttatccattctcatcttgttctcaataaatgatagaaataaaaggagatatatatatgttctggcaggacgaaatagcagcaagtcctgtcatcttacactgcttttaattccctcttctttattttctttgcaagtttccccatttttgtatacctaaaacctgttgcctttaaatgctttagggcattgtgtattttattttctgtaaagaaaaatatggacattggtagtcaaaaaattgtacatcgatttgtatcagagtatttcttgtcttttgaactgtgttatctgtattcttctctgatgccctatttttctaagaatactcaattgtggtaattagattgaaattataattgttaccccaattcccagaactagttttactctgttgccacgctttagaaatggttttgctttagagaattcactcctaccctgtcaggaattgtgacactatggaaatgtttcaaaaatcagcaactctgtttcacatttgtaataactttttattaacatagtaagttcagcaaaatgtcactgatttgaactaatttgtcacattggtctgaattatatggtaaaagaaatttttgtttttgccctttttgttctgtttttttcaggtcagagttctgctggatttgcatgttaaacattttgtatacaaatatgtattagatgtacaggttgagtatcccttatctgaaatgcttgagaccagaagtatttcagatctcggattttttttgggttttggaatatttgcatttgtacttactggttgggcatcccaaatctgaaaatccgaaatccaaaatgcttcattaagcatttcctttgagcatcatgtcagcgctcaaaaaattttggattttggagcatttcaaattttggagtttaggatgctcaccctatgttttaaagcaatttatttctctctaattaaatatgtcttctgcaatcttttactttattaatttgtttgataatttgtgtagacagtaccaatggtaatgtcatccatttgaattattgaaaatttatagtaaaaggttttggtttgtttctttgattcaaaaggaatatagataatatacatttgtcaaacactttgctttttaaagcacttttacagccttgtcatttcttgctcctaacaacctgtggcatggaggggaagatgttattttccttgtttgacaaaaaagcaggcagaagccacgcctggtgaaaggcctgcatcgccactcccctctgcgcctgccacgttacctctccttccgagcacctgcatcaccattctcctctgtatctgccttttttttctgtgctgtagcttcagaggaacttggtaacaagaagagcatattccttttacaacccctcaatctgatcagcacttagtgtgttttcagtgttttgcttgtttactggatttcattatgtcacttgcagaattaagagaaaagttaattgggcctcgtggaaatactgtgaaactctagatcaggcatattgtcagctttggggatttgtgtttagcaattgcctatgttcttaattcatctgtgacttgaaatggagtatacaaatgacttgaaaaaaatttttcttcctgggtaatcaataatatttattagtttaaacacatgggctctaattgccagaatacctcttttttatgaggaatggcattgaaaatcatgaggccatagaagatatttattctgtttataaacaactagttttctttccattatacaaaagagaaaatccttaaaaattaattagcttattagtaattaccaagtgaaagtaaaactagaactcagctcactgatgaagttgaattttcactagctatttcaaccctctttaagaaactttggattttttttgctgtagtatttgagacaggcatgtttgtttcaagtcaccttgaaaattacattctttcctttttgagctgctaactgacataataatactattgcaaattttgcaaaatcatgtttttcctctaacatttaggatccttcaatagttggtttgtttgtactcattgattgagaaataatttttctggaaaatattcagatagaaaaataatttttaattcttgattgttcagcttccatagagactgcactcccagctcttgttgttcccatcttggagccctgtggtaattcagagtgtctgcacatttttgtagatttacattctggaatgtttcaattgatgctttatggacttggtaagttactaaatgatataatcattcaatgtaagaaaaattatttttaacaaaaacaaaataaacattttctgtcattaggtattagaaagaatggtatatgcagtgttgaaagtgggtatggaaaccataactctgactgatgtcagttcctcggggccgttttaactactttggattttcttgtagcagatgttaaacttcccagtataacgcacattcgtgtttccttatgcaaaattaataatgttgatggctgctgttttttaggttaacttatctatcccagtagctcagtttctattttaccactgggtgacatggaaatcacaataaggaattctaatgtcatttgtggctgaagaacatttttatgacagtagaaacatctaagatgacttgaggtacagaatcctggaggaaaggatttttttttctggcctaaacacagtagaaattaaagtttgatttcttacttgttctgttactgagtcagtgttatgaaatgatgaaataagaatttagtgtttttgtattgctactggacagtgttcttgaatatattaggacatctgctatttgaaattaatattcagctagaaaggttgaaaataaagggctttctggttatattttatagctatagattttttttctatgggctgctcatggaaaactgaactaattactttgaatgacatcacatttatgatggctaaatgacgcatttatgaattactttaactgtgggttccaaataaggcaaatgttgtttgttcttaaaaacttatatttaggccaggcgtggtggctcaaacgcctgtaatcccagcactttgggaggccgaagtgggcgaatcacaatgtcaggagatcgagaccatcctggctaacacggtgaaaccctgtctctactaaaaacacaaaaaattagccagacgtggtggcgggtgcctgtagtcccagctactcgggaggctgaggcaggagaatggcgtgaacctgggaggcggagattgcagtgagccgagatcgcgccactgcactccagcctgggcggtagagcgagactccgtctcaaaaaaaaaaaaaaaaaacaaaacttatatttaactgtttttctgattattaacatagtacatactcataaataaaaaacttaaacacacaaaaattagaaaagcaacagaaaatagtcttttagggatgtatgcttgtcttagcagctcaggctgccgttaacaaaatatcatagactaggtgacttaaacaacagaaatttattttgtcatagttctggaggccagaaattcaagatcaaggtgtcagcatggttgatttctgatgaaggctctctttctagcttgtatatagattgtatatagacagctgccttcttgctgtgtcttcacatggctgagagagcgacttctctggcatccgttcttataagtctgctactgatcccttcatgaagtccctaccttcatgacctcatttaaacctaattgcctcccaaagaccccttctccaaataccatcacactgaggattaggggtacaacatatggatcttggggggacatagttgaccccatagcagtgcttttctaattttttctatactttgtccccattaatcaaaatcattttgtatcttgcttttttttgctcattattctgtttactagcattttctagtgtcattaaaaattctgacttaatttgcaagctgatcttcagccagcagctgttccatatgccagagatcatttgtgtttcataagtaaatatttcagtggagttttttgtttttatgatttttaaggttctaagtctaataatactatgagttttaaatacttataatttaaaaatactgattaagtagactaggagtttggggaattaaaatataggcaaagaatggattcatgtatttgttacttgttctttctgccagtgtacatttgccattagttgtcatatctataatgctccctaaaagttaaagagggaaaacaaattaggttggcttatatctaatggtacatttagtttaatttttctctgactcaaaaacaacatgattttctgccttaaacaataattttcatttgttttatttgttttacactacctagataaagattttgtttctcatataagcaattaattaatgaagtgctttattctgtagaccaggccactctggatgacatggagaagtctgtgaatgatgatatgaaacgaatcataccctggattcagcaacttaagtaagcttatttatatagctcaagactaaaaatggaaacttattttgacaagatatgttttcttctccatcattactcttggtcattcactgtccttaaggtttatgacatgaaacttaagtgccgtttggtaccttagaatctaaattctcttggaatagttccaagatgtcagtttctcatatcaaattctcctctagagcaaatataggtgtgaagggcataacactcagctttcatcccttaccacattttcttctatacaagcactttacaaatcacttacacaatgaattttattgtatcaagtgttctctgtaataaagtcctatttgttcttatccagggtaatcgtcatggttgactaccaactgacactttcaaaatagtcatttctgcttctcgaatacagtcattcaatttgtctcaaaatcctttaaatgcttcacactgttaaactaaataaaattgaaaatggagctagatataattctgtggagtttcattaccactctggtacacaaaggtacccttatagcaactctaacaaactctttcttaaaattaatagaattccaaaggataaaaaaaaaattcagagactaaaaccaaaactggcaaatggagaaggcggtgggggggcggtatctaaagaaaagactataaagtgggatctattgtttttataatcttttagcctctgcccttccctttagccaatatttgaaaaattcaatataaccaagtaatgttttcattagcagggcatgaatttttttttttttttttttttttttttttgagacagggttttactttgttgccaccaaggctggaggggagtacaatagcgtgatctcagctcactgcaacctctgcctcccaggctcaagcgattcttctacttcagcctcctaagtagctgggaccacaggtgcatactaccatgcccagccaatttttgtattcagggcatgattttttgttttattttatttatttatttattttttattgagacagagtctcactctcttgcccgggctggagtgcagtggcgtcatctcggctcactgcaacctctccctcccgggttcaagggattctcctgcctcagtcttccgaatggctgggattacaggtgtgtgccaccatgccaaactaattttttgtatttttagtagagacggagtttcaccttgtttgccagactggtcccaaactcctgacttgaggtgtgatgtgcctgccttggcctcccaaagtactgggattacaggcgtgagccaccgtgcccagcgcagggcatgatttttaaagccagtagatagataatattatgtgagcctttttttttgagcagctatttagtgtatctgtatgtgaaaaaaaatcagtcattaatctgggtaatgatttctaaaacttttagtgttttagcatcattgtgcattttggctaaataagcaaggtttaaatatcctaacatgcttaataattcacatcttgcataacttgaggttgtttatctggcagttctagctgcccaaaatataaactaaaaccagaaagttaagttccaaaagcctttaactcaccaaatgtgtgcctgtatgtaaacttacatgatttatttataagaaaagtcccctgattgtcacttataatagtgtttctcagatgatttgtggtgaatgaccagtttatcactaatctatcatgggacactgatttttcaaaataactttattgaggtataatttacataccataaaaatgcacccattttaagtatacaattcaatgatttgtagtaaatttactgacttttgcaagcatcaccacaatccacttttagaacgtgtaggacatttccatcaccccaaagaaatgtccatttatagttaataaccattcccaacctcagaaaactatgaatccactttctatttgccttttctggtcatttcatataaagtagaatcaaaatatgctgtcttttgtgactggcttctttcacttagcataatgttttcaaggttcatccatattgtagcatgtatcagtacttcattcctttttatgactgaataatatttcactgtatggatataccacatttggtttatccattcatcaattgatgaacatttgggttgtttccactttttggttattatgcataatgatgctgtgaacattcatgtgtaagtctatatgtggacttatgttttcttttctcttggagtagaaccaaggaatggaactgctagggcgtacagtaatttgtttagcttttaaaagaaaatgccaaactgttttccagagtgactgtgccattttacaacctcatcagtaatgttgcgagaatttccatttctctacatccttgccaacaattgttactgtctttgaatatagacatcctaataatgagtatgaagaagtatctcattgtgattttcatttatatttccccaacaaataatgatgttgagcatctatttgttcatgtgattacttttttaaataatgtgcaataaaaatgaattctaggaaaaaagaaatgaaagaacatgtataagatataagccccaatgttttttattagaatcaacagataaagttatacttcagtaaatataatcagaacataggaaaaaagaaaattatagaaactgtgtacatttttcattgaaagtgtatacacaggcaattaatatagaaagtcacttagactcaagttttttgtccctcagaatcataacaaataatgaagagtgaaatagcaattccagattgactttgaaaaggccaccttgtatatcagtatttagaatttttaatgtgacacatgagcttgtttcttgtttgtaataacttgtccacgttggattgatgataatgctaatcatgagagatgtttcttatgttttccttttaataacatacatactagagaaatcattctcacaaaggtatgttgatgggaatcaaagtagagatttgaaataaattttagcaagttcaggatattcatttttaacttttattcaaaatgaagcaagtgatggtatattttcaaaatttatcttcattccttcatcagtaaccagttcttgcatttgatccgtagagttgtagttaaatttgtctttcaatgaaaaaaacaaaatggtttccagaacagttgacaaactacccttaaaatgtcatatattataacatggttttactgcacataactggtatacagtttgtaccacatgcaacttgccacacaaatgtatcagcacccaacctggtctttgccctattcatcaaggcaagtctgctgatcatgagctgggatgttgtggcatcgttatgctgctgtgaaaattcttattttctgtagtttcattatgcatcagtggagtttgtgaaccagccattttatcccttttttacatattatatgatatcctagcttcaaggatagataatcaaataaaaggaataaaaggagtactatattaaaaacgtcagtgaaatctggcagcttacctgaaaggaacgtgggaacaaaggtagttaatactactgggacccgctaggtatactacacacttcacacatacacaatttaaaaactggggctatataaagaatgttgagattagttggtgctgtctttaaaccgtaggaaatctgtcactccttaataataaactaacatagtatctcatccttacagtgaattctaccttataactaagatcattcacattgcagtttaaacttcttaaactaaaactagaattgacagtagtgcaaaactatgaaaaaatgatttgtcattatggccatgtgtccttttattagttcagttaaatttcaattaattgtttttttaatggtctttaatcatttgtaaatcgatagggcacagataatcagaaaagtctgagatttgatgtggattatcacttttaaattcaggttttggcttggacaacagcgttgcaagcagtctataaaacatctgcctacgataagcagtgaaacattgcagctttccaattactcaactcatcctattggaaacctttctaagaataaactgttcattaaacttacccgccttccacaatactacattgtaagtatgcaaaggagtgatttggagtgatcaagtttagtaattctgttagtatcttgaatgacttattgtttaacttgccaatgaattttattgaatatttgactttggtatagtgaaacccaggggtttagaattggggagagaggaatgtcacgtctcagttggggaacataaggtataaccccatccctcactctagggtctgtcctgtgatgaggcctagtctttgattggaatgagacatctctgtaagaataaaaaatttaagaccaattcctatgaaggtctggcgatgttttgatgtcagataaacttgtttcacttgaaatattaacttgtatagtgaaacctttcaaatatggactggctgaattagctttattttttcatccttctttgattgaaggcatctttcattttattgagtatgtgttccttttagtgcacagtaaggtcctctctattcctttttcactgtttctgtatgttttttagtttctttatttttgaattagttaaaatttgcaataattttaaatatgaacccatcctgaatatattttcttgcttgttgaaatttctggccaggcacggtggctcacacctgtaatcctagcacttgggaggctgaggcgggtggatcacgaggtcaggagattgagaccatcctggctaacacagtgaaatcctgtttctactaaaaatacaaaaacaaaacattagccaggcgtggtggcgggcgcctgtagtcctagctactcgggaggctgaggcaggagaatggtgtgaacccgggaggcggagcttgcagtgagccgagatcatgccactgcactccagcttgggcgacagagtgagactccatctcaaaaaaaaaaaaaaaaaaatctctgtatataccaagtagatatgttggctaagaatctatgttttacaaattttaattcaggccaggtgtgatggctcatgcctgtaaaactaacactttgggaggccgaggcaggaggatcacttgagcccagaagtttgaggtcagcttaagcaatatagtgagacctcgtcgcttataaaaataaaataaaaattttaattcaagattgtttgttgaaagtaatgggagtgaactttttaaggttttgacctgtacttttaaaagatactattttaaaaggacaccattgtaggctgacatatcttaagctcgggatacttatgtagactagtgagtctgtcattgatctgaattttacttttttctgaattttaaaacagcagctgtagaactagatttggcccactacaaaagactattgtttcagttctcagtgagcttgcttggtctacatgtgaaatgataatacagaatacatgcatcatagcgaaacccatgaacatacaaagatctcttataatcagccatgcacaaaataagacaaaaatggttataatttattattttatgacatttaaccacgctttaatgtcagtgaccagtgatctattataaagcaataatttgtttcatatggcttagaccaaaactgaatgtagattattcctcgtcctctagatttatcacttaggggtaatatgttcatggaagtggaaagaactactaacatggacattaagaagaacagaggaaagtcttgctgcagttgatatccccttaaatgtctttctgccattttacctttcttttttggttagctttattaagatataatttacataaagtaaaaatacagactttttagcatgagttctgataaatgcatacagttgtgtagcctccatctcagggcacagaacagatccattatcccccaaaattgccacataataccccttataatcagccccctccaactagtaatcactgacttgttttgtgtctctataggtttgccttttccgtccagtttctttgactcagcataatacctttgacattcatctgtgttgttgtgtgtataatagttccttccttttgttgcagagtagcattccatggtgtgggagtaccacagtttgtgtttaatgagtcactcattgaaggacattggggttgtttccagtttggggtaattttgactaaagctgttaaacatttgcatatagatttttgtgtgtgttcataagttgtcattttttatttcatcttggataagtaactaggagtgggattattgggtcatatggtaaatgtgtgtttaactttgtagaaaactgccaactgttttccaaagtgatgtactattttgcattccagccagcaatatatgagagttctcgttgctcctcatgcttgccaacagttagtcattagaattttttaaaaatattaaccattctgataggtatgtagtggtgtcttatcgtaggcctaatttacactgccctaatggctgaagatgttgagcatattttcgtgtgctcatcctgtcttctttggtgaaatggccatttgacttttaacatttcctgaggtacatcatcagtgtgatgctttcctgaagagtatgtgtggggaggagggggagcaagggagaaaggaagcaggaagagaaatggaaaagaatgtgtgttggtcaggagcctttcctaatggcatatatttttgtcactaaagcatttaggggacttttcttaaattttagctagaccttggaaacagtaagcaggtatagtaggaagaacaaggcctctggagccaaacttctggaatcaaagcatgagtctgtcacttactacgtgtgtgaccttgggcaagtaacttgctttttttgtgcctcagtttcctcatcacaaaaataaagataggccagttgcggtggctcatgcctgtaatcctagtactctgggaggccaaggcaggtggatcacccgaggtcagcagttcaagaccagcttggacaacatggcaaaaccccacctctaataaaaatacaaaaaattagcctagtgtagtggcacacacctgtaatcccagctgcttgggaggctgaggcacaagaatcgcttgaacctgggaggcggaggttgcagtgagctgacattgtgccactgcactccagctgggtgacagagtgagactctgtctcaaaaaaacaaacaaacctacttcacagggttattaggaagattaaatatgttagcatctgtaaagtattaggacaatacttggcacatattaagctttgtatcagtgttaactgtcaatattgttaccctcacagtgaccatatttttcagttgaaaaattagggtttgtttttacatgtttccaagtatgagggatggttgtcatttttctctgccttaataatggaatttttaagatgtttgagtggttaagggaggcagcagagcaatttaaaatagataccattctagaaaatctagcagactgtattagtctgttttggcactgctgataaagaaatacctgagactggacaatttacaaaagaaagaggtttaattggactcacagttccatgtgactggggaggcctcagaatcacagtggaaggcaaggaggagcaagtcacagcttacgtggatggtgggaggcaaagagagagcttgtgcaaagaaactcccgtttttaaaaccatcagatttcgtgagacccattcactattacaagaacatcacaggaaagacccgcccccatgattcagtcatctcctaccaggtccttcccacaacacatgggaattacgggagctacaagatgagatttgggtggggacataaagccaaaccatatcacagacctactggatttaggcaaatttgtttttgtttttttcaatttataagctgaggtgtgaatatcaagaacacttaatacataatagtttaaatgccccatttgttatagtttatggttgcttttgcttttatcattcttctttggtctcatctactttttggaaaacaaattatgtatttgctaggaatgcttttttttgatacgattgatttaaccttttttttttttaagacatctacattagatttataattctgagccttacttgatgatgtacggaggaaaatatctgacacttcttatttctctaagtcttatttctttttgggatttttaggttgtggagatgttggaggttcccaataaacccacacaactgtcgtacaagtactactttatgtctgtgaatgctgcagatcgtgaagacagccctgcaatggcattgctgctgcagcagttcaaggaaaacattcaggacttggtttttcgtacaaaaaccgggaaacagaccagaaccaatgccaagcgcaaggtatgattccatatgaaaatgagcacagaatttgtgtgtgttaacttggttgtgttctttactcatttttaatatgagaaagaactaagatacagtttttaagagacgaggcagcaataaggcttaagtaacaattgtctacattttcttgaaaatgcttctgttttaattaaataattgtccaccattttccatgagagaacttgtgaaacacaaaatatttactaataaattaccagtgtttaggtcagtatttactcagtaaatacaataacatttgttttggttaaccctgagctttcttccagtattttaactatcttaatgaattgcatcacatgtacttttttttttttttttacctgtttgtgttctttacttaaattctagttgtctgatgatccatgtccagtagaatccaagaaaacaaaacgagcaggagaaatgtgtgccttcaataaagttttagcccacttcgtcgctatgtgtgatacaaatatgccatttgtaggacttcggttggaggtaagttttttggaacagttctggataccccaaatgaaagagtagtttttaaaatgtgttgctgagggtatatatagattccattaggaaaagcagaatgtttgtgatcctgttcattttgggaggagtggtagggttacaatcatagcatctaatggtatacatgtaaaacatgacttgaattatttcatctctctgattccagattctgggtcttctgctctttatggaaattgaatgtaaaattttcccagttaaaaaaagtggacagggctgggcacggtggctcacacctgtaatcccagcactttgggaggccgaggcgggtggatcacttgaggtcaggagtttgagtccagcctggccaacatggtaaaactttgtctctactaaaaatacaaaaattatccgggtgtggtggcacacgcctgtaatcccagctacttgggaggctgaagcaggagaactacttgaacccaggaggtataggttgcagtgagtcaagattgcaccactgcactccagcctgggcaacaaagcaagactctgtctccaaaaaaaaaaaaaaaaaaaaagattaaaagaaaaagtggacaggctgagtgcagtgactgatgcctgtaatcccagcactttgggaggccaaggtggaaggattgcttgagcttaggagttcaagaccagcctgggcaacatagcaagaccttgtctcttttaaaaaaattaaagaaaagcaagtggacagtttttaagaattaacattttacttttatacctcttagtaggagcattgtttaagcctattagagatggttagttgatagccaggtggcttatttttgagttggtaaagccatgtatattgattaagccctagtaaaaccgggatcctttctaagaagcagatcagaaagaatattaaactaaatttttacttttctcacatgggagaagcaatagatttatgcagaattagtgccttgaaagaatacgcagttgtgatatccaatataatcctcaaacgtgaaagggaggtaacagacctgcactttttgtatttccaaaaaggagtttggccaaggatgggtagcccctcaaaagtgatacactaaaaccccagttatttccctgtaggttaaagttttatgttttgtaagaatcccctcctctgtaagttattgtgaatgaaggagagacctggaaatgtgaaaatggactttttcagttgggctgatgatgatggccttgggaagatttgttgaaaatagctttcatgctttagaacagggattgggaaactttttctgtaaagagccaaatataaatattttagactttgtcggtcaagtggtctctgttatagctactcaaatctgctgttgtagtgtgaaccagccagagctgatatttaaacaaatgagcatggctgtgttacggtaaaaaacttcatttacaaaaacaggcagtgggccgggcacggtgactcatgcctgtagtcccagcactttgggaggccgaggtgggcagatcacctgaggtcaggaatttgagaccaacctggccaacatggtgaaaccccgtctctactaaaaatacaaaacttagtcaggcatggtagcgggcgcctgtaatcccagctactcgggaggctgaggcaggagaattgcttgaacctgggaggcggaggttgcagtgagccaagatcaagccactccagcctgggtgacagagcgagactccttctcaaaacaaacaaacaaaaaaaccaggcagtgggctggatttggctcatgagctgttgtttgccaactcctgctttacaggaatttgggatctgtaggcagaggataaggtgtgaaattgtaaagagcccagagagaaacccaagcctagaaacaggcacctaaaataaatactcatgtccttgatgacccagctcctagaactgtgagcctgatgaatgtcctcttatctggatactggccttagctcctaaactgtggagtgtgtccatgtttcctatgtaattgactgtgttcttggactcttttattgtgttatttggattgattatatgaatatcattcagttactacctttgcagtgggaagggaagatggatatgtggtgctgaggcaaagcaatgcatttatatcctctcttcccctacccacaggccagaattggcaaaaatgtgtgtctttgtaggcctacgtaggttaatgactgtagacatacgtcctctctgtccaccttctctgtattcctatacctgctgcacatatgggacacagatgaacattctgtagttctctattgaactcagtcaagctcttaaaaacttacctactttttattctcagtgaacattctagctatgttaaagataaaagcaagtatattttctgcttaaagtaatttaggctgagatgtgaataactaaaactaaatctcatcttataagggatgtttatatatcttttttttttttgaaatggagtttcactcttgtcacccaggctggagtgcaatggcgcaatcttggcttactgcaacctccacctccctgattcaagcgattctcctgcctcagcctcccaagtagctgagattacaggcatacaccaccacacccagctaatttttgtattagtagagacggggttttaccatgttggctaggctcgtcttgaactcctgacctcaggtgatccaactgcctcggcctcccaaagtgctgggattacaggtgtgagccaccgcatctggccggatgtttatatatctgattgatagaatagcagcaacatttttgagctggcccacacttcatttccttttgaatctgaacccctacttcctatttggtagcagctatttttctaaacctttccctttcccaggcccaaagagcagggctcactcaaatacctggaacttccttaaatcctttccagaacatggtagatataaatagtctgtcatgcaagacctgggaatatctgccaaaggcaagcatttctttagatcagatgactttctggcatactgtaattacttgcagtcccatggaaagggtttcaggcactatctctgcatttatctttttaatttgctttctgaatcctttaattgggaaagagatgtcattgggtaaatgcacaaattggaaatcttttcttgggtttcacataggaagtagtttaattcttaaaaatgtatttcagaaatgttgtaaactaaaaaatatcatttagaaataagctatgacagtgactcaaacattgttttgaacaaacagaagagaattacacgagaaaccattcttgtggcctcttgaactactaaaattgattctagattacttttggctccctgcaaaaattagactaatctcctaaattttgaatatttgccacttgtggaggtgtttcttaaactagatgcactgggacagctttgagttccactggacttcatgtcgtttcccagggaatctaatgatggggataatactcatgcctaatatgttgtaacttggggaaaggatggtcctagaacaggtgccacaagaatagagaccgtagtacttagaaatggtagttgtttttgtaaaattggtcgtctgatataattgtttttctctttctagttgtccaatctggagattccacatcaaggagtgcaagtggaaggtgatggcttcagccatgcaattcgcttattaaagtaagcccctgtcatatgtttcacttggtgccacatgttgcagtcacactctgaaagctgcttctctttcatgagacaacataaagcagtgttcagaacctgtgggtgttgtggatttctgcatagagttactagggtctgggggaagattcctttaatctatggagtggcaatccagcatcacttggttttgttttttttgttgtttgtttgtttgcttgttttgagacagagtctcattctgttgctcaggttgactggagtgcagtggcatgatcttggctcactgcagcctcccaacctctgcctcctaggttcaagcaattctcgtgcctcaacctcccgagtagctgggactacaggcacacaccacgacgcccagctagtttttgtgtatttttaatagagacggggtttcaccatgttgaccaggctggtctcgaactcctggcctcaagtgatccacccacctcggcctcccaaagtgttgggattacaggcataagccactgcacctggcctcacttggtatttttggatgtcttttctctgcatttctttgattcgttcagcagatatgcattgagtgtgactgtgtgtcaggcttgaattctgacatcccctcagaatgctgtgggttcataaagcagaggaatatgggctagttcagaagtcaggaagggtatccctgaggaagtaccagttatacttggactgaaggagaggtgagaattagtcagaggaaagtggggcagaggcagtgggaggtcctaaccagagggataactgctaatgtgaaggcttggagggaagagagagcttggcatttttgtgctgaaaggagttcggcatggcaggagatgggagaaatgaggctggaaatgtacgcaggaaggggtcacatcctttaggcctatgtaaatgtccttcaacaatttaggctttatcctaatggcactaagaagctatcagatgattttaagctaaaactgacatcattagataggtgtttttgaaagctcaacctgatagcaatatggagaataaattgaatgggaacaagactaaagtaatgaaaccacttgttgaagtggttcacattagagttgttggtagctcagagtagggtacgttccacaaggagttaggagagaaaatattcacgagttatgattagattggtgttgaaggtgagaaagaggggaaagtggcaaagatgattcttggttttatcttgggcaaatgatggatggtggcagtgttttctgagatcagggacaccaaagatgtgagtttgaatggactttgctaagtttaaggtgcctgaataccctttgggcaggcagagatgtgtttcaagctcaggtaacagatctgggaaggagaagtagataaagtcatcaccatggtgatagtaattgagctggggtagtaaattagatcaccaggaaagagtatacagaaggagatgggcatagggcttaagttctaatggacaaaggacgaggagccaaaagatgcttagaagtaaagctaatgtggtacatgtgctttaaaagtgacccagtatggacttgcaaagccagaataccatctaagagatcaacctttttggtccaggaaacaggtttctttgcaaaggaggggtacactttattgtttcccagatgttgcttaatgatataaattatataagcaatttttatttattgaattcctctgtctgctaagacatagcagctctgcaatttgagcagtggggctttaccatttgttatctaggaatctgtttccgtggaaggtagatagagctagcaaatagtgtcacataacccatgtgtcattagtgctcactttagatactacagaattgaactagaatagttcctcttcctggctatcttaacaacatttccacaaaaacgttttcaggagagagagagctagtcttaaaatggaaatcagtaggaaaatgcaatacttccaattgcatttggttttgaattgctttgccttgaatataggttttttttttctttttactcttctaggcacctgtagataagttgataatgttaacatttgcattctattctcttagttgtatttttcatggtttgtgaaattttaaaaatatcttgttctcggcatttttacaagagaaatttcagtctcctttcttcttgaactcaagagaatgcgtaagagtcctacctaggaaggaagtactttatattttttagcttcattttataataattcttaaagtctttaatcttggcttttgttttctttattttaaaatgtaaaggaaaatatacataaacggatatgttaaagatgactgttggtccagtaagtgctgtccattattggggtagggtatagaagtgaagaagaaaaaaatgtaaataataaatgtctcaacatgattttattaaaatcctatatagacctaatgagtatggaattggactcatgcatttattctttagaaactcttgtaacaagcttttagttctggatatattaatattgaatatgaatatgagttgatacttcaaagctttaaaattggcacactttccttctctttgccaaaaatacattctgttcttgttctactttatccccttgaaaatttgttaagcaggcctccttgatgcatctctgcaatcatagtatcaaatggatcatagtaaatttctttgattgctatgattcatggacctgttgccttgtgcaaattcaagagccttgatcctataacccaaattaggattgggacacaagttttgagagagcagcatgctcatggtgcctagttttgaacgcttcagcaaacttcccaccttctcgttgaactcatgtcacagtcatgtgcagtagtaaaggtcctctggccacacccacgagggtttttcatttcctccattttgtttctttgcctcctgtagcttatgctgataatgcacaggcacagctctttttttgcaagttgtgcagcccagcttgtccttcatacacgtgtgcaatctttataaaaacctcttcactttccttttaggcacactcatgctgcttttgctagcactgtcagtgatctccctggttttgcactgcagggccatagtggggttaatgatgtttgtaaaagccctcacaacaaagctgacacacatctgccagaccttaaaagaccatagcctggctcctcaatttgtttagtactgagaagtacaggagaaaagttggttaggagcagctgtgtaaatcaaacatttttgaattggtaaaaattttcagataggttaatccattgtccagaaaataccttcctcggttcttaatttttaggtactataatagtattttgcagtattttaagtttgtaacaattttgtcaggtttccttttggggaacctggtttcgggttgttgcttttttcccctcacatgatcatgctgggaagataaaagttacagtttatttttattcattctgttccattcataaccttaaaagcaagtaactattttacgaattccttgaggtagagctcattgtatctgcatcacagattaaagtgatatacagtgcactttcagggttccgctgtccctaagagcataaatgggaaaagaggcttacactgatgttagttctcacttgaacacatgctggcttctgtgctttccttttctaactagatagattttgtgaaaaacctgttttatttgaaaggaagataatgtactgcatttatattttcaaacttgagatttaaaaaatctgtctgaattggctgctttataactcctacggagagggctatgtcgtgaggggtaagggcaggcaagtcctcagtatacctgtcacgttgaagaacggataggtagtttatgcaatttctgtaataactacccaaaatacagttgcacaaaatctttctggcagtgataaaaagtatgtagtgtgaaagattaacttttgaaaaacttcaaaagctgtatattgaagaggagctgtgatagaagttttaattagcacatgcaatctattttttgctctcttaagttgtttattccaggtcagtggttctcaaccccagggcagttttgccctgcaggggacttctggcaatgtctgcagatgtttttgatcattaactgagaagagggagtaggaagtgctactggcacctagtaggtagaggcctgggctgcacaagacagccccctcaccccgcaacaaaggattttccagccccaaatgccaatcctgccaagactgagaaactttgttatattctgaattaaggggtctgaaccaagattctctaattccaattatatttgttgtttttttgcctcaatataaatatttattataccaaatctgagaattaaccaccttctgtatgagttaaaggttatatataattaagtaatctcattatttcatctcactgaaataactcatgaatagctaaaatatattacctcatcatgttttatgaccaatgagatagtttgtaaaacggtagaaggaaaatggataggtaggtattttaagacaccaagctactacattcctcttgtatatgtgatgtatgtgtgacaatatgtatgttaaatgagttaacacatgtaaagctctatgaaaataagagttacctctacagaggaggaggtggcaaagtggggataatgaacctggaattttatcatggttattcagtcagtgaccaagatttggttttactgcaagggagaattaacatacatggggccaggcttggtggtgtgcacctgtaattctagctactcgggaggctgaggtgggaggatcgctcaggagttcaaggctagcctgggcaacacagcaagacaacatctcttaaaaaacaaaacatatgaatacttgctgtgtcagccaccataagcactttcattttcttcgtcaatgacacataaggtaattcttcatctctattttgtagctgggaaattcagagacattaaatgtggctgagtcagagttagaatgtgggtctctgactccaaggcccttattctttgtactatatcattctgtcttcaaagagtggttttataaggatttggtccccttagcttttccttgaggatgttctagatagattttgtagaaaaccagtattcttgattttcattctgtagaattgtagtcttttttaaagaacaaaattatgaataaagacaagcatcactgttaaaatgagagttctaatccatattgatgtgaatggaaatggattaaatactattaattgctgtgaattgcttcctccttttgcagaaggtatctagaagtggagtttgaactgaagctgtaatgtcataccttgtctgtcattgtgtacattgtgctttgtctgtgtaaagtatacttcatatgctgtcttttatcaccagaattcctccctgtaagggtataactgaggaaacccaaaaggctctggaccgctctcttcttgattgcactttccgattacaaggtagaaataaccgcacttgggtagcagagttagtgtttgcaaattgtccacttaatggcacttctactagggagcaaggtgagatgtttcacacattttgtctttgcatatttctggatttttttggtatcgattactattaatattctcttttaatcctgtaggaccatcccggcacgtttacctgacatatgaaaatctgttgtctgagcctgttggtggtagaaaggtggttgaaatgtttcttaatgactggaatagcattgcacgattatatgagtgtgtgttggaatttgcacgttctctaccaggtacgtgtggagataatctcctttttaaataaattaaaaaaaaaaagccctcaccctttttttaactgaagtgaaacatgcacagtgttccaagcaaaaaaatcaaagtatatctaataaaacttaagtattcctttcacttcagacttcaatttccttcccctaaagacaaccactgttaagtttcttttgtttgcaaaaattttacacacaggtataccatatcataataatagtgcttatttactgtgtggcatacaatattataaacagtttgcttgtgttaacaaatgagttttcacaatcttcacaatcacaatcatgagggtaggtattattcctcattttacagaagaaaacaagttgcagagactaagaactttgcataaagtcccatagctagtgagtggcagagttggaattggaaccctctaaccactatgctagactgcttcagtatatctcacctacccttgcccccttttgtagaaacggaagcatattatctgtttgtgctgttgctttttttaaaaaactaaattacttaactagagacctgtctgggcatataatattgccaaaatgccctgttactcaaatttatattttaaaattttacatgtataatattaatctcctttttgtttccttctgtttagacatacctgctcatctaaatattttctcagaagttcgtgtttataattaccgaaaacttatcttgtgttatggaaccaccaagggaagctcagtaagtctgattaaaatgctgaagttcctgtcttatgaatcttaaaaatcaagaattaaaaaaacatgaaaattaccttaatataagtaagagctcaagtaaaagttagggataaaatggtaaattttaaatgctttgtggctataaatatagtatactataatgcttaactctttaaaattgaaaacaaaaataataccctatgatggggtatataatcttgaagcaatttggacaaggtaatgtactgatggtgtttgtatttttttcttcactgattacagatttgcttggcaatgtgattattgtaaggaaaattgtgtatgagtggttataacaatatggtatgtttttgcttttggtcacatgaatgttaacattatttcatcttaacttaatcttgaagtatttcctgtaatctatagttctttattttttttcccacctcatatgtaaagtcctagaaatgtagtataaaaatgcagccagctggtttctctctagacttctacgtcaagtaatgtcaggttacttgagctttttaaaatctgttaaccaagtgtatctgtgtccagagtggcgcccttcccctttatgacagtgctccttagttgatggtaccaaaagtgtgactcttcttcagttcaagagaaaaacgaaaagaaacactaatgataattttcaaataaagtttaataaagttgttttagcgcctttctgttttatttagtaaaagaggactaacacatggtcagggagtgtactgttcaatattaacagcacatctggagttcgaatccagtcttattttattgcttgttttccaaaaaaaaattccatttagatttttggcgttttgccttacttttaacattttttttttctcctacttgaatctgttactttctcagtttctgaaacatgtaatcttttttatttagattagtatccaatggaattcgatccatcaaaaattccacatttctttgggaactgttggcccaaactcaggttgcagtaactgtcacaataccattctccatcagcttcaagaaatgttcaacaaaacaccaaatgtggttcagttattacaggtaattaagtttattttctgtctaaaaataagacttagtatgccagccgtgctggttcacacctgtaatcccaaccctttgggaggccgaggcggaaggattgcttgtgctcaggagttcaagaccagcttgggcaatgtggcaaaaccctgtctctacaaaaatacaaaaattagtcagttgtggcgatgcacgcctgtagtcccagctacttgggaggctgaagtgggaggatcacctgagcctggggaggtcaaggctgcagtgagcggtgattgtgccactgtactccagcctgggtgtcggaatgagaccctgtctcaaaaaacaaacaaacaaaaaacagcatttagtgtctcaggcaaaactcttcaaaagatcatggggacttgtctttaatgactaaggctgataattttgtcttttatatcttgaacacttctttgagaattttctttgattcagtgtggacccagtgatctagtttgcattctcttcaaggggaagttttatggaatgtgccagaaggacgttgtttcatttttgacagttatacactgaaaattctgaggttttaacatttgtacagaaactggctgctctcactgtgtttgttccttataggtactgtttgatactcaggctccattaaatgccatcaacaaactccccactgtgccgatgttgggcttgacccagagaaccaatactgcctaccagtgcttctccattctgccacagtcgtccacccacatcagactggccttcaggaacatgtattgcattgatatatactgccggagtcgaggtgttgtggcaatacgggatggtgcctatagtctttttgataacagcaaactagttgaaggtttctatcctgcaccaggactaaaggtaacagactttagtgttataacatgagtaaacataaaaattatctctaaaatagtttctttgagggggaaataatggggaaaagcaacaaattcctgtttaaatttagtaagtagcagtgttaactcatcatctgtataacgtcattctgaaggagctagaagttctgataaagtgttgtgcttatgtgtatgagatgattaaaagtatttttctttatattcttaccttctgatcagtagggtgaagatactaaaaacaatttgtgtttggtctttggaactttaaaagtagtttttatcattgatttttgaaaaggtttggtcatcaattctactgtgatgcttatttatttatgagacagagtctcactctgtcacccaggctggagtgcagcggcacaatcttggctcactgcaacttcagccatgtgggttcaagtgcctctcctgcctcagcctccccagtagctgagattataggcatgcaccaccacacctggctaatttttgtatttttagtagagatggggtttcactatgttggcctggctggtcttgaactcctgacctcaggtgatccacctgcctcagcctcccaaagtgctgggattacaggcgtgatgtaatctgtgcctggcctgatgcatttaaaaaatgtaaggtcctgggaccctcccaaagtgctagaatcacagtaacctgtgcctggcctgatgctttttaaaaatgtaaggtcctggaccacaactgccagagtggttaactgatgtgatagctcagttgtatgtgtttttagtctagagtcaaataaatctaaaaggcttgatttgaaaaatagtctcctgcaacccactcttgtcattttcttgctccccagatgccttgttttcagttcttatgtagctgattctcttggtatttatatctttatctctaagtagaatgcctacattgctatttgtttactttttggttgagggcattatctgattctcacaatggaagatgagtattcttttttctattttttttttctgtttttcttttctttttttggagacagggtctcgttctgtcctcctggctggagtgcagtggcatgatcatggctcactgcagcctcaaccaccagggctaaatccatcctcccacctcagcgtccccagtagttgggaccacacccggataatttttgtattttttgtagagatggggtttcttcttgttgcccaggctttaattcttattaaatttttttttatgtgtgctttcccccttccaggctgctctcagtgcataaacacatttgtctttcctcctatctttgtaacatggttaggtagcaattttgattagattatttttcagcatttgtgcagttatgaatatgtaagcgctgctgcaaccaagcttactatgattatttttcctgtcttgctcaacattttattttattgggaattattaattgggtcttttttggtttcgctttctctgtagtacctatcactaattaaccttaaactcttctcctagttatgtaactccttttagtatgttcaaacatatcaagataacttattgatttcatcttgaagaaatctcttcaataggcctctgacctgctccaatttggactgatagcagtctgggctttctacacagtgttcacttaagaatctgcaaaaggatgaaaggggagattccttcatttctcttttatgttgcacattgcatgccttgtgtggtgggcgccttgttttttttcttggtttacttcattgttttgattactgggagaaggtacatggggggtggggaattaatttgaaatcacatatgcctgaaagcatctttagtttaccctcatctaactgaagtggctagataaagaactctaggttgcaatcattgtctgtaaaaattttgaaggtactacttcattgtctcctggcttccattgtgactattgagatgtgtaatgagttcacactgttgaacattatgtgacttgagtgggctctttctgtctgaaaacttaatatccttttgctttgggaaatttccttgcactatttcttggttcatctccattgttttctctgttagctcgttcgagtactcctaatgttctgatgctaggcattgtggacttgtcctccaattttcttatttcttttgtttttttgtctcttttttctgggagatacctcacttttttcctctaatccctctattttttatttctaccaatattttattttggccattctttaaaaaattttttcaaaaggttttttttgtttctaaatgtttattttaaacattctattatatggcaacattactttttctttttatcctacataatctctattttattcaccttgcttttgtgtgtgggggggtgtggtattgatttcttttatattagtgtctttcctcaaatgttaagcgattcttaactctctgctcttatttaaaggtaagacttattgactgtggtcttcattgcaggatgatctccttgggccatttctttgggaaactcccgatatcagtagctttaggtctttttgttgggctggtgtgagtaccaagacaggagtatccaaatcttctgcatagatggtatgcatcttgctttcaatattgggaaagtcaaatgaaaaaacgagtattctcaaatttatgtagactttgatccccattttttatatagtagtccttctctgagttggtctttggcatccctcaagtcagagatcctcctccatggtggaagagataaccgagctcagtgagaatagcagaggatctgggagggtctaagtgtctcttagactttcacttagtccttctgttattagtcccacttttatccccacttccaaaggtacccatattagtctgttttcacattgctgtaaagatactacccaagactgggtaatttataaaggaaagaggtttaattgactcacagttccacgagcttaacagaaagaacggctaggaggcctcaggaaatttacaatcgtggtggaaggtaaaggggaagcaagcacgccttacatggctgcaggggagaagcgtgagagcaggggaaactgctacttataaaaccatcagatctggtgagaactcactatcacaacagcatggggggaactgtccccataatccaatcaatcggtccctctctcaacacggggattacaattcgattacaattcaagatgagattcgggtggggacacagagccaaaccatatcagtgcctgatactgccagttccaaagtatctcagggatctggatggaaatagcttgcttcttggcttttcccacagcttacttaggatacaactttctcacattggatggttctagttgctactcagccatctgctttgcagcctcccggatgtattgctgtttcttctcttctcctattctttttgtctttgttacttattgcttcaaaaaattctttccagtagtttagtggggaaagaatgcaatgtgtgttgtgagcccatcatctttaattaaaagtagactgtagacttcttttttgagacagggtctcactctgtcgcccaggctggagcgcagtggtgggatcacggctcactgcagcctcaacttcccgggctcaagcagtcctcccatcttagcctccctagtagctggatccacaggtgtgcaccaccatgcctggctgatttttctattttttgtagagatgaggttttgccattattgcccaggttggtctcgcaagggatcctcccatcttggcctcccaaagtgctgcgattataggcatgagccaccatgctcagcccactatggactattaatagctctctagtgattctgataagcttatgattcaaatatgtgtatattcgaatactggggatgtgaggagtgttaaagagaatctgtgcttgaaacacaaactctgatagctttgctcagttttgacaatatgtaaaacaaggctgtcccactcttaatggttcaagattaaattatataatataaaaaaggaaaaaattggatcgtttcttactcagttttcctttcatattttctagtttaaaaagtgagatggctcactagctgggaaattttccaagtcattgaagttatggccaatatgcttttcattttttacccccatttctggattagaagttaataagaaaatattatgatctgatggtaagaggtgccaggatgtacttctttcttcaactttttgctcacacaatatttcttagtcaatatgactttttttagatgctgtttttgttaactgttttcctcagtttcccgcttcaaaattaacaatatttcttctaggttgtcctagtaacgatcttcaaggatcaacatactgtgtttctgtttaaatattctaaataatttaaaatattttactaataatgttaggtaaaataatctaaattttacctgtttatatccgtagacgttcctgaatatgtttgttgacagcaatcaggatgctcgaagaaggtctgtaaatgaggacgataatcccccttctcctataggaggagatatgatggattctttaatatcgcagctccagccaccaccccagcaacaggtaatatctagccagaattccaagtggtatcacatttctgtaacttcacaggttctataggtgtcaagacttcattgaaagacaaggaggtccttggtgggcctgagatgcccaggaaatacttatgaaataaagagttacagaaggaggcgaggagacttccagtgacaagaaatgaatagtgttggaaacagcattaatctcaggtcattcacacacttaaaatgatgttatatgattccagagatggaaataccatccgcaggatctgagatctttgagagagtttccttaccttgtcttgaaggacagatgctattaaagtagagcacagtagactaaatgtctagcgatgttcagtagggactcctacagagaacaggtggacaaattttcagggttctgtcctcaagaccatttggataagccacattatagaaccataagagctttcagttctgtcctgtcaccttcacatgtctgagagttgaacaggcccctaggctagccattgttctctcactgaccctcctgaaatagaaggtgaacagtgattgtttagcccttcaacagtcctttgtgactccctagtctggaaaatcctcaatggggctgtagactctgggccggagtcttcaggggcttcatttttagttgtatatgagcacacagcctgtaggcaaggctctttggcacatcctttagttttggtttacgaaatagctcactgcttctcatccagaagctttcatgaataacattgcttgaaaccagcattgtgcagagaatcctcttagcttattttattgcttagcttctggtctggctacttagtgactacaactttccagtgcttaaatctttgaaaaagtactagattcttactagaaggagggttttgtggaagctgtattgttcctggcagctatttagggttacttgccttgtcactgtttcccttcttggccttcatgtagaacagggaagctcagtaaaggcctatgcgaatgtctctgtgtagccgaggtgcggggctcttgtgacagacattgactcagatgagatactagccctttgaagatgctgggccaccatgggagagaagtaccttggcccagcggatatcagagcagcttttttcttgtggaagccactttcttgcattttcaatctttcctgtacctgatatggagcaggggatgagccacatcctttgggggaaagaagtaactgagttgggctggctgatgaccatggccgtagcagggccaatgttatagggggaatggagggagaatgtggtccattattctctccctctcccaaaataagttgttcattggcccctctataatgatttttttttttttttttgagatggagtttcgctcttgttgcccaggctggagtgcaatggcgtgatctcagctcaccacagcctccgcctcccaggttcaagtgattcttctgcctcagcctcctgagtagctgggactacaggcatgcatcaccatgcctggctaattttgtatttttagtagagagggggtttctccatgttggtcaggctgatctcgaactcccgacctcaggtaatctgcccgccttggcctgccaaagtgcttttgttactgaaaaaaatcataatttgacacagtgagagcctgcagcgctagtttattagatattctgatttggctaagagcaatatacacccagtaacatttcatactgaacatgagatttctaagtaggaaaatagttgcaggctaaggcagaaggattagaagtgggtagattggccaaaggttaggatattctagaaaagttagaatgatttgtcactttgggaaaacttgaggaattttctgccttttcttgctctctattcaacctgtaggtagagcttttttgtttgtttgtttttaagttaaaaagtttgacacttaataccaagtcagaatccttttaaaagaatattcatctgccatggttaaatgtctttagttggtggctttggctttatgtacctcctaaagattgagcctttgattgagcagtttcagttttcagtttttttctgtttatcagatatctgtgctatgcttctatttgtaaactatttgtctccctgataagacagttgtgagaaaaaaatgttcataaagggattcatgtacattttacttgatgttagcaggtagcttttcttcttttatataaaatgcagttttagtgcataagctagtctatgagaaaggaaaggaagaaaatagaaaagcttatgaatatcatagttttaattaacaagttagtatggcttacatctccaaacataaaggtacattctgcattattggataaaacagtatgggcaaatatatgattttgtaccttatgagttagcctgaattctataatttctttaagatagcttagaaagaatcaataaaaaaaaaaagtagacaatctggttttaaaagtaggtaaaagattcaagtcatttcacataataggatgtccaagtggccaataagcaccgaaaaggtattcaaacattatttgccatcacagaaatacaaattaaagctacaatgagataacactccacacccacaaaaatggttttaagaaaaaaattgataattatttccaacatttgatattaggaacaactgaaactctcgtttgccactagaaaatatgtaaaatgttacaactaccttgtgatagtgataaagatgagtaaaggtcaggctgagctaccatatttcattgatactaaatgccaccaaatgtaagatgcatcagtttttatctaccgctcagaaagaaaaaacactgccagttaaactaacatcccataaatggaaagacacaccctgattttagagatattaaagtgtggggggaaaatgtcttagaatcaatgaaatggtagataaataatagagataaatcggttatatgctagatagaaaatgagcaaaaaacatcttgagggatagaaagcattgcaagatcgggaaagaggatgttgctattttaaaacatttcgaaagtcggggtttataaagacttgtgctggtgatgtgtatttattttgcacacttttatatctcatgtttcctatttggtaaccagcaaagtgtgtaaatattaacactgtagctataattagtgaaagccacactcttatgctccgtgcggttggccattttaccaacatttaattttcttcttttcagccatttccaaagcagccaggaacatcaggtgcttatcctcttacttcaccccctacatcttatcatagcacagtcaatcagtctccctcaatgatgcacacacagtctccaggtaagatattacttattctcttgtcatgttcaactttcaaatccaaaatacacacacacaccccacattgagaagcactgtgcatctagtctcaggcttcagagagaattccctttctagtctatggctagatagttgtcactcatttattatggaaggtttgtgaaatctgtgtccaggcttgggagcactttaaaaggtttaaattaatgtcacccagagccagactcacagcacaactccagggggtgctaatcacaacatgatctatgttacaggttgacagactctaaggcctatgagccaaatcctgcctgtcacctgtttttgtaaataaagtttcattggaatgaagccacacttgtttatataatgtctatggctgctttcccactacgacagccctttacagaaaaagtttgctaagccacggaataggtgaagggtggcctgcccccaagctccagagttaggcagtgcatagtctgcttgtccagacataatggctttgttggcagccctatgaagtgcaccgtaaaagtgcttgagaatgccaaatttttgcttttaactgaatgattcagtggtatctcttgagcacttactctgtgccaaatgctgcctggtgctgaagatttagcagtgaaccggataccagccctgctcttgagcttatcatctagcgaggaagctaggtcatcagatttattggggagaatgacccgttgcctactaggtcctagtaatatttccagagcataatgatgtttttttcaaagaaagttttagcataaaagatgtgatatgtaatataggttgtaaaatataagaaattaaatgatttttaaaagcatgtgtaataaaaccttttatctagtgtaaatatatcagtccactgaactaaagaatacattaagtagttttgtaccaattgaaggcattcgggcttatcagaaaacagggcaaacaaaactacgttaattttttaagtagcaaacccaacaaatacatctgcttttaagttttcactttgaaaagcagaatttgcagtgcatactgttctcctttattttttttatttttttttttttttgagacagagtctcgctctgtcgcccaggccggactgtggactgcagtggcgcaatctcggctcactgcaagctccgcttcccgggttcacgccattctcctgcctcagcctcccgagtagctgggactacaggcgcccgctaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctctcctttataaaatacaaaaattcttatagatatgtatatgtgtgtctatatatgagaaatttgtattgaccagagaatctgttaatctgcaggtgggagatgtagtgacatcacttattcaatagctaattccatttgtaaaatgagaataatataaaaccttttccatagagatgttgtgagaatcgaatgaaatagttcacataaagtgtttagcctggggcgtggtacatgacaaatgcctctttgaccagtccattgtaatctgtcttgttgcccagattgggctgctcgacatcccacactgcctaggcactcacaccctggcagatcccacccccaccatgtctcacacttagccactcatattgctcttcacattacttcagtggtgtcgttttaaaaaaatagatcctcattttaaaaatctttaaattcacttttatttggggggtgggttgtgcttcctctgcttagattcctagataaacagtcttcatctgtaatgccaagtatgatgagtgttacaaaaagggtcacttgggcttctgaaagagcattcgataaggggggttcgattgtttctttcttgaggatgcgttgtttgcctccctcctttcgacactggttaagctgagacttgaaaggtcaagagttacccaggtgcagggacatggacaaggaggatatctcaggcagactgtgcagggtgtgtggagtctgaacttccagaagatggtagactcttccaaatggctggtgtatggagagacagggcgctgttaacaattttggcctttattgtatgggtaaataggaagccattgttggattttagtctgggttaaatttgtacaactgaaagtgacgagtggtggacgggcagatttcacagagaaaggaggggggagttctcttgaacctgttgattttgcaagtccccagagattactaagtcaagatgtccagtaggcagttggctgtatgagcctatggctcatcagagatggttggaccacagatgaagacttggaagttgttgttgtcatgtctagggtcattgaagcccaagtgggtggttgagtccacccctaggaataccagtggtcagtggggaagtagcagctagggaggaagtagacaaaacaggagaaacaggattgtagaaccccaggggagtgtgtttctaggataggagttgacattgtttttatatagtaggaagggaaaaatattttgaaataattataatagtggtagacaagcatatagtgcttactatgtgccaagccctattctaagcactttacccgtttaatcctcacagcaaacctgtggtgtaggtcctattattattcacattttatggaggaaaactgagacatggggaagttaggtcacttgtccagatcatacagctaaataagtaaacataaacacttaaaggttagtcaagttgatcaacatactgattgaaagtaagacagtgctttaggtattacagaacacaaaaatatgaaattatctcacatagtacagtcccccctcttattgctctccaaggttttagttggcctgaggtcaactgaggaccaaaaatgggcaagtatagtacaataagatatttagagacagagagataccatattcacataacttttattacaatctactgctaagagtgttctattttactgttaatgttaattttttactgtgcttaatttgtgaattaaactttatcatatatgtgtataggaaaaaaacaggtttcaatactatctgaggtttcaggcatccactgggggtcttggaacctatcccctgtggataaggcggggactgctatagtagagaatttgaaacatgctgatattaaaggtaattatgataatgtagcaagtgcttaaatgttgcatttattcatagttttggtagccatagttcacactttcataatcctaaattaaaactagtcctgtgcctttaaataagttaacgtttcactgttttttatatctccaatctcagtctctccataagtctagtattgtattttcttttttctttgattttttttttttttttttttttggagacagagtcttgctctgtcgtacaggctggagtgccatggcgtgatctcagcttgctgcaacctccgccttctgggttcaagtgattctcctgcctcagcctcctgagtagctgggattacaggcacatgccactgtgcctggctaatgtttgtatttttagtagagacggggttttgccatgttggccaggctagtctcaaactcctgacctcaggtgaaccgcccacttcgccctcccaaagtgctgggattacaggcgtgagccaccacacccagccttagtattgtattttctagctgtctattcggcatcatttccatgtaatgtctggtagatatctgcaactcagcatggccaaaactaaactctggatctcttcactgccccagtgctcctcttcccacagacaccccagctcagtaaatggcaggcccttccttcctgctacttgggccgaagctcttcgagtcatgctggacgtctctttcatacccatgttcggtcatttaccaaatactatcagcttgattttcagaatttacccagaatccaaccacttttcactaccatagtctgtcacctttaccaagccactagtcctctctcacctgaattattgcagttgtttctaactggttttcctgtccctacccctacccttgctctatagtctgtcccacagcagctagaatgatccttctgggacagaagttcgtccatgatttccgctccaaactctgcattggattcccactcattcagggtaaaccctaagttcttagagtggcccacaagtccccatgtgatctgggacccacccctcttcctccaacctctctggtgtcctctcttcccactgcccccctcgttcactctgttcttgccacaccggcttcctccctgataactgcttccacctttggggcatttgcactagctctctgtttggctggaatatctcatcccctgggtatcctcatgccttatccttcactttcttcacgtctcagctcacatgcccccttccttagagaggtcttttctgattgctgtatataaggaacaacacccacctccttcactacacaatcttgtccccttaccctgttgtgtttttttccatagcacttacctgacagatacttgtctttctcattctattagaatataagctttgtgagggcaggaatttttgtctcttttgttaactgctgcatccccaatgcctgaaacagtgcttggcatgaagttggcattcaggccttcttgttgaatgaatgaggaactgaataaaaagtacaccggatttttttttttaatcagtcaatataagagctagaatttgggcgcatggaattgaatagtctctttcaataatgaaatcgtgccagtttttctctgtgttatatatatgggagctatactacttgtttctttaatttatagggagatttttaacttggggtccttggacaggacataaaatgtgtcctgcaagattatctataattattttcctttattaggaaatctgcatgctgccagctcccccagtggggctttgagagccccatcaccagcgtcatttgttccaactcctcccccatcctcgcatggaatctcaataggaccaggggccagttttgctagtccacatggtgagtccatacatggaaatcgatatagcataagagcttgatgtgaaaataatttttgttgagtaaattttttcattgcaaaattaatacttgtttattgaggaagtagcaaaaatattgctcaagcaaaaagaaaatcaaatttatctaatcccaccacacagaggtaacgaccagtgagtttgtctctgccttggactctcccttgctgtctccgttgctctgccttgcccttcctgtcacacatgccctgcttgcctgccctctcacgtttctgttattctcacttgctgtctaccaagctgcttgtctcccccctcaaatacctgcccttgccccccaacaatgggtaccctaacatatgaattgttttgagacttgaattttttaacttttgaactcaaaattttattttgaattgattcaactagataaaaaatagaacaagtagtcaatgaaaggtttcctttttattccactaaccacctagttcctcttcccagaaacatgtagatattcttgcagagctgttttatgcatacacaagcaaatacatgcaagtgttctttcccctctcctttacacacacaacagcatactttacagtgttcagtgccttttttcacttaatatatcatgagtatgataccatagaacataaacaggttcctcagtttttaagctgtgtagcatctgggattttagtttttactattaatatttgtgggaacatttccgtcattaaaaactccacatcatcataccatatggtgtaataatatccgcttgtctgggcataccatgacttaactgctctcctattgttacatgtttagaatgtttccattttttcacaattaaaaatggtgccatctgtgctcatatccatgattatttccttaagtaagttccagaagtggaattgttgtatcaagggatttgacaaattctaaagctttcgaaacatataactgctcatctgaaaggctgtaccatttcccatgccatcatacaagaatgtctgttatcctgcatcatcgccagggagtattacatattttaaagaccttggacattttcataggtgaaaaatggtatcttactgtttaatgtatttctttattagtgaagaaaattgaaccttttttggttggtctttggtttttttgttttgttttgttttttttgagacagagtctcactctgttacccaggctggagtgcagtggtgcagtctcagtgcactgcaacctcggcttctcaagttcaagtgatcctcctgcctcaacctcctccccagcaaagtagctgggactacagatgtgcacaaccacgcctggctagtttttgtatttttttgtagagatggggttttgccgtgttgcccaggctggtctcgaactcctggactcaagcaatccacccacctcagccttccaaagtgctgggattacaagtgtgagccaccgtgcctagccggtctttggtgtttcttattttatacctcccagttatatatgctttgcctatgttcttgtgttttttcttgcccatttgtaagacctaagtaaagaccatttactctctgacatatacatggtaaaagtattttttcagtttgtcatttggttacagagggatataaataatatgttgaaggtatctggaggatgaaatttatttattttttatttttgaatatcttcgtagataccaatggagggtgaaatttaaatatcaaattgttcaggaagtcactgctttcaaaacttgagtcttggttcatttcttagtcaacgtagtctaaataaagaatatggaaaatttccttctcctcattctacttagagtagaatgaaaatatggtttgtcaaagttggtttaaaaatataatatttctgcctttaaaggaactctgagattgtttgcttaatattttaatgcatatagtagcatacattgttacatattacatacattgaagcttgtgtgaaggtaaattttatcctctctcaagctttatatttttctaatttttgtatcatgttaaaaagtaccttacacaaaatagagattcaggcatgacatgttaacacacatcaagcttcagtgaaacatcttattggaagaaaaaataaaattattactgtgtaaagatttgaatgctgtcaaataattttcagttattaaaatataggttttgagaatcatttgtttaccttttttataggaactcttgaccctagttccccatacactatggtgtcaccaagtggacgagcagggaactggccaggatctcctcaagtgtctggcccctcaccagcagcacgcatgcctggaatgtcaccagccaacccctcactacattctccggttccagatgcttctcattcccctcgagctggaacaagtaagtatcatcaacatttttatgttcttttttagtataacccaaagtgacctatcttgttgcatcctcacatttgaaagtcatgacctactttttgagagaggatacttaaaggatattacaaaggatgcagatgaagagatgcataaggggagtgcagtttccatgccctctgtgagccttcacatgtttgcctatctggaagttctccaaactctgtccttttgggtttttatggaagtttcatcacgtaggcattattgattaaatcactggccactggtgatcaactttgggggtggggctgaaactaccaaccctctaattgtgccgtgtctttcctgtgatcagcccccttcctgaagctacctaggggctgccagccatcagccatctcattagcatacaaaaggacacttaaccactttgaagagtccaaaaattttaggatttgtatgccaggagctaggacaaagaccaaatatatatttcacaatatcacacataataacagagaagagaattgtacacatttattggttagcttttgctacatttagtggcttaaaacaatatatgattgttatatattggttcacaattctgcaggttggcagtttagactaagcacagctgagtgattctttcagactctgctgggcagctcactcatgtgtctgtagtcagctgctgggttggtttgggactagatggcctcagatggcaaggtttctctctgctttgtgtggtttcacacttgatctgaggtttgttcacatggtggctcaacaggattttaaggcagggagtagaagctgaggcctacaactagcccagtgtcacttccaccacattctgttggtcagaagcaaatactaggccagccaggtttcaggtggagaaatagagtccaccccttaaaggagttgctgcaaagtcacattgcaaggggcctggatataagaaggagaaaaatagtggccatttttgctaacaggttgttaatatatgattgttacaccacaaggagtaactaaaacagtacagaatgatttagaacatcaaagatttatgatgaaagcaaaacaggaagcaatgagatagtatgtatttgtaaatgacataacatgttttccttcccaaaaggttctcaaacaatgccaacaaacatgcctccacctcgtaaactacctcagcgctcttgggcggcatccatacctaccatcctcactcacagtgccttgaacattttactgctgccctctccaactccaggccttgtgcccggcctggcaggtagttacctttgttctccacttgagagattccttggatcagtcatcatgagacgacatcttcaaagaattattcaacaagaaacggtatgggtacctaatgaccttctaagtggtgattgttaagggtaaaatgctaaattgtcctgcaggataggatctgaactaacgtgacattccttcaccttccctcctttaacaagcttgttagaattatgattttcaccctaacctggcattaaaaatggactccattattttcttttccattcttatgttaacatatttctgcattatacagtttgctgtgctgtggcttctatgttatatggctaacatggacctggagatagatttctgcagcacacaggagcactgcgcacaggatctggccttgcagagaatagcataccagtaattatttgccttctggagtgcccgtgcggggaggctgattttgactctgagtctttattgaaataaaataattggctgggtgtggtggcttatacctgtaatcccagcactttggaaggctgaggcaggaggatcactgagcccaagagttccagaccaccctaggcaatatagcaagaccctctctctacaaaaaatttaaaaaattagcaggcatgcacctgtagtcctagctacttgggaggttgaggcaggaggattgcttgagaccaggagttccaggttacagtgagctgtgatcatgctgctgcactctgtcctgggtgatcgagtgagaccctgtctctaaaaaaataaaaagagaaaaaaaatttgaagaaaattatttatggttacaaggacaaaagcttctttttaaatatgtgaacaggacgggcacggtggctcacgcctataatcccagcactttgagaggctgaggtgggcagatctcttgaggtcaggagttcaagaccagcctgggcaacatgatgaaaccccgtcgtctactaaaaaatacaaaaattagccaggcatggtggtgcgcacctataatcccagctatatgggaggttgaggcaggagaattgcttgaacctgggaggcagaggttgcagtgagccaagatcgcgccactgcactccagcctgggcaacagagtgagactgtgtttcataaataaataaataaatgaacaattgaatttttaaaaactctcgtagaaaaaagacttctaaaaaaaaaagaagaaaagagacttctaacttatcctatgctgatagccttaggagataatttataattgagagcaccagttctacagtcaggctgcctgggtttgtagccagccatactacctgctaatgtgtgcttaggcaaatttcttcagataatagtatttacctaactgataacagttgtgtgaatttgagatagttcatgtaaagcccttaatatactgtctaggcattttcattatttataattactgttattattggtagatgcatgtgctaatgaggtagtcaaaatggtgaatgtttaggccgggcacagtggctcatgcctgtaatcccagcactttgggagactgaggcgggcggatcacttgaggtcaggagtttgagaccagcctggccaacatggcgacaccctatctctactgaaaatacaaggccaggcgtggtggctcatgcctgtaatcccagtactttgggaggctgaggcaggcggatcacttgagcccaggagttcgagaccagcctggccaacatggtgaaaccccatctctactggaaacacaaaaattagctgggtgtgatggtgcacgcctgtaatcccagctacttaggtggctgaagcatgagaatcatttgaacccgggaggcagaggttgcagtgagccgagatcgtgccactgcactccagcctgagcagacagagcgagactctcaaaacaaacaaaaaacaaaaattatctgggtgtggtggcacatgcctgtaattccagctactcgggagactgaggcaggagaatcgcttgaacctgggaggtagaggttgcagtgagccgagatggtgacactgcactccagcctgggcaacagagcgagactccgtctcaaaaaataaaaaaagaattaaaaatggtgaatgtttaaaatattcactccatgtttagtgtaaagccattttgcaaccttcatactaagatttggtggggaaacgtttttgaataaattagcattcaaaagaaagaaaaataataaaataaactaaaattagcactcaaaatggtaatcatcagacccgggatctagcctcagctatgccacttaccatctatgtaagctttcagctctttggcctcattttgctcagctgcataatcaacatactctgctaaaacgggtcagtaaactacggcccctggtgctatgtccttaccacctgtttttgtaaataaagttttattggaacacagccacacctgttcatttatttattgtctatagctgctttcagctgtgatgacaacattgaataattgtgacagagaccatatagtgcataaaacctgcaactttttctatataacactttacagaaaaagtttgtcgacccccggggctagaataagagcctaatccagatctaaccttttgtaattgtactctgtcttctttttttctaatgtgccactttaaaaaaagatattgtggaaaatgttcagcatatacagaagtagaatggtataatgaacttctgtactctcatcacccacctccaacagttaactaatatcagtattgtttcatctagaactcctccccccagattttcacagcaaatctcagacataatttcttgcataaaaatttttgcatatgtctctaaaaagtatagactcttaaaacaaaacaaaacaaaaaacacaacctgcaccattctcatacctaaaaaaaataatttctgtatcacatatctagttgatacccagatttcccaggttgtctcattttttacactttgaatcagaaccgaaataagtttttctaagtccccttacaacttttggttcccccatctagttctccttcttcatccttatgcaattcggaatcacttagtatttttttgatccctatgttttctatcacattggtcagtcctctggatcaaactactgcatgaattcaggctcaagtttttttatgttgttttgcaagaatacttcataggtagagttatgttcttccatcaagaggcacataatgtctgatcgcatctctttttgcagtgttgccagcagctgatgctcaatgctgtaggtgcctttgttttggaataggtatcaacttagtggttttccttttggaacaattctcagtaacatcttcattttctctttgacttacatgttaatttgatgtgtccttgttttgtagctgcagctgataaattctaatgaacccggagtgatcatgtttaagactgatgcactgaaatgcagagtagctcttagtcccaaaaccaaccaaacgcttcagctaaaagtgacacctgaaaatgcaggacagtggaaacctgatgaacttcaagttttggagaaattctttgaaacaagagtatgtgtttaatagtgcataatttgaatataattaatgaaacagaagcattaatgtagaatgaagagtaacttgctttatttatccctgtaggttgcaggaccaccatttaaagctaatacgttaatagccttcaccaagctattaggagctcctacacacatcctcagggattgtgtgcacattatgaagctggagctggtaagtcacagagatatacatttctagcaaggtttgtttgaggaggttagagttggtgggagcagtgtttattggttttcacccatctatgtagtttcttctatttttctcttaaattcttaatttttaacttaaattttatttatctttgaataggtaacacaattctgttttatcttttgaatttaaaacaagataatatagtgagaaatttcccatcagttcctgtctagctatccctgtcccctctatccctgtccaactgtcttctggccaaccagagttaccatggcttgcctctccttccagagatggtccattcataaaagcaaataacattgctctcataaacttttgattgattgagacacggtctcactccgatacccaggctggagtgcagtgatgagatctcagttcactgcaccctcgacctctggggctcaggtgattctcccacctcagcctcctgagtagttgggactacaggtgcacgccaccgcgcctggcttttttttttttttttttttttttttttggtagagacggagtttcaccgtgttgctcaggctggtctcagacttcaggtctcaagtgatccacccaccttggcctcccaaagtgctgggattacaggtgtgagccactgtgcgtggccttcttataaatattttaaatgaaatgatatttacacatcctgttttgtacttttttccatttttattatgagatggtttatgtataaatttataacatataatttttaaaaatctgactcctcagctttgttggtcctagactttgtgtcctgaatagctattaaaactgaagtgcaggccgggtgcggtggctcatacctgtaatcctagtactttggggggctgaggcaggcagattgcctgagctcaggagctcgagaccagcctgggcaatgtggtgaaaccctgtctctactaaaaatactaaaaaattagctaggcatggcggcacagcctgtagtcccagctactcgggaggctgaggcagaaaaatcgcttgaacccgggaggcggaggttgcagtgagccgagatcatgccactgcactccagcttgggtgatggagtgagactgtctcacacacacacaaaaaaaggccgtgcacggtggctcacacctgtaatcctagcactttggaaggctgaggcgggccgattgcctgagctcaggagttccagaccagcttgggcaacatggtgaaacctcgtctctactaaaaatacaaaaaaattagccaggcatggtggcacatgcctgtagtcccaactacttgggaggctgaggcaggagaactgcttgaacccaggaggcagaggttgcagtgagccgagatcatgccactgcactccaacctggacgaccgagtgagactacatctccaaaaaaatcaatcagtcagtcaatctgaagtgcaaagtaagagacagcaagatgctccgtgggcagcagctgccttcagagcactgaatatctgttcttggtttgttgttggcccttgggggatttcccttagtttctgcatagctcagtctgcattcgtgttcgttttttagggctgccacaacaaattatggcaagctgagtggcttaaaacaataggagtttattctctcacggttctggagaccagaaatcctaaatcaaggggtcagtggggccatgctctctgaagaccctagggttgaatctattccatgcgtttctcttagcttcaggtggttccagcggtctttggtattccttagctactgcaacctctgcctctgtcgtcacatggtgttctctctgtgtgtgtctctgcctgtgtctcttctcttcttataaaggacaacagtcatattggattagggaccattctaatgacctcctcttaatttgattacgtctccaaagacctggttttcagataagatcatattcatgggtgctgggggttaggacttcatgtcttcttcaggtgcgcaattcaatgcataatagcatttaaaaagatggcttttggctgggcatgggggctcatgcctgtaatcccagcactttaggaggccaaggcaggtggatcacgtgaggttgggagtttgagaccatcctggccaacatggtgaaactccatctctactaaaaatacaaagaattagccaggtgtggtgatgggcacctgtaatcccagctgcacaggaggctgaggcaggagaatcgctcgaacccagaaggcaaaggctgcagtgagccgagatcacaccattgcactccagcctggctgacagagcaagactccgtctcaaaaaataaaaaataaaaagatgcctttccacccccagtatttttagtgtttgtggtggatgtgatttccaggatatctaacctggcatattgctcgaaatggaggagcatcttgctttattcactgaacaaatcttggagatgtttccatataagtatataaaggatgtctttgttttgtgttgtttaacaaagcttagtatttcattagatgaatgtattaaaattgctgagtagtcccaacttgttggccattttggtttcttctgatattttgctgttacaaacagtgccacaataaagagcctttttatggatgtgccagtatacctgtagaattgctgggtcggaggatatatgtaattgtaattttggtagattttgccaaattgttctccatagaggttatgccagtttatattcccaccagcaatgagagtactggctttttcccacatccttgtcaacagttttatcagcgtttagactttgggtctttctaatttgtagatttttaggtcttttgatttgtaggaattgggtatgtacattagcgaagttagccccttgggatattcattgtaaatattttttccgcgtttttcatttgtgttttgacttgacttttggtaggtttagctatgcaaaattttcttttaaatagtgaaatgtatcaatattggtttttaagttttcctgattttgtatcattgttagattcttctcactcccagattttgaaataatcctcccaaagttttttttctaataccatttggattcctttttttaattatttaaaattttaaatatatttttatttatttattttgagacagggtctcactttgttttggtgtcaaatatgaggaggtatggatccaactttttcagatgctcatttatcatataatcaatcttctctgtatggggagatatatactgtgaaagtatgtagttatatagatggaatccagatggcagctgatgtatttttttcagtcttacggtgatcttttcattttaatgtttctagtgttgatttgagtaacttcaattacctcactctttttttagttagcgttttactataaatattggggcaacagtgttcttttgctaatagtctcaacatttggcttctgatctaataggctgtaggaaacattatttatgtcaaaaagaaatccatttgaatttttaaaggagtaaatatttatgtggctaaaaaagcaccaatggatataatttaaaaatctttcacacagtttgactagtttgtttaggcaaagagttggaaacaggactgggaagtctagattggcacagttaagaagggccttgaatgctaggtgttggtcctcagttgtgggtggtagggggatagcatgtgtcactaaatgtcactgaacatttgtgagcttgactggaaccatgttgtaggacctatatctgatggtggtatgaggatggactggaagaggcagccactggaaagagctgttaggggagcacaggagaagtaataaagccctgcacatggtggcctcaatgaatatagagaggagggaacagatgtcagagaccctgcagaagccgaatccataggccttaggaattaacgaagtgggagggaaggaaggggaaaatcttacataagtccacagttgacttttcagttagcaacttcatgtatgtatttgttttgaaaaagtgcagttattaactttatgttctgttaataattgggtatgaaacaaaattctaacctctcagactttcctacctagaatatgattttaaatgtttatatgcctttatcttgatttttccccctcaaaatagttccctgaccaagcaacacagctaaaatggaatgttcagttttgcctgacgatccctcccagcgcgccgccgattgcacctcctgggacgcctgctgtggtgctgaaatccaaaatgctattttttgtaagtaccacccagcatgtgtgcatgtacagagcttctgagggaaatgccacatgataatagagcaacttttggataactgcataaattatctcttgttgccaaatagaggccaggattccttaattgtcagcgtagatgtcatgacatcctggttcctttagtaataaaacagaaatttattgaaccaggtaattgtgtagcacagttgcatcttaaccataatattcagttgtttgtcacttttcttgtcatgtgtaattttcttttgcttgcttatcttaatctgaaagtacagtaaatgatagtacctttgatacatttagacagatgttttatgatgtttttattctctttgtgtgtgttgtgtgtatacagcttcaactaactcagaaaacatcggtccctccccaagaacctgttagtattatagttccaatcatttatgacatggcttcaggtacaacccagcaggcagacattcccagacagcagaactcttctgttgctgctcccatgatggtcagcaacattctgaagaggtttgcagagatgaatccaccacgacaaggtacatgaccagtagacaatattttattgcatatatgttataaaagttcttttgagagacacccctttctcctcttctcttctccctccttacctactctaccacccaatcatagcaatagaggtctggttgccgtggccctcttaatgtctgcctgtcgctttcttcctttctcactggttcttcatttttgtccatttctctgctgcctggactttttgttagtgatttactattgggactgacccagttgctaatgccagaagcttgtatttatagcacacattgccacaaagacctaggttaggatgatagaattttccacggctgtgaattcctgccctaccatcaatacctgccactctgtacatcacaaagttgaaatgcatgttggtttctcatatttcatggttcaatcacgaatagaagaatattattaaaagttctgtatcttctaaatgttttgtgaagaataaaagctgatacaaatggcattactgcttttttgggcttcttatataagtgtcaggtgggtgcaagtgaaccttttcaccatgtgcacaatgaagctctcaaactgaacatttccgaggaaaccagaatgtttctggaaagataaacaaggtccctgcaatactggagtagacttcacttaacacgtaactcctggcagtgctaaatttggggttgcaaaatacaaagctcagcaaagagaacttttcttccattttgctcatttctaatattaaggaaatttaaaatttgcttatttctaatattaaggaagttctctgtatctctctctgtttagaatagttaaataacaattatgtttttaaatgagggaaagttgttctctgaaacatttttaggtactacagtgtccaaagttttctagaactaggaatcaggagagaaatgatatatttagctatttgtttccccacattggatatgcaggcgagttctcactttaatgtataaggaatacactgggcagtagagaagggtgtgcttcttttgttgtaatacttcttctacttcttacaattttctgctttcatcctttgacttctctcttctttcagctaaaaataggtcctcaagaatcaaagtttaaagctatcagaattctcaaagtaacagtccagtagaaccttgataataaacaccattccttcacaagcagatggctgtcattatcttatgtgtttttatgtattatgtcttgtggaatttaaaattaaaaggaaaatgttttgatcctattgggatcaagcaagttttcttgcctatcaataatgaaaatgtgttttttaaaaaacaatacttctccttttcagaaattgttgagatattttggaagtgttttcatttttttccccccttggactgggcagacctttggatttcctttttctttctgtaccttctcatgtgcacaggatcactgcacatcctgccctttgctgaaaggccatggttcacatgaggtcttcagttctcccactttcagccactgtatacagtgttagaccatgctgtagaggaagggatccagcttttggtttataatatttaaatacttgtaataattacaagaagcagagtatttggtttctttgagcaaaggagaagttgacaggatgaatcgccagcaccctccccacccacaaatcctgtttttggattgttggtgtaccatacttcagtctcccaccccacctcccacacccatcacttctcttctgatgaagtgcttttaagaaaatcatttttgtatttaattgattttaatgttgaactctggaagttgaccatttccttgaattttgggagaaaactccaatagatgtcagagacatgcactgtccagtataactgccactagccagcatgtggctatttaaatttaagttaatgaaaattaaataaaactttaaattcagttcctcagtcacactagctatattacaagtgcttaatagccatggcacacttatacaacatttccatcatcacaaaaagttctattggacagcgctgtcctaaacatttttatctggcctttaatgcaacgtttgaaagataccaccaaagttgtaactaatgcataaatataaactagatgtttttatgatatccaaaatgcccttataagcactcagtagccttaaagcccaacttcaaaggcttatctaatgctacagtgtttctaaacagaaactctagacatatcttcctaaatacaaacctaactgggacttgcttgaagtttcctcctgagaaaaaaaatccaaaccaaatataatctgatacttaacaccacagcttaatccccaataatctgggcagttaaaattgtcttttattttgatctttaaagttctcactaattttagatttaattaccccttcccttaccggtgtgttaacatctttcctgtgttgtgaatagctaatgaccatttttctctgttgcagg

SEQ ID NO: 1176 - DNA, 83948 bp, mus musculus; identical to SEQ ID NO: 1175

SEQ ID NO: 1177 - DNA, 7821 bp, mus musculus
gcggccagtagtttgcggcatccggaggagcagcagcagcagtagcggcggcggctggcgcagcgcggagacggacgagcgggcacagacggcagcacagctcccgtgcaccatgcctggcttgcccgggaggcactggcacccgcgtccctagcccggcgctggcccttggcgcgttgcgctccgcagcattccggctgagcgatttcatccgaaatcctaaacctcctaccccaaacccattgcctcctgcttgctcatactccacactcacactccccacaccacacactcactcttcctctctctctcacacattcacacacagcccgagacagacagagaaagcgagacagacctcccgagtgcgcgagcgcccgggaggaagggagcccaacgcagcgcggccagcgcctctccgggaagatgaaatcaagacgctcctgcaagtaaacttcggcggcgacaaaatcgtcgactgtggcagctgctgaggcggaccccagcgacgtgcaactgagctaggagggcttcctcccgcggcggcggcggcggcggcggcggcggcggaccttggagcgacaccccagcccaaacggagagaagagaagcacccggtacccacggcggcggccccgcctctcctggccggtactgttgttgcctccccttccctcttccccattccccgccacccccggccattagaaagaccggggctttgattttcttggacaaattgccatctccccgtttccacaaacttgacgtggagggtcggactgcgttgttaactttgatttcctagacgaaaacgcccgcagaccctcaactgctctgtggggggaactccgctcccacctcggatcctggacagacgcgcccccaagcccttcgaagccagccttagcgcgagggagcgcgctcaagctctggcagcctctctcccctcccccttcctctgctggccccgggaccgccatccgactcaaccctataaccgggtgcccgcggcgcttgccagtaactgactcccgtctgcgacaccccctttctcccgaacaggcctcgaagaggccagtgtggcccccccagaccccggagggcgcattccaagcgggtactctctccgcagtgaactgggagcgctggggggaggtctttgcgcatgccaggtgcacagacagcgagttcgccagcctcagtgccggtgcaccgcggcgggccgggcagtgcctgaaaggctgcgcctcctccgccctctttaccttcgcctcaagtactgtccggactcagcggtgcgtcctccaggccgcgcagacgccgcccgacccgcagccctgggcggctgccgacagtcgcgcccggctaactttgaaggggtaaaactgagtagccgggctggagggagggggctcggggccgcgcggcgctcccttggcccctcggagcccccggggcccccgcgagcccccgccgcgtccgccgcaacctcagcattggagccgccgcgggtgtcccccgcgcgccgccgggccgccctgggcgggacttctcccgcggcctccggggccacggggcgcgcgcaacaggcggcccgagccggcgggaagctggagcgccgacggcgtcggtctcggaggggtgtggagaggcgaggccaggcagagccccgtgcagccatggagtcgctcctgctgccggtgctgctgctgctggccatactgtggacgcaggctgccgccctcattaatctcaagtactcggtagaagaggagcagcgcgccgggacggtgattgccaacgtggccaaagacgcgcgagaggcgggcttcgcgctggacccccggcaggcttcagcctttcgcgtggtgtccaactcggctccacacctagtggacatcaatcccagctctggcctgctggtcaccaagcagaagattgaccgtgatctgctgtgccgccagagccccaagtgcatcatctcgctcgaggtcatgtccagctcaatggaaatctgcgtgataaaggtggagatcaaggacctgaacgacaatgcgcccagtttcccggcagcacagatcgagctggagatctcggaggcagccagccctggcacgcgcatcccgctggacagcgcttacgatccagactcaggaagctttggcgtgcagacttacgagctcacgcccaacgagctgttcggcctggagatcaagacgcgcggcgacggctcccgctttgccgaactcgtggtggaaaagagcctggaccgcgagacgcagtcgcactacagcttccgaatcactgcgctagacggtggcgacccgccgcgcctgggcaccgttggccttagtatcaaggtgaccgactccaatgacaacaacccggtgtttagcgagtccacctacgcggtgagcgtgccagaaaactcgcctcccaacacacccgtcatccgcctcaacgccagcgatccagacgagggcaccaacggccaggtggtctactccttctatggctacgtcaacgaccgcacgcgcgagctctttcagatcgacccgcacagtggcctggtcactgtcactggcgctttagactacgaagaggggcacgtgtacgaactggacgtgcaggctaaggacttggggcccaattccatcccggcacactgcaaggtcaccgtcagcgtgctggacaccaatgacaatccgccggtcatcaacctgctgtcagtcaacagtgagcttgtggaggtcagcgagagcgcccccccgggctacgtgatcgccttggtgcgggtgtctgatcgcgactcaggcctcaatggacgtgtgcagtgccgtttgctgggcaatgtgccctttcgactgcaggaatatgagagcttctccactattctggtggacggacggctggaccgcgagcagcacgaccaatacaacctcacaattcaggcacgcgacggcggcgtgcccatgctgcagagtgccaagtcctttaccgtgctcatcactgacgaaaatgacaaccacccgcacttttccaagccctactaccaggtcattgtgcaggagaacaacacgcctggcgcctatctgctctctgtgtctgctcgcgaccccgacctgggtctcaacggcagtgtctcctaccagatcgtgccgtcgcaggtgcgggacatgcctgtcttcacctatgtctccatcaatcccaactcaggcgacatctacgcgctgcgatcctttaaccacgagcagaccaaggcgttcgaattcaaggtgctggccaaggacggcggccttccctcactgcaaagcaacgctacggtgcgggtcatcatcctcgacgtcaacgacaacaccccggtcatcacagccccacctctgattaacggcactgccgaggtctacataccccgcaactctggcataggctacctggtgactgttgtcaaggcagaagactacgatgagggcgaaaatggccgagtcacctacgacatgaccgagggcgaccgcggcttctttgaaatagaccaggtcaatggcgaagtcagaaccacccgcaccttcggggagagctccaagtcctcctatgagcttatcgtggtggctcacgaccacggcaagacatctctctctgcctctgctctcgtcctaatctacttgtcccctgctctcgatgcccaagagtcaatgggctctgtgaacttgtccttgattttcattattgccctgggctccattgcgggcatcctctttgtaactatgatcttcgtggcaatcaagtgcaagcgagacaacaaagagatccggacctacaactgcaggtaaagccaagttttctttctttgtcttggatgaataaggtgtgtttatctgtgtctctgtgtgaaaatcctggtgcttttgtttcctacttaaatgcatgcagcatacttgcagtgcttctttttgtagggtgaaaagtttgtgacagtccaagttgatcaattcttttgatctgacaatttgctggaagacaatcatttagtgtttgaatggattctgtcacataatgatggtgagcagaaacgcaattatcattttaaaatttgcatagctgtctccatgaagttatggtaggaaaaacagagagagagagagggagggggagagagagagagatcatatttttaggaaaaccaccaactaccacaacttggtgtctggggcacagtgtttttgggacaggtactgaatgaaaggagagggagtgttggcagctaccctgtcttgttgcagtgatgaactctggagagagactgggagtgggagtgtaagatgggaaagggagatgagggggaggagagaacaggagtgtgtggagatgcaggtgattagtggtttttagtttattcttggcttgttttttatctagtccccaaacatctggctatataaagtgaaattctatcaggcatctgtatgttttcaaatatctggttggttggtagtgtggagaccaaacatcccaatgaggaacaagactttgcatccagatgtttcagtaaaaatagcaatcttctagagttgatgatgctttcctctaatgtgagactgtgttgtggcattaagatctggttcctaccagtggatgtcactgtgggctattgtgttacagtttctcttgaagtgtgtgaaggatgtgtgtgtgtctgtgtgtgtatgggggggggagggagagagagagggatagaagggggaggaaaagggagaaaagaagaaacacagtattttttaaaaagatttcctgataagcacattagaaggtcttactgaagccctttcttacatttggatagagcacataagtctaagcatttctagaatcctagaatccaatttaggataatacatgacattttttttccagcagtgtctcatcgaaacagttgaaaaaagttgtttctttagtttgctgaaaatgaatgatgctgctatttacaaccaaggtgtgtgtgtgctttcaacacacctacacatcagtgtgtcttttgtgccatttgtgtctgcatgttaatcagtcaaaatatgttcctgtaggttcagtttgtatttgacaccgtctgaaatgcacacttctgtgaatcagagccccctgaatatgtaacagccatgcaattattgtttcccttttactattctctgcgttacacaagttagtagacaaatgctaaccacacatgaatatcaatcaggtgccataaaagagcagctgcaatgcctcataaatgctttaatcctgttactagtgaaatggccatgacttttctttccttcagcaccaagtcatttcagatgggagaaatgtaaattaatattgctcttagctttcaaacctgtgactgctagtggcgatttttataggagaaaaatgtggggtcaataaaattttatttatatggagataattatggagaggactctttttaagccatcttctcagcataaagtaaatgcataagatcctttccttgatgaaaaagaaatcagcttgaaataaagatattgaaggctttgccacctcttggtgatgtatgactagaagtgagagccctttctgagaacttgccaaggagatgattaaacaggaggagagcatctgaatattgaaaaaaaaaaaaaagagtaaatctcagtgctctccaacttcacccaaatgtgtattttgtgaagcgttctgtttcctgtgatggtttgggattaatgaagtacagtataattaaataattggttaatacagaaagggctgcacaatgaatgcttcagctgaataatttgatggggcattgccaaagttactcatcttgggtaaacaaaatgattaaaatttcccattgattctgtaaacagattagaatagaaaatcaaccttagtactagggttttggggattttatctgctcccaaaccccagtagtaccagtttgccatcactgcaaatcttcctgagcacagagcgaaggggtgaggggaactcaattgcttaactctaggtagatcctggggacagagcaagaatttgcctctgtagatgtgtagtctccctatctgctcagactttttagaaacctaaagttcaggagcgtgtctttccatgtgattaggcagaggtttctttttctaagcctccgcagaacctcttcctgaaatgcattcatttatgagacttgcgagatgatctgcaattgctgcttgaattgggctccctttttgtattcagacaattagctttgtcgagtgagaataaggcacagtctttcccttgtaaagatcaacctgtattacttattaaccctattgttttgctgattattgcccagaaatcgaatttccaaaaaagaaactgaatcattatgtgcaaagtaataaatgactttgagaatctggctacatttaaatgtatttcttttgacaagtctcttaatgcctggtgtctttggtgcacgttgctgggtctgtgtcagtgttaattaaattgagctctttatgttccagttgcagcacagctgcttgtaggtacacctgaatggagaaggatgctgaatgcactaacctttaaattcctttgcagtaattgtttaaccatcacttgtctcctcggctgttttataaaaggacaaaacagcaagtgtctgcattgcatctcggtttctcccattagcgaggagcaagacaaaaagacagaggagaaagtgagcctaaggggaaagaggtaaaaaggcatttcccctcatttaaatgggtttggctattagatttttctaggagaggagggggtcggggggtgagtaaaagggaaccgggctagggcagggaggagggtgtggaggagacgcgaaagaatggggtctgatctcctaccccagtccaaaactgatcgagtgagtcatagaggaagctgattgagggcgtgtgccacatggcaaatgcctggaggaactggcaagggggtgggggcgggtattttttattttcctctatctcctctttggtgacttgctttgtatttcacctaggagttccttttggttccagggaagctccagatttgagcattttcatgctttctctcccataggctcaactttccctgtccccccacccgtgctcacaggccactcacaatgaaaaattccaaatccaaagtatagaaacttttttagggggggttggtgggaggttactatgtttaatatgaaaagtttatggccctcagcctgttttcccttgtaaaaagcacagggagaaacccgatgatgtaatgcaccagaataaggagctggagcggagatggggtgcaaccctctggggtgcttaatgtttattaatcagtgcatgatttgggagggtgttagtgattcatgctgccttttctgtcacatagaattgctgagtactcctatgggcatcaaaagaaatcaagcaagaagaaaaaaatcagtaagaatgacatccgcctggtaccccgggatgtggaggagacagacaagatgaacgttgtcagttgctcttccctgacctcctccctcaactattttgactaccaccagcagacgctgcccctgggctgccgccgctctgagagcactttcctgaatgtggagaaccagaatacccgcaacaccagtgctaaccacatctaccatcactctttcaacagccaggggccccagcagcctgacctgattatcaacggtgtgcctctgcctgaggtgagtgcagctaagtggctctgtgaggttctcccaggtctccttctttagctgctcgctggata

SEQ ID NO: 1178 - DNA, 7821 bp, mus musculus; identical to SEQ ID NO: 1177

SEQ ID NO: 1179 - DNA, 57664 bp, mus musculus
gggaaagttgcagctttttccgcctcccgggagggtgagaagggccggctgccggagctgggttgcgatcttcccggagccggagaccctcccttgaaaccggcactgggacttctcgatctctggaggcacctgttgcaagtgacaggtaggtcaacagccagcggccggcccctcgccctcggtccggtgctccttctggacccccagctccttttcgctgctgaagcgcccccacccccatctcggggtcgtgcgtcttccctacccgctctctggtcccccaatttttccttctccctagctgaccgcgtctcccctctccccgtccgcctctcccgaccgcatccccaggcttggactcccgtctgcttgggcggtccctcccggccacttttctttctccagggcttcttctggccccttccctgacccacccagcactaatgcggtctgtgcccctctgggagccgcctcccctctcctcttcggctcccctcgcggggagtgcccgggcttttcccgccagcccgagctggtgcccctcccgagagctggccctgggggcgggggcggggccgagctcctagcgggaactgcgccctccaaggcgtccagtcaccttttcgtgggttcctctcacagcgctcggccgtcgagcggggtcgctaacccgcactctcttcggacctacgacatcgcggcttctctggcgttggccagtcagccacaggtaaaggctggaggctggttggctggagtcctgcctcagtgggctccctctgcgcttggggctggggacctggctgtgtgctgtggagctgctttatattgccgctcttcaagcaggctgtgagagatctggtactggaggagggtccccgagatctcagaaggggcacagaatgcttctgtctcctgtgttggtttgtaatggggcagaaaaaggtgttcctccaacccttaacattgaatgaggtgggatttggggtggtgaaatcatttggttagaattctggtggcttgaaaagtggtgactttctaatcaagcttttcttcccccagtaccctgcttcttcaggattagaggacgtaaaattccagagtactgtgcttggcagggttgaccctagaccttgtatatttgtggcaaaaatgagtcttctgtacatcctggacctcctatatttaactggcttattttctgctctttaagctccccacccccacctctcataaatctattaatattgaggtattaatgacttaagacttttgtcgctgtgggaacaatgtttaatgcagagacgtggccttgatgaagttttctgcgtttttggttgtttggtttttagcaccctagtagaaaagcaccaccaacttggcttgtgaggccctttttgggcagaggatgaacatttctggtaacacaatttcaggtgtctcactcttggtcagagcagtgaaatggagctggaggcctgttctggggtaattgatctgtgagtatatgtagcattctggctctctgagcttgttaggctctggttgttaggctccattgagctggacactgtgataagttctttacataaaaatgcaatcctcacaataactctatacagtaggtgctacagttataaccatattatgatgaaaaagagactgagaagttaagtgccttgccctcaaaatctcggaggcagagcttgtgttcctatcctgtcacaccacctctgttgtcttagatgttgggaacactgaatagctcatggatgaggactaagtgattaaaaaattgtcttccaagcccaagtatatgtttttctccttgcttccaccttagatgcactgccgagactatggactacttaccttactgatgtcttacccacttcatttccaacatgggccagttgccacgttaccactataagtacacatccctgagtgtaattagatgaatgaaatctcccgggttttcagctctgtggtaattgtcctgaagttaggggagggtaaccctggattctagggatgtgtgcctgactcaacttcttcctctcctgctggctaggggagaaatgagggagtggtaagtgatatggatttcctgacagccataccagagagcctgagggtgatcgtgtgctagttttgtcatgggatggatggagtaccatagacaaggataggaagaaaatgtcctccctattcccatctctgggactttgctcaaactgttcctttttttcttcctaaaaagctaactttcctccctcattccccctcccctgacattaattcctatccatccctcaagattgagttctaaagtcacctcctttggaacggccttactgaacacatacttcttcccccaagcagaattgccagttatcctgtgtcctaaagcactttgtttacacctcagtaaagcccttaacactgcttagttgtttttccacctggaaggctgtaagttctctaagggcaaggtctggatctcggagctccctttgtcttaaatataagatgttggcaaatatttgtgccagtaaccggacataccatgccattccttcaaggggctgaggtgtagtgatggtggggttgaggtacagaagacaccttcctgaggcacttgaaataccacagctaggaatttgccctgaccaccctatttaaacgtgtaatcccttccctgaacattccatatgccctttccctaccttattacattgttcttgcttattgtctgccctcccactccctcacccaccataacataaacaccctgtgggcagggattgctgtctgttgtattcaccagtagactcttggacccagaacagtccttggtacatcataggtgcatactaatatttgttaatgaattaatggcattgccattctaggaatttggcactcttggagttaggcactcctggacctgaaactaagcctacccagtttgtcgccctacaggtgtaagtttgccccaggcccaaaactcagctttacttctgctgatttttgctttgagattgcattcctgatgccaactttgacctagttggaagtacttcctctctcttacttttttttttttttgaggcagagtttcgctgtgtcgcccaggctagagtacagtggcgcgatcttggctcactgcaagctctgcctcctgggttcatgccattctcctgcctcagccttctgagtagctggaactacaggcgcccgccaccatgcccggctaactttttgtgtttttagtagagacgggatttcaccgtgttagccaggatggtctcgatcttctgacctcgtgatctgccctcctcggcctcccaaagtgctgggattacaggcgtgagccaccgctcctggcctctctattttttaaaagtatgagtctctgggtggaaatctctaaagtttaaaagtggaaatgtaaaaatgttgtgcttcttgttggtaggaagggggactgcactgggaggaaggggtgtggattgtcagatgtcttgaggcttttcaggcttctcgcaagatcaataagaggctggagaaagttactgtgcaatggggaagtgaacagctcaaaagaataacggatggcacaaattaggcttctggtttcaagttacccatagccttttaggtatgaggtggttattggattatggaactttatggaaaagccgtagctgagtgctatttgtgttgtacttaactagttttctaccaggatgactgtgcagtctggagaaaccactgtgtaacataaaagaaaaaagtgctattctgtttaaaagtgttttgaaatgttcagaaaggaagaggccagaatctcttagaagacagacttggaaggagttgggcccttcaaaaggtggtaaatatgtgattctcatcatttaatatatgttaacttatttgaaactcaaatttgtacaaaaagctgaccagcttctttttctactaaatttgtctccccagcctttgaacattgcagtgacctggggttcagtccctggacttttctccatctaaaatcttcacagaggctctcatccagctgcatggctttgaagaacatctgtctagactgttgtcactcccaaatttatgtttgttacccaggcctttcttctaagctgcagcctcatatatccaatgacctatttgacatctctgcttgcctatcagatagacctctcaaatgtaacgtggccaaaacggcactcccgattgcccttgtattcccaccctcttccctcagcactccctgtctcagtaaaatgtcaccatcatccattcagttgctcaaaccaagaacctaagatcacccttgattcttctttttctatcactgctctccacccaatttaattcatgagggagtcctgctgacctgatcttcagactgtatcatgtgttctgccacacgtctccatctcctctgcctgtcaccctagtccaagccaccacacgtctgccacaaacattcttgcataatgctcaaggatatatatatacacaagtatttttgtgggatagctttctaataggagaattgttaggtcaaaggacatatacattaaacaatttaaataggcatcaccagagtgacatctaagagggtttaccctttcaccattgcgagtggttttcctcctgcccttgctgaggatggatgacgcttttaattttttccaatctgataggtgaaaaatagtatctaactgatttaacttggcatttctctgatcactagtgtggctgagcatcttttcatttgtgctagctatttgtatttttccaagacttgctcctttatatcctttgcacatttatcttttgggttatatatttgatttgtttgtaagaacactatatttattagttatatttacccattgcctattatatagtgcaagtttttttctctctagtctgtcatatgtcataactttgttcatgatgtgtacccctctcgtaatcagataaaacccactataaaacatttaaaaaacacgttcattagatttggcaattaggaggccaatgacaacatcagtgcagcaggaggagagaaggcagatcgtagagggttgggcagtgaggactgagaaggactgataaaaaatatggtagatacacatggacatggagagtgggatgatagacaatggagactcagaagggtgaggggtgggagaagggtagatgatgagaaatttcttaatgggtacaatgtatgttattcaggttatagataccctaaagtctctgacttaaccactgcatatgtaacaaaattgcatgtgtaccccataaatttatataattaaaaacatgtagtatatacattgaagaagcttggctatgatgggaaggagagagtgttccttatagacagtaaggcacaggggataaaaaggctgttttatttaattttgttttactttaaatataagagatagatgagcccatttatgtgcagatggcatacagcttgatgatgcaaggtccccgagaaagtcagagggtgggagtgccagagtgaaagaggagaaaagactagccttagagaaaaagtggtggctcttccattgaaacaagaggattcaccaatcctcttggtaaaaactatggagaaggaagtacctgtggagggacaggattttgagagagcccctccgcccccaacaagagagtgaaaggttcaccagagagtaaagaaggcaagaatggtgaagggttggaatagcatttgagagagacgaaaagaggagttctttaggggcatatcatccaggttatgtatgtgtatttcaaaatatcatgctgtacaccataaatagacacaatttttgtcaagtatacctccataaaactggaaaaaagttttaaaatggcttgggtaacttgaatttgtctctgcctcaagtcgcagaaccctgtatccattctgtctggcagcactcatcagaccaggaacagagtgtggacaatctagtatggggaattttttccgggtggccgtgacagaaatagggagagggctggagattggatggccctggcagaagaatagttgaaatgatggaccactgtggctttcatattcatatctgtgactatctaaacctaacttgaccttgagtaatttttaagaagtagaaaatttccatggcatctacactgcttcttgtttgtagctctatcgattcaggcatcagaataccattagtatcagtgtctttaaactcatcagaaagcgtgatttgatttactgagggcctatgttgtgccatgctctgtgttgatttactgaggatttacgttgcaccaactgagagcctacagtcaggatcctacaatgtagatttatccatctatccatccatcaacccagctagatgcttgaggtatggctgagaagaaggtagacaatggccatttttctcctggaacttatttcggcaggggaagtgtatattaaatattgtatcacataattttttaattacaattgtgataagttctgtgaagttcagttttcttagaaatcagattgtcacattgctttttaacaggccttactaatttacatttgccaacaaaatatgagaatatctcttaaatcctttttaaaaactgaaaattgtctttctgaaattttgctgaattaataagcaaacataaaaaaatctttattgccagtaagagtgaaactttttctttttgatgtgtattggccatgtgatttttcccctttaagaattatctattcacgctctctgtctattggatacttacctcttcttgtttttaatagatctctcattccatgtttgaaaccattagctacacttctctcctttctctcttagccctggtgaccttaaaatattttcccctagtctctacggccattcccttttgatctcctgtgaaatttttttcttacctagaagtgttgctgtgcttagggatgggactacatttttattacttgactcaataaaaggtaacatataaatcttctgttcctgcttatcccactctccagaggtaacaatgttaagattgtatttctttctagacatttttccattcatccatgatccaatctgtctaaaatgtaaacaaataaaaatggaatcataatatatatgatttgcaatttttttaatttaatatgctttcagtgtcagtatatatagaactacagtaccttcttctttttttttttttcttttttcttttttttttttattgatcattcttgggtgtttctcgcagagggggatttggcagggtcacaggacaatagtggagggaaggtcagcagataaacaagtgaacagaggcctctggttttcctaggccagaggaccctgcggccttccgcagtgtttgtgtccctgggtacttgagattagggagtggtgatgactcttaacgagcatgctgccttcaagcatctgtttaacaaagcacatcttgcaccacccttaatccattcaaccctgagtggacacagcacatgtttcagagagcacagggttgggggcaaggtcacagatcaacaggatcccaaggaagaagaatttttcttagtacagcacaaaatgaaaagtctcccatgtctacctctttctacacagacatggcaaccatccgatttctcaatcttttccccacctttcccccctttctattccacaaaaccaccattgtcatcatggcccgttctcaatgagctgttgggtacacctcccagacggggtggtggccgggcagaggggctcctcacttcccagtaggggcggccgggcagaggcgcccctcacctcccggatggggcggctggccgggcggggcgctgaccccccccacctccctcctggacggggcggctggccgggcgggggagctgatgacccccccacctccctcccggacggggcggctggccgtgtggggggctgaccccccccacctccctcccggacggggcggctggccgggcagaggggctcctcacttcccagcaggggcggccgggcagaggcgcccctcacctcccggaacgggcggctggctgggcggggggctgaccccccccacctccctcccggacggggcggctggccgggcggggggctgacccccccacctccctccctgacggggcggctggcctggcgggggctgaccccccacctccctcccggacagggtggctggcctggcgggggctgacccccacctccctcccggacggggtggctgccaggcggagacgctcctcacttcccagacggggtggctgccgggcggagggactcctcacttctcagacggtgcggctgccgggcggaggggctcctcacttctcagacggggcggccgggcagagacgctcctcacatcccagacggggcggcagggcagaggcgctccccacatctcagacgatgggcggccgggcagagacgctcctcactgcctagatgggatggcggccgggatgaggcgctcctcacttcctagatgggatggcggccaggcagagacactcctcacttcccagatggggtggcggccgggcagaggctgcaatctcggcactttgggaggccaagggaggcggctgggaggtggaggttgtagtgagccgagatcacgctactgcactccagcctgggcactattgagcactgagtgaacgacactccgtctgcaatcccagcacctcgggaagccaaggctggcggatcactcgtggttaggagctggagaccagcctggccaacacagcgaaatcccatctccaccaaaaaaatacgaaaaccagtcaggcgtggcggcgcgcgcctgcgatcgcaggcactcggcaggctgaggcaggagaatcaggcagggaggttgcagtgagccgagatggcagcagtacagtccagcttcacctctgcatcagagggagaccgtaccttcttctttttaacaaaggcacaatattccctaatatgtgtgtacaataactagtcagtttcctttgatggatgtttatgttctttaatttttttttttttgctgtttcaaatattgagcatcctcagaatatatatttgtgaatttacttgaatatcagcagaataagtttctcaaaatgaaatggctatgttaaaaatatggtcagtggtactaaagatccagagaaatctaggaagaccaagaactgtctattggatttaggaagttcttggtgaccttagagcaatttcagagaactgtgaggcagaaagctaaactatggtgggttgagaaatgattggagagatgaggaagtgaaggcagtgattatgtacaattccttagagaaatctgtctggctttgaagagcagagaaagggtagtagcaaggaaggagttgagattgaggacctgttatttatttatttatttatttatttaggaaggacttgagtttctttaaaggctggtgggaaggagggactaattaatagagcaaaatccttggaaggcaaagtccttatgccagatgggaggggatccagattgaggtagaggattatcctcaataggcatagatgaaagtaggttcatagatttggcggcaggaacttgtctgatggtatttctatttctctatgatataatagttaaggccaacctcttagagcaggggttaagatgggacaaggtttgagttagatatttgtggtatttgaagaaggtttgaaatagttattgtggagaacaggagagcagcctagggaagcatagttgcagtgccaggcagggttaagatgagcttggtgaccaagaattcatatggataataatctaccagagtgtgattttttttttctccagtagatctcaggagtccttgtgcatgcataaagtataacagttgggcttagaagagctatggttttttaaatcagatatttgcagtgaaattatgcattattgaggatattgacaagagtgcagttgaaacaatagaattggctgggtgcggtggctcacaccagtaatcccagcactttgggaggctgaggcgggtggatcacctgaggttaggagctcgagaccagtctggccaacatggtgaaaccccatctctactaaaaatacaaaaattagccgggcatggtggcgcacacctgtaatcccagctacttgggaggctgaggcaggagaatcgcttgaatccaggaggcagtggttgcagtgagccaagatcatgccactgcactccagccagagcaatagagaaaaagtctcagaaaaaaaaaagagaaagaaacaataaaatttaaatgttattgggaaggaagtaaagatgggaaggagctgaggaggtgaaagcagaagggtctatggaagactgcccccatccaagaaatctgagaacaggaatggggctagttggggggctcattggctgaataggctagaagcacagcaggttgtggtcagagagggggtgttgaatcagtgatatcaaaggtggagaagtcctagatgataagctcttgggtgtggctgaatatgatatatggtattcttgatgccagctcattcattcaacaaatatttattttgtgcatattatgatccaggcagtgctctaggcaccaaaggtacagaaatgaacaaaacaaagtcccttctgtcatacagcttacaatctagtgggggagattatttttataaactaaaagaacatccttattgatgtgctgattcctgtatgtgtagctttatttgtaactaatgataataccaggatcaaatatttacatatatgggggctaagaaggtccatctaggcattttgagtatcttgctttatctcaagttatacttactgaattatgaaaactcatacctcttttccccttagaactttttaaggtatttttacttactatgtcagtattgaaaataaacaaatatatacaaatctaatttgaatatttcattggttttaattttttatactgtattttttaaaaatattaggatattgcttcaagctgtagaccagatgttgataatgcatgtactaatcttgctctagggatttgatgtaatgtgtaaagtaattatggttaagcagtttaggagggaaagagggcttgtaataagttaatattttatgtttatttttatattattctccaatttattttattatttatacctaccttttaatgtacatatggtcatgtatatatttattaatattttatttgaaagaaataagcatttatttggcatcttataggcctcaagtaacactttaaaattacctgccacgtatgcaattcaatttaaattcaactacaggttattttttattgttttaaggtttctgtggccatagccagatcacagcatccctaaaattaaaaagaaaccaaatgcatgaaatcacagttatgtgtgagcatgggctggattagtcatgaaccatgatgatttcacatttaaggggactgtgtgggtaatttttaggtgacatggtctgcaagaaataatcagatgccagttagagttcagtttagaaatccccaccatctgtgatcccagcaggagaagagggtcttccctgcgggagtgctgcattatcaaagcttgttgactaaggaaagataatagtgttctgcgtgggaggtgatgaggcttattgaaaaataacaatgtgtcagctctcactggacttaaaaatgttttgtacatataaatgacctagattttaaaacagtccattcttttagttggggattttagattttttaaaaatctaaaaaatggggctgtcaaggaaggggcttttggcagagaagagggtaaactggccatcctgcacccatcagcctatgaggctcttgtgtctggctcatgttagaggaagcttcaaatgtagattttgaaagctggaaagctaaatgggatttgttttaatatatgtattttccctgttgccaagtagggtgtttggacacatggtctttataatattttagagttacttctatgtatcacatttatggaaatctgccttctaggattggtggtgggtttaaggcaccttctagagttgctgaggagcaggggacaaacgtgtagaatcatgaaggaccacatttccacatatccaaaacaaccattctgcaggagaaatgaatatatagtattaagatatctgacttccttctgggacttgttttagagttgtatatattattttaagtgggaatttctacaaaccatttatgaacagaatttgttggtattgaaaggtagctatgtggattccatctggaggaaattgtccccacatatgattctaaaagctaacaaaagaggcattttagttactaccactgccttcttccaccctgctgcccacccccaccccctgccccaccattatgcacctgccatcttttaggatggatgtcctggatgaggggaatgagttattgtcttgcgtataatgttgctttgagctagagttgctctggcgtgttacacatattgcaggaggaggtcaggggtctgggaaagtaagccagactgagggcctctcaaacattgtgtttgttattagctgaagacttttagaaaccccacctcaagttcctgaggttgatgttcccttttccaaaaatcaccatatagagcaatattgccagaatatgaagagacagtataatgtaatgtaacggttaagagcttggactctggaaccagacggcctgggtccaaaaaccagactgtcacagggcatgtgaccttgagcaagttatttgctcaatctgtgcctcactttcctcatttgtaaagtggacataataatttagtacctacctcatagtgtgattgtgaggactaaataaagtgcttagaagagtgcatggtacataataaacattatagaagtgttaactatcattgtcatcatcttcatcagttggtggatatcttaaaaggagtgaaaaccggccaggtgagatggctaatgcctgtaatcccagcacgttgggaggccgagatgggcagatcacgaggtcaggcatttgagaccagcctggccaacatggtgaaaccctgtctctactaaaaatacaaaaattagccgggtgtgatggcacacacctgtaatcccagctactgggaggctgaggcaggagaatcccttgaacccaggaggcggaggttgaggtgagctgagatggcgctgcctaactccagcctgggcaacagagtgagactccatctcacaaaaaaaaaaaaaaaaggagtgaaaagcacaaaatgcctcagcacatgcaaactctacttttgtagaatctattttgaaaaggatcgtagggagccaaaaccttactgcaaaatcagaattttgtaaaattaagagctagttgtaaatttctcattgttagggaaaaatacagctttgctcccatacaacttttgagaatggatttgtgaaggcaggccctaggggattttatgtgaggcatagatgtgctccatggatggacaggtgagggtctagaccccagctgactcctaggaagcctcagttgccctttggttttggagccttgatactgactctaccagtttgtctccactcctatttttcttctttttgatcctatttttaaaatttatgatattttttgatgttttatgaatctttgtaagtcactttaaatcctgtctggaacagtgtataaataaatatcctttaaactgatcatatctaattactaacatttgcttcatatttatgcttgtcagcctccctccatgcagagaggtacggtgaccttccatctaggcaagaatactgattagatttctcaaatttcatagaaagatgtcaaaactgccatatgctcatatattttccaaagcatatggttaataataattaaaactaaacagctaccaatattgggtgcttactctaggccaggcactatgctatgccttttactcatgatgcatgcttgaatcctcaaagccataggcaggagctcttattattaatcctcatttttacaaatggggaaacagactcaaggaggttaaataacttgcccaaagttaattcagggaaaaagcaaagctgtgattttaacccaggcagctcagatccagtgcttttaagcacaattctatgctatactgtccttaattagaaatctagcacatcagaactccaagtcctagtataagaggccgtacttgtgttacagaacattcacaggtcctgcagattttctctccgtgtaatgtctttaatatgcccctttccatctctagtgccactgccctctactcttggctcttgttatctttcccctggatttatgccacagcctcctcaaatccatagtctgcaaaattgtcagtgtgccctaacaagtccttgctttacataaaactcttcaatgatttctgttgtcaaaggctaattagccgtgtttttgcgcgtagcatatggagcacccgccagccacacatgatgtgattccccacctgcctcttccgcattctcccttacaatttaaaccaaccagcatcattgtattacttgctcataccacgttgctttatgcctccatgcttttgtaagtgctacgcactttgcctggaaagccctcgttctcctgcttatccagctgaaaaacattaatttacaatcagttcatgtgctactgctggatattctctttctagttccctttccccaagctgaattatgtgccctcccttggtattcttataatatctcatgcatatatttctttggttaccatgttttttttttaggattatttaagtgtctctgttactaaactgtgaactctgtgggcatggactagctctgttcttttcttcttagccagctagtgtaccgcttagcacatagttggccctcctaactagtgagcattctgtaacagtgcagaatacagagctctaggacagggaaagaagtaagatttggaaggcctgaaactgtgcacacattcaaagataattaccaggacagcagaaggagctcttgcagaaaaatctttggggccaggtaatttacattatttaacccaagagccagaaaggatgtggggagatgggagctggggtctgaatccaaagggaactttgaaacttctaagaagccagacttagcagctttataaattgaaacttccttgaatttgtctgagtagcctggaataggtatctaagacagttacattttaataagaatatttatagttttctaggagagacatcaccctaaaattgaaaggggcagttgatacaataaccaacacaatatcccaaagcaattattttattgactgtaagcaatgttgtatgctcatgcaaatgttaccagtaagatgttatccattggtatttttgtgcataggtggctggatccagacaaggggattttaggaagccctgcatccctggaagctttcttttctacttgagtttttttcttttttttttttttttttttaagttttgcagaccaccatatactctggatttggtttcatttttccgtgctctaaaatcaacttttttttttttttttttgagatggagttttgctcttgttgcccaggctggagtgcagtggtgtgatctcagctcaccgcaacctctgcctctcaggttcacgtgattcttctgcctcagccttcccgagtagctgggattacaggcatgcaccaccatgccagggtaattttgtatttttagtagagacggagtttctccgtgttggtcaggctggtcttgaactcccaacctcaggtgatccgcccgcctcggcctcccaaagtgctgagattacagacgtgagccaccgctcccggccaaatcaactcttttacctttagattatcaaataactagtcccccgcccatcggtactagattttgctaccttttagggctatgcttcacccatgttctggaaacccacacaaataatacgtattagttttgacagtactttagcttgatctgctttagatgctgtcattgcctttgtcacaattagttaatagagtccactttttttttttttttttttttgagagagagagaaaaggtcttattctgtcacccaggctggagtgcagtggcccaatcttggctcactgtagccttgacctcccgggctcaggtgatcctcccacctcagccttccaagtagctgggattacaggcacataccaccacacctggctaatttgtgtgtgtgtctgtgtctgtgtgtgtgtagagagatggggtttcaccgtgtagtccaggctggtctcaaactcctgggctcaagagatcctcccacctcggcttcacaaattgctaggatgagccacctcacctagcctagagtccacttttgaatgtgtcttatgacagcaaaaattcttattcattatgctgtactacttgcataagagcaactgcattacaatcatcagaatgatttattctttcctaattaacatacatcatatctctatgcaagtagaatcatgaaaatatatggcaatttgtagaatagtttcccttaaccagcctttaagtaaaggacttcctagcttttttgattactcacctttatcaccccaaatttttatcactcctaaaataagtatttataaactacattatttaccactgtattggtcatatattataaagcatgcacaggccaggtgtggtgtctcatgcctgtaatcccagccctttgggaggccgaggcaggaggatcacttgagtctaagagttcgagaccagcctgggaaacatggtgaaaccccatctctacaaaaaataaaaacaaagtagccaggtgtggtggcttgtgcctgcaatcccagctactggggaggctgaggtgggagaattgcttgagtccaggaggtcaaggctacactgagctacgattgtgccgctgcactccagcttgggtgacagagtgagactctgtctcaaagaaaaagcacaaaaatggaaataaagaaggatgagagattaaatgaacttttaaaaaataattctaatatttattaatggtacaataacctttgctctcattttgatgaggccagtgacattaaatgtgcttcatttaaacaaaattttggtttatgatacagctacttgaacatctgattctaacttctgtttatttttatacttgattttaatgactgatgcctcacaaagtatatacattttaaaataaaagaagtatattgtttggatgcacttactaaataatcatactcatattacagttccaggcaccagttatgcaaacattttattgctgttcctgaacctgctgtcttttatgtttttgacaaattgaaaagttaaaacgtgaaacatcttttagataacaaaactgtgtagtaagggaaatatttcaaacctactctgtattgtttattctctattaaaaaaccttggccaggcacggtggctcacgcctgtaatccccgcactttgggaggctgaggtgggcagatcacgaggtcaggagatcgagaccatcctggctaacacggtgaaaccctgtctctactagaaatacaaaaaattagccgggtgtggtggcgggtgcctgtagtcccagctactcgggaggctgaggcaggagaatggcgtgaacccaggaggcggagcttgcagtgagccaagatcgtgccactgcactccagcctgggcaacagcaagactccatctcaaaaaaaaaaaaaaatcttgacataaaatattttagtgtttcaattaatttaaaggctcctagtgtcttgtaggtattctgggattggaaaacatgattacaagaagaaagtttagttacatttaatattaaaatgtttaaaaacattttattgaactacaatagacaaattatatataaagtatacaatttgacaaattttgacatctgtatatatccatgaaactatcaccagaattaagatattgaacatctatcacctccaaaagtttccttgtgccatgttgtaatccttccttcttgtccctgtgtgctattaccctccttacccccgtcaactcctgaaaccactgattctgttttctgacactatgtattttctagaattttatataaatgaaatcatacagtgttttttttttgcctgacttatttcagtcagcataattattttgagattcgttcatgttgctatgtgtatcagtagttcattcttctctattgctaagtagtattccattgcatgggtatactacaatttgtttatccatttacctcttagtaggcatttgggctgtttccagatttgggctattaccaataatgctgttaacatttccatgcaaatctgtgtaggcatatgctttttttttttcccccttttgaggcaaagtctcactctgttgcccaggctggagtgcagtggcgcaatcttggctcactgcaacctccacctcccaggttcaagcgattctcccacctcagcctcccaagtaactgggattacaggcatgcaccaccacacccagctaagttttgtttttgttttcttttgagacggagtttccctcttgttgcccaggctggagtatagtggcacgatctcagctcactgcaaccaccacctccctggttcaagctattctcctgcctcagcctcccaagtagctgggattacaggtgcctgccaccacacctgggtaattttttgtatttttagtagagacggggtttcaccatgttgatcggctggcttcaaattcctgacctcaagcgatccgcccaccttggcctcccaaagtgctgggattgtgggtgtgagccaccacgtccggcctacgtatgcttttgcttttcttggataaataccaaaagtggaaagcctgggtcatatgggagatatatgtttaactttttaagaaactgctaagctgttttccaatatggctataccatttcacattcccactgtagtgtatgagagttccagttgcttcaaatgccggccaacatttggtgcattttaaattttggtcattctaataagtatgtagtgatatctcattgtggttttagtttgcatttccctaatgattaatgatgttgatcatgttttcatgtgtttatttgctatttgtatatcttctttggtgatatgtttattcatatcttttgtctattcatatcattgtctattttttaaatttgtgtttttaaaaatattgtagagttctgagagttctttatatatgctggatataagtccttatcagatatactagttgcaaatattttcttccagtatactgcttatctttttattttctaataaagttcttacaaagcagaggttttaaattttgatgaagcctaatttatcaagttctggatcacgttttacgtgtcatgtcagaaatgcttgctttttttgtttcatatggatatctagtttttccagcactacttgttgaaaagactgccatttctccactaaacttcccttaacctttatttaaaaaatcaagtgactataaacatgagggcttatttccatactctctattctgttcgtttatttgtctgtcttcctgcccagtaccacattgacttgattactgtggatttatagtgtctcttaaaatcaggttaagtttccgctttgttctaccatatgttttgaacctcacaatatatcgttatttttcctttaaacggtcgattatattttaaaagagatttaaataataagaaaaaagtatttttacctacattgttaccattgcatgtgctctgtatccctttttgtaaacctatatttctgtgcagtaccattttctttctgcttcaaggacttcctttaacactttttatagtgcaggtctgctggtgattaattctttcaacttttgcatgtctgaaaaagtctttatttcacctctgtttttgaatgatatcttgctgggtgtagaattctatctaggttgatggttgttttttttctttcagtattttagagaggttgttctgtctttacacttgcattgattccaatgataaatttgcttttatcattatctttgttcatctgtatatatataatgtgtccttccccaagaccccaaccccaccccaccccaccactctagcttcttttaagattttcccattgtttctggttttaagcaatttatggtgtgccacatggtatatttttctttatgtttctggtgctttatgttcatagagcttcttggatctgtgagtttatagtgttcaccaaatttgggccattatttttggtgacatcaatgacatgtatagaaggtagcttgatgttgtcccatagctcattaattcctttttctttttttcagttttttctgtgttccattttgaataatttctattgctatgtcttcaagttcttaactcttttctactgtaatgtccaatttgctgttaatcccaacgagtgtgtttttcatctcagacattgtaccttttatccataggtttgatttgagtctttttacatctcccatgtcccctgcctagctttttgaacatatagaatgcagttataataactgctttgatgactttgtttactaattctaacatttgtgtcagttcttggtctttttgattgatttttctcattattatggatcatattttcttgcttttttgcatgcctgttagttttttactgggtaccaaatattatgaatttgaccttgttgagtactgcatatttttgtattactataagtatacttgctctctgttctgggatgcccttaaattacttggatacagagtgaccctttcaggttttgctgtttagatttgttaggcaggaccagagcagtgcataatctgggctatttcccactactgaggcaagacccttctgagtccttcagctagtgtcccgtgaatcatgacgttttccaatttggctggcggaaacaggcactattcttagccctgtgtgagtgacaggcattgttcttttgaatcctttcaggtagttctttccctggcctagagtaatttcctcacaggcataccatgggctaatcagtcctttgctaaacacttgagtgaaaccttctgcaggcctctgaagatctctttctctttctgtggagctctctcaggtcctctgtcctatgaactccagctacctggtttttttcccagactctcagctctgtctccagaactcagggagttcactaggctctacctgggttcttcctttctgtaccattatctggaaattctcttaagacagtaagctgggaaaatcaaagggctcaccttatgtgttttccatctcagaaatcataatccttcattgcctgatgttcagtgatttgaaaaccattgtttcatgtatttggtacatttgttgttgttgttattgtttcaggcagggtggaaattcattccaccttgacattttataatctccaattatgaccaattaaaatttgtagcccaatttaaattctcatctttcgaaaaaagtgtagacaccatcacatttcttgacgtagctaaatcagttctgaatacccatgttcaaaagtatacagaatctggcatgcagcagtataaatctcacatcagtataaaactcattgatcagtttcggtgtaaaacatagtatcattttaaaaagagcagtttaattcaggcttcttggttaaatgaatatattttgaaagactctggttcactttttcatgttcagtgaggtattgtccattgtccttagcctaaacagcaaaatacttttattacatcactttggcaggatatgataatccattagaatgtatttgcaaaaccatcatataattactacttataactttagagaataatttaatatcagttcagccttttggcccttgagcatgggtcaatttttaagaaaatcttctgtcatctataaggctgtcagcatggttcctcacttcaaaaacagtggcctgtgattaatgcattaaaattaatcactataaattcatccatgtacccaaaaactacttgtaccccaaaagctattgaaataaaaaaatttaaagaacaataacaatagcctgaaactttaactgacgtctagacagtttaactcacaattcatctgcattctttaaaagaaaataaatgtcattttctaagacctagttaagtccgaaagcacaaatgaacatatacaaactgacaaaaataggtaacacttagcattctttgtgttctcattactttaagcactttacgtattttaaaaactcatttaatctttataaaaacaagccccaaaggataggtacaatttttatcttcattttgcaagtgaggaaattgaggtactgagaggattagtaacttacccaaggtcacacagctagtaaatgtggaagttgggattcaagttcaggcagtctggctcaattccaagctttttgtttgtttgttttatggacacagagtctcactctgtcgcccaggctggagtgcagttgcaccatcttggctcactgcaacttccgcctcccaggttcgagccattctctgcctcagcgtcctgagtatctgggactacaggcgcaagccaccatgcctggctaatttttttttttttttgtattttttgtagagacagggtttcaccatgttggccaggctggcctcaaactcctggcctcaagtgatccacccgccttagcctcccaaaatgctgggattgcaggtgtgagccacccacctggcccagagtccaagcttttaaccacagctcacacactgcctcaggaaaacaaaaacatttttctctcagctctattacagctcttcaatttccatgggtttaagtttaaacatgtaaacacagatagatttctgggtaaagacattcactagacttttgttgaactcatactgtgtgtcacacactgtgccaagctcctggggctatgatatccagatatagtacctaccttcaaagaggttacgtctggtagatgtttctagtttgagcataagtaccatatattaccatcttcacttttatgtgtggcctgcatgcaacacagcaaaatctgttgtatttgctgtccagggcagggacattacttgtgtcttcctaattcacatcagttttcattttgggaacaccaatgattacttttaatctgagtactattcttacaaggaattctatattttagtcatctttttaatattctagtctcatgcccaaggtcatatagctaaaaatagcagagctaggatttgaacccaagtctgtctttcaccactattttcattattctatgcttcctgtcaagttttgcctagcttttcatttttaaaattggtctttagaatttgaaataatttgagatagctcacccatccccttcttgaaaaccagttgtgttagtgtttattttcattcattgttattatttctcaatcattaggattaggatatagactggatatatctagttggatatggaattctacatatgtcctttagatcaagcttattgtgttgttcaccttgtctacatatttactaatttttcatctgttatactatcagtaattgagagaggtatggtaacttcccatttttatggtagatttagtttttcctttggttttgtaagtatttgcattaacatattatcctcattttttagtagtaaatatgtataattgctaagtaagccatcttttcttttttttaattttttttattatactttaagttctgggataccagaatgtgcaggtttgttacataggtatacacgtgccatggtggtttcctgcacccatcaacccgtcatctacattaggtatttctcctaatgctatccctcccctagccccccacccccgacaggccccggtgtatgatgttcccctccctgtgtccatgtgttctcgttgttcaactcccgcttatgagagaacatgcggtgtttggttttctgttcttgtgatagtttgctgagaatgatacaaaccaccttttctaaaatatatttttatgggcatgggtcccacaaggatgctatattaagatacttcatctgagtcttgacacctcaggactaacacagaacaagttgtccatctgagctcagattctgacactcatgttacctgagccgtggtcttctcaatagataatcttgcctttttgactgtacacctgggactgaatgtaatgaagggtcttaagttttcttgggctttggtttctctattaaaccctagtagccataaattgggagtatccgattagtcatagcttttctaacttcacatctatctggttttcttattataactgtatttgtgcctccattattttcctgagttctagttttcaaaatatgatgtactatttaccataaaaatatatcacttggtttattgcatatgaaagctgtatttttctttcatattttcctttttgaatttctagagaacattctatgccatagtatggggagtagtgatggtagtgaggtaggaggcaggtattttcctctaagatgttaaggatagatttagtaccattatgatctcttctttgacatgtgggttatttagaagtgtctttataaattttaaaaaaaagtattgtgataagaaattaccttattttaaattgatttcttatttaatttaatttcctcgaagtcagagactggtctgtatgggaaggattttttaaaaaaattatgcagacttgcattacagcctagtacatggtcagttttgggagtaaatattctatatgtgcttgaaaataatgtaattctccagttggatatagattttttttgtattcctattaaatcaagctcattttgttgttcaacttgtctatatatttactagtttgtatctgcttgtaccattcataattgcaacaacaaagaagtatatgttaacctctcattttgatggttgatttttcaatttctctcttttgttcctttgtatatttagtgatgttttattagtgggtgcatatttattatctctatgtagtgatcttatctaacctttataaagcttttattgtcttttttacttttagatattaatatagctacctcagctttcttttggctagcatttacctggtatatcttttcctatctttttactttcaattttcccttcaatttatgttttagatgtgtctctcataaatggcacataactggattttttccttttatccagtctgttaattcctgtatttcaaagggtgaattttgctcatatatgagtttcatattcattgatatacttgaacttgtttttaccattttaccttttgttttctctttgtctcagttttttctgcacttacctttgtcttcttgccttttaatttttgttcttaatttgttttctgctcctcattactgattctgcaagatcccattgcaaacaagctggctgttaacagggttagtgttggaaacaacagcaacctatggtggaaggtggggcttggggtgggatatggcttttctgaaaggagtcagattggcaagtgatggggaagaggaggcagggagctgatagagtccatgtctgatggtcttacaaaaacctttttacaagtatgagacaagcatgtctgatgggactggagggaagggaagtgggagtgtgagatgaatgaaggcttgaatagaacccaaagggactaggtaaaggaattgaacaagcataagtaacagaatttatgggtgacaatgagggttcagctgaggttgtagaccaggaattatgtagaacctgggtataggagcagacaaggcaggctagagcattagcacaggtttgggattttcatgggcagttgtggcagagggatgaaggtatatggatatggaaggtactggtgagagtggttcaaatgttgagccatctggagtccaggatgggtatggggggaagatagatcagcagaaggcaagtggaccaagagacaatgtggggctcaagagactgtggtcttgataaagttgaagaacagatagagcaggagtgagctgtggttggaaagtgggaattcttgaatttaagatttcagagggggcagttctggttggtcaggtccataaatgaaaaagaaagggcagatgtacaatattggtagttccattttcttaagatactatctttatttcctcaaggatcttcttacttccctggattttgatattacttggtctcattattatgccaacgtgcctttctcatcacaatattctgctgcctctccacaagcaccagtttttaaatctggtatggttctcatttctagtgtgcctgtgctatccttgctttttagctgacaggtaactgataatacctcttttatccaggagccactgatttttttgcgcagtgtttcagccgtaatcacacatatgggaattcatttccacaatgcttttgatttgtctgtttagtactttatagttgctttggttataattctgcctagactgagcctgtagagcaccaactctggtgtcagattgcctgggcttgaatccctgcaatttcacttacttgctctttattcttgggcaagttagcctaacctctcctgaatcctaatctatacaatgggggtaataatagtcactcattcttggtattgtggcaaggattaaattagttaatatatgttaggtacttgtttggcgtatagtcaattctcaataaaagatactgttggggtgacaatgacagtgattgcaatattggcagcatatgcaaaattgcataccagatattgcattaagtgctagggcagatacagaggagaagattgaaaaagtccttgttttcatggagggtatatattctccttggggataagaactaagaacacttcctcaagactgtctaagaaagggtgtgtgcaagaggcttaacatcttatagttcaataaagaccaggaaatatacaagttgaggaaatattgaggtttcaggaacctgtatagctttgccgtgttgtttatgttctccactgttttgtagggaactagtaaaaaaagaaaaagaaaaaataaagtgaaagaggcgtgttgtctagtttcaaaggagaggagagaaggtaagtgtgattctcatttcctttttcactctctgtctaccttgggctctttgactcccatgactaccaagtgtatattatcagatacattttttcttcctgaggtccagccctgtgtctccaactatttcctgggcccagttacctggatatcaagtatgcaacactaacttaatagggttaaaacaaaactttttgccttacttccaaacctgtttctttccttacatcttctattgctatgagggctgtcactagccagtcagttgtttaatcttgactgtgaactaggcatctttgacttcaccttcttcatcctctctgctcagtcagtctccctattctgtcaattctacttctcaaacctattctgttttttcttgctgcctggctcaggcctttatcattttagaagattcagcaagtatttgtactccaaacattgtgattggccctttaacacacattatttaattttttaaacaacgtttgaggtgggtcgttttgtagatgagaaaccaaagagtcagaaataaaatgacttctgctgggcacggtggctctgtctatagttccagctacttgggaggctgaggcaggaagatcacttgagcccaggaatttgagtccaggctgggcaacatagtgaaactctgtctctaaaaatgaaaaataaaatgaaatgaaaaataaaatgactggtctaattgtttagaggcacagttagtaaatctagattgtcttttgctgcagtattgtaataatatctctgcctcatttgtattgttttcttttttgagatataaatggaagatatatgtaaaaacaaattagaactatgtgaagtaaaaagtgaaagttgccccttcccaattctactccccaagggaaaccaatgatagtggcttttgttctagacctttctctttgcatatacaaatatttagataaattctttataaaagatcattttttattgtcctacaactactttttcactcatggccatatttttatgtcagtacgtgtgtatctaccacatttttaatggcgacataatgttccattatggggacatattattttgtttaatgattcctatgttaaataactgtttctgttcttacaaataatgttgcagtaatagtcttgtgcatatactcttgcttgtgcatttgtatgaatatttctattaggtaaattcttagaagtcatattgcttggttaagtatatgcctattttaaatgtatgtactaccaaattgtcctctgatttgtcctctaaatcagtctttcatattataactagagcgatatagctataatatgtctttgtaaagtgaatttcatcatgtgatttcccagcatcaaaaagcaacatcagagatgtttggtggatttctattgtctatgcagtaaattttaaaattaaaaaaaattttttccagacaggatcttgctttgttgcccaggctagagtgggccacatgtgatggcgtgatctcagctcactgtagcctcaacctcacaggctcaaacaatcctcccacttcagcctcccgagtagctgggaatgcagccgtgtaccatcatggctagctaagttttgatttttctttttgtagagactgagtcgccctgtgttgcccaggctggtcttgaactcctaggctcaagagatcctcctgcctcagcctcccaaagtgctgggattacaggtgagagcctccatgctgagccaaaattcttaaaattttaaaaaagtttttaagagttatgtaatctggtcccaaactatctttcctaccattcttccctaccaggaaatttgtcctctgataaggcaaaatccacctcttctgtgaaatttcccatgtatactgctctctttcctctctctatgcaagatagaatgagttgctttcttccctaagttctcatagcacttaatttatagtcccttataatccctctgatagcacttaatgcgttgtactgtatttatgtgtgtctgtctcccctgctactctgtgattttcataagggtaggaactgtgccttactcatctttgtatccccagcactttacacaatgcctgtcagcgtagtgctcaacaagtgttcatgaatttgggaaagatatcctggaggtagtgctagagtgctagtatgataagaactttgagagatagagtagggggtggaagttttgaagtatagcagaaagctgactgactcctgggagaatggaagctggttaggaatagacaactgggcttaaactggcaggagccttcatgtgcttttctccttcactgcagagaccagctgcctggttatttgggttaataggcttgagatttgagaacatttaaagtattaaaaattggatgattgaggactcacttggtggagggggagattgactcagctgttctatgttctttccagactaagatgcatatactgaataaccaatccttttcccagagtcacgaataactttttctttctgaaaaatcaaggactcttcattttcagggcatgtttcggatgggagtaggaagactaaataggtcagatacttctactttgtctctttagcttggctcaaggggaaaggaacctattgaaagggtttagggctgtgggcctattcttgagtaaatcatctgtgtgaaattagttcttttgtcatttcaggcaactctggtagctctccttgtctggttgttttgaagaaagaagagtagaagaaaaagttgagtaaatcatgtcggagttactggacctttcttttctgtctgaggaggaaaaggatttgattctcagtgttctacagcgagatgaagaggtccggaaagcagatgagaaaaggattaggtaagagttccccaaaacgcatggggtcccaggcctttgaccaatgatgtctgggcttttccttatgtctcccacctgactttcataggaatttgtatatgtgatgtttaccactacttattgggtcacgctgggctctgagtttgttgcttccacagaaccaaatagtcttactgtctttacctctcaacccctctccatccaatctatgcatatcctgaatccacttacgcttctgttttgggtcttggcaggcgactaaagaatgagttactggagataaaaaggaaaggggccaagaggggcagccaacactacagtgatcggacctgtgcccggtgccaggagagcctgggccgtttgagtcccaaaaccaatacttgtcggggttgtaatcacctggtgtgtcgggactgccgcatacaggaaagcaatggtacctggaggtgcaaggtgtgcgccaaggaaatgtgagtgtcacctatggctgagtagagagggggcgaggccttggccgtggtgagaatttctttcctcagcctttattagacaagaaccattctttatccatctgtcattttcttttatttcttcccagagagttgaagaaagcaactggggactggttttatgaccagaaagtgaatcgctttgcttaccgcacaggtagtgagataatcaggatgtccctgcgccacaaacctgcaggtactggacctgtctagagatggttcttggtatggaatcctagtgtattctgactggtagcatcttaactccatgggctcagccagttagtggagaatagaagattgtattgtcatcccttctgcaagcatggtgtatttcaggggatttgctatgagggttgtttcctttttcccctactcataaccaccaccctggcatacttttctttgtcttgaagtgagtaaaagagagacagtgggacagtccctccttcatcagacacagatgggtgacatctggccaggaagaaagatcattcaggagcggcagaaggagcccaggtaagaatcaagtaattgtttaaagaaatgcttacaatatccctttaattcttttactattctttttacttcttctgtttataaaataatagatgttcattataggaaaacttgaaaagtacagaaaatagtaaaggagggaaaaaatcattcctaatcccactactcatatgtagacattaacattttggtatatttacttagttctttattttttatagtttgcattcgctttctcaggttgaatagtttgttctttatacgaacaatttgaagacaaataaaaataacacatgctcattattaagcaacaaatcacccacattcctactaccccagttttcacattatgtgaaaattatttcgtatatcttctatgtatatacataacgggttgactggatggataaactgaaaaatctttttaatattggatcatagtataataaattaaaatcatcctatttaattttacttgaatttaacagaataaaacactgaaataaaatgaaagaatagctaatcttcagacaaatgtttttttaaagtaaaagatattagttgttaacattcctctaagcttaagaaaaaatattatgaaagccattgagcagttggtcacttttttagtggagtttttttggtaacagccttattgagatatatataattcacatactatacaatttgtccatttttggtgtacaatgcaatagtttttagtatattcactgagttttgcaaccatcccttgaatcaattttagaaaattttcatcacctcaaaaagaaaccctttacccttttagctgtcaccctccctgatccctaaacaatcactcatctactttctgtctctctgtatttgcctatcctgggtatttcatgtaaattgaatcatacaatatgtggtcctttttgacttgcctctttcacttaacattaacgttttcaaggttcatccatgttatagcatgtatcagaacttcattcctttttatagccaaataataccccatgatatgtatttatcacattttatctgttcatctgttgaagaacatttgggttgtttctactttttggttattaagagtaatgctgggccaggcgcagtggctcacgcctgtaatcccagcactttgggaggctgaggcgggtggatcatgaagtcaggagatcgagaccatcctagccaacatggtgaaaccccatctctaccaaaaaaaaaaaaaaaaaaaattagccaggtgtggtggcacgcacctgtagtcccagctactcgggaggctgaggcaggggaatcacttgaacctgggaggcagaggttgtagagagccgagatcgcgccattgcactccagcctggcaacagagtgagactccgtttcaaaaaaaaaaaaaaaaaaaaaaaaagagtaatgctgctatgaacattcattaagagttttgtgtggatgtatgttttcttttctttttttttcttttcttttcttttttcttttcttttctttttcttttcttttcttttgagacggagtttcgctcttgttgcccaggctggagtgcagtggcgccatctcggctcactgcaaccttcacctcccaggttcaagcgattttcctgcctcagcttcttgagtagctgggattacaggcacgcgtcactaagcccagctaattttcatatttttagtagagacggggtttcaccatgttggccagactggtcttgaactcctgacttcaagtgatccacctgccttggtctcccaaaatgttgggattacaggtgtgagtcaccatgcctggcctgttttcatttttctaaggtggatactttggagttagccgtcattttaaaaatctgcctgtttcaatatttaacattatcagtgggcgctttgctgtgaaagaggaagcagttagctttcttacacttcccccggttattttcttctatccccactatttgttactcaaattatttttcctttgtcagggtttataatatttacattctcttatataaccataaaccatctgtttgttttatctgtttgtttccttttagttttatacttaaaaggattgtatgcttacaaccaggccttataccacaacttctctatttctgatttatttcttggttttctggatttcatcattgaggaggtccttcaagaagagcttgcaggtgctatatttattgtattcttacacgttaagaatgtctgccagctgcctttatacttgaatggtatcttggctggatattatattcttgggccacattttctttccctcagaatgttgtagacattgttccattgtcttcttccattgaatgtaactgtgaagaagtctgaggacatcttggcccttgtctttctttcttatggatgagagagagagagaaagagaaagagaaagggagagagattggacttgcctgaaaattttcttttctttttcttgaagtttagtaatttaagggctgggcacagtggctcactcctgtaatcccagcactttgggaggccaaggtgggcggatcacaaggtcaggagatcgagaccatcccggctaacacggtgaaaccccgtctctaataaaaatacaaaaaaattagccgggcgtggtggcgggtgcctgtagtcccagctgctggggagactgaggcaggagaatggcgtgaacccgcgaggcggagcttgcactgagccaagattgctccactgcactccagcctgggcaacagagcaagactccatctcaaaaaataaaaaataaaaaaaaagtttagtaatttaacaaggttgtaactcaatggtgatcattctgtatcatttttccctatatgtgatatatccttgatgagttctttcttcattgctggaaaatttttctgtatcatgtctcagaactctttttctttctgttttattatttaagttctccacctcagagatactggattttcttatcctctatttttgtcattttcttttactagcgaatggaataggaaaaatggtgaaagcaattaactgtgattagcccaacccattcctccatgctattaatttggttttcagtttatttccctcccctaccccttttcccctcccttccttactttttgctgcttctaatttaattatttgagtaaattatcttatttaggttttgatttgttctttgctctaatcttctttctctcattttgttttatcatcttgtatttgaattcttgcactttattgaatttatattattagttcccctgtagtgtaaagcactcacatgaaacctacttgttttcctagggttaaattcttctccagactcggttcttcatccatcttgcaaattgttttcatttctctccacttcatggctatttatatatctgccagactattatttcattttactgaactttaatatgggaagttttgtctgtatcttttgtttcctctgatatagcatatgtgagttcttctcaccttaacttgaaacaatttatcttttccccattcccagctgtactttagtttaaggactgaatattgctttttatatttctttccttgtaacctgaaggggtaggtgcagaaggcaacttggagtcctgagttttggtctcatgaaattctcttaaatgtcctggttcagggcttacctgtcccagatctgggttaatcccctagctcataccagtgccctgggagatgacattttgcatcagtcttgtctgtctctgttgaggttctacagtggtacctggggctataaatcttgaggacttctgtttttcttgactactcactcacttaatctgcaaattgctacattggaaaggattagttaaggagctttgctgaattaaatcttctgttttcttaggtgcgatttttgaaatctgtgacttgaggctttatttttgactcatttggttgtggcggtgaatttttagcttttgtatggtgtgtgtgtggtttttttttcccctaactttcactcacccaaagggaaatgactttatcatgtttcatatgattgttgaaaaacagcatagaaatgtataaagtaagtcctccagtaacctcactgcttcttccccagataattatcgttaatagttgtgaatagttttggcatatggactaccaagctgtctaaatatacatatatgggttgggttcctaagtttttaatttctttttctttaaaggatgatactataaacatgttaagtgaaaaaaagtgaaagaaaaagaactttaaaaactcaataatacagacaatcccatagaaaatgcacaaaaaatttgaacagacatttcaccaaagacaatatagagatgtcagataagcacatgaaaaggtgctcaacatctttagtcattaaataaatttgacctaaaaatcacaataagatactactacatacccattagaatgactaaaattaaaaagactgaccatgccaattgttggtgaggatgtaaaacaactggatttaaaaaaaattttcttttctacatttcctccttgctattataaacaactagcattcttatacactgctggtgggaatgtacaatggcatagctactttgaaaagcagtttagcagtattttaaaaagttcattgtgcacctaccttgtgattaagtcatttcattcctgggtacttactcaagagaagggaaaacgtatgtttgtacaaagacttctacgtgaatgttcatagcagctttatttgtaatagcccaaccctggaaataacccaaatgctcatcagcaggtgaatggataaactgatttgtttatacggtggaatactactcagcaatggaaagaaatgaactattgatacacgcaataacatgaatgaatctcaaaataatcatgctgagtgaaagaagccaagcagtaaagagtacatactgtatggttctgtttgtataaaaactagaaaatacaaactagaaagcagtgacagaaagcagatcaacacttacaggaagggcaggagggattagaatggggcaggaggaaacctttgggagtgaaagatatgttcattaacttaattgtggtgatagtttcgcagatgtctacatttgtcaaaatgtcacgttgcacacttgaacatgtgcagcttatttatgtcagttattactcaaagcgtaaaagaaaaaaattgtagaaggatataacatgaacatctttctgtgtcagcaccaaggatctgtttcattcttttgacatctgtatgatgtttcattgtatatatggactgtgatttttatctacacagccttgggtgggtgactcatccgttccaggtgatgaggcccccttttttctttgtggattaaggataagaatggcttttatttgctgaacctgattaacacatctgacatcatcagtcagaatgtaatttctgaaacctattgcttctggttgtctgtgatctcttgtctcattggacccagaagactcttatttatcctaaacatgaaaacagattaagtgaccataaatgatctttcccatgaaattatggagcctcagagataatttaattcaaccaccctatttttgcagaaaagaaagcaggataagtgatttacctgagatcatacagatagttagagcccagggctcccatctcttagtctattttttactgcacagatgtcaaataattgcttttctgcccttgggttgtttgtattagctgtggattggtatgtattaatctttaggaaaaaaaggaaaaaccactctccatggaccattgttaaaactacctctctggaggaatggttctgcttgggtttttttggcgggggtgggggtggggacaaaaggggaaaaaggacaattctaaagtaaaaaatgaaatcaagcccccctgctatgtcttgtgctatacaagtaatacatctttcaaggaatgactgacatttcacctcttgtaagtactaggatttcagccctgctgtctgttttcacagaactgtcaaacatcatgtgacaacttggagagtttattctttactggctaagacattatagattttggttacctcattctttgtgcatctattagtttgtttgtttgacaaatatctatgaatgcctactatgtgccaggcattgttttagaccctgagatacactggtgaatacaaggcctcttgtttgtggggcttagatttccggggtgggagataaaaagatagtcaagtaaatgtatggtatatcagatgttgacaggtgctgtggagaaaatgaagtagaccaaaggtatagggagtgccaggaatgaatgtgtgtacatatactgtttaggatagccagggcaagtcttaacaacagggtaacgtttgagcaaagatatgaaaaaaatgagggagcaaacccttagggtatctgggggaagagcatgtagatagagaaagaaggaggtataaagaccctagggtgagattttgtttggcacttttgagtaatctgaaactgagtgagcaagggaggctgaggaaggagttgaggacagagatgggatgagaagcagatcatgttaagactttggtggcacttgtaagcattctgtcttttactccaagtaagaaggatggctctgaggggcacagccttattttgtcttctttttaaaaatggaggtaaagttgacataacataaaatcattttaatcaattttaaagtataaagttctgtgattgttagtactttcagaatgttgtgaaattagatcaccactatctaatttcagaacattttcaccatcccaaatagaaacccgatagccattaagtagccacctccatttaccccagcccctaatatgctttctgtcttgatggatttgcctaatctagacatttcatataaatgcagtcatgcaatatgtggccttttgtgtttggcttatttcaattagcataatgatttcaaagttcatccatgttgcagcatgtatcagaatttcattgtcttttattgatgaataatccattatatgaatataccacatttcatttgtctaatcatgcattgatggacatttaggatgttttcatcttttggctattaggaataatgctgctatgaacattcatgtaacatttttgtgtggacatatattgtttagttctgttgggtaggtacccaggaatggaattgctgggtcatatgatagttctatccctgatttacattttaaaagctcattttggctgttgagggaaagtcaaagccaagggaagaagcaggattagttaggaggctactgcaaccatccaagagctacatgatggtggtttggaccagagtaatggcagtggaggcagtgagaacgtatcagagtctaggtatacattgaagaggatttgctgacagatttgatttgtattgtgagaaaaagaggagtaaccgatgattcttagcgtttttgacttgagaaatgaaagggaattgccatttgatgagacagagcgaagagcagttttgggggaagattagggctttggttttgggcttgctgtgtttgagacatccacgtggagacattgaggaggccattggaaaaacaagtctggagtttgagtaagagataaatttgaggccgggcatgatggctcacgcctgtaatcccaacactttgggaggctgaggcggatggatcacctgaggtcaggagctcaagaccagcctggccaacatggtgaaaacctgtctctactaaaaataaaaaaattagccagccatggtggcacaaacctgtaatcccagctactcaagaggctgaggcaggagatcgcttgaacccaggaggtggaggttgtagtgagccgagattgtgccactgcactccagcctgggtgacagagactccatctcaaaaaacataaaaaataaaaataaatatatttgagttattagtttattgaggatatttaaagccatgagactagatgagatcatttagggataattctagatagagaggaggagcagcccaaggaagaagtttggacataatctaaatattagaggtctacgggaggaggaaggactagcaaaggagactgagaagcagcagccagtgaggttggaggaggaaaccaggagagtgtggtgtccggggagccaagggaagttatttgagatatttgaggaagaatcgatgttttttcccccttttcctgctgctctcactaattctttgaggtaaggggccgaggaaccgtatccttcccttgaaagatgagaactggtattttgaatgcccagagtcatccttcattaaggcgattaagctaaaaaaaagaattctggtcacctgaatactgtcttctagacatactgcttatttatggatatatctcagtcccactgagggcatttattcaataattcagtcaataaaaatacttgagtgcatactctatgctagtctctcttcaaggcactgagaacacatcagtaaataagatacgtggtcactgatcttatggaactttgtcgaatggaggagaaagacattaaataatttgtttaaattattgaaccaaataaataatttgtttaaaatacataaatagttacatatgtggtgactgttactaggaaatcaggatgctatgggagcacagaggaaggttactaatcgagacttagggtgggggcatggccagagagatctggaggaattgacatataaggagagacctgaagcaggagtagattgaggcaggtgaagaaaagtggccattgtgaaaagaatatcttaggcagataaaagagggaagatggagagcttcaggatattcagagaaacaaaataactttgtctttctaaaatataaagcttgaaggaggagtagggggtgaaaaatgagactggagagggtgagcaggggccaaatcatgaggatttcttgccatgctaaggagtttcagctaaatcccaacagcaatggggaaccactgaagagttttaaaagtatactgagggccgggtgtggtggcttacgcctgtaatcccagcactttgggaggccgaggcaggcggatcacgaggtcaggagatcgagaccatcctggctaacacattgaaaccccatctctactaaaaatacaaagaaattagccgggcatggtggcacgcacctgtagtcccagctactcgggaggctgaggcaggagaatggcgtgaacccaggaggcggagcttgcagtgagccaagatcgcgccactgcactccaacctgggagacagagtgagactccgtctcaaaaaaaaaaagtatactcagctgggcaccatggtacatgcctgtactcagctggtacaccatggtacagttactcagaaggctgaggcagcagggttgcttgagcctaggagttagagactgttgtgcactatgatggcacctgtgaatagccacagtactccagcctgggcaacattgcgagaccttatttcttaattaattaatttattatatgtttaaagtatactcatatttattttagaaagatcactcaggctacgattgtgaatggattggaaagaggcctgactagaggcaggagaacctgcttcctttcaatattggctcttggtttttattctagtgtgctatttgaagtgccaaagctgaaaagtggaaagagtgcattggaagctgagagtgagagtctggatagcttcacagctgactcggatagcacctccaggtggggttccccccatttccctcatctcctctcaacccaagttgtgattttgttctgcagcatcagtgttcctgacttctgtcctcaggaagttgaacgaagtattttctctgtcctcaacagaagtcttttcagtagcacgtctactgatttggctctgagcacagcttcctggaacacattgacatctctagtcaattcccccagtatcttggagtattcttcttagcccagtagcaactgatgctgctgtcccttaagaatgagggtgtgagtgtttgtgtttgtgcaaagttgcctatctgatcttctgcattccttccaggtaaatcacatgcgaagtgtaccttctgaatttggttattacgatgacccaagccattggctctccttccatagagctttgatccctgggtagaaggggaagggtaggaggtgacttagttataatttctgaatctacctccaggagagactctctggataaatctggcctctttccagaatggaagaagatgtctgctcccaaatctcaagtagaaaaggtaagcttcaggttattgagccaccttcctcccctcccttccttccctttctcctttacctcctgtctccctccgtctttccctccctccctccccctcactcttctcttcctctttcttccctccctccctccattctcttaggcagaatttaaatcaggaatttcaactaaacaaatttcagttcaaattcacttgggagcattttctgaagttttgtttgaaatgtgtgagaaaataggttttgtactatttctaggcatttaatctttcctttaagtttgtcatagtttagcgaaaatctgagccttattcttcttaagactgtccttccttactcactccttctacctatccatctgttcttttccattttcttgcccttgttccttcctaggaaactcagcctggaggtcaaaatgtggtatttgtggatgagggtgagatgatatttaagaagaacaccagaaaaatcctcaggccttcaggtaactggtttcccttactggtctttcaggactgaagttctgagtacccttgatgggctcttggtatggagaagaataggtctctttgatttggcttttttggtcttcccctcagagtacactaaatctgtgatagatcttcgcccagaagatgtggtacatgaaagtggctccttgggagacagaagcaaatccgtcccaggcctcaatgtggatatggtaggtgcccttatattttacttggtcactatatgaaattttacttatctggagttggctttagtacctgatattctcagtcaacctatttaattctttaagaaaaggcaacatgaaacttgatacccccaagtttctaaagtaaatctggttcctgatttgcttaaaggaaaggactgtctttgctatctcttttttttttttttttttttttttgagacggagtttcgctcttgtttctcaggctggagtgcaatggcacgatctcggctcactgcaacctccgcctcctgggttcaagcagttctcctgcctcagcctcctgagtagctgggattacaggtgtgcgccaccatgcctgggtaattttttatatttttagtagatatggggtttcaccatgttggccaggctggtcgcaaactcctgacctcaggtgatccacctgcctcggcctcccaatttttttttttttttttaagagacagcatctcactctgtttcccagactggagtgtagtggtacaattatagctcagtgccaccttgaactcctgagctcaagctgtcctcccacctcagcctcctgagtagctgggactataggcatgaaccatcatacccagctaattttttttttttttttgagagatgggagtctcactgtatttcccagcctggtcttgaactcctaggctcaagtgatccgcccgcctctgcctcccaaagtgctggaattacaggcatgagccatcacgcctgaccatctcttttattttctaataaattgctggatatatggctggggctcaaataaatacttcttttgattaaaatgtaaacagggttggggaaagtcaaatggaaaagagttatagcttctatgaaaaacattaaatattcttatcttattcttttgagatatgagaaggatggttggaatagagctgggaaccctgaaatgggaagacatgtaaaaagaaggatatgaggccaggcatggtggctcatgcctgtaatctcagcactttgggaggccgaggcaggcggatcacctgagatcaggagtttgagaccagcctggccatcatggagaaaccctgtctctactaaaaatacaaaaattagccaggtgtggtggcgggtgcctgtaatcccagctactctggaggctgaagcaggagaattgcttgaacccaggaggcggaggttgcggtgagctgagattgcgccattgccctccagcctgggcaacaagagtgagactccgtctcaaaaaaaaaaaaaaaaaagaagtatgtgtgcgtacacatacacatggcaacttggagctttaaaggaaagatattagtctttgaagctaaagaaaagtctttcttttattaactctgaatttatatttattgttccaggaagaggaagaagaagaagaagacattgaccacctagtgaagttacatcgccagaagctagccagaagcagcatgcaaagtggctcctccatggtaagttctattagatctgtggttacaggcatgttggggtactaggaagaaaagaagcacctccctagagcagattcgggacctggggaaaccatcctagtcactcttttcaggtaagtaagatcatttgtttgttcctatcctcaatttagactataggtgcttagtgtacatctaggtgacttcctgagcccccacctggagattattacattacagcttgggacatttttcatcacagctttgtgaacaataaccttaacttatcctctaaaggggtacccaggctatgaagtgagcaagatcagatttcttcatcatagcccattccaaattctcaacattaaaagaaagtgagtgtcatgagaggggctctggcagggttgatcgacatcagggtatggttaacaagcaataataccagtcaggataatgaatttaaagggaacatttaagaatcagggcctggttctgtcataagcatgaagattgatatttagggaaacaggaacaagggtgaacagaatttgttcacactcacacacaggaagagaatgtcagctcgcatgaccgattactaccagaaaggaaggtgccttttcacttctggtggggtttcctccctcccactcactcccagttctggccaaatctcttttctctgtaggccctgataagacataaggtggataagagaaacccacagataattaaggcaccttgttttagttagtaactaacccccttctagctggtgttttagtgtatataacacattccccagatggacttaactgcaccttgcctctgctccctgcccacctcctggggcaggtgaaaatgaacactaaaatttgtaaaaagagttgaggaagagaagctaagaggctaggtgagccatgagctgattcattcacctgaacaattttgagtgctggtagttctctcttaccctctgggtcaaggaatgtcagcagcactggcttattgcaggggcttctgaaacttctgttcagtgactgtggttttatcatgagggaagatgtgagcaatgcgggcgggggagtgtgccttccccagatgttcgtgggtgctttatcttcagagtacgatcggcagcatgatgagcatctacagtgaagctggtgatttcgggaacatctttgtgactggcaggattgccttttccctgaagtatgagcagcaaacccagagtctggttgtccatgtgaaggagtgccatcagctggcctatgctgatgaagccaagaagcgctctaacccgtgagtgcttctggaacctgactgatgctctgagaccagagaccagaccccggcatctgtccgggcactcttgaacagagcttatctgtttctgggggagcagggaggtgtaatgtaggaaaagaaccaggattgggaaaaagcaagaatggcatgtctaagagggcttgaggtgacatttttgacatcacatgtcaccatggcatatctatatggagaggaggaaagtgaaaagcaggcttgagaaaggccagcaaattactcagtgctgtctttggtttctagatatgtgaagacttaccttctgcctgacaagtcccgccaaggaaaaagaaaaaccagcatcaagcgggacactattaatccactatatgatgagacgctgagggtaagtatctagacctcaagggtaggagaacttgttctgtcttgtgccctaagctgtagctattcctctgcaacatgaccaggtgacacgggcttcagtgggccatgtctgtgtctgaggatacattgggtatctgttcacatcctgatctcccagtgaagagaacaaaggtgatctgcctttcctggattgatgtgaagtttgagattcacatggccacaaatctcatgtaaaaaagacatttgagataaggagtctccttggcagttctttttggacaatccagtgttatctcatccacttaagaaaaaatgaattttccaggtcctcctatggaatatggtaggtttttataaaatgagttaagttgaggctttgagtgaggaaactcaaagtgctcagggaacataaagtaatttggtattcaggactagtgacttcaggaatggttgctcaggttttggaataatcttgtctgaagaattacccttaactaatcatcttgggcttttactttcccttcacagtatgagatcccagaatctctcctggcccagaggaccctgcagttctcagtttggcatcatggtcgttttggcagaaacactttccttggagaggcagagatccagatggattcctggaagcttgataagaaactggatcattgcctccctttacatggaaaggtagtctgctttaacaactcctgcagtttggatctgaggtagaattgtctgcagtagcctctgctggtctatgttggtagcgtctttgaatgtagtcttctctggagttctagtgccccctgctggtgtttctgagtttgacagcaatttcagaggcatttgtctatcaagtgtgagttctgtgtaaaccaggcaaagtgtgaagccatggttttgctttgaaaaaattttcatatgtgtaccaaactttgtctcctaaccttccagaatctgggtgtatcctaacatcctaactcgcacctcttctccgagctaaccttctgtgtatatcctaatctgtacccttttgccaagccactgctttacttccaagtgggaagtaaagcaattcatggagctccaattgctatgctcttggttacagaggccagggaaatattactttggagatggcacctcgggccacagtgtagcagtatggcataatcatgcctgggatctgagtgcagacctgtgttggaatcctggttctgtcacttgccaactagatgagtcacttaactacaaaataatgtagggaaatcatctggctaagaagaaatagctaaaacagaggacttattcagcaacttcttgattatcagaactacacaatgacatgacaaagttcatcttatttttttttacactagcgttttaaatgtgggatggttttacatggtccatagactttgggaagttagatgagaaactagtcatggtggctgcctctaggaatggagactgaggtagaaggaatatttagttttctctatatcccctttttaagcatttgaactttttaccatattaagaaaattaagcaaaaatggacttatgtacacatgattcaaaattaaaacaacataaagtatattaaaaggaaagtaggttccattccttagaaataaccagtgttaacactacttgtgtatccttctagaaattttttatggctaggtatggtggctcacgcctgtaatcccagcacattgggaggcggaggcaggcagatcacctgaggtcaggagttcgagaccaccctgaccaacatggtgaaaccccgtctctactaaatacaaaaaaattagctgggcatggtggcgcaagcctgtaatcccagctacttgggaggctgaggcaggagaatcgcttgaacccatgaggcggaggttgcagtgagccgagattgcgcctttgcactccagcctgggcaaaagagtgaaactctgtctcaaaaaaaaaaaaaaaaaaaagaaagaaagaaattttgtattaagcagcacagatatgcatccatgtatttatatgtatttttttctttttttacacaaatgggttcacatggacctcattgtacacatttttttttttcatttatcatgggcatccttttgtgccatcacttacagatctatctcattttaattgctgctgcatagtattttttcatgtgcctgtattataatttatttaccattcccccactaataggcctttaagttgtttgaattcttttttgctcttaaaactatgctgtaatatatcttggtcttcttttgtgaatgtaactgtcagagaagttcctgttggtggaattgctgagtgaaaggaaatataaatccaatattttgatagctgttgcccttgcaaaaaaaaatagtgacaacattaaatttgtccctttaaatactaataaaaacaggaatttgttcaacagcacagtaggatgactatagtcaacaaaaatatttgtatttcaaaatagctagaagatttgaaatgtttccagtgcaaaaaaatgataaatgttcaaaatgatggatgtaacaaaatatcacatgtaccccataaatatatacaaatattatatgtcaataaaaagacaggaaagaaattattaccaaagtataacatattattacaaatttagaattttttaaccatttggcacccaagtcattctctacggtcaatataattatattggaaatgtcactgtaaaccatcatgaactactgccaataaaacttttatataaagagaagaaaccacattaacatggaggtctttgctctttgtaaatatttggagccagaataagaatgtgctactaaaacaaatatgccagtttctagctaatgctaaactccaatttttaagagtccactgaagttcacagaacttttctaaaaaataattttctagaaattaataaattgtgtagacattttataaacaacagaaagaccattcccatattatatatcgattttaacttctacatttgttgtttctggttttgtttttgttttttgttttttccctagcaatccatttgctcctattcagttttcccttgcctgcatctacctcccgattcttttgtctctctcacatatattaaactgtgtgttctgggtatgtggtatgttgatccaaacttatggggattatgccttcctagcattggtaaggacctaagttagaggaaccccaattaacacaggcaaggccaagtgcagtggctcctgcttgtaatcccagcactttgggaggctgaggtgggtggatcgcttcagctcaggagttctggaccagcctgggcaacatggcaaaaccccacctctacaaaaattagctgggtgtggtggtgtgcgcctgtagtcccagctactcgggaggctgacgctggagaatcacttgagcttgggaggcagaggttgctgtgagccgagattgcgccattgcattctagcctgcctgggctctgggaatgaaaccctgtctcaaaaaaaaaaaaaaaaaaaaaaaaaatacaggcaggtgaaagggcacctctagtctgcaccagctcatgctctggatactaaagcacaaggaacaaagtcatgccgagagagccaatcgagtgaagcagttctgccaatcaaagccaaagacaataggccacctgctgctcatctcagacattcattcgttcactcttaccttcattcagtaaatatttgtggagcacctactatgtgccagatactttgctaagtgttgggcatactaggatgaacaaaaataggcttgatttctgtctcttggcacttcggctgcagtgttagagacagacattgatcaaagataacttaaatgcaaaatttataattgtggcaaatccaaattcgtgtaacagagtttcacctagccctcaaatctttgcaagccctccttttttctttttttggggggagggacagggtctggctctgtcgcccaggctggagtgcggtggtgcgatcttggctcactgcaacctccgcctcctgggttcaagtgattctcatgcctcagcctcccaagtagctgggattataggcccacaccaccccgtcggctgatttctgtgttttttgttgagacaaggttttgctgtgttgtccagactggtctcgaactcctggactcaagcatttgcccacctcagcctcccaaaatgctgggattacaaatgtgagccactgcacctgactgaaagccctctttttttttttcccctgcaagccttctttttaaaaataccttgtaaaaatactttgtatttttaaaaaccatacaaatgatatatactattctcattaaaaggacactaaaagttaatatggagtaaaaaagggaaagttgtctttcatttccctattctgttgccctccctagaggaaacgaggataagtttgttcgtatcctgggtttttctatgcagtgtagtataatgtttaaaagcacggactctggaaccagtctgtctgaatttgaatcctagctctgccaattactaactgtgtgaccttgggcaagttacttagcttctctgttcctctcttccatcagttgtaaaatggagttaatagtacctgtctcatagagacagtcatcaaacaaaatgatacacctaaagtacttataacagtgcctagtacatagtaagggctaacataagtgataatggcaatcgttatttacatacatttatattcacatgtacaactatgaatatattttaatataagtggaacatttttctgcatcttgctttgttgacttaaccctatgtcttggatatctttccatgtcagcatgtacagattcactgaattcttttttgatgactgcatgccatatgccataccaggacactacaattattcatttaactctttctatagtgattgacatttaggtcgtttccactttttggctattactaacaatgctggtagcaagattctctgtcatgctgtcagtccttcgtgagtttgtatggcaaccttgcttgaagatctttgagagtatttggaatctagtaactatgcccccaaagtggcataatagtgggtattgcagaagactctttgttggttctgccctatttccttctaaagaaactgccatagaaacctgtggctgccatggcctagggacggtggattatattcatatgaagaaggatcctcttttgccctgatgctgttcttggggggtaattttagaatttttttcagagagaagtcccaacaattcttgagaagcccagcttgacctgttgggtttccctgtgtttcagatcagtgctgagtccccgactggcttgccatcacacaaaggcgagttggtggtttcattgaaatacatcccagcctccaaaacccctgttggaggtgaccggaaaaagagtgagttttctttggggtcctggatgtagcttagtcttctgcataggatctgtgcaaggccggtgctggctactggttagcactgttggagagaccaaattgggatgctccctggatctgctagggagattcctttactaaggaagcctctctgcgttttttcaaacagaagggaatgccttagggttggcattcttttctttttttaggctattaaatggacttggtcttggtccagctgtggcaagctactaagagggcagaagagaacagaaactttggggctgagaagggtggctgggagaggtggtaaagtatgaaggacaggaagttgaaagctggggaagagtaattcaacatgccagctgctgtgttagtgactacggttgtgtagatgagtaaaacatatttgctttcccttgaggagcttaagtttttgcaagaaagacagtcatgtgctaaaaggacacagatataggagtggtgaattatgtctggttacatttgggagagctttgaagaagtaacattaaaactggatcttaaaactttaccagacagaaaaggagcaggatgaggagagaagagcattttcagaagaggggataacatgcgcaaaggttttaaaaaggcatggtaatgtggggttgtatgtgagtgtgtcccttattttagtgggactggagttctggtacactagatgtaggtgtggggctggagttggacatgaggtgggagcctgactgaagagggccttgaacttaatgataaagagtttcacttgatcccttggcaatgtgtggcctacgttctttgaaaaaatatacctttggcagagtcacatctagaaggtttgggggaatcaatgaaatccccaatgagggtatgtagcatgactagagaagagaggcaagtatagaaccagagagatcagcaacattttaaaggatgaagagagaaagaaacaccagtgaagtaaaaggttatcaggagagagcttcaagaagaaggggcggaggttatcaacagtattgaaatactacagggaggtcagaccagatgaggtctgagaagacatggccaattggcattagattgcattttcagtggatcagtgaaagcagaaaccagatttcactagaaactaggctgagtgaatgggcaaagaagtagaggtggtaagtgtggactttttttcctcaggataattgatggtgaaagaaagtagagacatggagaatagcttgaagaagagataaggttaaagggagcttttcttttagaagtactttttcaaagagatgagattagtatatatttagactgaggggaagggacaagtggagaaagagatatttaaattgggaggtgaggattgaaattgatgatgtctgaagagtcctgtgaagtaggggtggaatcgagaactcagatggaggagttccctcttttttaaatcattgaacaaatatcaggcaactttatgtctctaagcctcaattttctcatgtacaaaatgaggacaaaaatagtgtgactctcctagggttgttttgagaattaaatgcttaacatggtatctggcacatagccagttttcaataggcatttattaatattgtggttgttattaatacagcacctattgcttactggcaggcactgtgctaggcactgaggagacaggacaggcacggttctgttatggagctcgctgcctttaggagcaagcaaagaaagtgctgcataaacaaagctcaagataaatctagaggtggaaggggctcacttgctatggctgacatcccttacaggtaaaggtggggaagggggagagctccaggtgtggatcaaagaagccaagaacttgacggctgccaaagcaggagggacttcagacagctttgtcaaggggtgagtccctagaccagccccaaattaaccagtttcagaacaagagagctaagagaagaatttaactttctctgtggatattatccagtgtgtcttaccactcccggcaaccaaatttgttcctgaaattaggtaatgacaaaaccttcaccacctttgcactggtctgggctgtagacttgataatccaaagaggagggctgcagacaggttctgacttttgtctgactcatgttcttaattaattctgggtgaaaatctgtgtcttctgactgtctagatttgggaactcagggctttgtttcccacagtttttaagctttccgaaaattacagattacctactgacttaatttatctagaaatcatgtttggctaagtttatagatattactattggttttatttaaagagataaattgtctagtagaaacaaagccaaatatttaaaacccattttcagtggagcacagaatagcctcactaatactattatattcattttctctctaggttaaaggaattgaatcaggtgaatgatctagtagaggtagtgggaactctgcttcagcagattcaaggaggggcgtgtgtagtaggatctggatgtgggttcatcttcttgggctaggcctgtggtaggggaaaggggaatttagagagataactgtccgctttgagtaggctgttgattactccccgccctctgccagatacctccttcccatgaggaacaaggccagtaaacgtaaaactcctgtgatgaagaagaccctgaatcctcactacaaccatacatttgtctacaatggtgtgaggctggaagatctacagcatatgtgcctggaactgactgtgtgggaccgggagcccctggccagcaatgacttcctgggaggggtcaggctgggtgttggcactggtgagatcccctcccccatcctcacttgtttgaaggcttcttgtctattttactcctattaccattcccgccccccaacacaaagctcctctgtgatgacagttgtcttctttcctttcagttaacattcagccaatacttattgagtgcctactatgtgccaggactaggggaaggctgagctcatgcactgatatgtgcacagataaatgtgaccctgattgccaggaacttcataatcttcccaccaaaaaaatctacaaacctacctatatgtatgtacctatacattccatcttccatgctgttaataatgaaagaagggtcattgctagcaaaagccaagctctctccaagtgctctgggccacctccccctacccttctcgatgacctcacttctataatcgtcatctctcagtttcatcctccctacctaccaggggtgaatacagatatgctctggtatttccaatcttatgaaacaaaaacaaacctttccttgactacacgttccccttctagtttcttagaaagaattgtctccacttctcacctctccttcagctctccttcactgtgatctggcttttgtcccaccactctgctgagcagttgctcttgccaaagtgttgttctcatctcactagaattttcagcactatttaacatgctagatcactccttttcgcttgaaacgctgaacttctattgacactgcattctgattcccttttaagtcactgctcaccccttctcagttttctttgtaggtgctgcattctatacccaaactctaaatgttggtgcttggcagagcttagtctcggatcctcttctttgccctctccctagtctctgcacttgtctattaatatacttatatattaataatcacacagaatatttaacatgaagcatatagactgatgtttttacacatgtaagccaattcatgtcagtcccctgttaaaacccctcagtggctttctgttgtgcttagaaaacaatccaaagttcttaacatgcctacaggcccctgtgtaacctgggtcctctgttcctttctgatccgtcttgtatcactcttccccttgctcactatgcttcaaccaaaatgactttctgctctccaaatataccaagctcattcccacttcagaacctttgcaattattgttttctctgaatggaaagtctggttctttcttatccttcaggtcttggctcaaatgtcaccttctcagagagtcctcagaccactccatctgcacagtagttcctgagtcagtcactatacatcaccctgtttatttacatcataatgttaacctcactgtctgaaatactcttattggtttgcttgtatattttctgtcttccctattcaaatgaaagttgcctgaggacagagactttttctgctttgtttactagtgtctctagagcctagaagagtacctggcacacagtaggcactcaataaatgtttgctgaattaatggatgaatatataagagaatatgaatggggccacatacgatcctcacttctgacctggagtctgcagctagaggagaggtgtttagctttaaaagaaaaaagttggccgggcacggtggctcacacctgtaatcccagcactttgggaggctgaggcaggcagatcacgaggtcaagagatcgagaccatcctagccaacatggtgaaaccccgtctctactaaaaatacaaaaaaattagctgggcgtggtggcgcaggcctgtagtcccaggtactctggaggctgaggcgggagaatcgcttgaacccaggaagcagaagttgcagtgagccaagattgtgccactgcactccagcctggcgacagagcgaggctccgtctcaaattaataataataataaaagaaaaatgtttaagtacagttggcaatagctctggcatgagttgtcaggcactagaactctgtaacagcctcagaataagaagtctctagtgactgtgtgccatttggagtctgatttcatcaacccagagtctcttgacagagtctcaggaatacaggtgagggagcacttcccagactgctgtggccattagcccatcttcgtaggaaactgttatggggtggctaatcttgctgtacaacccatcttccctggtgggctgagagtggggcccctctttagcctcttctggtgtttctcctcagggatcagtaatggggaagtggtggactggatggactcgactggggaagaagtgagcctgtggcagaagatgcgacagtacccagggtcttgggcagaagggactctgcagctccgttcctcaatggccaagcagaagctgggtttatgagtccctgtcctcttctgcaggtccagccctggcgagggcaggtcagaggaagtgaagaaatcaagagcaaagatttataatttaatgtgtatgtgtgtatgtgtgtatgtgtgtgtgtgtgtgtgtgtgtgtatgtgtacaaacatgtattttctgcaaatctcattatgctggctagagtgatgcagacttgttcttctttttaaagcagtctcaagaataagcatttctttaaaatgtttctgtgtataatctagtttattttcagagtccattttttcttatgtctttataaggttcacttaacttaaaaacagcttttaaaacaactttttatcttctgtcttgctatcattgttcctacttccctaggaagccctggctacctttcgcattaggaccagtctgggttttaaggctctgggaagcagggttggttagtaaagacaggaatgttggggagaggtgagtagttccttcctctttctcctctccaatttatgcttttaacttattttctacctggataaacttctggaacttggcttttaaatttaacttttctagtttttaagcagtttccaccttgctttggtctaatgcttttctttgaaatgctaacagaattcccaagctttttccagttctagatatctttactagacctttgggggactcttataatggagctgcttttgaaaagcactttaattagataatgtattttgactaaatcacgaggatgcccagtgagagcttctagctgatctcagaggaccagagtgactgagggtaaagtgtctcacagcccatgctgaattttctgcattttaaactgatactgcagtcattggagagagagctcctcatttctcgaatgaaagatgagatatattcatcctcatgtaccacatctgtcttagtgtttgcgtctggggtgtgttatcaaacagagcatggtctacatcccactgtgtcaaccagaagagccaagtgttatctcaattggcccagtgtttctccaggctggggactgttaagggctctaagggaatgtagacagagtctccctgttattctgacttcctgcttgatgagctttcagttcctgtttttgctattgtttcctaaatttgacctacatattacatgggtgtagtgtgttgaggcttttcaaagaagggtctagtgagctaagtttcatcttctggtactcattgatcaaactgacctttctattctcataagcgtttctacccaaagttgtgtgtggaaggagtgtatagcagagaggaaatccctttcaacagagtcagctgctaactgatttcctataagcacactggattaagggcagccacagtggtttctactgtatgtatgaaccgaatggaggaatgttttcaaagattgatttggtgtggattgcaattgtaatggaaggcataacttgggatcccgggctgtaacttgctcttttgtttcccacccccctgacatgtatgtgtgctttaataaagctttctcacttgtcaaacgtttgtgtttgt

SEQ ID NO: 1180 - DNA, 57664 bp, mus musculus; identical to SEQ ID NO: 1179

SEQ ID NO: 1181 - DNA, 408747 bp, mus musculus
gtgtctgcgcgaggcgggtgagcggggctggcgagccggtcggctgctgaggcgtaggggcggagcagaaggcggcggccgcggctcccgcccgcacagagcgccggtcccgcgaagccccctcccactcccgggcgggcggtggcggctgcgggaggaggagaaagaggagggagcgtctctgccgccgcctcctggtccccagcgccgatccgccgccgccgccacctccctccgcggcgatcctcgctccatggtcctgccgcggccccctctgtagcccgagctgctccgcgacgcgacggagccggcctcggacagagggagcggtcgcggcctcgcggcccgcgcgggctgacgagcggagagcgcgacgccgcgcggtccccgaggatccgcacgccgggcagcgcggcccgagcagcgcgagaagcagcgggcgggcgggcggcgccgggcccgggccgccctcgctcccgcgccccggccccgccgcccgcgccggggcggtcgcctgcagaggaaggcgccgcagtctctgggcctcgcggccccactcgagcgtcctcggcaccgagggctcgcgggtcctgaggggaggaggcgatcccggggctgggcactgagctcttgggcgcccccacccccgttttcgaagccctccacgctgcggccgctatcccctccggaccatggccgacgacgacgtgctgttcgaggatgtgtacgagctgtgcgaggtgatcggaaagtgagtctccacgcgagggagcgggagtgtggaaaaatgcatttcagtgatgccccggtcttcccgcacccgctcggggcctgccccctgccctccctccttcccctcttcccctctcgtccttctcatcctggagtatttatagacgtgtacctggagctcctgccaggcgggggcctgggggttctcagcggtccattgaggccaccgagccgaggttggccaccccgtaaggcgtggggccggctgcctgcattttatctgacggttgcacagggacgtggcacagccgattttatagttgcttcagttggggttattgttaccttgcatgtaccatagaccatttttgaaacagagcagcttgcatttcctttgcttgtgtggtgagagagtccagggttttaattgtggggtgtgtgtctattgtgcgggatattagacagatgcctttgtgtacaccccatgctcggattggagggggtcatttaagacggggtgctttcagtttcagcaaattccctcctggtgtacacgaacgtggaaagagttgggggcattcgaatttttaatgccttgttatgcaatgactgttcaatcagtgctcgagactcccctcgactgttgttgggatggtggttagcgtggtagagccgtctgctttgagtcaccgggctggtctagaatatagaactgacagtccaaatgctcatcctttcatctgtgttgtataattacgctggggaaaagcagggaatcagattaatcacagtgctgattgagaattaaatctgcagttcctcatctaattgtccattccttaaatctattttgaatagtttccttttcattcttgtcaaacagtactccaagtgcacaatcctgctaatttgcttgtgaaggaaatgctggcaatctgaagttgatttcctaacacagcgtgtattctgcggctttagaagttgaggagataagatttaagagcaaatttttgcttaataaggatcgctagagctaacattgaaatatcttacctctttttttttttttttttttttttggaagcggtgctttattgtctattttaaggtccacagttgggaaatgaaaccaagaccttaaagcagttggccctatctcttttaagttgtctgcagtactcaatttcaatttgagtgctaatttgtttccttttctttccatattgaggtattacagtgttgcctcacatggtgaaattgtgggtagagcttgctacacactttactcagacccaattgatgtgaggacatgttactccttgccctattgttacatgaccagccagacttaaaaggaaagtatccaaatgtgtcctgttaaagtgcttgtggaagtgttctagaacagcactgtccaaaagatatattatgagccacatttgtaatttaaaattttctagtagccacatttaataaaaacatacaggtgcaattaattttaataaaatattttatttaaccctgtagatccaaacttaacatttcaacatgtaatcaatatgaaaaaatattaatgaaatattttacatcttttatgctaagtctttgaaatcccaatgtgtattttacactaatagcacatctcaattctgacactaagctacatttctgatgaaaatcagaaatacttaatctgtatttaggtttcataaaatttgcgtttgcaaaagtatattcacatacccaagttgttcccaatatacataaaagttttccaataaccgaatcaagtacctttttctaaatttaaattttaattaattaaaattaaatacaattcaaaattcagtttcccagtcggaccagccacgtttcaggtgcccagtagccacatgtgaatagcacagttctagagagaaaaatgcatcaaaaatctccttggtttcctcattcttaggagcacccagtgaagataaattaggtgtttcccaaaagcctccaaatgactgtatgtgtgggtgaatgatgtttgttgcatcttagttatagctgatgtaaatgaactaacaaagtcataattggaaaatgtgagattaaaatgttaattatattgtgaagatgtaaaatagccatctctgaatcagttttggtaactagttctgattccttaaagtctggaagggtgatgatgtgatctctttggatatcaaaaagaaatggtcagaatcacattaacacagtccatattctgctgatttgtaattgatagaatatttttcaggaaacacccctgggagaaaaaaattcatcttttctgactgtttcagagctgcataaagaggggcagcaagctaattttgaggtgataggtactctatggctaccttaactactatgaactgtgaaatctcattcatatcctacaaaatctgacttggtcagtgccaattataaaatgccattatgtgaaataatgaattcaagctagccttattgttaaagaatgtaataatagtgttcctcaatctgagtaaaggttgaaggtttctctagtaaattgtcttagtatatattgatctggaaattgaaattagcttgagattttcttgcagggaccttgacagcatacatttttaacttataatttgttcacctctgaatttgaacagaaagcccttgaagatattcacatgtactgaaaacctttttattgatttctatccaagttctatggaattttgattttcttttttaccaaattagtatcacaagttgtttttcaccactagatcttaataggttttaatttttactaaggtactttaaaatagatttcacttttcaagactaattgactacccactcactcctctacctacgcaaccacctactcactcacccactgtgtacttggccttacttgatggcataaatgaaagttctcgtttaatttagacccttcagtgtgtttttttcccccttggttgagaaagataacttacagagttaatgaggttttgaaatataagatcattatttggaatatgttttctttccagtggttgcagcctttacccttgttaaagctgtctttgagggaacatgtgcccaatttgttacaaatattggaaggatgccgtttccctttttaaaaattaaaactcttttccctgtgtttctcatttttgaaaatcttgcagaaactcctttgagtgactgttggttctataacattttctatgtaactatcttttaaatgactgaaacaaatctccaataataagaccttatcatagtcccaaaacttcttgtcttagcaaatgtagcgattactggaaaggaagggcgttatgcaaatgaggttaatgactaatttttatgtcatgatcatttactgtatcttttacaattataagtaagtgtacaaccggtaatactacatgaaggaaatttaagacaattcatcgaaattaaaacatagaaaaatgcctactttcttggtacagcagtgtgtatgaaagggaataacaaaatacataccatttttaccttgtgttaggtgaatacttgccctgtttagtagcctgtagcttcagactttcctgctctggtaggacatacactaaaattggaatgatgcagcatgacccttgcttaaggatgacgtgcaactttgtgaggcatgctgtatttgcttactcctcgagagcacttttatttaattacagttacttatttatggatctctctagttcactaataaggagcttcctgagggcagggaatgtttcttacacatctttctccattaacacagtgcgtgcaatgtaactgcctttcattagctgtggaatgaattgagtagttttaataaaatctcattaaaaggcaaaaaagcatgtttgtcaacctcagagcaattattgtccgaagagcctgcattagtttaaagtagtggttctccacctggctgcatattagaatcatccggggagcttttaaaaaagatcaacgccagagccctgtgtcaaagcagtgaagtccgagtttctgggactgggtcctggtcactgacatttttttaaagctctctgtgtgattctaatatgcagctataatgaggaatcattggcttaaaacttagattatgtatgtaatattttgggactggcttttcagaggcttacaattcttacaaagtagaataaattctttttggaaggtattgaagctaaatggctaaaacatggattttatcttctatgcacttgtgtttctcagccttattgtgtaaaaatttagttttagcttgtgtttggctttgatttcttgggccttttaagatccacattgatttatgacactcatctaatgctaacatggcgattgtctgacgtttggaacaacacagaacaaggattgcttcaataacagttgatgatggttttccactataatggcttgatttaatatgaagaaatttatcagtttagtatggattgtgtttgtacatacactctattaaaagagtatggttaagttgcttgtatgctttaaattacatacttgtgattccagtaatgctgttagctggagaattgagttaatgcagcctttatgtaaatactggattaataatacgtaaagtatataattcagcatacagaaaaattcagctttactaatttgtactaattactatgactttcacatgtattgattcatgcagtgatttgggtttctagtaccatagggagaatttcgcattgtgttgaaaaaatgtttcccggaaattttaactagactttgtaggtaaactagtttttaatgttaggaaaagatcaagtgtttgcctgaaggaaccgagaattttccagaaatgagtagatattccagaaataccagtgatcgtgaaagcagtgcatgatcacagtgacagccaagtaacaaggtaaaagaagtgatcagcagctaaattgttggtggcccagaaagaatgcaagccatgggagttaagctgtacttctacagaggaaaatccttttgaactcagggtgtggatgctacagatagcaggcctcaatgggagtggggaagcaatattgattcctgatgatcctaggatcatttggagggagaacagagctactccgttgcttttctgcatgtatacaaccttctctagtctcttcctgtctgctttttacagattgctttagggtgtgttgtttgaagttgtcttcataaatacttcctgtggactcccttaatttttatgtccgtaacacgcttctatgtacttgacatacgcagttcagctctctccattttttccttgtatctgcaacagtttcacctgatgaactacgtctcaagtgtccctaaattgtgtacctggatatttcctttaaactgaaaattctgtctccagctgtagttctactcaataaattgaaggagcagatataccttgcttcttgagattattcttgaattattacattttcttaaacgttttcacattttaaatgtggtaggagcactgcatttaaaggaactttgacataaggttgtttaaaaaacttctataacttaaagcttactttataaagggattgacatttatccctctaatgttaggcattttggatgtattatttaatcatacccattttacagagaacactgagattcagagggggtgatcagtaattcgcctaagatcacacagattccaacgcggttccatggttttaaagtctgttcatttcatgctgcattctgctgctaattcaagttgtgaaaatactgtgttggattttcttaaagacacgtcttcattttcagagtttctatactgcaaattttagttgtttgactttctggttaaatttcttatttcttcagtagaggttccatatactattcattctttcatctgtttcttttttatttttgtctttctctttaatgaaacatcagcatttgttaccaaactaactggtaaatctagcaatggaaatatagactcttggccatctgtccaaaatataatttgttttggaactttctctacttcttttactctccaaattttttcttccatttcccttgccccaacagacaggatagttgattaattacccctaacttgccaaaccagaagtaataaggtttcagaggtagatgtttgttggaagtggggtggagtggtttccaaaggatagttattcctttatcctgtgataaaaatacggagattgttctctctgattctgaaaaccgtgtagtgagctgcagccgctgagtctgtgagcttctagctgtttgccagcactgtacaccttaaataatcaagagactgagttaactattgcagagcaggtaccggaccccagccaacaagctgatgggatgtgctgttctcacattttttggttttattttttagttgcaactgacagtgaagattctagaagcaccaaatatggctctggatttatgctgtgggatttaagatgctacagaacttgctctccttcctttctgtcctggagccactatggtattggttgtagagcccaagtcagtatagagtctctgacttctaccctgggaaaatttcatttccgaagctagtttgttttgaagttaatgtttatttccaacattgagatttaataattttgtgttacttttctttattaattagtttttatacagtaaattataaaagtaatgatgcacgtagtaaattttattttctttttttgagatggagtctcgctctgtctcccaggctggagtgcagtggcacgatcttggctcactacaacctccgcctcctgggttcaagtgattctcttgcctcagcctcccaacaagctgggattacaagcatgcaccaccgcgcctggctaatttgtgtgtgcgtgtgtgtgtgtgtgtgtgtgtgtgttttgagacggagtctcactctgtcgcccaggctggagtgcaatggcgcgatctcggcttactgcaagctccgcctcccaggttcacgccattctcctgcctcagcctcccgagtagctgggactacagacgcccggctaatttttttttttttttttgtatttctagtagagatggggtttcaccatgtaagccaggatggtcttgatctcctgacctcgtgatccacccgccttggcctcccaaagtgctgggattacaggcgtgagccaccgcgtccagcctagttttttatttttagtagagacggggtttcaccaggctggtctcgaactcctgacgtcaggtgatccacctgccttggtctcccaaagtgctgggattacaggcgtgagccactgtgcccagccatacaatttaaaatataggtgatacaaagataagtagtgagtctgtctcaattctcctaccatccatatccccattctctagaggtaaccattgttcagtttcttctccatctttctggaagctttttgtttaaaagtgagatatttgtatactatgctgaaatattgatttttcatgaataatagtatatacttgatgatcttgtcatatccatcaatgtatctgtctgtctctatctcctctttagctgctgcccagtattctgtcatatggattgttactttggctttggattgagtgcaagccaattgtaattttacattgcttgaaatgctgagctggaatttgggtgagaggtatggaatggcagtgaagatttgggagtcatctgtgtggaagtaaaactgagtgaacaagttcttgggggttgactgctctagggctcgtggtttggagtataactcatagagttagaagaatcaggataatgggctgcacagaagtttaaaagaggggggaggatcaataatgtaaaatgccaatatactctgaggactaagaacacatgtggctataacagagaaacaatttaaagcacttatcaaaatgaatattatgtttaatagtcaattcatgatgtgtctgaaaagctaggtctggcttcttttctgtggatactagtaattttatactatctctctgtaaatctatctcagaaccaacatatttagggtaaaaacaaagtagatttctttttcactctaattgtgttttgcagatttctgatgactggcttttaggtaaaatcatttggttttcctaagattatgtccttttcattcccgagcttgtgcatgactgtcaattaaatggaagcctttcatgaagtgacaaagtaagttttagatactttacatttactttaagttcttggtatgtgtcaaaccactgttattgtcttatatctttctactataggaaactgaattctttctagcctcaaggatttttgtccacgttggatgaatgtagtactgtcctcctctttcacatttcttctcccatcacctcctaactaaatttgttcattggctatttttggttgtccacatccattcacaataagaaacgattgcttcgttgtacataagccagttttttggtatctaagtgcgtgctatttcacttcagcttcttgtattctatttattactgggctgttgtacattgttttttctcccaatctttgtgatttcttttaatatactttctttcctttttgctttgtaatcattgttttgagtatttgaatcatttgcaggtaagaatgtggattgttctgtctctcatgtagtttaataatatccaaaatatactatgttcagtctgtatttcaggcttttaacacttaagttagagtattttggtatatttaaatctaggatagaagtacactgtattaccattcaactacatgcagattttaatgttttcttaaattaaaggatgatgatattcattcagttacagaggtctctctctctagtccttccatggtgtgcagattaccattatactactgctatttcatagattctaatttgtgtttttagaaaacatcatcaattcttggccttctttcttacccttggtatgtgatttcccctaaaggtatggaatgcggttgctctgtggcttgttaggcagcccccttctgatctggtaacctttgggcacagtgtggctattttctccttatttataaaaggaatgatagctgcttcacaaaccatttgtgtggattagtgaattgtaaagtgcagcataagtattttttatttctagaatgtctctgagatactcaaattacttttggcagttatgtacgtaagtttcaacaatttccaaatgtgcacattctcagtgctaaacacaggctctattacataaataatatggtgaaatgaacattcttttctaccatgtgtgtaaaattgttagtggtgctaacttttattcattgttcatttatgtattcatttctagctatgaggtcctgggcaagttagttagcctctctgaccctcagtttctttatctgtaaaatgtggttaatggtatatactttgtaaggttgttgtgaggattgaatagcatgatctatgtgaaatgtctaaaggttgttattttaattgccattgtcattattattattttttaaattttattattattatactttaagttttagggtacatgtgcacaacgtgcaggtttgttacaaatgtatacatgtgccatgttggtgtgctgcacccattaactcgtcatttagcattaggtattgctattcaccaaacacttgagttctctggcctcagggagctcaaatgagttattcacacactcatgcacatatcctctgcgtaacttggtaaccaacagacacacatagtaaaatatttggtcagcagttgttgaatgagtgagtacattaactgagaaatccagagactgtgtgaccacctagtaggagaaggaagttggggaaatcattacagaggaggtgaggcttgaatgatttgtcggtcttctccttgggtaactcatgttatctttgtaggcctgcttcctcatttataaaaaggagtagaggaatacaggtagggaaaattgaagaaattttaataaagtcacatatattactttaaaaaagtataactttcataaattatgtatattataacattatatatatttttatatatattttatatatatatatatataaattacttgcaagagggaaggagagagggtctcactatgttgcctaggctggtctcaaactcctggcctcaagcagtcctcctgccccaacctcccaaagcgctgcgattacaggcatgaaccactgcacccagcctaagaaatatattgaagagtcctttctgtctttttaaaaactgtccaggccgggtgcagtggcttatgcccgtaatcccagcacgttggaaggctgaggtgggtggctcacttgaggtcaggagtttgagaccagcctgactaacgtggtgaagccccgtctctactaaaaatacaaatattagctgggcatggtggtgcgtgcctgtaatcccagctacttgggaggctgaggcaggagaattgcttgaacccaggaggcggaggttgcagcgagccaagattgcaccactgtagtccagctggggcaacaagagcaaaactctgtctcaaaaaaaaaaaaaaaaaaaaaaaacagaaaacaaacaaaaaaactgtccagtgagctgtaatcactgcactccaacccaggcaacagagcaagacactgtcttaaaaaaattcttttaaaaatgtcattgctctcattgttcaactcccacttatgagtaagaacatgcagtgtttggttttctgttcctgtgttagtttgctgagaatgatggtttccagcttcatccatgagaacatataggcacagggaggggaacatcacacaccggggcctgttgggggttggggggcaaggggagggataacattaggagaaatacctaatgtagatgatgggttgatgggtgcagcaaaccaccatggcacatgtatacctatgtaacaaacctgtacgttctgcacatgtatcccagaacttaaagtataataaaaaaagttaaaaaaaaactgtcattgcctcttatgtacatagaaaatacagtattgagttacagattttcataatttgtttccaagtctgttctagattataattccgtagtgttgtgaaaaactcccaagattgttaaaagaaggaattttgtatcacacttcttatgtttgcatttagacaattgacagattaattaattgttcataatgtgaaatttcaagactgaaaaaaggaaaatcccagaatatatatttcagaaacacccatatataggatttatgaatattgtagtgttcctttatgtaacttcccaaaattttattacaacagcaatttctacatcttaacagtgagcaaaatgaggtggaaagattctgaagttgtagtctctgacactactgggcactgaatctaaataacctaaaaccacagaacagtatttcatcttctagttcttattacattgtcaggtgtaagaatgatcatgttgaaattgagtggttggtctgtttagatcacttctatggaaatactgcttagattggtttcagaaatccttggacagtattatttatattgcattatttaggttagaaatttttgctgacttccatctgagttattagttcaaaagcagaatcatcagcctttatatggaatctctgctggtgctcatcttaggcttagtatcttcttaactgggtttttgttagcagtatagtgtggcattaaatttgagactatctttttaataaattttttaaaaattttgtcagttgtagaataattagatacttgtaaaacaagcaagaagctgttttcactgaggactttctttaattacatttcatataaatttaagagaactgttactagaatattaaaatcacaggttaaagtgagaatgtatttcacataatcaacatacataacatttttaacagcatgctaaagatggaaaaaacctttaccaaccatacatattataggcaaagctttaaaaaaaacaaaacattttgctcttatggatgtgaaagtaatctgtgtaaatatgtatttaaatgaaaatatctattcattatcattgcagaaggagtgtgggtatctggagagggagcattctaaacttgctgctctactttttggattatctacattaatatttctcccattgctgagtatttctgttatactgctggatcatcatacttccataatctgtgacccacttgctctaatggtagagtgggctttaaactgccatctgattaaagttcaggtttcttagttagacttgcctgggtggcttcagaattaggcccacaaatatgaatatggacttgaagatcttactagaacaatattttccccgataaagacacatccataaacatggtcctaaaaagatatgtgtaagttggatttgaaaaatgcaatttaagagttactaggaaaaagggattttaaggaaacattttaagtaatttgtgtgatatcaccagttggtttttcttcagtttcttcatcttgtaaaagaaggatagtaatggctatattatctacctcatgagattctcatgcacataaaattacataattcttaagtcttaaactaccttacgtatattattatttcaattttattgaaataaaacactttttttttttgtgatggagtctcactctgtcacccaggctggagtgcaatggtgtgatctctgctcactgcaacctccgcctcctgggttcaagcaattctcctgcctcagcctcccgagtagctgggactacacatgtgcaccaccacgcccggcttagtcttgtatttttagtagagacagggttttgccatgttggccaggctgatctcaaactcctgagctcaggtgatctgcctgcctcggcctcccaaagtgctgggattacaggcatgagccactgtgcctggcccaaactaaaacacttctaatggacttgtactttggctgggcacggtggctcacacctgtaatccctgcactttgggaggccaaggtgggtggatcatttgaggccaggagttcaagaccagcccaggcaacatggtgaaacctcgtctctactaaaaatgtcataaaattagccggccatggtggcgtgtgcctgtaataccagctacttgggaggctgaggcgggagaatagtttgaacccgggaggcatagtttgcagtgagccgagatcatgccattgcactccagcctgggcgatagagcgagactaagaaaaaaaaaaacaaaacaagaacatgggctttgttgacttttctttgattttgtaagaatcatttacctttgtctttaaaagtgattttattttcttgtttgatttatagacattaatacttctcaactccttatagggctcagaacatgttaggtgaaaatattgcataaagagatttgagaatgaatggggcaatgataaatttacactgaagtcaaagtaaagaaagacttctgagtattttgttttccccagcttctttttaaattgcttaattttgttggagctttgatgtgtggaacttactacaagtgacaaatgtttgtggccaatcagatggcacatcctgttccatctgatattgaacatcctgtttagtcagtgaggtttagatcagtggttttcaaagtgtggatcttctgaccagtagcagcatctggaaactcattagaaatgcagattcttaggccctgctctggccctacagaattagaagccctggggttggagcacagctatttctgttgtaacaaaccctccaagggaattctgaggcacgctaaagattgagaaccactgtcttggaactctagatcaggggtcagtaaactatggtccatgggccaaatcatcctactgcctgtttttgtaaatagttatttggaacacagccaccgtcatttatttaagcatcatctatggttgcttttatgctatggggcagagttgattagttatgacagagaccaaatggtccatacagccttaaccatttctccagctttttacacaaaaagcttgccaatccctactcaagataaagcattcgtgctgttttctttcctttaattctgaactgtgaacagctaaaatcattaggtaaacgcttgtgtttgcctttacacctgaccctcctatttctacagatccattcttctctctcatatcaaattattaattcaatgagtagagacttgtaaatgaaaataacatactactctaccctttccttttctgttaggtagtggtggtagcctgtttaacaattccatgaccttttctcactgattgtgtgctggtgtgtccttggtttttctgtactctagtgtaatctaacttaatcatgtattgtaatcttcatttttcccaattcttactgcctttttacttcctcaagagaaaacccaccttgtgactgccaagtttagggattcatgtgagctgtttggaatgtttgtttgtttgtttgtttgacagagtcttgttctgtcgcccaggctggagtgcagtggcacaatctcagctcactgcaacctctgcctctcaggttcaagcaattctccctgcttcagcatcctgagtagctgggattacaggccaccacgcctggctaatttttctaatttttgtattttttagcagagacggggtttcaccatgttggccaggctgatcttgaactcctgacctcaggtgatctgcctccttcagcctcccaaagtgctgggactgtttagtgtgttctaagccaggggtccccaacccttgggccgctgaccagtaccggttcatgacctgttagaaaccaggccgcacaacaggaggtgagcagcaggccagccagcattactgcctgagctctgcctcctgtaagatcagtggcagcattagattctcatagaagcacaaaccctattgtgaactgcacatgcgcgggaactaggttgcatgttccttatgagaatctaatgcctgatgatctgagatggaacagtctcatcccgaaccccctacccccaccccggtccccatcgtccatggaaaaattgtcttccacaaaaccggtccctgatgccaaaaaggttaggtaccactgttctaagccattgaaatagtgccatcccttctggaaaattgttacccttgtcctggagtgctgtagtcactggtatttcaccaggatgttagggtatttcaccaggatgttagtgagcacatagatattgaatatttcgggcaatcttagaatgtttactgggagagttttaaaagttagccttcccacatccctccaagaatagctgtttctctttgtagctggaatgtcatgttgtactcttgattctcctttgtacctgttcttagccattaaggtgattggtggtcaacttcgtataaaatacaactcaattttaccattgttcttattgatgcacatgaatgtttctctttatgcatatcactgagggaagtatagtagcctttgaaagaaaggccttcttgtagtctcccctggctctggtagcaaggtcaggcaaaagtgttgtttttgcagttgtgactccatggttgtgtttttctttacataactgatgttttaagtcaggaaatatgactttgccaaatgatactgagctatattactggtgagtttgtttggttcctgatttatttcagtaaatctgggttgaatagtttagtagtagatgctggggaagatacaggaaatagtgagtttgagactagaaatgattgagttagacatttaatttaggctttcccaatcaacttacttcataccttttgccctgcttactcatcccagaggtgaggaacaatgagaagaggggtcaggcaaaggccatccctcagaatgtggttacttaggtctgtcgccaaaggcaacctatctactggaaaatttgagctttactgtcttctgcagtatagtgttggaaatgcagtattttaaaaactaaattgttatttatagcagtgaataaaatgtgaactctttaaaaaaagagcagtgttactgtcccagctagcacaatagccacccacatgaatcatctgaacaacctcctcatttctgttttatctacctgaaataggggtcagcggtaggtgatgatgaaagcttgggaaatcatgccatgcattaggcaggagaaatgctgtggtgactctttctgtgttgtcctgccctcatgtgcataggaggctggggcagccccaagagctagaggtaagctttaataatttccctgggttccttggcagctggctgtgcttaggagccgggtgctacttccagagtagcaactgctgtagaaaagttctgccaaatgtgtagattttgaaccattttaaaggctatagtgttcagactcaaattttttagtaggcagagagtattatttaagggtacttatgctgcagtattggataaggttcgttgtgaaatagatactacaacaaggcctccatgtgacataaacttattggaacttgtgtacttttaaaaccatatgtttaatacatattttgagcttcattaggtcaggattcttggctatcatagtcattgttgtatctctacaacctagagtagtgtctggtacatagtagatgttcagtatatagttgaatcagttcaaacaaggggaagaagtgactgaacacattagaaaaggtaaaatttatggcctataatgcacaaagtcagaagttcatattttcttttagtgctaatatcttgctgcttcaaaaccatttagttctcataatgttcttttgaaataggttagtagacatagaattgtatagtatatgccgaacatagtagtggaatcctgaataatacctggtttccctagttgagatctgtaagaccaatgctctaattagatgaagaaaagaagtttctaaggttgaaatggaatggagaattttatagtgagtggaattactaatgactggcttacttgatctatctaaaacgatttcattgcttgtaaaatggagacagtagactttaactgatagtattgtttgaagattaaataagatagtgagtatgaagtccttggagacttgcaggtgtgcagtgagcatgaattgttttcaacatcaacagtaatttttgagagcttcctaatcagtcacctagctagtcccacccagccttaggcaaagcgaaggggccataggccaaatcctgccgtctgctttatattgtagccactagccagatgtggctatttcaagttaattaaaattaaaatttaaaattcactgaacagacatttctccaaaaaagatttataaatgaccaataaatacacggaaaggtgctcaacatcaagtcattatggaagtgcaaatcaagaccaaatgaaataccacttcatgtgcactaggatggttagaatcaaaaagacaataacaagggttggcagggatgtggagaaattggatctctcgtacgttggtgggaatgtagaatgttgcagccaccttgaaaaacacactggcagttcctcaaaaagttaaatatagagtttccatacagcccaacaattccattcctaggtatgtgcccaagagaattaaaaatgtatatttacacagaaacttatacatgaacattcatagcagcatttcataatagccaaaaggtgaaaacaaccccagtgtccattaatggatgaatggataaacaaaatgtggtagttgcacacaatggaatatcattcaactataaaataaattaagataaagacgcatgtgtatgttcatcacagcactattcataatagcaaaggcatgtaattgacctagatgcctgtcaacagtggactggttaaagaaaatgtggtacatatatactgtgggatactatgcagccataaaaaagaataagattatatcctttgcagtaacatagatggagctggaggccattattctgagtgaagtaacacaggaagagaaaaccaaataccacatgttcttacttataagtaagagataaacattgagcccacacagacacaaagaagggaacagtagacactggggcctacttgagggtggagcattaggatcgaaaaattgtaggatactatgctgattacctgggtgacaaaattatctgtacaccaaacccctgtgatatgcaatttacccatgtaatatgtatcccctgaacctaaaataaaagttggaaagaggaaaaaaaaagatcactttgggaagaattgatagcttaaattattgtgtcatccaatgtatgaacaaggtatatctctattatttgggtattgtttaatttctctcagcagtgttttgtagttttaaaagtacaagtcttgtacatcttttgtcacattcttaaatatttcatatattatgctgtggtaaatctgtttttcatttgaatttctgattgattgttgttagtatatagaaatgtaattgattttttgtatgttactcttatgtcctgcaactttgctagattcacttattctagtagaatgatgtatattgcattggatagtctacatagatgatcatatcatctgtgtataaagacttcctttccccaaaaaaagaaataaagtacagatacatggtgcaacatgcattaacttcaaaaacattatgctgagtaaaagatgccaaacacaaaagaccacatattgtatgatttcatttttaagaaatggcctcagtaggtaaatctgttgatatagacactagattagtatttactagggactgggaggaggagagtgtgggcagtgactactaataggtatggggtttcattctgaggttatgaaaattttaatggaatttaggtagttcttagtgatcaaggcacaactttgtgaatatactaaaaaccaccagattgtatacttaaaaagggtgaattttatggtatgaattatatctcaataaatgttatttttaaaaattcagttccttagttactttagccacatttcagttgctcagtagctacatgtggctagtgactgcatggtagacagtgcagatttagaacgtttccatcatcacagaaagttctgttagacagcactgatctaagagtctcaatctgagaccaaaaaataaaggaagaaaaaccagtctaaaaaacacagggagtggagaacagattatgttctgaagaaatgttactttggggtaattttaccctttgttgccctttgactgttctactaggagtcctcaacatgattttcattttattctcaaaacaaatgcctgtggtaggtactgttatactcatgttttataattgaattatatgagttttaagatatttgtgtagtaagggtagagcaaaatttctaacctaggtacataatctctgttacattgtttacctctgtttatggtatttgattttcttaccaaccatccttcactcccactttgttgctagcccactagagctattttcagtaccctaaatgcacagttctttttgtgccatagcagatgctagccctccttcctccttctgccgtctcccaacactagtatgtgcatgtgcacacatttactggccccacttacctgaaagtgtggtgcacatctctcttcctttgtgaagctatctgataccacagttttaggggctactctctcacctggttaaggttacataatgtcgcaagatataagcaagaatgctgacaggattcttgttgtgacactatgacacattgagcccaattcatagctgctgtgttggtgactctaacagggaagtggtcttctagtccaggcccttggctcccatttatacattatctcctttccattcacagccttctttaatccccacccacactgctacagtacctgactgaactttgcctttctttgcctcttcatatgtttttctgcttaagctttttgaacctgatgagatactgccatgtttttatatttttctgctcataaaacccttaatggtaaaaagatacctgattgaattctgaagtgctttcatggctttgcctgattctgaggtcatattttctaactttatgctaacatcagtttactctctggttttatatggagcatgtactcctgtagcttctgaagaaaggtttaatgggaagcaaattttgagactacatgtagtaggctaaatcatggcccaccaaagatgtacacatcctaattactagaacctgtgagtatgttactttacatggtaaaaggatctttgcagatcttattaaatttaggattttgagatgggggattatcccagaatatttggatggacccagtttaatcacaagggtccttataagaggaaggcaggagggtcaaagtaagtaaaaggagacacgacaatggaatcaaccagagtttggagtgatgcactttgaagatggaggaagagggccacaaaccggggaatgcaggcagcttcaagaacatggaaaagcttctcccctgaagccaacatcttgatttgagatttctgacctctgatcagaactgtaagagaataaatttgtgttgtttaaagccactaagtttgtggtagtttattacaacagtagtaggaaattatgaatacaccatgtataaaaatgtcattatgccctttaacttgattgatagtttatgtagacctaatatatatgtacacatactagtctccatggctccatgctgcagtggacccaggacccaggcccaccatccatggactcaggttccaaacccaccccagcagacttggcctccagactcaccctggcggatccgggctccaggatcatccctggttgtctcagactccaggcctgcccctgcagacccagtcttcaggcctaccttcgtgatcccaggcaccaagcctgcgtccttgaatccaggtgccaggctcattctagcaccaggctagtcccttaagactcaggctcaaggcccagtgcagcaccagattgagctttatggacccaggattcacactggcccctgtgaatacaggctttaggcctgccctgcatgcccagctgacaggcttgacaggcttacctgagtggaccctggcactaggctgttccccatgcacaccaggattgagatccaccctagcaaactcaagccgtaggcctgtcctaatggacccaagtttcaggatagcccacctgaaaactccagcagcaagcccccctgccagacagccctccggaatttctggacaggctgactggtaaaaggcttttcctgccaaagccagtctgtgaagactgcaagtgcctacttcttcttctttttttttttttttctgagacagggtctcactctgttgcccaggctggagtatagtggagtgatcacagctcactgcagccttgacctctcaggctcaagcaataccactgcctcagccaatcctactgcctcagcctcctgagtagctgggaccacaggcaagtgccaacaggcctggctaatatttgtattttttgtagagacaaggtttcttcaagttgcccaagctggtcctcaagcaacccacccgccttggcctctgaagtgctgggattacaggcgtgaaccaccatgcccagccaagtgcctgctttgtaaaatgtgcagacactaatgcaaaactgcaaggatcaccgataatcagggaaacatgacatcaccagaggaacaaaatgaagcaccggtaaccagtcataaagaaatggacatctatgaattgactgataaagaattcaaggccaggtgcagtgtctcgcatctctaatcccaccactttgggaggccaaggtgggtggatcacttgaggtcaggagtttgagaccagcctggccaacatggtgaaacctcatctctactaaaaatacaaaaattagccaggtgtcatggcatgcgcctgtaatcccagctactcgggaggctgaggcaggagaattgcttgaacctgggaggcagaggtcacagtgagccgaggtcatgccactgcactccagcctggctgacagagcaagactccatctcaaaaaaaaaaaaaaaaaaaaaaaagatttcaaaataatcaaataatcatcttaaaagaagttcagtgagttaaaagagaatatagatggacaacaaaatcaggaaaataatacacaaacaatatgagaagttcaacaaggaaacctcaaaaaaaaaaaaaaaaagaaccaaacagaaattctagagctgaagaacacagtgtctgaactgaaaaattccacagaaagcttcaatagtagacttgaagtagaagaaaaaattagtgagctcaaagatggtcatttgaaactacccagttagaggaagaaaaagacaactaaatgaaaaagagtgaagacagcctatgggagttatgaggtaccatcaaacaaagcaataaatgcatatgagatttccagatgaagcagagaaagaaaaaggggaagacagcttaaagaaataatgacagaaaatgtcccaaatctggagacatgaatgaacatccagatccatgaagtccaaagaacctccaactagattaaagagatcttcactgagacactttataatcaaattctcaaaagtcaaagataatttcaaaagcatcaagagaaaagcaaaccatcacctacaaggaaacctctataagactatcagtggatttctcagcagaaactttccaggccaggagagaatgggatgatatattcaaagcgctgaaagaaaaaaaaaaaaaacaaaacaaaaaacctgccaaccatgtattatatacctggaaaggctgtttttcagaaatgaagtagagataaagacttccctgtgggagttcatgtcccactagacctactttacaagaaatgctaaagggagttcttcaagttgaaacaaaaggactctaacaacacgaaaacatatgaaagtgtaaaactcactataaaagtaagaatatagttaaattcaaaatactctaatgctgtaatgatggtgcataaatctctcttaattctattataaaagttaaagacaaatattaaaaatgactatagttgcaataatttgttgatatgcaatatatacaagctgtaaattgtgacatcaataatagtggggcagaggagaaaaagtgtcgtacttttatatgtggttgaagttatcaatgtaagatattttataattataagatggtttatgtacacctcatggcacaaagaaaaaatctgtagtagattcacaaaagataaaggaatcaaagcattctcttacagagaaatcatcaaatcagaaaggaagggacaagagaggaagagtggaacaaaggaactacaaaacagaaaacaaggtatcagtagtgagtttttacccatcaataattactttaaatggcttaaattcttcaatcagaagacacagaatgaatgactggataaaaagaaataagactcaaccatatgctacctacaagaaactcactttagttttaaggacacacataggctggaagtgaagtggaaaaagatattctgtgcaaatggtaaccaaaagaaatagaggtggctatatttatataaaacaagatagactattaagtcaaaaactgtcacaagagacaaaaaggataattttataatgataaggggtcaattcatccagacgatacaacaattataaaatatatatgcacccaacatcagaacatttacatatataaagcaaatattaatagaagtgaagagagaagtagatagcaatacaataatactagcagattttaataccccactttcaacaatgcacagaaaatcaataaggaaatagcagatttgtactacactgtaggccaaatggatctaagagtcatctgcagaatatcttatccaacagtagcagaatacgatgttcttttcaagtgtgcatggaccagtctctaggatagatgatatgttaggctacaaaacaagtcttaacaaatttaagaagattgaaatcataccaagtgtttttttctgaccacagtggtatgaaactagaaatcaaaagaaaacggaaaattcctaaatatgtggaaagtagacaacacactcctgaacaaccagtggatcaaagaagaaattgtaaggaaaataaaatcttgaggcaaatgaaaatggaaacacaacataccaaaacttatgggatgccatgaaagcagttcgaagagagaagcttataatgataaatagcaatacatgaagaaaaaagaaagatctcaaatagacaacctaactttacaccttgaggaactagaaaaagaacaaactaagctcgaggccaaaaaaggaaggaaataataaagatcaatgcagaaataaatgaaatagagactagaaaaacaatagaagttatcaacagaactgagttggttttttgaaaagtaaaatcaacaaatctttagctagactgagaaaaagagaagactcaaaattataaataaaagagacattgcaacttaaagagatacaaaggtttataagagactactataaacaattatataccaacaaatttgatagcctagaagaaattgacaaattactaaaaatacagcctatcaagactggatcatgaagaaatagaaaatctgaacagacctataatgagaaaggagattgacttagtaatcaaaaacctcccccaaaagaaactcccagaacctatggcatcagtggcaaattctgtcaaacctgtaaagaggaattaatgccagtccattttaaactcttccaaaaaattgaagagggaatacttccaaactcattttatgaagccagcattaccctgatgctaaagctagacaaggacagtacaagaaaagaaaattacagaaaatacaagaaaaaaattcctgatggatatagatgccaaagtcctcaacaaaatactagcaagccgaattcaactgcatattaaaatcatgcatgcttggtacaacagatatatctgaagagactcttttctctatggttggtttcttcttgatcatcactacctcttagtgtacaggaagctcaaaatattactgtgtgaccttaacaaaataaatttacttctctggtctttaggtttttttcaatgggaaaatgggaaggttggctccattagtttctaaagtccctttgagctctgaaatgagtaattttataatttctaagtgtttaattcatcaactacatgactttaccttttttcttcattacctgtcaaattcacttaaaaactattatcacacttcatttgctttttaataaatttctgacagcatgaatgggagaaaaaaagggactatacagcatgatcaaagaagatttatccctggaatgcaaggatggttcaacatatacaaattgataaatcacattaacagaataaagtacaaaaaccatatgatcatctcaatagatgcagaaaatatgtttgacaaaattcaaaatcttttcatgataaaactctcaagaaattaggtgtagaaagaacataccttaacacaataaaggctgtatatgacaggcccacagctaacatcaacactcaatactgaaaagctgaaagccttttttctaagattaggaagacaaggatatccactctcaccacttatagtcgggataatatgggaagtctgtcctagccagagtacacaagaaaaatgcatccaaatcagaaaggaagaaataaaattttcggtttgcagatgacttaaaattatatatcaaaaactcttaaaactccaccaaaaaaacctgttaaaactaataagcaaattcactaaagtggcagatacagagtcaacctacaaaaattaatagtgggggaggagggagtagggatggttaatggtcaccaaaatatagttagatagaatgaataaaatctagtgtttgatagcacaacagggtgattacagtcaacaataatttattgtacatttgaaaataactagaagagtataattggaatatttgtaacacacagaaatgataagtgcttgaggtaatggatatcccatttaccctgatgtgattattgtgcctctatcaaaatatctcacataccctataaatctctacacctacgtacccataaaaattaaaaattaaaaacaatagcatttgtatgcactagcaatgaactgagaaagaaatcaagaaagtctgatctacaatagaatcaaaaatatataattcatttctaagaggtttttttgttctctcttcttgtatatagcttcaagattttgtttcttatatgctatgtctaatgtcctccaagagaaagagagggaaatggaattataattaacattgtcttttccctatattatctgttttctcttattttcttttttcctgttttttagctttggtacttgtctgtctttcatgttagaggtgtttctcaagcatcttcagctgtttgttgctattaaggaaaagtttattggaaactgtgttcatgactgtggcttgttcagtgatggacctcatgtggtgtgattgagggaaacctggctatttatggggagcctatcagttcttttttcttaagccagtcagcttttctaaataggatttctaaattgaatcttttgtgggagggagtttgggagtaataagctcatgtctagggctggatccttaatcattggctgcaaagacttatttaacccttgttttcagtaaggcatcccatttttgttctcagttatggctggtgttcctgagttcaggggctctgattcaacctctccagagagtaacttaagccctctgctatgtggagaaaaggcagttgccagatgctctggttggagtgagagtatgtgaaaatcttacttctcttttttaaacaatttttcagcatccccccaccacttgctttaaaaaaaaggattattttcttcaaatgtgcccataagctgcaattcctgagcttttaccttctgttcttccagggcactcaggagtgaactggcttacttgcctcaatttagattcccccactgcaggtacttggcacaaagaagaaagatacaatcaagtcagttacctcttttccaaatgcttttcattttaaattttgtgggcctatctcctttgctgtcatcatctccccacgctcttcatcttgttggtttatatcttttctaattcttcagtcttttgatttgtagagggagttagataaatgcttgtatctgatcagttatgtttaaacaaaagcgcctccctcccttgacaccttctctttttcttggacttctgtttcttagactgtttccaccattagaataagagcttgtcaagggcaggaaccagggtatttaatagctccagcatttgtataatgcctggagtatagtaggattattaaataaatgaacatacctttattttcaattatagatttctctgacttgagaaataatttcaaataaaacagtgaagtctctcttacagataagttcggaagctctcctctttcctcgattcttgcttatttttatccacagtgcgtctcgtgaaggaaaagaatggatcattctttcttgatttcctcgttggtaaagtatttggctttaagagctattcaaatgaatgtgcaaagtaagagtaagttgggtgtatttctagcactaagttgttgaggttctagaaaggtagttttgtgccttctagataccatgtctgcctttcctaatgagcctggtatgtatactattctgcctagcataactaggagcaataggatagagaagtgggatataccatttcaaagattcactgatgctgcttagaaacaaaaatctaaatgaaaaccaatgtacataaattagataattcacatataccattagaaattccacttaaagtcagtactgctagaaaccttgtcattaccttgctttaaatgctaagcgctttctgattaattctttttcagtttatttacctgggaggtattcgatctaagcaccagcatccctgcccccacttttatctattaatatttacaggtttttccctctttgaagctccctattgaattctgaatgactttgaacttggaattgctctgggtctgcttttcacctcctttctctacctcccaccccaaccttcactaatttgcttttttttttttttttttttttaatatttgggtggtttcttcttgcattctcttttttctatatgctccatgacagcctggactacatttctgttactcactgctgcatccagtgcttagcacatgctgggccttaagtcactgtttattgaaaagaataaatggattactcgttgaaatttttttaattatgaataacaaaaattagtaatctaactatatattatcaatcttttgctgtcttatcttacaggttttctttctggttttcatactggatagtctctattgacctagcttcaagtttgctgatttttttctactgtcaacttaaacttgctgttgagtccttctagtgaattttttgtcaattatagtacttttcaactcctcagtttctattttttttaagaattctttttctttattgatgttctctatttggtaagtcattatcctcatactttaaaaaacttctttaagtatagtttcctttaattctttgaatatatttataatagctaatttaaagtctttactaagtctaacagctgagccccctcaggaagtttctattggctgctttttttcttctgtatgggccatcttttcctgtttctttgaatgtctcataatttttctgttgttgataactgaacattttagataatatattgtagcaactctggattctgatccactcaggtagtggttattgtttttacttttgtttttccattgcttaatgacttgcctggactaattctacagaggctgtctttgctgaaatgtgtggccactgaagtttgtgctaggattttttgttttgttttaaattcttgtttttatttttaagcctggcttcctagggttttccccttggtcatccaatggttggccacaagttttccttaaacactttgagccaataagccttccatcttttgctgaaggaatctctgtgtgggttggggcatacgttgaaagttcaggcagtttaaaagtctgccttggctttcactttctgcttgtgtagggcctcacagtcagccaggagcagtagataattgggaatctttctggtctctcttgaacatgcatacatgcacagagccctccaaatggatacaaccttccagaacccccaagtatgtcagagctttaagctttctatggctgtctcattccccacatctaccttttacatgttggctagtgtcttgcttacctcaaccagtattgcagacttaagcagctgtgattgtttctaatgattgctattgtttttgacagtgcccctggccatggggctttctcttggagctccatatcaagtcagcttccttcagtggaactgtccacaaagctacaaggccagcgaattgtggtagaagcggacccaaattaaaatgtcacagaccctgctggtcttacctaggatcattagtagctgaggtcctcactccgccattccagaagtcctgccccccacctctgccttaggttttcaatgtgtttttatagctgtttatagttttgtggcttttcatttagtataaatattttctcatgttcttgataactcattataactaatttctactggctctcatcatttgaatgtctcataattgatttggtaatttcccctgttgttggacttcagataatcactggtgtaatttgcctttcccaacaggctctaacctgaatgaggcctgggactgctttgtttactacttcatcctcagtgcctgacacagtaattcttgttaaataaaggtcaccccacaattttttaaatgttataaataacactttgaggtggatcgtactgccaaaactgtattcagatttcagattttttttaagaatggagtttcagaaatggaattgcttggtcaaaggatataggcatttctaaacctcttgacataggttgccagattgatttcttaaaaagtcctatcaaaatagaaccttttggccgggtatggtggctcacacctgtaatctcagcacttcgggaggctgaggcaggtggatcacttgagatcaagagttcgagaccatcctggccaacatggcaaaaccctgtctctactaaaaatacaaaaaatttagctgggtgtggtgacgcgtgcctgtagtcccagctatgcgggaggctgaggcaggagaaccacttgaaccccagaggcagaggttgcagagagccaagaccacgccactgcactccagcctaggtgacagccagactctgtctcgaaaagaaaaaaaagagaacctgttttttcagcagcatccttatctgttgcattgtatatttggcgacatcagatgtgctagttgctcaagttttattgaccttattggccaaaaaaaaaaaaaaaaaaattctcgttgaactattttgtgtctttttttgagacagggtctcagtctgtcacccaggctggagtgcagtggtgcaatcacagctcactgcagcctcaacctcctgggctcaaatgatcctcccatctcagcttctcaagtaactgggactacaggtatgtgccagcagacccagctaattttttgtttgtttgttttagagatggggtctcaccatgttgcccagcctggtcttgaactcctgggctcaagcagtcctcccaccttggcctcccaaagtgctgggattacaggcatgagccaccatgcccagctattttgtgtctcttcgataaccaatgaaagtattagttttcctcatactttttaaaaaaaattctttctataaattggccatttgtttttcccccattttgctcttagttgcctaatgtttttcttgctaatttatgtaaactttatatatcaaagatatttatctattattgtcttttatatatttttaaaatttttcattttgttcctgatgagtttggatgtgcagaaactaaaaatcatacagaagaagcctctttgttcgatatgattggatattacaactggtctgctaaagagggaggagtataaaaaaagtctacagatatctcttcaatattttaacttgaagacaaaatatacattaagtagctaatcctttgatattgtgtgacccttttctttgaataagtctaattgattcgaaacctgctctatatttcttttatatatctcatccaaaatgcatcatcaacgatgtccagttttgatttatttaaaatggggtaatgacttaatgagctgtaatctgagtgcaaaatccttttggatattttatagatccttgctccccccgcccccccacccagtcttttgcagttttgtcacccacatttaattcagtatctcctttatctggtctttgaagccagttcttctcttttgtagtcacattcaattgctgtaacatatatgtaacatataattaagaattataggccggatgcagtgcctaacacttgtaatcccagtactttgggaggccgaggtgggcagatcgcttgaggtcaggagttcgagaccagcttgaccaacatggcaaaattccatctctactaaaaattaaaaaaaaatagctgggtgtggtggcacgcacctgtaataccagctacttgggaggctgaggcatgagagtcacttgaacctgggaggcagaggttgcagtgagccaaggttgcatcactgcactccagcctgagtgacagactgagactgtctcaaaaaaaaaaaaaaagaaattatagtaacacctacacaaccaacataaagaggtacacatttaggaacaaatacaaatagctcttggtatgtagacaacttaatttgtggggttcatgggctcatatgtactacacagtaccctgtcagcattgagcagtcagcatgcagcaggcattcattaggtttctacagagggaatggagaatggatcagtctgtgaaatttgttaagtggggtcaattaagagtgcttctaccatggtcaaaatctaatcagtctttttctttgttgtgattgtttccatgcttagaaagtccttcccttcttgagagttatgtgaaaattcacctacatttttctgtctttcttttgattcatacatttaactctttagttcatctgaaatttattttgttttttagtaagaagtaaggatgtaagcatctaaatagattttccaccttcaaataatgtgctgttttttttttccccagcatagccagtgcattcttcaaaggcaaagatcaaaaatgtaatttctagttttcaacaattagaataggggttgaatgggtctgggtcttgggagtggaaggtcagtatggtccttggggttggggaagggcaggcagagcatagagtggaatttaaaacacacacacacatacacacacacacacacacacacgcatgcacattcacatgataaggagaaaaagataactgagaaattggataataacagagctagtaggaagaggatatagtacaatgaaccctctttagaatgcaggccctttccaaaatgaaaatttgaagggtacttgggctctatttgatgaattatagtgaggtaaagtagtttattaagcatttgaataaacctaaatagttaataagctattgtttattaataaaaggtatgccaacaaggaagtaattatgcaaagttctacagagctgtcaaacttgaaagcatgtttttccccaccgattttgccagtctctactgggaaattatttatgatcattccctcagtcttttgaataagtcaacttctctcagtgcaatcattgctttttcctgggccatagcattaggtcaattagtgaaatattaggcataatactctttaaggctatgaatggccttgaagtactgtatgaaaaatatgagattaatattaagaagctgctatgaagcaaatgttaccagtggaaaattttattatacagtggtgtttatgctggttttaagttttaaaacattttatctttaaatgaccactgtataaatgttactttcaaaatattgtttggtgttgataggttctatttactcttcccaacatttatttgtattatgagtcacttcatactgactcaccagcattgcattaaaataaccagtcaccatcaaaaagtggactaaggacatgaatagacaattctccaaagaagaaatacaaatggccagcaagcatatgaaaaaatgctcaacatcactaatgatcagggaaatgcaaatcaaaaccacaatgcaataccacctcactcctgcaagaatggccataaatcaaaaaataaaaaaaaaaagatgttggcatggatttggtgaaaagggaacactcttacactgttggtgggaatgtaaattagtacaaccactatggaaaacagtatggtgattccttaacatctaaatagattttccaccctcagataacgtgcctttttttttttttccaggatagcaactgcattcttcaaagggacagatgaaaaatgtcatttctagttctcaacaattggaatagaggttgaatgggtctgggtcttgggagaggaaggtcagaactaaaagtagatctaccgtttgatccagcagtcccactactaggtatctacccaaaggaaaagaagtcattatacgaaaaagatacttgcacacacgtttatagcagcacaatttgcaattgcaaaaatatggaactagcccaaatgcccatcaatcaatgagtggataaagaaaatgtggggtgtgtttgcgtatatatacacacacacatatatatacatacatatatacatatacatgtatatatacatatatatacacatacatgtatatatacatatatacacatacatatacatatatatgtatatatatacatatattcacatacatatacatatatacgtatatatatacatatattcacatacatatacatatatacacacacatatatacacatatatatacatacatatatatataatggaatactactcagccataaaaaggaatgaaataatggcatttgcagcaaccttgatggaattggagactgctattctaagtgaagtaactcaggaatggaaaaccaaacattgtatgttctcataagtgggagctaaggtatgagaatgcaaaggcataagaatgatatattggactttggggactcaagggaaagtgtgggagggggtgaggaataaaacacattgggtacagtgtacactgcttgggtgatgggtgcatcaaaatctcagaaataaaaaaaaaataaatgaatcaccaaccaccaaccaaccaatatgggagatttgtttcagctggagggccttagtttcttaaagtagttttcttctcttgctctggaaagtactaattccaaggcctcttttctcctcccagttgtaggatattggggattcttactagaaagcgtaggcagagcacatgcagccagtgtccccaagttttttagaccatctggagctacctgtggctgctatgtagcctaaaacttcagaaggccttatgatctattggcagatggctaaactgggatccttgtgtcagggttttcttttatgttatttttaaattccagaatagaagagaaaatgaaatggagaaagaagacattgaaggttgtggtgttttctgtgaagttcaagaagtattgacatttctcagaagagtatgactatagatgatattgttactgtttggggttttttgttggtcatggtggtagtgatggatttttttttttaagagtcacgtttcttcacctagaattagctgaggaaaagtggcatctgtattgatggttttaatagatatgattttattggtggtgccttcagagtagtggcttagagtaattagaaagacatcattgctttgtataggtcttaaaaagattgttaaacttttaattcaatgttggctgagcctgctgtgcctgatacattaaaagaaaaaagtcttatgatttactgaaaagagtaaaatggtcctgatttcagttactcccttctactcatgcacactgtgttgcttactgccctttttaaatccaaggtgattcttcaacctcatacattgttttaacatttcactctatgtctaggacatgtctagaatatttaagtgcctttttcttggaaataatagagatgtatcatacccagttttatttgcttaggtagcagataaagacttcagaaatactcaatatttgagtatttgggttggaatttgacactgtgtgtgtgtgtgtgtgtgtgtgtgtgtgtgtgtgtgtgtgtgtggactcaactagcctaaaagaaagataaatgcctcttagaagctagaggggaaaaacctatgaaaacttagtttgggatgtacctatgatgaagaatttgccctctgatttctcttccatgtggctgattttgaaggttgtatagtattttgtttttatgttttgatacagctgttaattcttgaccattttcctcagaaattggcatttccagattggcaaaatctagtatcattgtaggtagctctttacagataaatttgtacgggagagtatgcaatatattttgaaacttctgtttttgtgtgtacaaatctctaaatcagcccagatggtggccattatggattagtaatagcaagaaagaaagctgttaatatcacagcttctaacatatgtctcctgattgtgggtatatatgcctggtgtcaaagataacgctacagcatacctattacggcttttaaaaagttactaaggcatttctatctgtatcagccaactagaaggatggattagacaacatgatatatgtagtgcttttatctctggcaggtagctaagtctttgaaagaagatatatcttctcatctggccagaatgttttgattttaacttgaaatttcctaacaagagttcttatgtgtttattattgcatgttcttatgtgtttatttttaaaactatcctttagcatttaggcacattaatttatagcacctgtagagcaatcagttgcaatatctgcatatatgccttttattttctgtaattgagatctgtattatatttatataatcagtgtgtaagttactctaaaagttatctagtcaagcttgactttaaagatgtctttgtaacttgttctacattgttactgtttccttcagaaagttaagtttccaagcttctttaagttacattctagacgttccgaggggttccaaagtgttgaaaaggaaattgaagtaagctttggaatatgttaataagcttcaactggaaacatgtatggtagcagctgttttaaaggccgctgatagtgagatgttaattgagtactttttaaaatatattacccaaccttctctaagctctgaagcttcaattacatttatcctaggcactaagacttgaatccaaaggggttacttcactgctcttcttgaggttgggggtcctatgttattcactattgtaacagcaacagattataatgattggtaggcaaccaaatgcttgctgatttaattaaacttgcctagttatttttaccttattgtaaattttggtctatagagctgaagagatttctccccttttctttgaattaagaaaaagccacatatgtgtggtaaactccccttcaccataatgaaactactttttcttcattctttgtaaaatattaacccagtagagtaaaaactgaattcttccatgaatggtggtatttcttctatctggcaaattaaagcaatggagaccattagggtataaccctgaactttttgtgctccctccaccctggtccgttatttctttggtataaaatcagaagaatgaaatcttagtagagttctcgtaccactacacaagacaaggtaaccatgctcttgaaatagatttaattttagatgttgagtgttcctaatgggtggcaaattatttatgctaattgtgaggaataaattacttatagatttattaataatttacacatagtaacttaaggttcaaagtttgttaacacttattttatatatgacattcacatcaactgtatgaggtaactagatttttctttttccatctcataaatgaaaaaaacaggttttttgtgaaaatgcaacttgcccaaagttgtagaattagatttttataaacagatctgagttacttaatatgtgtagaaatctttacttgacaaattttcgacattgtaaggtttgtaattttatctcagaatcctagaattctagagctgagagaaacttaagttgatacaaatggaaaataggttctttattgagtgccaggttaatatcaattgtagctgttgagacttggagttgagacatttttattgacttatttccagtttattggcagagagtgccctaattgattaaccatgcctgaagtagacatggggcaacatatagatgacaaatatgtggcagtcagactcagtaacttgatatagcattttgaaagtacctaatatagctttttacagattctgtctaacgtgagtttctattaaatttggcaaattcctcagtaagttacaggattctgtatgtatcaagaattgaatttggcaatgtggaacagaaaacccaaataatagtggcttaagtaaatttggattcatttttctgtaatgaaatgagagaattaaacattccagggttgatagggtgcctccatgatgtcattagggccctaagcaccttctcaccttcttcccagccatccttgttgtgtgctcctagttataagatggctcctgaggctccagtcatcccatttgcgttccaggcaggctggaagacagggaggagcaaaatggtgcctgtcagctgagtaagacctcttaaaagagctttgctgtaaaccacatctattgaagtttgcttttatctcattggccaagctgtatcacatgactgtctcatctactgcaaagctaggaaatgtatttttacttaagcacattggaacccagcaacaatggccttctgacagcaaaaaaagaagcagatggatgattaataatctttgctacagtacacctctttagctatccagtccttactcagttatcttcccacacaaagaacatgcttaccccttccttaatgggaacacctccaaagtcttatctagttactatatccaacttttaagtctttgatttcttggtgatgtacagtcctctcaattaggtctaggtgtggcttcttgtggtctggtgtcccacaaactgccccctccttcattgttacatagatagaaaaagaataggataactttagtaaaagttcccacccaaccaaaaaggagagagtaggaaacgtagcatttaacagatcctattgggcaggaaaagcaaagactctctgtcctgccttcttggatggcccatttggcaggccctggctctgctctaggggaatttcctttgcctgggaaagaaatttgtaagggaagccccagcatccttgaagaactctgtgatcagtgagaaattaacagcgggaactgcggccactgattgggaagcctaaatacaatgagggtaattggatcccaggatggcaaggaccagtagcacttaattgccaaaggaagggcaggtatggttactgaaatggacagcagagtcaaagcaacaattagaatgaactgactagtacagggtgatttcttttgctccaagcaggcccctggctgttctctggagattctttattgtccattcttctccatggccctatctgaaatgctctttggggagcacatttttcttggggactacacagctttcatagctaacatattactgttgagggtttggagccatgaattattttagagatttaatagctattggctgctgcagggcagttttggggtttccatgacaatatcgtttcgtcaaaaaatgtcgatatttttcttcttgtttttagtaagctccacgggggagaagccacatctagacatagtttcttagcctgaaaattcttctacttactggcctctgtgctctgcccttttctttcagcttttgagttaatagccagctgcctcgaggtaggcaacacccttaatctgatttttgctggctagttttctttcctgtcctgaagggaactcttaaaacagcttggggttgtggtttcatctcctgctaagacagccacttctctgagttactgcttataatcacctcagtttgagagtacaggagctgttgatgtttatagtcctccaaagcttcaaattatgtgactttcagtcgatttaaattgaaggctgcaggcacagaatggctggctcaagttctatttggtctctcctaggactgggctcaaaagctgcaagaggaaaccatcatacatccatatcccgaaaatgtcctacatttccataaactgtagcctcatttggcatatggtattaccaaatgttttgccactacctaacaagagtaaccagctttaagagtcactgtgaattggttagagactgatgggattagttaagactaattttccttaaagtcttttcttttccttgatataggtatattccaagtgttgatgggcagcttggggtttatttactttttagacttataaattgggagaaattaggactaagggaaatgattttttctaaggacatgaacatttataaaagacaaggaaaaagtatgacggaagaaatatgtggatgtaattgccaagaaaggagttcatcagtgatgggtaaatggtcaagaaaaaatggacagtgtgatctctgtgtgatcctgttaatatatattgtgccagccattttcctatttcagccaccaagtgatgcagtttacccagggtctgggttccagtcctcattgagaggaaccatggttaagaagaaagtgaacttacaaccaggagtttatatgttctcccacatttacccttcggatggtatctaatcattttctcctctaaatgaaatgtattacattctcttgtggctgatttctctagtacttatcttatatattcttaaacttacctttatgtaaatgtgctcaatcaattttagtaagacttaaacttcctgagctctaccttttaacagcatcctagactgagagttagtctcaaaagtcaagttctacaaaagaatcctttatgctgtttaacttaatatgttgtagtgttgtgacttctctacctttcagtgtttcttgattaggattcttcaaggtatttcttttgtttttaatcttaaaaaaattaacatgtcaaataagagaataaatagtacctggcctttattagaatcttattttccataatgttttaaatattttcatatcctatgagatatgaagggaagagttatcaaacaataaacttttgaacaccaactatcagccttttactacaccatgaggcttaataatagtaaatagtagttggtttttattgagtgcttattaaataccaggcacagtggtaaacattttatcttatatatattcattttatcctgacaacaatcccaagagataggtggtgttatcttcgctttatggatatatgtaaaccaaggctcagagagttgtaagccacttgcccagggttaccaggctattgagtggtaaagctaggagtctaaggaagttcaactccaaagtccgaactgtgtagctaccttgctataattgtagatggtccctgccatttgggaacttggtttaacagaggaagtaaacacggaaataataaattgaatgatttccctttcttagtttggccatagttgttatgatcatttcataataatcatttctataaatgtaagttggcacatatgaagcacctttggtatgatgtcagaatatcatttttgaagtagtgaactaaaatggcatatcaagtgacccaaaatgtcatgaagctttttggaaacattcactctacgaaatttattgaacaattattatggtccagggtcttctgggcccagagggtacagttgtgaataatatagaagctgtcctttctgtcatggaacttgcaagttagagagggagagacaggttaaataattctacaaacaattgtttaaaattcaatggtggtgagtgctgtgaaggaagccatggaagtgctgcaacagtataaaaagggaactgaacctacttcaagagtaagaatcaagggagtgattcaccttgagtagagctgtctttcaaactccataacatactttaatattttatcagtgagtcttgtaattcttgatcgttattctttctactagtatactgcagtcttgtgctttgtgagcaccaaggggaagagagcttaacttggtctgaggggaaatgaaaacaattcttagatacttaagctaaatcttgaagggacagtagagaggaattagaccaggggaagtatattctaggcagaggaaacagtttgtacaaagtttacacaaaggcattgggggcagatgagaacataatcctttaaagataattatggttagtatagctggatgcggtgtgtgtctagatggtattgagagatgaggctggaaagatagatagaaaatgtgaaatatttatgtaaccaaatctggtttctgtagagttggtctattaacttttccccatatttcagaggatctaagagatatgagattttcttttctcccccatattttaattgttagcattgttaaataaagtgtaaggattggcctaaatagatgtatagtgagatatcttatagttttaaaatgtatgtaatgcagtaattttaagggttgcagtcagatacccaaagcaaggcaattaattagtgaaatacatttggatctcctggctagactgaggcttgagtgttgtagaaatacatattactgcatgtgtataagattgggtctgcctgaagagaaggtttaagtgtggtgttccaggtatattccaatggtgaggcagaatattttgttaatgatcaaaggagaaataagagatcaagtgggaggaaattattaacagtgaaagcaacatgggcagtttgatgtagagcactgagaactatgtaggagacacatggcttgcatctgagctggcctctaccactgaccataggcaagtctctgggtattttggaatctgaatccaaacttcctattgaagtataacatggcatacagaagagtatataaattataagtatgtagcttgatgagcttttacaaactgaacacattcctgtaacagcacccaagtcaagaaactagaatgttaccagaagccctctttgtgctacctgtacttccatttgtttaatctttaaaataggggtaataatgtcttcttcacttttagaagtgctgagaaaatgacaacttgagaagtgccttgatctctctcagtgttgttatacaagtgaaatgagatgctaggaagtaggaccagcttccaaaattgtagaagtacatagagcttacttatagtattattagtaaacctattaaattggggatgcataaggagataactctgaaaaccacaaagcaaaggacaaaacagttgtctaaaatgaatcataaggatgcatgggcatagtatatgtgatgtcttttgttcttataaggtgtcattcttgggattcaggagagcaacttgtgtatttttacctgttcaaaaaatgtgaaactattctcattatttgaggatgctggagaaatggtagcttcctgaaataaaagtaagttctgttttaaaaatagccataagtcttgaattcaccaaatatttctgtttgggtttcaggaggtctgatgctgagtctctttttgttaatctgaatgcttacgaatacttttagaatgggaagtcctccttcatgttcttaatgccattagctaaattgatttttttcaaagtaacaaagtcatcataaatgaaattacatacattagtccccacttatccaaggttttgctttccatggtttgttacgtgtggtcaacagtagttcataaatattacagtagttcaaaaataaagtattttgagaggggggagccacatttttgtaacttattatagtatattgttgtaattattctattttattattagttgttagtctcttactgcacctaatttataaaataaactttgtcataggtatgtatgtatgtatcagaaaaatcatagtatatatgggatttggtgctatccacagtttcaggcatccactgggggtcttggcatgtatcccacgtggataagggtaggggactgctgtactcttgtagtactttttgaaaaagtttcaattttgtttagtgtaataacagattgatgcataccatttcttacacgacactagctgtagtcaccacaataatctgcatttttctatcaggcctatttgctttccaattctccatcatctccctgtacaggtatcttattagatccccttaagatctattctgtcctttacctgtatacagtgaactaagacttttaatttctataaggtaagatcattttattagcatatttttgtctttgatatataaaattatctctgctgagctcaaaagtttagtaaattttttgattgataatttaagaaagtctttaacataggcagtacagttataagggatagacaaatagagcagctttatttataataaacatttggctcttttgcaggatttccagattttaagatacactgaacccagtttatagccttttatccctcacgcccccgacctttccctcccaccagtccccaaagtccattgtatcattcttagaaacattctaagaacttcatgttacagttctgaaaactgttacatttacacttgttgtatttctgaagactttgttacatgtgagttacaggtgaatgaatttgagggaaaaactgacaaaactcagcttgaaaaggaacccacagtgatttctctacaagggtattttttgaatttgtgaataatttattggcagcttgctttgcaaaaaatacacaaaaacctatggaaataaaattttaaaaaaaaagtcaggaaagactgcaaaaaccatgaccttgcacaaaggccattgcaaccgtatacaaaaaaaagaacacttctgttgaggacatctgcccagccttggactggcatcacccttattattgatccttgaagccaaggacaatgacctaaaaacaattatgtaatcttcctcattttatctttgaaaacctttgtcttcctttacttccctaaatacacacatagtttactgtggcacacatattttcattgcaatgccctattcccaaataaataccattttctgtttttttttttttaagaatattttgtgctattatgtgattgatgttggttagtgctattagtgaagaagttggtgctttaaaattgaagcaccagagtctacttatttcgcttaaaacacgtgctaatttttaaaacatatcttcacacctcatgaaaataagaggcattgtgtttaaaatgtatttttttttgtttctttcccattaaaaatttaattgtggtaaaattatataacataaaatttgccattttcaccatttataggtgtacaatttagcggcattcattgcatttacaatgttgtgtagccatcaccactatgtctatacctttgtgctatattaccctacgtagatattatgggaagaaggaaaaattcttcccataatatctacaatggtatagaattgttaaatgatttcttaagatagttttattattttagatctggattaagaaaatcctttggtaaatgttatagttggatctgattggccagaattcaaaccagcaagtaccttattcaatagctgcttttgtaggcacaggtattccagtaccacagggtaatgagtatttcaaacaaaagagggttagagatatgtctaatgtttattgccataccctcaccctctgggctttgatctttctggtggtcttaagttactactatagatttcttccttgctcataatatctatttggcaatgggactgaaatctggtaacttctattgggaacaaaccattcctctccactgtggaaatggctgttgtctcataagtattctccctcctgctcccgactgttaatactaaatctttgggtaaataaagttactcatctgtacaaagagattggagaccagtctaattcccctatttgaaggaagccccagagagttggaactaatagttaagtgatgcatttagaattagaacacacctgttccaatctccaatcagggaagttgattgtcttgtggtggttgaagaaacagagagggacggggtcagcagaaaaacctatgaataaacctccagtgccttatggtttttcctgaagtcagaatttagagcttgacaaaatgaaagtatttatctagttctaacccactctattaaaaatgaggaaactggcgcagagtgactgtaacttaaaaatatataaccagttagttgcaaagctagaactggacacccgtatgtcttgacttttgccctagtgccaaatatatgagagtgtgactctggccctgcctctaatagtttatttgcctacaagatatttagtggaattgtcagtgccacattactgtagaattatttcaaaagaaatatttttgatattctggttttgtatccccttctaaccaattaggaacaagatatttttagtgccagttaatagtgcagtctttcagcagaaaggaatctaaatcaatatgcagtgttaaattcactttaataaatgtgaaaattgtttttaaagtaaccattgattataaagagagatgctttctatacattttggtgggtacatatacagtatttttctcatataagtgaatacttactatatactattttttaaaagcctaaagtcctacagaacataaacatataaggcaactgaaatctgtacaccttctcaatatataaaataagtgaatatttgcttctaatgaaagagataaagattagataacttcaacaggggaccttggcatatgtctgataatagatatgagacagggatagcatattgattaaaaaagtcatggactttggatctggaatttttaggacccggattctcactgaaccagttacttgatctggggctatagccaagttatttaacttctctgaaactcgatttccttatctgtaaaatggggataaatatgctaccttagagagttatgagaattaagtgagttaataccagtacctcttagaaaaatgactggcatatagtaagtactcaatagctgtaataataataataatataccaatacatactaatactaataaagtatctgttactaataattttatcattgctactgttgctcttgttggaagattatggtaaaggtgacatgtgaacagataatccttttatgcttctatggtaagtataggactttttacctgtggatgcttttgactacttggatttaaatacaaatattttaatcataattaaacaactattaatgaaattttttgttaagaaaatatttcccagtccagatggttccactaagccagctccttgatcagttttctgtaccatgcagttaaactattttttccattttcatgtttatgttcctgaaagtatattcattgggattacttttttctgtttaaatactaaaaccaggctttttaaagtatcaaattgtattaatcatggtttccactattttaagtcttcttttgtactggtattgaagtacattttttttttcttcatcattatacactaatgtactaaccaatatagcttttttaaagaagcattgttacacctccctgattatgcttcatttaaaatgcagtcccctacagtcctctccaccaatccccacccccaacctttatattgttcttaacatcactttcttcaataactctggagtgagggagcataaacagtaggttatgggtgaaagtgaaatggccccatagtgctgtttctgatgactagaagagtagcatggctgagtcttgcagtacaccaagatgttctgcatgagaggataaaggtgggaaaaggaagaaagctaaaatgatttcgcaaatgctctacagcatctgagttatgaagagaggcatttcaacaggaaaaggaggccacaatgtttagttaagtggtaaagaagactcactgaaacttaaggaaaaaccaaagagtatttccatggttattttcaaatatttgttctctcatcagttctactctgggcaaatatataatgcagaatttcactttttaaagatcacattattgaaactattctgctaagcaatgacttcttgatttacggtaggactcaccaagattttaaataaagcaataaaaacagatttgctctaatggctttagtgttatacactgtggttgatagtgtaatgttttattaagattgataaacattaagcattgtgtatttgaatcaaccactaatccaaaccagtaagcatctgttaccattcgtgattgtctgttatgtgaaaagcaacattattgcagagctaagagtatcttgagcagtaattgaaatagtagcctttgctaactggactgatcactacaactgtctttattttctgatgattataatgcattttatctactagagttgaggttttagctgagtgatcactttcaaaaagaatgattagtcttgatcaatagtgtattacctatagatgagacttttagcataatgcaatttccttagctggtgttgagatccatttcatctgttcaggaaatgaaagcaggagatatatagtactttggattgtttgtattgcagattagctaaatatttgtgggaaatcagaggtctaaaacatgcttaaaattctagtctgatatctggataaagaaaatgcagtacatatacaccatagaatactatgcagccataaaaaggaacaagatcatgtcatttgcagggtcatgggtggaagccattatcctcagcaaactaatacacgaacagaagaccaaacactgcatgttcttacatataagtgggagctaaacaatgagaacatatgcacatggaggggaacaacacacactcgggcctgtagcaggggagggagagcattaggaaaagtagctaatgcatgctggacttaatacctaggtgatgggttgataggtgcaacaaaccaccatggcacacgtttacctatgtagctaacctgcacgtcctacacatgtaccccagaacttaaaatttttaaaaaaaaatctagtctgttatatggtagtaacagactattagattggtgcaaaagcaattgtggtttttgccattaaaagtaatagcaaaaactggctgggcatggtggctcacgcctgtaatcccagcaattttggaggccaaggtgggcagattgtctgagctcaggagttcgaaaccagcctgggcaacatgctgaaaccccgtctctactaaaatacaaaaaattagctgggcgtggtggtgtgcgcctatagacccagccactcaggaggctgaggcaggaagaattgcttgaacccaggaggcggaggttgcagtgagccgagatcgtgccactgcactccagccttggcaacagagcgagactctgtctccaaaaaaaaaaaaaaaaaaaaaggaacaacaaaaactgcaattacttttgcactaacctaatacaatctcattaagcacagtaactctgcattgtgtattgtagaagcaccagaattttcttacaaatgaaatgataatggctttttgatgtgttccctagaaagaattgtggtccatcatcttttcagtagatatactttttgttatttagtgctttaggtgttatttgctaatattacagccaaaataaaataggaatgtgcagtggaactcatttcttctctgttatagctggctctttgaaagttgtttgaggaaactctaattacctacagccctgcaatgaattgcacaacagatgtactgttttaaagtcttgattcttgcatgcatttttcaccttttacttcagttttagtctttgatttggaacacttaatgttaagcagtataaatgtgtctttctaggtgacataattggattctctctctctctctcttttttttttttttttttttttttgtgaggaagaaagcaaggtcagcattagctttgcattttcttcccaggttgttgttccttgaatggagtcagagttgggtcagggtcaaaaatactgactactactgctactactacttcttcttctttagctaaaatattgtagtagaatctacatatttttgataaaaaccccttctgaaattttgcattttaggtaatattcaaatgacatcatttcagtccttttgtttgttattacttctgacaaaagcacttttctgtaagcttttcatttattttactcttcagctatgaagtatttgattatatgaggacacaggaagaaataaggagtagcccatggccccagctaatgtgttagacatcttatacaggattagtgctagattagttccatgaggtgatttgaactgtcaaggtcatcaaaaacaaggtaagtctgagaaactgtcacagccaagaggagctgaaggagaatgatgactaaatgtaatctggtatgctggatgggatcctggagcagaaaaagggcatttaggtaaaaactaaggaaatccaaataaagaatggacttgagttaatgctgatgtatcaatattggtccattaattattacaagtgtaccattctaatggaagatgttagtaataggggaactggattcagggtatatggaagtctctgtactatctttgtaatttttttgataatccaaaactattctgaaaaataaagtttattcttttaaaagaacagcatcataagaggtgatctttctgtttagatgacctcttggtagtaaggtataagataactgtttaataaaagcacaaggagcataggtaggggtatgccatgagatctagaatgtgataatcctggtagtgcagtatcaattcttggacaagggcaattctaagtcaaatagacatgctgaattcacttgaagcagaattgaagaggtaggaaacatagtcatttagcataacctgaaacctttactccaaatgcattatgtaattgagattaaaacttgttgggaacatctaagtgaggggtggacaaccttgtttctgtaaagtgccagacggtaaatattttaatctttgcaggccataccgtttttgtcacaaccactcaactctgctgtagcaaaaaagcagtcatacacaacgcgtaagcgaatgatgagtgtggctctactccaataaaactgtatttacagaaacaggtggcagtctggatttgtcctgtggtctgtagtttgctgacccctgatctaagtgatcatactgcccagctccattaggtgtactataatatctatttcaaaaaggaatgcaatctgagcaagatagaataatattgccttccctctgttttcaaggagagtagaaatggcagcaatggagggacagaagtacatggtttacttgtacatatggtcattgtgcctctggaaaccccaaggtctatgtatctgaactcagagcaatttattaaccacactctttttagatttagtctgattatggtctttttgtttatttgtttattcttaactgattttactatgacacagtatacaaaatcctttagggaaaccgtataccacttctctttgcaatgaaatttctaatcagggcttaaagtagtattttcccaagtgcatgacaggtattgtggtaggctgtgtttttaggtggtaccccaataagtcattaaataaacagtaataaacagaattatatacagtcttctttcagtctttcttattaatacatttgagaaaatttagttttaatgtagcataaacaaccaacatagactctgtttttggtttttgtttaagtgagaatagccctcaagttcacagcatttggaaaggaacaatactttcctggacttttgtagtgctattgttttagtttgttctatttctttttaaggttaccttctgtttatggcaagtgatactgtttcctgttaatgaaagtggtataataaaaaaaaattacctaagtaaagagagtcaacttaaaggagatttcctgaagaaagagattcagattatgagaagaaattggtatgagagagattctccattgctggcttgaagatggaaagggttgtggcacaaactgagtggcccctggctgatagccaacaaggaaatggaccttcagtcctacagctgccaacaacttgaatgaggttggaagtggattcttccctacaacctgtagataagagcccagcccaagtaacttcttgatttcagcattgtgagaccctacgcaaacaacctagctgagacacctggactcctgacctacagaaactgttagataataaatgtgtgttttaagccggtaaatttgtagtgatttgttgtgcaacagtaaaaaactaatacagcctataggctttgttcttactgctcttcaaacagagaccatgccctcctccaccaccaccaccagttcccctaacactgtgtctcagttcttttagtggttacccttaaaatagcaacatgtattatatacttaccaagtataatattagtcagtctcattagccttatctcagccaatgcaaggatcttaggacattttaactttattccttcctgatttacatgttaatgtctatcatatattttaattctttctgtacttgaaaactcagcaagacattattattacttacatagtcagtttacttaggttcattcacatatttatgttttattttactcttcattctttgctgtatctttgactttctatccggggtagttttccttctgcctgaagtatcctttagaaatttgtgtagtgtggatctgctatgacaaactctctgtattgtcttaagtttactttcatcattgaagattattttccctggttataaaattatttggatggcactttattttagctcatcaggtacatcatcattctgttgtcttctgatttctattgtccactgtcaaactgtcacttctttggagatactctgtccttttattacctctggttattttcaggtttttgctttgtctttatttttctgtagtgtgtctaggtataaatttcttttgtttatcctgccatgattcagtggaatcttgaatttgtagatagacacatctgatgaaaattctataaaaagatcctatgaaaaattctcagccatttcctcatagattttctctaactcattctctctttcctctcctgctgggaccccagttgacatacattaaatcttctcattattttatctaagtttcttaccctaattctgtgtttttcacctttttgtttttctccatggtgtattctggatcatttattttgacctatatttctcttcattaattttattcagctttcagttcctctgaaacccatccattgagttttaaattttggcttttttttttttttttttttttttgagacagagtcttacttcatcacccaggctggaatgcagtggcgtgatctcggctcactgcaacctctgcctcccgggttcaagcaattcctgtacctcagcctcctgagtaactgggagtacaggcgcgcgccactgcacccagctaatttttatattttcagtagaggcatggattcaccatgttggccaggctggtctcgaactcctgacttcaagttatcaacctaccttggcctcccagatcgctgggattgcaggcgtgagtcactgctcccagcctgtattttttgtttgtttcaatacctcatgtattttgtcttttatttttgctaattctaagatacggtatcttttcttgagagcatctgcctaccaggtttaggggataggacagctcatggccaggactgctttaatccaactttaagatttaaaattccatggaccaccagataaaagagagccaggctccaagtccatgcgaggccaggtttgttttgggttcacctccaccctaggcgtagcctttcagaacaaaacagaataaggtggaggttggtttatcaaatggactgtaggtattcactcactcattcattcctatgaggccctatgagtcctatggggcagttgcttcccaggggtggagaattaccctccaggcaaaagtagttttatgtgattgaactcactactgtgagttccctttttctcctagatcatcaactggcaaaatttaagtaccttataagatatttgatactttcaaaaaatgatggagaggggaaggttttattttgtttttcagtaggaaggctagtgtaggttatctatttcatgatcattggaagcagaactttctctggcttcttccttgtttctttgttttggtagtgaaagggtacccttttggtatggcagacatgatactttttaggggagaagtaatgaagaagtacttgtacaatagcagatgagccccagaagaagtctcctgttgttcgtatgcgccagacacaaccctttatgccttgttatttcctgtactgctgagaaccctctaaagtagctattatctccatttcacagtataaataaagtagccccagagagattgaataactggcctctcattatagttagtaatgagtaatgggcacatccaggatgcagccccaggtcttttgagctatcaagcccttgctctgtttatgttgtggtggctttgattcaaagaggaaaaagttaaagtctatcaggggctaaagtgcattctctcaaggggactttcccataattatggggtgtttgcagctggagtgtctgtacgtccaggttgcctgggcttgccaaaaggaagttgtaagttcattgtaaaatattaatgtgcagggattcttggttaatagaataaattattttttctttaaaaagttcaatggtctctcagtggagctgcctaaaaaaattcatgttaaaacatcttgttcttttacatgatctcaagccatctgtttgcatctatgatagatattcttcatgcttcattccctatttcttccctactggttgatataaagtaaaggattccattaaaggacagggcatagtaattgcatatgtcttgatttttaatgaattgataaacagtcattggccaaaatgtttctaattttatgatctcatcctgtgtctatttactggtttaaatttgtgctcaaaattgtcagtcttcagtccagcattaattaggaaccatgaagttttctttgtcatctgagtcttaattgagtttatatacctctaacttcacaaaaaggtgatcatgtggataatataagtagtttatttccatttaatgatattttctggtggtaagctattatagtgattgagtgtcatatttcatcttgccagatcatacaaactgaaatttttaagcaaactattaaaacatccaaaccaacaaaaagcttgaatgaattctgagctaatcattgtcacagctgattttgtaaacctttaggttgaaaagctttctgaattttaggagctatgtttggttcagttctctgctattacaaaatactattttgtaaaatgcctcaagtttataaggcctattttaaatcattaaagtatttaagaacagatgttattacatggtaaaagttaaaaagtctgctttctgagtcttagttatggtatcactggaaggattttgaattagcaatcaatgtctctagtaaaacaattatttttgaagatgtgtttaaaaaatagttaacatgttatatgattttacagcttttgtttacctttcagtaattggcattgacaaattaacatttttatttgtattagataagtgaaaatctcccccaaggtatcagagagctatagcttcaaattaacttaaatgtaactatgctaatgtaagtgtctggaagatggcacccatgtttgtgcatcctaaaatggatttatctatttgtccatccagtagcatttactgggtcttcattagcacagtgtcaggcacagttctatatgttagagactcaggatggataagagaaaattcctgccttcagagaactagtttagtcaactggtaggtcctttattaagagctgaccttcagttatgcataaccgtgtttgtgtagaatactgtaacccctaactttcctatttgtgtaatatggaaggccaagtgatgaaattgttattaaaaacaccaattcccaaacagtgtgccatgattttaatatgctaaatagactgtggcaatgttagatttcctttttgactcaggaagactgtgagggtgagtgagtgagtgagtgaggatgtatatgtgtgtgcatgaggagacaacagagcagaacccctagtctagtatgctttggttagttggtattcatcaaaccccaaaagattgagaaacatcgttgtttgagaccctaaaattctaaggtagagtgaggaatcatggaagactacattatggacctgatgagtttaatgcctgccatttttaactgagtatgttgatcataaaagaactgtagcttgtactctcattttaaatagactggactccttctgtaatagggattgtcaacaacaacaataaaaagaatggactcctaatgctagccagaataaaataggttgaaaatgcacagatttccatttccagaacaaaaaggcgtagacttacttttcactgccccttccttcctctataaatataactaaatgtcctggaaattattcaactgacagcaataaagggattctgaaagttgggaagaaagcagagtagcttggaacctcaggactagaagtttgaggacaatgagtataagttcactgggttttcttttaatctcccattttctcctagactgggtgctggagagacctacaacccagaatcaccagtgggcaaagaaagcagaacaaaaagcctgctttctctggctagaagaccaggaaagggaaagcccaacaaagacctaagtgggagtgctcatccccactgtttcacagtgggtcccggtgggcactctgatctgtccccattatggccccagttgctgcgggagcagcaaagcccctggccctcccacccactgctctacaactggggccatgacgggtggtttgttctgccaactacggtgaagaccagaccatttcagcccctgtggtctgctctgtagacagcagcagcaacagcaaagcccaggctatactgcctctgctcccaactggccccagcaggtggtctcttctgtagggagcagtaagcagctgcagccgcagcgaagccatgtgtcttcctgccctccacctcatggcttaaggagacccaggccccagtaggtgaccccctccccctcaaggtttcccagcaatagcaagtggccctgggaagtaccttttatccctgcagatggcatcagcagggattgagtgggagtcccaacatcaccagaagaatgaagcacaccaaaatagcattgtgagggctcagaaaactaaactgtcattggaactgaagcccacaaaagtagtctagaacctacacactaaacctaagcagggtgaccaccctgctaaaatagaagatcctgtcatcaagtcttctaacaataagcaaaacatccagggtacaattgaaaaccacttgtcatagcaagcaccacaaaatatctaggatacaatatgaatgaaaaaagacatcaactgatgccaatacccagttgaatcagatatgggaatttgataaggtttttaattcagctgtcatgcaatttatccaacagtcagttgcaaattttcttgaaacaaatgaaaagatagaagatctcaggaaagtagagccaagagcatttcctaatgaactggaatgtcagagaaaaaaaaagggtcaagaatggtgccataatttttggctaagctatcagaaggaaatacggagttgccttcaactgagatagcaagaggagagattagaaagctcagttcactcagatgttttgggggatctgattgccctttctcttgtcttccatgctctcttgtgtgccttattgattagcaggagtcattacggagactgagaggttggtccatccatgggaaactcgttaaaagtgagcattactaacttgcatactcacatgcagggagtttggtttcttacctaacttgaaaaattccccaagtgtttagatgtttgattttactatgtcgcctaaacagttacatccactatactcttattttcaaattttttcccctaaagcaattattttccagatcatctactttatgtctttagacctagaaactgattactacaattatgattcaaaacctattttctgctgccctgcactgagctgagtaattgggtgtaaatggttatttcgtttgcatgctttgcctttgtgttaagtgttttttggttaaaagaccagaggttgcattattgcctgctgaatatgcttatattaacaattgtaaaaaagtaaattacttttgggagtattaatgaataggcacttaaattgcatagttaaatcttttccatcctttactaagcaaacaattggattaccccccataagaatttaattgacaatttccatgccacatttgggtagggaatatttcttacagacaaaagttgtttgaaatcagaaggttcttagccatttcaatttcataatttgtatttgtgttgttattataaatactaaaatttagattatcatgtccaaagtccactgataataaatgctacatgggcaacggggtggagtgtgacagaagagagaggtttcttaaccacaagactggactgctaatgtgtaatatgagtacgggggcaggaggtaggtattttatatggtgtttcccaaacttacttgaatgcgaaactttcattctttaaggactccacaagatgccaatttgggaaaccctgacttagagtgttaggtaattacatttttgtttctgttttacagtataattttgtataatcctgatgcaactgaaatgaatagagagaggcgtattggtgactgagatatctttcactagcttatttaaattagataatttaattttatttaatttagaagtaggtttacctggttatggagatctttaaaacatggttttaaatgagaagagattaacggtattccacagaagtatcactgaaataaaaatctcttaaggaggataacaacttcagagtgcagatattaacctccgccccctagctgcagagttgtgattaatggcttgcaacaatactattataggataatgtagcatttggaaaacaacctatgttagtggcatattaacagaacacaccccttagaaatatgatttacaatgtaatttcagacttccagacttccataattattagtttccatttacaaagagtggattatgcacagagaatttgacaattgtgataatgctaggtactagttaaaagtaattaggtttatgaacactagtagagaaggaggagtgaagaggaggagaaaaaggtcaatagtgaatttcaaaaaagttgtttctctactaaatattttcattgggccaatttctgatgtataggcccacatttagaaaataacaaaatgtgaatatatagctcttaacataaaaatgaaagttatggttttcttgcaccagccttaagaggagtgttcctgtttagggcagaccctgctaggccttcctgtttgttatctccacaagatattgtaccttaagagcttgcctttagcactttttctttttcctttctgggcttcttacagtctttctatggggatgtttccagcagccccttggggaggggtttggggatatattcatgttttctggggctctgtcctctgtatcctgaagtgctgtcattagcagcaatggcttcaattacctctcattcactcatgctacctagggagtatagaggttaagaatttagatttcaaagttccatatgtttaggctccagtcctagctctaacatccactaactgtttgaccacagacaacctcttagcctcagtttcctaatctataaaatgaggctgatattatattagctatgatgacaaataaattatgataaataacaagaatctatgtaaacttcttagcagcatgcttgctgctgacatgttatattataaatgacagttgttgatgtcttcattatcatgacccgttccttgaactttatactcctatctatatgccctctataaatctctgcctggatattccatggaaaccaatattttccaaacatagccatgtgcttcgtttctttctcagccttctatcagttctttctcttgtaattcctttctcatttggtggtatcattcacccagtaactgttgccagaaatttgtaagttttcttacaactcaaccccaaccaccatctagctaatcattcactgtgttatcttgtgaatttattttcttaagtatctctctgtcgcctttactttatcacctcttgcttgggctaatgcaataacttcctgagtggctcccacccactccacaacgtctctcactctctgtcatagtgatctttggtccccttttccttttccagccacttctcaccctccagtttttcatgctagcagtaccaaatagcttgaagtgcccagcacacacttttttttttttttttttttttttctgagacagagccttgctctgttgcccaggctggagtgcagtggcatgatctctgctcactgcaacctccgccttctgggttcaagcagttcccctgccttagcctcccaagtagccgggattacaggcatgcaccaccatgcctggctaatttttgtatttttagtagagacagggtttcaccatgttggccaggctggtctcgaactcctggcctcaagtaatctgcccgccttggcctctcaaagtgctggagttacaggcatgagccactgcaccctgccagggcccaaaacaccatgccctgtgttttgacttggctgtaggccattgcacaggctattacttacctctggaatcctctcctttccctgcttagcccaacaaactcctattcattgtttcaagccctccaggatgtccgtgtgtcatagaggccttctctcagtaccatgctatccacagatttttaaaactcatagtgttatactatttctatactttataactttacactaacattatatataacgtatgtatacatacataatgtatatatgtatgtgtataatgtatatatacatatgtatacatacatatatagtatatatagtatatatacatataatgtatatatactatatattatatattatactatatatactgtatgtatattatactatatattatatgtatatattgtatgtatatatacatatatacaatatatacattatatatacatatatacatgtaatatatatacattatatatgtgtatatatacatgtaatatatatacattatatatgtgtatatatacacgcacacacatatgtcaacagcagcctactagattggaagttccctgaggacaagaattgctttattaatctttttcttgtttattctttatattctttgtcttattttcattggggaaatgaggtaaataagataaaatgtgcaaatgtcaatagaatttttaaaatcttagtgctttaatatttatttttgatttagctaagattgcctaaagtgtgtaaccaagtcagaattctcacttttgtaaggtttatcttcatatgttttcttgcttgtttctttccatgcatgtctaatctccttcttcacatttcttatgttataaaaatcttttttcttctctattaatagttcttgatatatcctccatcaagtgtgagctaacaaagacctagaatcgatgtccctctacattggctctaaccccagcccttctcacacacgcatgcacacgcacacacgcacacaaacacacacacacaccaatcaaattttccagaacctttgctttgagcagaaattgccttatgtgactggcagtcctctcataaaagtagtaaatgatgagtgtattatagttagactcagaccagaagatggtgtgctacatgaaatctaaagtgaagtctactaaacttcactgaagtatcaaggtgtgacagaggtactaattatgtcaatataagtactgagttagtaaatgctagtcttaactctgaattgttcagctttgacaggtgagctagatttgttccattagcttattggagattcattgctagctgtttcaaataaacctcccccttctattttcaaggaatgatctgaatcatactcctttgtcaagtctttaattgttaacatttaggcaacagttcctgagacttttattttaataattttccactccgtgtgtgttttttgcggtagcaatgagtaggaaaacttttttttctttggtttaatcactgtacctaaagcaactcagcttggtgaatgtatgtaagcatatgtgttggagctggggatgggtaccagaagtgttaaaaagtgtcaggacagcatctctgttcccttactgctatcacattgattaccgcgataatcattgtcacagctgattttgtaaacctttaggttgaaaagctttcacaaagctatcacaaagcacaggaagacaaggaaaggatttattgatgaaattatatgcataagctcttctttagtggcaatgactacactaaatagtgttgaaatagggaacagaccatcgttatctttaatcggtagagtttttatataaatttatatatgtctataattttcaagattttattcttactgctaatgttgtcatttatagttattttattttagctttgtttcctttttgcctacccaccatctatgtccctcaattcttaacgtcagaactgtataaaaagtagtaggaagacacagatttagaaaatgggtagagaaatatctagaagcaccatgatttctcaaaattttatgtacttacataaaattgcgttacttaataaatgtatcaatggcttattcatttctagtttgtcatttttcttatatcattcaccagatattttttgagggcctaatgtgtactgggtactcattaagtttatattttaatatgaatacacacacataaatataacattacatattataagtatatatgaaataatataaatacatgtatgtgtgtatatatgtgaatacacacagtttattctcattattcatggtagttgtgttctataaagttaccatgaatgctgaatgaaccaatactgaaccattgctcctaggggaagtacaaggttgggttccttcaaacctctggtcacaacattttcatcaaccgatcaatacataaccttgttttatgtgtgcttctgtttaaagatactgcatgtaatatatactgttgattcattaacattgaactcacagccaacattgttataactcatgcctgaaggaagcttccctaactcacgtattttccccataaggcacatcacagccttcttgtgcttaggaacactagacagtcccttcagcactatgcttggtgaccatattaaacagcaaaatcaccaagaaaaagcgcaaaatgcaaaaaaatgctctaaatagactttgaaaagatgacttgttgatggcatgagagctgaaacaagaaggcagagcatcatcttgtttgccctcagctggcatcatgcacattgggtgattcaaatttttcaccattacatgcgtgcctgtaaacgactgaaagtgccatgactgttgatttgggggttataagtgaattttaccaagtaggcgaatttacagacatgcactctgcaatgtaatgaggatcagctgtatatcaactttgtgtgtgtgtgttgtgtatatatgtgtgtaaaaatttgttcttggccttcactttccccatctttgtcttttcttttttaaatcattcacggttttcctacgtatcttgtggtacattgcacaattcattataaatgtaatggggcttctaggcctgttgttatggacagaaatttcattgcgtttattaaaggtttcctgagacatgatgtgtttttgtttatagacctctcatagggtgaaaatttaacatgtaactccaaagtttatatgtagcaactcaaagtattattttaaatttattacaattagatataaaattacaactgacaattcatattgactttattatgtttgagatgcagtgtttttttgaagtgccttcaaaagccctttgtgctcctccccaatcacaaccccctccccctcaaaccactatcctgccttttatattaatctttttaaattctctttatagctttaccccctatgtttgtatctctaaggagtatattgtttaatcttttagaactgagtagcaaacacaaacttagctgggtaaagaaaggacaatattactactattgtatgaagacttaggagaagagaagctgaacaagctcttgttcatagtctggcttcagatgttctgagagtggttaggagcccattctgggaagtcggttggcaaggtcatgcacaaataaatcccgagacaaggggctcttcacaggcaggacatttccgctgtagtgcaggatagggggaggtactgagcacccagcaggaatttggtggggggcactggctgccctgcatttcctgctcttcagctccctgatgcctgcctcccattctcaggaataggtcaaagcaggcactgctgtagggtgaaattaagagtcctctgctagtctaggcagcagagaaggacagaaatctcctcagccaattgtcaggaaaagaaaaacagaagaatctggatgcagctcacctacctattctgttttcaggttaaaaaggtggcccgtggcagtggaaaactgatggctctcagtctggattggttgtcctctgtgcctgaggcacagctgtcagcctgagatttcccttccttgcattcctggggattcccttcatctctcttctgtgttggatctcctatttgctgtctccaggcatgctttttattggtctattcttgttttagcaaacacgtcctacaataatttcttcagaaagtgtgcatggcaagtaatttattgaccttttttgtctgaaaatgtccttatggttaatgatggtctggctggatgttgaattcaagattagaaatcattttccttcatgattatgatggtgttgctctattgtcttctagcgttggcattgagagatccaaagctattctgggtgaattgtgtcatccttcctcgctgcacatctttacccccacttctggaaacctgacaatctccttgtccacagtgattttaaatttcacagcagtgtgtgtatggacatgggtcatttattttgctgagtacttggtgggtccttttaatttgagctccttatgatttaaattctgggaagttttcttggattattcccttaatttcttccccttcattttctttgttatttatgctctgcttttcccaaattatcggccaacgcttctattgataaatttctctgtgtgtttttcaagggctcttttgttttctgaaagttctggtttttgtttcacaattgtgatatctttctgaggatattaatggtaatttgaagtcttattgtgtagtgtgtttcctctaagttgctctttttgtttgtttttggttctatcttccaaattagagactcttcagatgtcttaggagccttggttgttgtatacttatgattagaaatagagcaatgattctcaactgggggcaatttgaaccttccgtaccccaggaggatatttggcaatatctggaggactttttggtggttaaagctgcagggggtgctatgctactagtatctagtaagtagaggctagggatgttgctgaacatcctacaatgcataggacatccctgcacaacaaaaaattatctagctcaaaatgttaatagtgctgatattggaaaccctataatagagggcctcaaagctgattaagagagctccgaaggtgcaggtggaacgtgttgactttgggttttgctggaggatgatctagttgagtagtttggagaacctcttcattatctttaggtcttttcttctgagctagtcagatattcaatagaaaagtctttcatctcctgccttaagggtaaagatctggcttccaatattccccctgttagtcaaaaagggactcgggctgtctgcgttcagtgtatatgtgaccacataatacccttgcttttcatataatacccacttcctcaacagccttgtgtttccagttgtgagaccctacagtttggttttttttttttttttttgagacggagtcttgctctgtcacccaggctggagtgcagtggtgcgatcttggctcactgcaagttccgcctcccgggttcataccattctcctgcctcagcctcctgagtagctgggactacaggcgcccgccaccaagcccagctactttttttcagagaccctatgttttatttactctttccagataattaacctgttgggatgagggagcggcagttatccatggtatggagtacaggagaccacctagggctctaactgcttctctaacacatttcattcaaaccttgttactttaactctaccctctcttcacttccagttccagagttatctggaacccattcatgagtttcttggggattctacagtatagatgggtttggttctgaactttccttattatctctttgcagttcagcttttccaggtctgccaagtcaattaccactctccatctgctttcttggattccaaatttaattattactattatctcctctcttgtactcccaatcctttttaaaaacccctttggtatcattgtagtggagtttggatagggaaataaattagatacattgtgctcaatctatcccatgatcctggaaaccaacatgctgtattctagcataatttcatttaattctagtcttattttggtatatttacctttgttatcagaattatttcctagacttaggttttcttcacataaatgaaaactagaggatattagtctgtgtctgcatagggacataattgaattcttttcaaaaccttaggggatattgtagtgatatattcacttctaacatattctggtttaatttacctttttgcttaaaaacatagactgctgtaagcagccatctgcctcaagtagaaccttgttttaccatcccaatcaatattcagaatttgtaaagagttgaataaagaatatatatttcattaaatctgaaatgctgtcaattatctttttccatttttaatacggtcataattagtggaaatatgagaaagatagttgtttatgatgacggcttataactatctctaccagtattttcccccacataaatattcaagaattgactgtaccttagatttaaaattttaagggtgatttcaaacatcaataaaatgtacaggccagactgaaacctatacctcctgaatttttgctgttccctaaactgtcatccaagcataagtaataagtgtaatatagtaggtgtgttacactactttatcactcctccctttttaagatgggaaaccaagccaaattttaaattttttatcagtttctgctgagtttccagttaatgggttaaatcgcaaaaacctcaaaacgtattttagtatctttttagggtgttaaatttggtttaccattgttaaccccctggatgtcattgacggacagacccttaaaatgctttacttgtaacctgtcttcaggtcttcagtagttcatagatataattattttctttgcctcgtactataaaattaaagaattggggatttgatttgatttttattcacagatttttaaaagtttgtgttttgttgtctaagtattctcttttctccctagctctattaattttattgttactaaaagaaaaggggggagaagatatgctttcttcctcacctttgttcaagcaggaaaaagtaaagaattgactcgattgaccatgaacaatcaaccccacatacagatgttgggaagtttccaaaaagatacagtgaattgaagcagactattcaaatgtatcataaatagagtcccaagggtttatgtgtggacaaaaaccaattacatgaagcatttcctgaaattgcttgctattgtcaggataagtaatcagaagtaagacatccaggttgagaatgaaaacgtttgtccctcagtttgtaatattgtcttctcacagaggaaaatctttgaacagttttgagggattatcaaaaggatcctctttctgtagagttttgaaagatatattattaccatttcttttcctcccaggttagcttttttaggttgcttgaaaagagagatttgaagctgtggtatagttgatgtcctcatgatgtcatcttggataaatgtttaagtctaagattaaatttagtagttcgtcctgtagttgaaagaagaaaaactttaaggccagcagtatcacaagtgtagtactgtaaatgaagaacttttctctatctgctaattgagcacatgcatctaggtgtactgtttgtacctgtaataagcgaatgaaggtggtttttttgtttgtttgccttctccccaggagggggaaaatacacgcatgtatacatgtacacatgtatttaatgaccaccatattaaccttcaaataaaccaatcacattgctattgcattctgtattttatagtcaattcacacacacacaaatctatatttggattatcttaactgagttcagatatttcttttataactggtaaccacagggaaccgtgtgtgtgtgtgtgtgtgtgtgtgtgtgtgtgtgtgtgtgtgtgtgtgcgcgcgcccgcgcgcgcgcgcatgttccctggaccagggtatgggcatctttaaatcatctcagctgattcaactgtgaggtctgggtcagcaaatagctagaccagtggctgtgctcatagaaattacttcctttcctctagtaatttcaaacaattctaatttgaagtttgaggaaaattaaggatttctctgtgatttcaggtgaaactggagagggttggagaccaaaccacgcaggcctttctctttgtaaagtgtttgttcaagtcttttgcccagattttattggagtgtgttttttttcttattgtatttacaagttacttatatattttggttcttgacttggactgtatattgcaaatactttctctctctctggtgttttaaacagggatatcatatcagattttcattttttaaatatcattacaagaatgaatgggagaaacaagtttttcagtggttctagtagaagatggtaggatgtgggacatggagagaagaggacaggttcaagagatatttgagataaactcagtaggatttgttagtgatgattaggtaaatggtgggtaagatgagagggaagtgtcaagaatggcttgggtttctggttcataagaataccaccattactatggacttcacttattttgtttaagatgttgataatctatatagaattgtacagtcattatttgccttgagcataagactactatttagaatttttaaaaaattactgcaaattgcaaatttattggtcatttttatggttttggtaatcttttaaaattatctcatgaattatagaaaaatatgttggaagttatattacttaaattttattttgaaaactgtgttcaatttggagtctaaagtagaatggcaaacattatctatattatatagataatgaaacagtaagacattaatgggaaataggaacttaagagaatcaatgaattaaaattgactttttgttttataggggtcccttcagtgttgtacgacgatgtatcaacagagaaactgggcaacaatttgctgtaaaaattgttgatgtagccaagttcacatcaagtccagggttaagtacagaaggtaagagatggatttcaagtaagttatttgatgtctggctttattccatctccaaaatccatttaccaacctaaccttcatctgggggtggggaagcagagggtatgatgtagagggaagtgggtggagacagtttaaactctattctagtttgtcagaattctaggacatagtatttgaaagacagggtaatttacagagttataaaatcatctaggatttctatgggcctatgttttttgactaggaagaaagcaaaaatctgggctttttttttagggtctaattttgaattatattgtgtgggtcatgggatgggaaaggaaggaggtgaaataatggcaagaatgataattgaagattcagaagaaacttagttacctcaaaatgcatcacttactacctttaggattatgatttagtggaatcaaaagattcatatctcacatttggcttaagtcacatatgatatatgtgtaaaaatttgaaaggtcagtactgttaggactttcaggacttaaaattttgtttcaatacattattatagataatcatatttatatgtatatttataaacagtacgtaaacattttaaagttttattttgtttgttttttaagccatagtttcatgtaactgtgacatacatgctcatacttcagatggcacaattgatcatgatactaacttttctaattagcccattactaacttttcacttttccacagttcagtaaaatatgaatccttctttagtccttccctttttaatcccaagagcaatacagttgataatttagattggaaaatctagggcagtgtagcctatttatattttatccagttattttactttgggaagtagaagcccacatattgtgagcttcaagtttgtctgttcctggagatctttttttcttttaaatacttttgtgaccctttgaattattattattcatataatgattatggaagattcttagaagttgctactcacaaagaataactgatttgtttttagtgctttaatatttaaaatattatggtaagatttagagattttatattttatggttttatgctctagaattggctattattgcttttgaatataaattattttataaatctagcaacatttaaaattgacttttaagtggggtttagaacaaaattatatttccttacacctttaactgcctttaagcttaatattctatatttgatttttctctacctctgttgtctgaccaaatactgaggtaattttgtataaacctaattcattaaacatatgttctgatcctgtttataaacttagtaagattccaattttaaatcacaagtctaagtcagttactcagttaccaatattaaattggaataatataagccaaattctcttaagcattgttataaataattaaaataaatattaatagcttctttttcaacccaaaattatcaataccagagttttgacttatctcattgttgtaccaaattctaaatctccccaggctaaagacattctttcgggaaacaattacttaccttctcattggctgaggttgtttattgacagatttcttcagccagatctcttgagctacagactcagaatgccaagctgaacctgtctcttgtcacttggtcagggagtcaaattccaaatttacaaaaggggaaagtacttagtatatagttcatatacctggtattaagtcctgtcttcatttaatataatatatgggagtctgttgctgaagttatagctcactccttcattactttgccattgctttggctatataaatgtcttcaagtcctattctgaagacaaagccacccattctattgatccctcatactcttaagcctccttgaacttaatagaatcatgtactcttttcatatccttcctatatggtaggaccacagcgtatagatattaaatgacatccagttggatttgggatattactcatgactttatctgattttggtcggagtttagtggtattcaagtgaaaatatgcaattggccctttatgtttatggcaccagaattaagtttttccatcttctttagcacagcgactcagtataaagttaggaaacaatcaaaattccatctccaccacctctacctttttttcttgcgatgggattcccatgccctctgttgctcatgttcacacaagctttcttgattctgacttggacacattttattataagatgtataatatatgtaataaatagtaaattatttcattatataaagtctctgtgaacagtgcttcccctccctcaacttctttcaacccttttccagtcactatgggcaacacatcttaactcctctgctcttctggtccatttacaaattgttagggtccaaaaatgacctcattcatggcttagcatagaaggagatgctacataagaagacacatattttgaagtaaaatttaacacagtaaaaaggaatccataagttcaaataatatctagaaatatctatatttaccgttacattctttcccaaataaacttatctcttaagcaacagataatttaaaatctattttattctttattctttcctttttgtttcattttattattttatttttggcttagtggtttgtttgctctttgttaattacctcaatattttttcttgttttcctagtgtacttgtattcaaatacattattgagtgaaataggtctttaaagggttatctaagaacctaccatatgctatttatttggataggtcattataatacaaatgataaataaaaagagcccctagccttatgggacctatgttttaatagtctccaaccattgtttataacatggtttttattaggaaaacaatgtgtaataaattcgaagtaaatcatttacaaattaattttttttgagatggggtctctctcttgcccaggccagagtgcagtggtgcaatcatggctcattgcagcctcgacctccttgggctcaggttatcctcccacctcagccgcctgaatagctgggactacaggcatgcgccaccacacacagctaattttttgtattttttgtagagatgaggttttgccatattgttcaggctgatctcaaactcctgagctcaagtgatctacccacctcggcctcccaaagtgttgggattacaggcatgagcctccactcccagcccacaaatttacttttgaaatgaaatgtgttgatttgttgcagaccacctgtacgttttaatattttaaattctcattgctctaatgaagatgagatattataattggtgaggctaaagatgagacatttcataacagatgagatatttttgaatatctgttctctacttttgccatcaaaatcataatttttattttatagggcttcttaacttgcaggttgccgactattcaataatcccttgaaatagtaagcagaattatgtttatttttttagagagtccatagctcttattagattcctaaaaaggcatattattcctaaatgatttagaatttctcctttcacatgtatgaaaaaatgaaattcatgcttatgaacatgagatgaataagaagtttctactaaatcaaaactggatgaatttatattaggatatgacttctgattgggggattttttatacttacatatacagcttccattaatgaatttcctagattattatcttgaacttttaattaatatactttttgtctcttactctactgagccactaatttagagtttttgtcttaaaaatagatatcaaaattaattcagacaaattataataaggaaactaaaggaaagtaagatgtatagaattggaaactaaattatcaaagttctgagttcttgataggactcaattctttatggtttattataaaagtccaaaattaactgtttttatttgggagtattataaattgtgttctagaaagagtatattttgggctccagtttgcttagtcttcaagaatgtctcattctaaagtcccagatagtaggtgatatcagtgaaattgaagaagtaaggaccttgacagttctcacttttcatttaaaaaaaagagaaaactgacagaaatgtcagaatcaactttttcagggctctggaaattgaccaaaggcttacagctatccaggaataatttattcaagaaaactgactgattcttagtaacaacagtgaacttcatagcattgtataataatttgtcccattcacatccccctttcttccagttctgtagtaaccttgaaaacaaacagttcacaatcacgatgaaaaccagcaacttgacagccatcaaaggaggctgaatggggatggagctcctctaaggccgcattcccataatattgtcatttttttacttgtctggtagttccctggaagacttgtcttagtacatttgtgtttctataaaggaatacctgagagtgggtaatttatgaagaaaagaggtttatttggctcatggttctacaggctgtacaagaagcatgacaccagcatctgcttctggtgagggcttcaggaaacttccagtcctggtggaaggggaaggggaaccagtgtgtacagagatcacctggcaagagaggaagcaagagagagatgggaggtactaggttgtttttaacaaccagttctcatgataactaacagagtgagaactcacttgttactgccaggatggcaccaaggcattcatgagggatccacccccctgactcagacagctccattgggcccctaccttcaacattggggatcaatcttcaacatgaggtttcaggggacaaacatcccaactatagcaacccctcttgcaataccatctttaattggcctgactcagagatcacccagtgcaaaaaaagtttcctctgggggcatttgccaaaaacctttagaggtagttgtttaatttcattgctgcctgaggcatagataacagctgggcaaacaaaaagctaacctaaaagcttaaaacaaaaagctagctaatgagatgcccatagaggctttgaaaaagctacaacgtattctctagaaaatactatgttaagaaggccatgcacatatataaggctatgaacaagctcaggaaaaatctaagaaggccttaatttctcacctctagctgactttcaggctacataaacaggaattgaatgataaggtagaaatgtgaactccctgactgagtgttgaaggtatgccctacacatccacaaaacccttgagcaaagactaaactaaataagcagagacttaagtggccacacataaaaaagaatacagactgcagaatgtgttcccccaaaaaatcactaagcaaagagcaggagtaacaataaacagcaacaataaatcctgcagaaaaggagattctgatttttagagttgacacataatattatttaagacactcagttttcaacaaaaaattatgaggcatgcaaagaaacaagaaaatatagctcacactttggggggaaaagcaatccatagaaactgttcctgagcaaacccagatgttggacttactagaaaaagagttaccaaatggaaagtatcaataatgagatagaaactataaaaaacaaaaagagaaaatcaaatcaaaattctggaattgaaaaatacagtaactaaagaggctcagcagcagatatgagcaggcagaataaagaatcggaaccagaagacatgaagataggttcattataattatctggtcttcagaactgaaagataaaagaatgagcaaaatgagcagagcctcagagacctctggggataccatcaagcataccaacatatgcataatgagaatttcaaaaggaatggagagaaaggagtagaaagaatatttgaagaaataatagtccaaaacttcttaaatttgatgaaaacataaatctacacaaccaataagttcagcaaactccaagtaggataaatgcaaaaacaaaccataatcaagttgtcaaaagctacagacaaggggagtatcttgaaaatagcaagggagaactgaatcatcacatacaagggatctataaaaatattaacagcagatttctttcaaaaaccaaggatactgaaaggcaacaggataacattcaaagtgctgaaagaaaaataatatctaccaagaattctttatccagcaaaaccatacttcaaacatgtaggataaatgaagatattgtcagataaagaaaaacggatagaatttgtcactagcttccttgtcctacaaggaatactaaacgtagttatttatgctaaaaggaaaacttatttttttaatttttaatgtttatgggtacatagtaggtatatatatttataggtcacatgaaatattttgatacaggcatgcaatcacatcaggataaatgaggtattcatcacttcaaacatttaacctttgtgttacaaacaatccagttatattctttcagttattttaaaatgtacaattaaattattaaattatttttgactgtagtcatcctgttgtgctagcaaatactaggtcttattcattctttctattttttgtacccattaaccatccctactttccccaacccctactagccccccgcccccccaactaccctttccagcctctggtaaccactcttctacctgtatcctcctgacttcaattattttaatatttagctcctacaaataagttaaaacatgcaatgtttgtcttcttgtgcctggctcatctcatttaacataatgacctccagtcctatccatgttgttgcaaatgacaggatctcattcttccttatgactgaatagtaccccattgtgtatatgtaccacattttctttatctattcatctgttgatggacacttaggttgattccaagtcttggctattgtgaatagtgctgcagtaaacatgggagtgcagatacctcttcaatattctgatttcctttcttttgggtatatacctaggagtgggattgctggattgtatgatggctctatttttagttttttgaggaacctccaaactgttctccatagtagttgtactaatttacattctcaccaacagcgtacgagggttaccttttctctacatccttgccagcatttgtcactgcctaacttttagataaaagccattctaagcatagtaaaaggaagtgtagtaaaaggaatgacaagaaatcaaagtagaacaccataaaatatctatttaacacaaaaggaggcagtattggaggaatacaggaaaaaaaagacagatagaaaaccagtagtaaaattagaaacataaattgtaccttgtcagtaataatattaaatataaatgaattaaacactccaattacaaggcagagattggcaacatggatgaaaaacaggtgagatggtatctcatgtcgttttttgctgtctggaagagacatacttcagatttaaaaaatacatataagttgaaagtaaatgagtagaaaatgatatactatgcaaatagtaaccaaaagagctctgaagtggctattactaatatcagatgaaatagactttaataattaaatcagaaatttaatagtcaaacaaattgttactaaagaaggacattttataacaatagcagcattaatccatcaagaagatttagcaattataaacacatatgcacctaagaacaaagctccaaaatacatgaaacagaaaaaggcagaattggagggagaaatagagaattcagcaataataattggagacttcaatacctgacttaataatggattcaacaactaaacagaagatcattaaagaaagagaaggtagatttgggcaacactagaaaccaactagacctaacagacatctgtagaacactccactcaacaacaggagactatacattcttttcaagtacacatagaacattatctaggatagactgtgcattagcccatcaaatatgtctccatcaattttaaaatatctgaaatcatacaaagtatcttctctggccacaatggaatggaatcagaaatcaataacggaagcaaatttgggaaattcacaaagatgtggaaattaacatagtagccagtgggtcaaagaagaaattacaagaatactttaaaaatactctgagatgaatgaaaacaaaaatataacttaccaatatttatgagatgcagcaaaagcagtgattagggggaagtttattattgtaaatgcctatattgaaaagtaagaaagagctcaaatcaataatttaacctttcactttaagaaactggaaaagaaaactaaacttgacaggcagaaataaggaagtaataaggattataggagacatagagactagaaaaacaatggaagaagtcaataaaaccaaaagttgtttctttgaaaaggtaaaaataaaattgagtaggctttaaactgaccaataaaaagagacaactcaaagtaataaaatccataataaaggaagggacattactactgaccttataaaaatgaaaaggattataagagaatatgctgaaaaattgtatgccacttaattagatagcctagattaaatgagctaattcctagaaagaggcaaactaccaaaactgactcaagaagaaatagaagatctaagtaaacctgtaataagaaatagactgatatgtactcaaaattttcccataaagaaaagcccaggcccagatagcttaatggtgaattctactacatgtttatagaattcatataattccttcacacatatttctgaaaaataagagagggaacacttctcaactttttgtataaggcctgcaataccctgataccaaaaccagacaaagatattgtaagaaaggaccaatatcccttatgaatgtaaacacacacattctcaagaaaatactatcaaactgagtttagcaatttaaaaaatgttctgtagttcttcagaaagttaaatctaaggttatatgacccagccattttactcctagacatatgcctaagagaaatgaaacatatatccagataaaatcttgtatatgaatgttcatagcagcattattcataatagctggaagatagaacccaaatgtctaccaactgatgaatttataaactaaatatggtatatccatacaatggaatgattttttcaaccataaaaaggaatgacatactgatataagctacaacatgaatgaatcttgaatatattgtgctaagtgaaagaagcaagtcacacgagattacatatgttctattcatgtgaaatttccagaataggcaaatctatcagaaggaagtaaattagtggttgcccagggtatggagaaagatgagatggggagtgtctggtaatgggtatgggatttcttttcgaagtgattaaatgttcaaaatttgaacacagtaatggttgcatgactgtgaatatactaaaatccattaaattgtatactttgtggacaaattgtatgataagttaattgtacctgaataaggattttttaagtaccacgagtaagtagaattataacagaaattcaagcttgtttaaacatttaaaaatcaacgtcatacaccttattaatagaaaaatgaacaacagtccacatgatcatctcagcagacaaaaagcatttaacaaaattcaaccccctttcatgataaaaacactcaacaacctacaaatagaagggaatttctttaaccttttaaaagacatctaggaaaaaccaaagtctaactttatatttaatgttgtaagataatgctttcctccgaagatcaggaataagataagagtatctgttctcaacatgtttattcaacattgtactggaaattttagccaaggcagttatgcaagaaatagaaataaaagcatccagattgaaaaggaagacttaaaatgccctctattggcatataacattatcatgtatatatgaaaatccaaagaaattcacaaaaagacttagatgtaataagtgagcttagcaaggttgcaggatacaagataaatatacaaaaaccaattgtatttgtatacacaagcagtgaaaaatctaaaaatgaagttaagaaagcaattccatttaccacagcatcaaaaagaataaaatacttaggaagatatttaaccaaggaagtgcaaggctaataaatggaaaactatattgttgagaaaaattaaggaagtcctaagtaaatggtaagatctctcgtgtttgcctactagaagacttaatattaaagtgaaaatatttcccaaattgatctatagattcagtgctatctctatcaaaatccctactggcgctttttgcaaaaattgacaaactaatctaaaaatttacatggaaaagcaaggtaccccgagtagccttaacaatcctgaaaaacaatggacaaagttggagtactcacatttttcaacttcagaattttttttttttttttcctggagacagagtttcactcttgtcacccaggctggagtgcaatctcggctcactgcaaccttcgcctcctgggttcaagtgattcttgtgcctcagcctcccaagtatctgggattacaggtgtgtgccaccacacctggctattttttttgtattattagtagagatggggtttcaccatgttggccaggctggtcttaaactcctgacctcagatgatctgcccacctcgcctcccagggtgctgagattatagccatgagccactgcgcctggcccagaattttctataaagctacattaatacacatagtgtaaccctggcataaggatagacatatagattgatgaaattgaattaacaatccagtagtaaatccatatatttacagtcaaataattttcaactgtggtgccaagacagttcaatggagaaagaatagtttcttcaaaacagtggtattgggacaactggaggctgacatgcaaaagtttgaaggtggacctctaccctacaccatatacaaaaattaactcaaagtagatcaaagatctaaatgtatgagttaacaccatgcaattttaaaagaaaacataggcataaatctttgtgaccttggattaagtagtggtttcttcattattacacctaaagcacaagcaaccaaagaaaaaaatagataatgggattcatcataatttaaaatttttatgcttcagtagacactatcaagaaagtaaaaagaggctaggcgtggtggctcatgcccataagctcagtactttggaaggccaaggcatgcagatcacttgaggtcgagttcaagaccagcctggccaacatggcaaaaccctgtctctactaaaaatacaaaaattagccaggggtggtggtgcatgcctgtaatccaagcttcccagctactcaggaggctgagacatgagaatttcctgaactcaagaggcagaggttgcagtgagccaagatcatgccactgcagtccagcctgggtgacagagcgagactgtcccccccacccaaaaaaaaaaaaaaaacaaaaaggaaaaagataatacacagcattgggggaactatttgcaaatcatatatttgataatctagtatctcagatatacaaagaactcttgaaaatcaacaataaacaaaaacagataacctgattaaaatgataatggatttgaatagacatttcttcaaataatatttacaaatggtcaataaacacatgaaaagatattcagtgtcattggcttttaggaaaatggaaatccaaaccataatgagataccacttcacacctactaaaatggctgtagtaaaaaaacaaaacaaaaaacaacagcatgtgttggcaaggatttggagaatttggaaccatcataaattgctattgggaatacaaaatgatgtaaccgctgttgaaaagcttggcagttcctcaaaagttgaacttagagcaccctatgacctagcaattctcatcctaggtatatacccaaaagcattgaaaacatatgtacacacgaaaactggtacatgaatagtcattgcagcattatttgtagcaggcaaatgtggaaacaaaccaaatggtcatcaactgatgaatgggtaaacaaaacgaatattacatacaatagaagatttattgttcaaccttaaaaaggaattaaaggtatgcaaaactggttcaacatttgaaaatcaattaatgtaatccatcacgtcaacaagctaaagaagaaaaattatttgatcatattagtagatggagaaaaggcagttgacaaaatctaacaccctcaacttgataaagaagtctacaaaaaaaaccctacagctaacatcttacttaatggtgagaaactgatgtttttcccctaaaattgggaatgaggccaggatgttcctgttccctactcctgttcaacatcctaccagaaacccttgctaatgcaataagacatgataaggaaatgaaagctatacagattggggggaaagaagtaaacctgtctttgttctgagatgacatgattgtctatgtagaaagtcccaaagaatcaacaacaacaacaaactcctggaacaaataagggattatagcaggttgcaggttacaaggttaacatataaaagtctatcgctttcttacatgccagcaatgtgcaagtggaatttgaaatttaaaatataacacattatattaacaccaaaaaattgaactgcttatgtataagcataacaaaatatatacaagatacatacaaaggaaatttctaaactttgatgaaagaaatcaaaaaagatctaaataaatagatactccacgtttgtggataagaagactcaatgttgttaagaatcagttcttaccaacttgatctgtagattcagtgcaatcccaagcataatttcaggaagttactttgtggatattgacaaattgatctaaagtttatatggaaaggcaaaagattcagaatagacaccatattattgaagaataagaataaagttggagaactgacactacctgacttcagtacttgacttcaatactttaaggctacagtaatcatgacagtgtagtattggtgaaggaataagtaaatagatccatagaatagaatagagaccctagaagtagatccacacaaatattgtcaatagatctttgacaaagtagcaaaggcaaaccaatggaaaaagtcttctcaacaagtggtgccagaacaactggacatccacttgaataaaaatgaatttagacatagaccttacatttttccaataagttttttcataatacttttcccctaagaccaggaataaggcaaagttgatcactttcaccattcttcttcagtatatttctggaagctaccacagtaagggaagaaaggtaaatataagcatatagattggaaagaaagaaatgaaactgtccctgtttgctgatgacatgacagtctacgcagaaaaattaaaaggaatctacaaaaaaaaaaaaaagactcctagaactagtgagtgcgtttgtcaaggatatgagataaacatacgaaaaatcagttatttctctatactcgcaaagaacacctggaaaccacagttaaaaacatagtaccatttgcagttgcttaaaataaaatgaaatgcttaggtataaatcccacaaaacatatacaaaccttgtatggtgaaaactacagaactctgatgaaagaagttaaagatctaaataaatgaagagatgtactctgttcagggattggaagactcaacatagtaaatatataatttctccccaaatctatctctagatttgacccaatttcaattaaaatcctaggaagattttttatggatatagaaggcttatcctaaaatatttctggaaaggaaaaagaataagaatagctaaaacaattttgaaaaactatgataaagtgggaggaatcattctacccactatatagatttatatagctataggaattaatatagagtagtactggcagagagatagacacgtagcttgatggaacagattagattacccataagtacccccacacaagtacagccaaatagtttttgagaaagattcaaactcaattcaatgaagaaagagtaatttttttctacaaatggtggtggagcaattggacatccataggccaaaaatgaacctcaatttaaacctcatgccctataaaaaattaactcaaaatagatcatagatttaaatataaaacataaagctacatagcttttttttttgagacagagtctcgctctgtcgcccaggctggagttcagtggcgcgatcttggctcactggaacctcccatcccgggttcaagtgattcttgtgcctcagcctcctgagtagctagctgggactacaggcacacaccaccatgcccggctaattatttgcatttttagtagagacggggtttcaccatgttggccaggctggtctcaaactcctgacctcaggtgatccacctgccttggcctcccaaagtgctgggattactggcatgagccaccatgcccagccaagatacatacttttgaaagaaaatgtaccctaatatcattaggacatggagggagatgaagaattcttagacatgacactaaatgcacaattcgtagatgaaaaaagaaaaacaaaaaacctcaacagtaaaaaataaaacaaatagtccaattggatagtggttaaaagacatgaacatttttcccaaaaagggttatacaggttctaaacaattacatgaaaatatgttcaacatcattatccattagggaaatgcaaattaaagccacaataagatatcgctccacacttaatagaacagctacaataaaaaggtgaggccaggggcagtggttcaaacctgtaattccaccactttcacaggctgaagcgggaggattgcttgagcccaggagttcaagaccagtctgtgcaacatagggagaccctgtctcttaaaaaaaataagtaacaatatgacaataccatattctggcaaggatgcagagaactggatctttcatatatctggtgtgaatataaagtggtacagtcactccagaaaagagttaggcagcttctttaaaatactaaaacatacatttgccatacaacccagcaagtgtactcctgggaaatgtacatcctaaggaaatgaaaacttatgttcacagtaagacctgtaatcaagtttttatagcagctatactcgtcatagctaaaatttggaaagtaccaaaatatcctacaatgggttaatggttaaacgaattgtgatacatctataccatggaatcctactgagcaataaaaatgaaaaatctactgatgcatgcaactacttggatagatctcaagaaattctacttcgttaaaaaaatctcttaattgtcgtgtactgtatgatttcctttatataagtttcaaagtgataaaattatagaactggagaacagattagtgattgtcaggtgtgggacactgcaaagtttaggtgaggattgtgagatgggtgagtgggtgtgactagaaagggttagcacttggggtttttgtgggggattattatgtagcagttctgtatctctgttttggtggtgactacttgaatttacacatggcgataaaattgaatagctgtgcacatagacacatgagtgcatgtaaaactattgaaatcgaaataaagtctgttggttgtatcaatagtcagtttcctggttttgatattgtactactgttatatgctactatgggggaaaatgggttaaaggtacacaaaatctctgtactacttttgcaactttctgttaatgtacaattattttaaaattttaaaaaattgtaaggtttcccttatgaactgtatgctcttccatgaaagagataattagcccacaaatatttaggagtataggtaaaagcattttaactacaggttttggtttccaaacattccaaattgttctgtacaggcaaaccctgactgatataactgatagcatcatcaaaaactgtcactcgttttcctcaagaaacatgaatatttaatagatttaatttacataggaaatttgtattcattttgtggaataattactggtttagttaatgaatctctataccttccttttgcatgcagaaatcatttgccaaaaccttttatttgcagttgcattttcttagtgtcatcatttgcttgactatggcttgcaattgatattgttagaagtaatccagcaaatttcaagatattaaggcttatacttttgtttaattttgtcatgcaaaatactatagaatatgcttccagaacagtttgatcatgtatttttaaattcccatcccatatttatcaaattatagtttataaatttaatatttaaaatgaaaactcattctttgaaacattaatgaattatgttcattatgtgacataatacgtcacataatataaatgtgcaatattttttgagttgtcagataatcattttgagcattggtattattaattatagattcttaaggatgatgaaatccttaaacttggctagtatttaaaaaacgtatttgttaattgtggttctatggggaaaaggttttgtgtttcttggaatagtttgagcaaaactgctagagaccagcttctagctgctgtaataattttcaatgaaacacctccttttcacagttcctgatcataatagtcatttaattattgttttgctcattggctagtattttcctaaatgggatttcccttagatttttttttgtttttcttcacttttaaagcaaatattctttgtatagaatttcatatatttctgtagaccttatatctttttttccccacagggcaagttctatctgtagaccttagacaataaattatgagtactgttttagcaaactgtacatctttggctgtttttcctaatggttttgtgtatgtgtgtctgttttgaattttttcaggctaatgagagtcaattttaaatacgtctgtttcttaatgattaattttgctgtattatgacaagcatttctggataactatttacaatgagatacaaatattacaaatgtaaagtttatacttgtcttgctaatcagatcctgctattctgtgaaaaactgctgatgaatctctaaacctaagacaatttatagtgattatgcttgagatcaactgcatgggaaaagaaaacttacttctttcatcttgttttttgccttttaaaaaatagtgtagattacctacttctgaaagtatgtggctatttgttaactaaaatgactcatacttgttcaatataattctaggtgtaaacatggcttgatattacatgtaacatgttggccataatccccaatatcaacgttttatttgtaaatgtctcttaacctgaatttctcatcttatatgacttcagtatgtagatgaggaggctcatgtttatataatagagctctcaaagttcattggctcatatattcaatttttcttagtatcatcttaatgttacattcgggaaatatagcaatatgaaaaaaatgtgagatgagtttctctactcattttttattctgaaataaagcagcttttaaaaaatgtttttccaggccaggtacagtggccaggcatggtggctcatgcctgtaatcccagcactttgggaggccaaggtgagtggatcacctgaggtcaggtgttcaagaccagcctggccaacatggtgaaaccctgtctttactaaaaatatttatttttaatgtttttcctctactataagtggaatttgtgtttcacaagttaaaaatgatttttatcattgttttctctttttctatacaaatagctacctattttctttcaaatctgcattttgctagcttttacattatgtgacgtagagaattccttaggaagctgtgggaatagaaaatagataaagacaggaatttggtgggttgacataacccttgatatatgggctacagtagctggaaaattcagtctgtacactaggtacaagatgaattttggagtatacttgctaattaaaatttgagtctgaagaattagatgggggtgttcttagatgtattgaataagttactgttatcccatctatatgaataacctttggaaataacctaagaagtgtcttttgttaagtttgctctgtaagaaatttgtattacacaattaaataatacatgtcagatagaaaatataataaattctaacttagcagacagtttattcaaaagaattatcgcaagggggagaaactattgcaatagggagtggggtctattttaatagaacactctcaccataagatctatgagtatctcaagggttaggcaaaaaatatttttcttttatgggaggaataaacaagactagaaagaacttggtgggaggaagtgggaaggcctgggggaaggagagaagcgtaaccagtttgattaacaggcaacttcaaattgggtacaagagctcctaattgttcacaaaaacttctatacaatatcaatcacgaatagttttaagggaaccacttttcaaattcttacttctatatatactcttcgtaaagttgatatgcttaagaaaatgtctgtaatggacatagaagttctcctttcttatatcccctttcacaaatttttcttctctcattttactattgtccttcctcctacccatccagaatcttaattgtggtgcgttacaagatctgttgtaatatgtatcaaaatctccagggcgccaaacaaaaggacagtttgaaaattggcatcagtgttgagaaagtgaatgactctgaaagaccaataacatactttttcaagttagatctattcttgctttgctttcaacaaaattgatggatgaccttatcaatttgtaagttgatggattattaagagtaatttttgtggctcactcctgtaatcccaacacttggggaggcagaggtgggcagatcacctgagcctaagagttcaagaccaccctgggcacaacatggcaaaaccccatctctacaaaaaatacaaaaaattagctgggcatggtggcatgtgcctgtagtcccaactacctgggaggctgaggtgggaggatcgcctgagcccaggaagtcgaggctgcagtgagctgtgattgtgccactgcactccagcctgggcgacagagtaagatcctgcctcaaaaaaaagcataatttttattaagtcattataattcatggtgtataactcaaaaagagattgctttaacagaactccatctattcccgtatacttggtttttttcaaataggtttattgagatataattcacacaccataaaacactcctttaagttgtataattcagtggattttagtatattcagagttgtgcaactgtcattgctacctattttcagaacattttcatctcccccaaaagaaaccctataccttttcatagacacccactattttcccccctcccagcctctggcaattaccagtctactttctatttctatggatttgccttttttggacattttgtataaatggaaccatagaatatgtgttgcatctggcttctttcgccttacatattttcaaggttcatccatgtagtagcaggtatcagtactttattccttcttatgactgaatagtattccattgtgtagatatatatcgattcattagttgatgtacatttgggttgtatcagttttttagctgttatatataatcttgatatgaatattcatgtgtagttaagcctcgttattcaaggattctttatttaaaaattcacctacttgataatatttataacccccaaactcatactcttggcgtcacgcacagacaggtgcaaagtgacaacaagtttgaatcattcaacatgcacattcccagctaaggtcggacaacgcaacactcttctatcttgttgtttgggctctcataccataaatgagttcccttttctatgtctacttaattccatattttttcacatttttgtgttttttgctggtgattttgcttcttaaagtggccccaaagcatagtgttgagtgctgtctagtattcctaagtgtgagaaggctgtgatgtgccttacagagaaaataaatgtattagacaagtgtcattcaggcatgagttatagggctgttggccatgggttcagtgttaataaatcaacaatatatatgaaataacatgtctttaaactgaaatacacatgtgataaggttatatattgatctgtggacaaatatggtgcaaccagagattcacagtaacctgtattttccctaaggaacagtgtttctgtgtttcctcagtcagtgtttgtgttgactttatagaatataagtactgcaaataatgaagatcgactgtatatggtttcatgtaaacatacgttttcagttctcttgggtgtatacccaggaatagaattgctaggtcatatgataacattgcttgttttgtgaacaaggtttctcagcgttcacatctataaaagtgaaaataggaatagaatttgtgttgagccctgtcttattctaccacatgcaagaaaatgagatccttgttggactggtgtggaactggccccatgacacacaggaatgtcaccttttgtgacacttccatagacataacttccaaggacccctgaagagacatgcccaagtggaagaaatcaccacattcaggaaagtccaaagctgttcaattgtaattttcctagagtagattgttttctttgttattataccagctttccaccatctgtctcactttcctctttcccagttcctagatggccgctttatgggattgaatctagagagtttaagccttacatagaaagttgatgagcctacaagtgggttaaagcttagtgtttttttttttaggtttcgtgttttttaaaaaagcattttcatatgaactgttgcttttttatttatttatttatttatttattttgagacggagtcttactctgtcacccaagctggagtgcagtggcacgatctcagctcgctgcaacctatgtctcctgggttcaagcgattctcctgcctcagcctcccaagtagctgggattacaggcgtgcaccacaatgcccagctaatttttttgtatttttagtagagacagggtttcaccatcttggccaagctggtcttgaactcctgacctcaggtgatcagcccgcctcggcctcccaaagtgctgggattacaggcatgagccaccacgcccagctgaactgttgctttataatatctcaattgtttacttcttcaatagcatgaataatttactatataattaaaagattttagtgatagtacatcaaaaagagtagtatctgcaaacagaagcagttttgtgcttgtttgtagtaaagactctatctataactgagtcagtaagcatattctcctttttaattactgccatgtactaatcaaacactatttaaaatgccaggcatgttgctaggtgctgttcatatctgttgtcttatcttcagagaaaccctgcaaaaaaatactttatctacattttgcaactgaagattaaagaagttaaataacttttggattgatgcacaggaagtggtagagccaggtgaatccaagttggtctgtcttttggactgcaaaagctgtatttttcccacatctgaagctgttagccctcaccctttatatcctagtgcccagctactttatgtgtcctgcacccctaaacccaaaagcggtatgtgtgtgaagtgaaggtagagagttttgtttttctggatttgttttttcacagctttactctgaccacctagaaccatgcctggcacaatataggtaatacttattgagtgaatgaaggaatgccacgtaagttttgtgaatttactgaggagtctcgggatggtgcaataagagaacagtgtgacagttgataaacaaaggaaggtttctgctttttggcaaagattacatctgtaaaaggtaaataggctgagtaacactttcatggtcaggactacaaagctgggctataaaaacacattattctaatccatgtttatctatcacttcttttgtttttttttttttttttttggcagagtctcgctctgtcgcccaggctggagtgcagtggcgcgatctcggctcactgcaagctccgcctcctgggttcacgccatactcctgcctcagcctcctgagtagctgggactacaggcacccgccaccacgcccggctaattttttgtatttttagtagagacggggtttcaccgagttagccaggatggtctcgatctactgacttcatgatccgcccaccttggcctcccaaagtgctgggattacaggcgtgagccaccgcacccggccatctatcacttcttacctggctggcacgctagtttatccaaactactttattgtacacgcttgttgtacagcttgctattaatataatgaggtcatataattagttatggtagtagatggtgacccttctcaaactatgaggaagatgtttaggtatcctcaaagtaaattctgcagtgatcccagagacagattaggaagtctcagagatggacaaaagacttgaaaggtatttcagaggctgggcacagtggctcatatctttaattccaacactttgggaggccgaggcaggaggatcatttgcgtccaggagttcaagaccagcctgggcaacatagtgagacccgatctctacaaaaaataaaaaaattagccaggcatggtgatgtgtgcctgtagtcctagctgcttgggagggtaaggtgggaggattgcttgagcctgggaggctgaggctgcagtgagccgtgattgcaccactgcactcagcctgggcaacagagtgagaccctgtctcaaaacaaaacaaaaaaaaagatatttcagaaaaaaaatgtatccacatgagcagtaaacaaggcacaactccattagtcatcagagaaatgcaaattaaaaccagataccactgcattcctaacaggatggctaaaaaatgaaaatgacagttgtaaagtggcagtgagaatgaagagccaccagaactcttactgctaatagggatgcaaattagtttaaccactttgataaactgtttgggaatatctaccaaagctgacatatatatatatatatatatatatatatatatatatatatatatatatatatatatatatcttgtgacctagcatttgcatccctgggtatatacccaacagcaatgtcttaacatatgttcacccccacccccccaaaaaaaaaaaaaacaaaaacatgtacaagaattcttttagcagaattcttcataatagccctaaattagaaacaacccaaatgtccaacagtggcggaatgacataaataaataccactgtattcatacagtggagcacaacaaagcaatgagaatggatggaactttgttacacaaaaaacacagatgaatctcacaagcataatgataagtgaaagaagccgggcttaaaaaactaccaactctatgattccatttatataaagtacaaaaacagtgtaactaatatatgaagtttgaggtcaaagtagtggttaccggtgggggaaggtagtgaatgggaggggacatgatgggagctacggaggtgctggtcatgttctgtttcttgatctggatgctggttgagttcactgaaaattcatcaagctgtacatttatgatatttgtaggaaggataggtatacattgtccgaagggaaagagtggagcagttttattttgtcagctcatgtggtctggcataaagatctgtctgggctatttaaatatttatattttgcataatggggatctgacttgttcacaaaagtattcattcagtcttggggagaaaagggtgatgacatacctgttctgtgccaaatgctaagtactgggatatgtaaaaatagaaagaaaacatagatatctttaaatctaataatccagacataagattctcttcctcagtagtaaatgctaaagagacagagtgactccatgtacaggtgaatctgctttgttatccttattggttactttaaaaataatgacagaaggcattggtgcaaaatgtatctaaagttacaacgtaagtgccatttctaaagcgtttgggagaaaattccactagtctatttgaactggccttgtgttgtctgtggtgtttggctttctcttgggtagcttaaatttcctccccatcagtatagtagattttatctattttgtttactcttcagaaataactgccaggggatttttaagactactgattgaggaatgattgccaaattacccatttttaagtgtaaagtcagtaagcaatgccaggtttctgaggagcttcaccaatttgtctctataatgtgtagtatttttttaacagttttaatatatgaatgaaaatactaccaagtttctcctggatccccacttttgttcattcagtgattttttttactgagctttggaaatgaaccttttgtctttttagtatgatcctctcccctcatgtcgtttgaaaatacccatctcttgcacgagactaagaacaatgctgtcctgttgagttcttataaaatccaaagaaaatttaagtactaagtggatgatagttaaagggtttacagcttttcttacagatccatcaaagtgggaaaatcatgagaagagttggagtcagacatgccagacattccaaatctgtcctgtacaatgtgaccttaagtagttccataaacctcagctttcctagttgtcaaatgaggagaatgatactgtcctcatggggctggtgcagggattaagggtgatgatatctgtgaagcatctcagcttagtgcttagcacactgtaggtggtcagtaattttcctgttctctgttgtgatatatcctctactaattctggagttatctttatcttgcctacctcaatccattctctacaatttccatttgtttatcttaattattttgtcttcctcttacttttttcctaaataaagctacaggagagtagattttctgtactctgacaagacatacatttttcttcttttaatagtgttaaaacaaatgtccaaaaaaacctttaaataaaaaaccaaacatgttcaaggaagttaccatcttttctaaactctgtcagcagggtggctgataaaataaattttctactcattagtctgagatgcttattgaagactgctaatttaggaagtatgggcctgctatggtctgaatgtttatgtcccccaccccaaatttatatgttgaatcctaattgtcgaggtgatggtattagaagatggcgcctttggaagggctctgccctcgtgaatgggattagtgctcttataaaagatgccttagagagatcacttgcccccactaccatgtaaggacacagtgagaagatgccgcttatgaaccagagagcagcctgcattagataccagatctgctggtaccttgatcttggacttcccagtttctagacccatgagaaataaattcctgttgtttatagaccacctagtctatggtattttgttatagccagcccaaacagactaagacagggcccttttatgttctggcttaccgtatttaactatggctattttactagtcagaacccctcttttctctagtgtatgtttctgtgacttagatttagtttgagggcattttcatgtttacttttttcttaaaaattttcccaagattattaacagatactaaatgaacttccctcttccatttcaattttatatggtatctcttttagatctttctcttaaagtaaatgcattacattgtatttttaaaacattttttgccttaataaactgctagcatttcagttaagaggagttaataacagtttcaccaatgcacattgaaaacgatgggttccattaaatagtcaataattattaaaattaagccaagaataatgaaagggatacaattacactaaagtgatatttatgtcttataaagatttctcttaaatgaaaattgacaattattagactagccatacacaaaatctggtattttaaaactaatcttggctgggcgtggtggctcacacctgtaatcccagcactttgggaagtcgaggtgggcagatcacttgaggtcaggagttcgagaccagcccggccaaccaacatggtgaagccctgtctttaccaacaaatacaaaacttagccaggcatggtggcatggacctgtagtcccagctactcaggaggctaaggtgtgagaattgcttgaacccaggaggcagaattgcagtgagccaagatggcaccactgcactccagcctgggcagcagagtgagaccctgtctcaaaaacaaaacaaaacaaaacaaaaaactaaaccaagggccaaagcagtatggtgacagggaaatattttatattttcccttagagacttcagagtgctgactcaccccttccacctaccatgtgaggacgcagtgataacacaccattgattaatgtctaagaatatattgaggaaaatactctatcaggctaacagggaaactggcacagttttgtttccactatattttattggttagagaagtcacagagccacctggttggaaggagaaaggatgtagatcccacctctggatgggagagatgacaaaaaaatttctggccatctttaatctgccacatcaattaattttaaacttaaactttgttgccttaatgtttgagtgagattgtagtagttgatgctactccattccgaggcagtactaaaatcctaccagaggatccaatgtcctcattaagtcccaattcaggatacatatgacagcagtgaataatttgtcactgtgaataggagactaaaataaggacataccatgttgcacaattacagactatttgaaatccagtctggcactgtttgttaaaacagaattttaatatttttgtaatcaaaagatagggaaattatttcaggcaggctgtttttataatttcgttttggcattcttctcttaagaatgaataataatataaggaaacaggtagtgattgccttttgaactataaagtgcttttcatttttagtaagaggttttatgtctataaaattatctgaaaagacaggtcatctgctaaccagtggtagagtatccactgcaaggctcaggactcctgaaacacatcataaaattgtcatgtaaggaaattcttggagctgagtgcagagctagtttgatttcatcataataggcagatattgatggattaactttgagtatttcatgaaataaaacatactttgctgtttttggtttataatacattttaaaacgtttgagtctgaaacaaaaattgtgaagctgatatttgtctttcctttcattctatatgtgaccagtttaatttttgtgattcggggcaatcaaagtatttgctgggtatctagagtgaatattttatcactttagataatctaatctaaaagcccagtaataacagttttggttatttttttcacaggtggggtagtatatcaaacagggtccagttaggagacagaaaccaaacagtaatttaatgtgtttcttttgactttttaaaaatttttgttggtacagagtaggagtatatatttatggggtacgtgagatgttttgatataggcatgcaatgtgtattaatcacatcctgtaaaatggggtatctgttccctcaagcatttatcctttatgttacaaaaaacccaaaaatactcttgcagttatttttaagtgtaccattaaattattatctgctgtagtcaccctgttgtaatatcgaatactaggtctttttcaatagtaatttaatttgaacatgcaaagtttagtataaggaattattgccaaggggttggggtaattggctagtaaaagttagagaactgtgaaaaatacaggcataaggaacagctgctattccaacggctgagatagaatgctcaaggaagaggtttggccttcctcctggcagcactaagatctgaaccttgttgaagaaaatatggccatgactcaccggatcacagtgaggttcactgagacaccatgctagtgggactcattggaaatctgccctctggagtccaggggaagccatccttagggacagaactctgaacatgcagcaagctcactgaggggctgctggaggaagccagtaacaaggagagtaccttgccagcagcgctctgctgtaaaggcacctgaagggggttccaagagaagctgcacatggaaagatgcatgctgctggccactgtgcactgcagataaactgcacacactgcaggagcctgatgagaaaaacactggaactgggacaacagaaccctttctcctccagtgcccctccagtgcccttagtggacaaagcttaatgttgtgccagttggaaaaatattcacagtcaatctccagtagtgcagagcaggcaatgaagtgtggatttggagctgacagacaatagattgataagtggcatgaggagtggagagattgtgtatatgacagtgagtatagttttgatgacatgtatcaagcaacctcattcattatacttggcaatgattttatttcattttgcttttttttccccctcctttaaggagattcattcaatacaacttagtggtatagggcttaaggaaggaaatgcccacgtttttgcttcatatgactagttggatagtggtgctacttattttattcaaatggatactatcaaagggtcagggagaataaatgagtttttgacatcttgcatctcagtaacttttgaaatataaatgttgatcagttaaatattttagtctaaaatttaggaccacaatctgaacaaaagagaaaagatttgaaaatcttcatcgttttggtaatagacgaaacttcggaaatacctgtgattgcttaaagaaagtatattaagaggccacaatgaaaaaaaatgatcatgaggaaccatttttggtcatgaaaaatggtcatgaggaatgatcctgacgaacacctaaatttaaagaaaggatggaaagagacagaggaaaccaggagggggaaagagaagtacaagaattattatcagagaatgctgtcatagacgctgagatcaaaaagattttctgtgttgtcaaatgctataaagaagccaaatgagggaacaactgtaatgtctatggaatttggcaacatggaaaccagtgtgaactttggccagagcaatttcggtattgcactggggacaaaaacaagattgtagtaggcagaggaaggaatggggagtgaggaagcagggaaaataaatataggataattttcaaatggctagactgagaagaggagagagaaacagtcatagatgcaggggcatgtggaggcaggggtagcgattaaaatgggaaggattccagtatctttttttttttttccttttttgccagaagagagagctaagaggaaagaaaagggtgcactgatggactgagatcttcgataggcagcaggtggagggtgggcccctcttccatcaagaccaaaagaaagtcaaggtactgatagagctaggcctgcaggcaggagaaggaaccagaggatgtccctcagctgatggcctgattttcagcaggtgggaggcagagccacctgctgagagtaggcatggtggtagagagtagagagataagagagttagtaatagcaggttaagagagataagagacattgctaggctgcctcaaggcccctccccccacccccgctgaggctaaatgcaaggaatttgtagcagcgcttatcaacatgcagatatgatttctctcagcaacactaagtagcctacaattgaggaaaggaaaattgtatgggtagattgtgctagagtgagaagtattacacacagcagacatgatggacaaaggaatcaagagagatgaaagtaatagtaatagcaagagaaaagaccatggagctggatggggaggaagattttagaggtgcatcaaacatattctagttggtcagtctcctcaccagtcacaatagttttcacgacatcaccgtaagagggacaatagtatggtaagtaagaaaaggaagttaatttcaggagacttgggttcaaataatgatcctgccatttatttattttgaccttgtgaaagttacctaacttctaagcaagcctgcatttttctttctttcttttttctttttttttttttttttttttttttgagacggagtctcactctgtcgcccaggctggagtgcagtggcgccatctccactcactgcaacctccgcctcccaggttcaagcgattctcctgcctcagcctcccaagtagctgggactacaggtgcacaccaccacgcccagctaatcttttgtgttttagtagagacggggtttcaccatgttgcccagtctggtcttgaactcttgagctcaggcagtccgcccgcctcggcctcccaaagtgctaggattatagatgtgagccaccacgcctggccacctgaatttttacacatagtaaatgctcaacaaatatttaatatgaagtgatatttcaagaaataagaaggtgcaatacaacacattagagatgccattctggcacaaagaaacaagtcagtgcctgctctaattttaatttaatgttacaatagccagttttgattagaatattttgcttcaccacatggtgctcaaggtactgtggctgcataacaaattaccccaaaacttagtgtcataaagcaactatttaatatactcacagcttctggggctctgcagtttagacagggcaaatctggggtgtgagtcagaagactcgagggctagggcaggaatcttctaaaggctcactaactcacatctggccattgatgctggctgttgactgagagactttacctgggaactttggcttacacttcatgtgacttctctctgtgaaaaggcttcctcatagcatggcagctgagttccaagggcaaatattgagagagacatccttttgctcagaataatggtattgagattcatccccatgtctgttgtattagtactttttaaattggttagtaatgttccatttcatgcatatagcaaagtttttaaatccattttcttgttcttagaaatatatgttgtttccactttggggctgagtaaagccgctttgaatgtttgaatgtaaatcttttgagttggacatattgtcacttctctcacataaatgcaagagtgcagttgctaggtcattaagaaactgccaaactattttccatagtggttgcactattttatgttattaccagtaatgtatgagagttacagcttttccacatccttgccaatacttggtattgccatcctttttaattttagccattctggtgggtatgtcatgatatttcttgtggttttcatttgcatttaccttatgactaaaaatgttgcacttattggccattcatatatctttgttgaagtatatcttcagatcttacaccgatgtctatttttcattgaggtgtgtgtcttttgtattaagttgtaggagttctttgtatattctggatacacttccttggtcaaatatacatattgcaaatatgttttcccagtttgtaactttcccttttatattcttaatggaatctttaaaagagtagaagtttttcattttgatgaagtccagtttacagtttttttccttcatggttcctgatttttgtgacctaagaaaatttcacctacgtcaaatttgtgaaaattttctttatattttcttgtataattgtagttttggctacgtttatgatgcactttagcataagagttgtatatcgtatgaagtgtaagggttgagattcatgggtagccattcgctccagcactatttgttgaaataaccctattgagttattttagcacctttatcaaaaataatgtgttggtctattttctgcactttctattctgatctgtatgtctatccttatatcagattcacactgtctagattattctatattaagtcttaaaatccagtagccaaaatcctacaattaggattttgtgtttaggctattctagctacttaaattttcataaacaatttagagtaaatttgtgaatttctgcaatgaagcatgagattttgattggtgttacttttaatctatatattaatttggggagaatggaaatcttaaccatattgagtcctccaatccatgaacactactccatttatgtagatttttttacattctcccagaaaatatctttgtagttttaagagtagatattttattcatatttcattacatttattgttagggcctcatgtttttgatgctatggtgaatagtattatgttaaaatttttaatttaatgattattgatagtatatagaaatacagttgattcttgtatattgatctcatatttggcaaccttgctaaatttacttattctagtggcttaaaaaaatccttaagattttctatttgaacaattgtgttattttatttctgtccattctgtatcccttttatttctttttcttacctttatgccctagctaggacattcaattcagtgatcttatattgatctcatatttggcaaccttgctaatttcacttattctagtggctttaaaaaaaatccttaagattttctatttgaacaattgtgttattttatttctttccattctgtatgacttttgtttcttcttaccttgatgccctagctaggacatacaattcaataatcttagggagcaaaccagtctcttaccattaggtattgtctgcaggtttttcttaaatgccctttattagattcaagaatttgttttatcgtcctaatttgttgaatttttattatggataagtgttgaatttcttagaatgctttttttctgagttgagtttttgtatagttctcctttattctgttacttacattgattgaattttgaatgctaaagtaaccttgcattcctgggataaaccctacttggtcatggtttattaaattttttatatacccatgtggtaaaaatactaatattttacaagatttttgcatcagtggttatgatggttattgctttctagttttctttttaaagtttctactggcttaggtatcagtagagtcaggtttactggtctcatataattagctcattattttctcaaaatgtttgtattggattgctattactttttcttagtgtattgtggaattcaccagtgtcactatctcctgggcttgggattttctttgtggggttattttaaattatacatgtaatttctgtaataaatttagggctattcagattttctattttttcttgtgatagtacttgtaatttgagtatttcaaggaatttgtcagtttcattttatttgttggatatattggtatatctttattatatttcttataattttcttgtctgacatatctgtactgatgtctcccctttcattgctgatattgataacttttgtcttctctcattttccttgatcattaaaatctttccaatggaatctttcaaagagcagaagttcttaatattgacaaactccagtttatcatttttagctagaggtttattattttcattgatcatacattgaacaagcttttggtatcattaactttattgtttgttcattttctgggtaatttctatcactgttttaataaagtccaatttgtcgacgtattgttttatgaattgtacttttggtgctccttctaagaaatctttgcctaatccaaggttggaaagcttttctccttttttttaatagaaatttaatagttttaggttttacatttaggtctttggtccattttgagttaatttttagatattttctgaagtctggatacaagttgtctttttttttggtcttgtcttttttttccatatatatagttgttccagcatcatttgttgaaaagattatcttttctccattgaatttccccttgcaattttgttaaaatttgattgtacatacctgtgtgggtatgtttcaaaactctatattgtttcatagacttattgatctgtctttagggtaataccacactatcttgattactgtaattttatgtgtctttggattttttaaaaaatagagacagggtatctctctgttgcccaggctggagtgcagtggggtgatctcagctcactgtaaccttgacccctcgggttcaatcaatcctcccacctcagcctcccgagtagctggaactacaggcgtgcaccatcacacctggccaatttttgtatgttttgtagagatgggatttcaccatgttgcccaggctggtcttgaactcctgggctcaaacaatccacccacctcagcctcccaaagtgctgggattacaagtgtgagccactgcacccagccctgtagttttatacgtcttgaaatcaggtgtcagtgtcccaactttgttctactttatcaaaattgtttgcacttttctaggtccttttcgtatgaattttagaattagtttgtccatttcagcaaacacacacacacacacacacacacacacacacacacacacacacacacagaaggcctcctgggatttttattgggattatgttgaatacaggtagtcctcaccttgcatggcactatgttaaatgaaacgtgcatattgaaaccaaggcctcaccatgcacagttccaatattcatgtttcagttaacacagtactagcactgtgcaaagtaagtatggcctatatgtagaataatttgggggagaactgacatattaatgatactgagtcttccaacccatcaacccaatatcattcttttatttgtatctctcatatatctctcagcagcattttatagtttttagtataaatgttttttcaacgttttgtaagaatttttctctgtatttcatatatttgatgctattacaaaatttttctagtttcaatatcctttttttaacttctggaatatataaatacaactgatatacaattgtatatcagtcttgtattctacagtcttacaaaactcagaacacattgagctctctagtccaaaaattcagaatgctccaaaacctgaaactttttgagtgcctatatgacatcacaactggaatattccatagctaatacctaaatccaaaacacttctggtcccaaggactttggataagagatattcaacctgtagttctaatagcttttttgtagactctctctgattttctccatggatgattatatgtcagttatgtcatcttgaatacaatcagcattaattacatcttcctttccaatctggattcctcttgtttggttttctggccttattgcactgactggctagatgtctcctccagtataatgttgaatagaagtcatgacagcaaatgttttcttattccttagagaaaaaacattagattgtttaccattaagtattaatattagctgtaggtttttgtggatgacctttttgaggttgaagaagtttctttctattccaagtttgctgagaattttcagtaggaatggatgttggattttgtcaaatgctttttctgcatttattgagatgacctttttagtttattgacatcatgaattatattgattaattttgtagtgatcaaccaacctgtattctaaaaactgcatattggcctctagttttcttttgttataatagtctttaactggttttgatatcaaggtaatgctgagctcatagagtgaattagaaagtgttccttttcaattttgggggaaaggtttgtgtagatgtggtattatttcttcatgtttggtagagttcatcttggcctgaagttttctttgaaggacgatttttaactaaaaattctattttttatagttataggaatattcagtttatttcgtcttaagtgaggtttggttgtttctttcatgaaatttgtctgttttacctaagtgggtaaatttattggcatggagttgtttgtaacattcattattcttagtatatctgtaaaacctttagtgatgttacctttctttatccttaacattattagttcatgtgttttctctctttttttttttctgagcagcctggctagaggtttatcaattcattgatctatttcaagaacccattttttgtttcatttatgttttctgttgatttactttttcctattctatttatttcaactttggtctttatgttttcctttcatgggcttattttgctttaattttctcatcttctagtttattaagttggagactaagatcaagttagttaatagtattgttcaacttttctatatcctcattcattttctgcctacttgttttatcaattataattttggatttgtctgttcatatacttttatcacttttgtcttttatgtattttgaagttctgttattagatacttatacatttaggattattatgtcctcttgatgagttgactgtgttattatcatgaactgatcttttttctttgttcttcctttatgcagtgtatccttttttctgaattaaaaaattttgtttttttagctgggcacagtggctcatgcctttaatcccagcagtttgggaggacgaggtgggtggatcacttgagctcaagactagcctgggcaacatggcaaaaccctgtctctacaaaaatacaaaaataagccaggcatggtggtgtgtacctgtaatcccagctacctgggaagttgaggtgggaggatcatttgagtgtgggaggcggaggttgcagtgagccgagattacaccactgcactccatactgggcaacagtgccagatcctgtctcaaaaaaaaactttgtttttatcactggttttatgcaatttgttgataatctgccttagtgcctttttttatttgtattttaatttgcttgagattctttgagcttcttatatctatgggcttatagtttacataacatttgaaaattttttgggctttatttctttagggtatttttcttctccatttgtctcttctctcctttgaagggctccagttacatgtatgttagacccctttatattgtcccacatgtcattaagcttctgtattttaattttatacttttcatgcattgtctaatctgtttagttcatccagtgactttttcatttgagataatatatttttttaattctagaagctccattttgttcctatttatttttttgtatttcttttctcattatgtccatgctttcttttaaatctttgagcatattcataagctattttgaaattcctgccttgtaatgcctacatagctatcatttataggtctatttgtattgactagtttttcttttggttatattttacaatttgctgctttcttcattagactatatctagaatagccattattttagtgccaaatttagctccactacttaggtgtgaattatccttagcatttcagtgaggtctctctactgtgtctggttagaactgcagtatctccctgctctttttgaccagcctcatggagtttcaagttatgcaaggacaaattattattaaagtattgttgggactttttttatacctcagtcccttcttttcagtaccctctcctgaacattccatctccctcatcctccccaaaccataatctctgttttctctactcagtgacactgcatgcactgctttgcttcccctccctgtgctgcatactggaaattgcttccaggaagaagccaggctctcatttggtactcattccattcatttccctttccataggaatcacaatcttttactgcctattgtctcagtgcctgataatatttgtttcatacatcttattcaattttctagttcagtgggtaaagaaagtcctattccaattaaatttgcatgattagaagctctttttttcccttcaaaatctttatttgcatttctttttttttattattatactttaagttctagggtacatgtgcacaacgtgcaggtttgtaacatatgtatacatgtgccatgttggtgtgctgcacccattaactcgtcatttacattaggtatatctcctaatgctatccctcccccctccctccacccaacgacaggccccggtgtgtgatgttccccaccctgtgtccaagtgttttcattgttgaattcccacctatgagagaacatgcagtgtttggttttttgtccttgcgatagtttgctgagaatgatggtttccagcttcatccatgtccctacaaaggacatgaactcatcattttttatggctgcatagtattccatggtgtatatgtgtcacattttcttaatccagtctatcatggatggacatttgggttggttccaagtctttgctattgtgaatagtgccgcaataaacatacttgtgcatgtgtctttatagcagcatgatgtttaatcctttaggtatatacccagtaatgggatggttgggtcaaatggtatttctagttctagatccttgaggaatcgccacactgacttccacaatggttgaactagtttacactcccaccaacagtgtaaaagtgttcctatttctccacatcctctccagcacctgttgtttgctgacattttaatgattgccattctaactggtgtgagatggtatctcattgtggttttgatttgcatttctctgatggccagtgatgatgagcattttttcatgtgtcttttggctgcataaatgtcttcttttgaggagtgtctgttcatatccttcacccactttttgatggggttgtttgtttttttcttgtaaatttgtttgagttatttgtagattctggatattagccctttgtcagatgagtagattgcaaaaattttctcccattctgtaggttgcctgttcactctgatggtagtttcttttgctgtgcagaagctctttagtttaattagatcccatttgtcaattttggcatttgttgccatggcttttggtgttttggacatgaagtccttgcccatgcctatgtcctgaatggtattgcctaggttttcttctagggtttttatggttttaggtctaatatttaagtctttaatccaccttgaattaatttttatataaggtgtaaggaagggatccagtttcagctttctacatatggctagccagttttcccagcaccatttattaaatagggaatactttccctatttcttgtttttgtcaggtttgtcaaagatcagatggttgtagatgtgtggtattatttctgagggctctgttctgttccattggtctatatctctgttttggtgccagtaccttgctgttttggttactgtagccttgtattatagcttgaagtcaggtagtgtgatgcctccagctttgttctttttgcttaggtttgacttggcaatacgggctcttttttggttccatatgaactttaaagtagttttttccaatttcgtgaagaaagtcattggtagcttgatggggatgccattgaatctataaattaccttgggcagtatggccattttcacgatattgattcttcctatccatgagcatggaatgttcttccatttgtttgtgtcctcttttatttccttgagcagtggtttgtagttctccttgaagaggtccttcacatcctttgtaagttggattcctaggtattttattctctttgaagtaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacagtggggttttctaaacatacaatcatgtcatctgcaaacagggacaatttgacttcctcttttcctaattggttaccctttatttctttctcctgcctgattaccctggccagaacttccaacactatgttgaataggtgtggtgagagagggcatccctgtcttgtgccagttttcacagggaatgcttccagtttttgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggttctgtttatatgatggattacatttattgatttggatatgttgaaccagccttgcatcccagggatgaagcccacttgatcatggtggataagctttttgatgtgctgctggattcggtttgccagcattttattgaggatttttgcatcgatgttcatcagggatattggtctagaattcccttttttttgttgtgcctctgccagcctttggtatcaggatgatgctggcctcataaaatgagttaggaaggatttcctctttttctattgattggaatagtttcagaagaaatggtaccagttcctccttgtacctctggtagaattcggctgtgaatctgtcgggtcctggactttttttggttggtaggctattaattattgcctcaatttcagagcctgttattggtctattcagggattcaacttcttcctggtttagtcttgggagggtgtatgtgtccaggaatttatccatttcttctagattctctagtttatttgcatagaggtgtttatagtattctctgatggtagtttgtatttctgtgggattggtggtgatatcccctttatcattttttattgcgtctatttgattcttctctcttttcttctttattagtcttgctagcagtgtatcaattttgttgatcttttcaaaaaaccagctcctggattcattgattttttgaagggttttttatgtctctatttcctttagttctgctctgatcttagttattttttgccttctgctagcttttgaatgtgtttgctcttacttctctagttcttttaattgtgatattagggtgtcaattttagatctctcctgctttctcttgtgggcatttagtgctataaatttccctctacacactactttaaatgtgtcccagagattctggtatgttgtgtctttgttctcattggtttcaaagaacatctttatttctgccttcatttcgttatgtacccagtagtcattcaggagcaggttgttcagtttccgtgtagttgagcggttttgagtgagtttcttaatcctgaattctagtttgattgcactgtggtctgagagacagtttgttataatttctgttcttttacatttgctgagaagtggtttacttccccttccaactatgtggtcagttttggaataaatgcaatgtggtgctgagaagaatgtatattctgttgatttggggtggagagttctgtagatgtctactaggtccgcttggtgcagagctgagttcaattcctggatatccttgttaactttctgtctcgtttatctgtctaatgttgacagtggggtgttaaagtctcccattattattgtgtgggagtctaagtctctttgtaggtctctaaggacttgctttatgaatctgggtgctcctgtattgggtgcatatatatttagggtagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatcctttattttgagcctatgtgtgtctctgcacgtgagatgtgtctcctgaatacagcacactgatgggtcttgactctttatccaatttgccagtctgtgtcttttaattggagcgtttagcccatttacatttaaggttaatattgttatgaatgaatgatcctgtcattatgatgttagctggttattttgcttgttagttgctgcaatttcttcctagcatcgatggtctttacaatttggcatgtttttgcagtggctggtatcagtttttcctttctatatttagtgcttccttcaggagctcttgtagggcaggcctggtggtgacaaaatctctcagcatttgcttgtctgcaaaggattttatttctctttcacttatgaagcttagtttggctggatatgaaattccgggttgaaaattcttttctttaagaatgttgaatattggcccccactctcttctggcttgtagagtttctgctgagagatctgctgctagtctgatgggcttccctttgtgggtaacctgacctttctctctggctgcccttagcattttttccttcaactttggtgaatctgacagttatgtatcttggagttgctcttcgcgaggagtatctttgtggtggtctctgtatttcctgaatttgaatgttggcctgccttgctaggttggggaagttctcctggataatatcctgcagagtgttttccaacttggttccactctccccatcactttcaggtacaccaatcagacgtagatttggtcttttcacatagtcccatatttcttgaaggctttgttcgtttctttttactcttttttctctaaacttctcttctcgcttcatttcattcatttgatcttcagtcactgataccctttcttccagttgatcaaatcggctactgaagcttgtgcatttgtcacgtagttctcgtgccatgattttcagctccatcaggtcatttaaggacttttctacattagttattctagttagccattcgtctcatcttttttcaaggtttttagcttctttgcgatgggttcaaacttcctcctttagctcagagaagtttaatcatccgaagccttcttctctcaactcgtcaaagtcattctctgtccagctttgttccgttgctggcaaggagctgcgttcctttggagggggagaggcactctgatttttagaattttcagcttttctgctctgttttttccctatctttgtggttttatctacctttggtctttgatcatggtgacgtacagatggggttttggtgtggatgtcctttctgtttgttagttttccttctaacagtcaggaccctcagctgcaggtctgttggagtttgctggaggtccactccagatcctgtttgcctgagtatcagctgcggaggctgcagaacagcgaatattgctgaacagcaaatgttgctgcctgatcgttcctctggaagcttcgtctcagaggggtacccagccatgtgagatgtcagtctgcccttgccggggggtgcctcccagttaggctacttgggggtcagggacccacttgaggaggcagtctgtccgttctcagatctaaaactccatgctgggagaaccactactgtcttccaggctgtcagtcagggacatttaagtctgcagaggtttctgctgcctttcgtttgtctataccctgcccccagaggtggagtctacagaggcaggaaggcctccttgagctgcggtgggctccacccagtttgagcttcctggccgctttgtttacctacttaagcctcagcaatggcgggcacccctcccccagccttgctgccgccttgcagttcgatctcagactgctgtgctagcaaggagtgaggctccgtgggtgtgggaccctctgagccaggcacaggatataatctcctggtgtgctgtttgctaagaccattggaaaagcacagtatcagggtggagcgcagtatcagggtgagagtgacgcgattttccagatgccatctgtcacagcttcccttggctaggaaagggaattccctgaacccttgcacttcccgggtgaggcgatgtctcgccctgctttggctcacactcggtgggctgcacccactgtcctgcacccactgtccgacaagccccagtgagatgaacccggtacctcagttggaaatgcagaaatcacccgtcttctgcgtcgctcacgctgggagctgtggactggagctgttcctattcagccatcttggaactgcccccctagaagctcttatcgtgagttttaatgtgattttaaagaatcttaattctaatgatattactttcaaatagagacagactattacagagttttatctaacaaagctaacatttatttagcatttcagtgatgtgagacgccttgctaagaggtgtctcagttcccattataatcctattataaaggtgccatgttatgcctattttacagaaaggaggactgcagcttgaaaacagttaagtgacttgttcaagctcacatatcagtcgagtaaatggcaaaacctagattcaaactcaatcttgtcaaactgccaaggccttgcttatcatcaccatgtgctatggtttggatgtccctgccaaaactcatgttgaaatttaattgccgttgtaacagtattgggtgctggatcctttaagaggtgattggcctggcacgatggctcacacctgtaatcctggcactttgggaagccgaggcagatggatcacctgaggtcaggagttcgagaccagcctggacaacatggtgaaacccatctctaccaaaaatacaaaaattaactgggcatggtggcagacacctgtaatcccagctacttgggaggctgaggcaggagaatcgcttgaacctgggagatggaggttgcagtgagctgagatcatgccactgcactccagcctgggtgataagagtgaaactccgtctcaaataaataaataaatacatacatacataaagaagtgattaggtcatgaggaatcctccgtcatgaatggatttatgttgttatcgcgagagtgggctagttattgctggagtgggctcctgataaaagaatgagcttgggcccattttctctctatgtcttgtgcttggttgcccttctgcaatgggacgaaccttaccagatgctcatgccatgctcttgaactcctcagcctccacaacagtgagccagataaacctgttgtttataaatttcccagtctgtgggtttctgttataacagcagaaaacagactatgataccatagtatgctgctttgaagtgggtgagcagctgggacaattaaggaatcagcttcagtactaagtgtctgggatgcaatgctttgggggccattttcaggttttgtacagcagtctttcttgggtcacattttcactgctctttacttcaaatggtcaagtcagacatcttttaagcaacatttatgggtaggttctgatggcatcttccttatatctgcatatgattggaaatctaagagcatttgggaaccttgtcactgaccatctttttttattgtaactctacattaaagtggggtgttttttgttgttgttgttgttgttgtttgagaatgataaggtaccatgggagcagaattacattactggaaaagtggtggctaggtttataaaagcaaaacagtcaatgatgttctcagtctcaaattatttcaaaataaaaagatttttaagaaaaatttacctaaaataattagtctcttttcagtttagccaccagcttcctatattcttagattgttttattttgatttttgggggttttttattgtgatttaattttttataatcatgtaaaacatttacgtggttccaaaggcaaactataaaagaaaatattttcaaagaagtatgttttctatccctgttcccaccctccttcataagtaatcattttcattagctttcagtttatactcattgtctttgctttaaaattgtaaatattgtagctgtgtgtgtttttacatacacatacatacacacacatttccctcttccttggataaaaggtggcatattctacacactattctacatcttcttgttttattaagtcgtagatactctggagttcactcaatagcatggtattaagattgtccttttttctttttaaagctccaggatattccactggatttaaatttttcaaaatctcatttgataaacatttattgtctactgtgtgtgtcatctgtcacgggtagtgcatagcattgtagggcaaacagaaatgaacaacatatagtcttcaccctcaagaaacttacagaattttaaaatacttttacaaatgtgtacctctcacagtagctgatccagtaacaattatttttatttttacccatctcctttttagagaacagagtaaaaatttttttgccatctattgtttctgttatatttaatgtcatttcagtagtatttataagcagtctaggaacacgtcccaacatttaaaatacttagatatatgattgtaaagtgtgaggcagagaagtacatcatatgaatgtatgctatttctaaatacttgctattaattttagtcactctaaagtcagaatataccagacagtccaaattactgtaattataccatccttttaaaaacttggcacctctttattcccaatattactccaaccattatcattataacaggttcctgttctgtacctcactcacatctgtactcttctccaatatttcttatttctttaatgtctgtacctcataagatgctgaacttttctttgaagacttaggcattggggctgtgggggtactagcctagacttattgaaagcagctcacctatggtactttgtcacgggagtgggtatatctgtgctaggtattgtccttcctatctctttgttggctcttaggggcactccgtctctcagggtcctgagtctgactttgcatctttgaatatggtgtctctccttaaagtcatcttggttacaccttgggtttaccttttctttgcctgtcctccagtagtggccctgaagcctatccatgttatcatttggctactcctggctcttccatcctggagctgttaacctagttgctcttgaactctgcatataaggcccccttccctttctctttcccctttccccagttgctctctaggttttctaatttctttcctgacactatgtatggctttagtcaagcgtaacccttgtccctaaatccacaaatataaagctaagacatgttacttgtctagttttcttagagaaggaaacttctcaggtctttgtatgcttcctcatacaattgtaggttgcagtaaggttaaatggctgaaaagcggtgaaggaacatgttcaagaagtttcatatgatttcactacatgaatgtagatgtggtaatctagcacctactgtactacttaaagcatttcctacagtgaaggcttctgagaaaataaatactattcctgaagtagtctcacaaaaaaaccttttttaattcagaaaattgattccaggttcactaagtcagcattttctctcatcaggcattgcaactaatgacattaatgagagccatgccatattttttaaaacaaaggataaaaagggcaaaactgagaattttaaaagggagttgtttccagtagtctgtttgaacattgtaattaaccaagaaataaaacaagaaaaggccattttaattgtgttttttagtactccattaacagtgcatcaagctccttatgaattgagacagtataaaatgagtgcttacgttaaagtaggaaagccatcagtctgcggtacagagcattgtatttattagagtatcccagacctgaatgagtattaccaccattaggtaatgcttaagtgtctattttaacaaaaggcatttttttttgttattatagagaacaaacactaaattgactaaataaatgaagtttaaacaagaaataaaacagctagaatttgcttgcttttgttggtggtgatatgctcttgtagccccagcaaattacatcagcattgttaccctcgacagggagctttataatttgtagcatgtaaaataacccttcccaaaaaagaagagagccaggacctgtgttgaactacttacaaagcaagcatgtccctggtgtcaccttagtagttttagtgagaaagatgggatttctaaggacagtagttcacagttgtgctctctctgttttctgtctttcatgctttaaggtttttttgctctcttattttaatgtgtgtgtctctatgtatgggcatgtaaataaatatgcagatggtggcacctatgtaagaaaatgtttgaacacagccccaatttcagagctcaatatggcatggggaattcttgggagaatgtgacctattgagggttggttggttgtttgtttttaagatggaatctccctctgtcacccaggctggagtgcagtggtgtgatcttggctcactgcagcctccgcctcccgggttcaagcagttatcatgcctcagcttcccgagcagctgggaccacaggcgcccgccaccacacctggctaatttttgtatctttagtagagacagggtttcaccatgttggccaggctggtctcgtactcctgacctcaaatgatccacccacctcagcctcccaaagtgctaggattgtgggcatgagtcaccgcgcctggccaattatcataaatatatgctttttagtggaccatatagaaagttctattctggttctttatatggttgggttttacttttatctaagtaatgtaagcacatggttttaaaagtcaaatcatgctacttctaacaacaaaaaagcagtgtctctcctaatttgttccaactccaccactttaagcatttttgctgtttcttctgtaaccagcaacatatattactatttcttgatttcatagtttcagatatcatcagttattgcctttttgctatgaaagatgtagctgttttatgttgctaccctcccaccccacttcctggtccctacttactttcccttccccatttttataatattcatatttcagttattcatataatatgattgtatttcttgtgtaatttattgttatatctggggtgaatcattgactcatttctttgattgcttagttttttgttgttgttgtttttgagacagtctcgctctgtcacccaggctggagtgcaatggcgtgatcttggctcactgcagcctccacctcctgggttcaagcaattctcctgcctcggcttcccaagtagctgggattgcaagagcgtgccaccacacctggctaattttttttaatatttttagtagagatggcgtttcactatgttggccacgctggtctcaaactcctgacctcatgatgtgcccacctcggcctcccaaggtgctgggattacaagcgtgagccaccgtgcccagcccgattgcttgttattttatgtattattgctaatttatccctaggctgtcccactaaactgtgtaactttcctcggtacattcaaccccattggataatttatcacattcattgtttttcttggtgacagagggccccctgcctgtgagcctttcatctgtttcattgtaagttggttgctgtcctggcctgctgggctcgtcatgagaattccttttgcctttcatctgtgctagagtctttgttccctaggtttcttgtttttttgcttttttggtttttttggcttccttcttcattttgataaagtatgccctctagtaactttctgagaagaggtgcttttttgagatacctgaaaatgtctttatattactctacaatttgatagtttggctgggtgtagaattctaggtgacaattttgaaaatatatagcatatgggtgaaagtttatatgatgcaacgagactacttaggttcatatcacacttaaccagctgtgtgtgacatgggcacatcacataacccttctgtgcttaagttttctcatctaaaaatcaggcataatatcttacctgcccttacagttattgagaggattgattgaataatgtatgtaaagcacttagggcagtgcctggccgtttttctcccaaagctttaatgatattctctttaccccagtgccctaaaattttacaatgatgtgctttactgtgggcctttttaaaagtcgttatactgattgcttagaaatatttttaaatctggaaactcattgttctttagtttagaaattctttaaaatatttcttagataacatccttttctccagtttctttgttcttcttttcaggagttgctgtgattcaaataacataagggcttataaggtagggcttcatctctaaccttttctttcctgttcctctttctttatctttttgctctactttgagagatttcttcaacttgatcttctaacccttctgtttgagtctcgtggtttagctctcattttttattttcaaggacttttttctgaatgtttttcttttaaactattatatagtttcatactcttgtcttcataggtttcatattcttatctatctcaaagtagtatatttttgaaattttctttgccttatacagggaacagtttcctcagaaaaatattaagagggaagtgttaaataggtgcctgggaacactctgtatatgggtaaattcattatcagtgatcagacaaagactaggccattttttgagcgccttatggatatccgttatctgtagatcttttgttcttaagcaggtcagtttgacagaagaatcttctgatcttctgccttgggctaagggtatgtgtattagggggagaaagggtacgtaggggcatttaagtctgactgcagtggttctgagagataaaggctgagggtctttattttaacatgtttaatacatggaactttccagttaatcctcttgtttgagtacagcacttcagtttgacgtgagctaggggtctggtgtccaaagtctccaaaaagtggggtaaggataatttgcttggccaaagatatccaaggtcatactgcatacctataaaggttcagccagtcctcctgttatctgctccaccatgcaaccctgccctcaaagatacctggtgcttcctattgctaaacctttcttagggacattttgacaggcatatcagcgtgcttcttactggctcgccttattgaaagcttgtgttcaggttctacagaaagcttgtgttcaggttctacaaaaagatgtcaagaagggatttgatgtgcaagaaatttattgagagtgaaaatgaatggtagggagctggaggaggctgggacagccatcacaggtcatgcaggtctgaccccgttggaggaaaaagggaagaaaaagaggaggattgggtggggaaattatttgaccaaggtgcagtttcaaggatgttttggcaaggcgtattgggagtccttgagccaaagttgaccatcagagacccatatctcacaggaattagcctgcttaagtattcctgctgctcttagtcaccagctgagagtatttataatagctgctttgaagtcttttctgctaattccaacatctgggctccctcaaaggcagtttctattttctgcttttttttcccctcctttgtaaaggtcacacttttctgcattttgcatgtctcctaacactttgttatagcaactgtggatactgacaccttcctccactccagggttattcttttttagttacttgctggactagttcagtgcaacctctgatgtccctcttcaggacaggtgtggtccttatccatgcatttctctgctacctctattggtgttaaacttaaccaatcgatagctgattgctcccttctttttgacaatgccttgtggtataaattgctccatagtctgatccaattaaaattgggtcccttcatggatgaaattggaaatcatcattctcagtaaactatcgcaaggacaaaaaaccaaacaccgcatgttctcactcataggtgggaattgaacagtgagaacacatggacacaggaaggggaacatcacactctggggactgttgtggggtgggggaaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaagaaaagaaaagaaaaaataaaaataaataaaaataaaataacattgagtcccttgtcagggacaagtttttctagtctttgagacttgctatacccttccctgagcagaatctctgcactatagagtaggagctggggaaaatggggaactcactcctcattggctgttccacccagatcctccctctgaagcagggtttttgtgttgccgggaaggaggaggtatgaactgtgcctccttttgcctctgctgctactcagtgtggatcttccacagctcaaaaccagggagtatgatatctgtcagtgttcaccaggtgctgaaagtactcagaatagttctttcaccctaggaagttgaaggagatgggagctgccactcagctgccaaacacatctctgtagctctcttgacaacacagagctgtgtgggcaggggggactacactgtttaccagcttcctcacctgattcctctgtttttagctggagttcaggggagagaaatggctgctgccatcagcttctgccgcttgctctatataggccttccacagcatggagccgtggaaaatgggatctgccaatgtttactagctgccaaatccaccccgagtagctcttccatctcaaggggcggatctgcccttagctgctgaactccttaaaacagttctttggcaaaacagagctgtggggggacaggtgcagtccctgtgtggtccctatctcgaatgctacagcctcttattgttcttatcgaatttctgtagattctattgaataaatgcttctctatttgttgtaagccctttgatcagtctccagggactttgaatgattgtgatttttgaccagctaaatatatgtctctccaggggagagatatccctgagctcctttatacagccattccagaagtcccacctagtcattgtgggggttttctgggttttttctgagacagagtcttgctctgtctcccaggctggagtgcagtggtgtgatctcagctcactgcaaccggctcactgcctcccgggttcaagcgagtcccctgcctcagcctcctgagtagctgggattacaggcgcacgccaccacacccagctaatttttatacttttagtagagacagggttttaccatgttggccagggtggttttgaactcctggcctcaagtgatctgcccacctcagcctcccaaagtgctgggattacaggcgtgagccactgcacctggctgtcattgtgtttttaatgattctgtcttaatagaaaactagttttacacaaatataatcaagtgacttaaattgaaaggactaagattgaaaactgaattgaaattgaaaattgaattgaaattgaaacctaagatttttttgaaaggtatgattttattacggaaatttgcttgattgagctttattttaatcaagactttgtatttccatttttagaattaattcagagaaatagctaacctataaagttcatcttcagaattgagtcattgtagacctaagaagcaatatagcagagttattaagagcataggttctggggccagactacctaggttccagtctttgctttgcagcttattggttctacctgggttccaatctttgctttgcagcttgttagttctttttatttttatttttgagacagtcttgctctgtcacctaggctggagtgcagtggcatgatctcagctcactgcaccctctgcctcccaggttcaagcaattcttctgcctcagcctcccaagtagctgggattacaggcatgtgctaccacacccagctgatttttatattattagtggagacggggtttcaccatgttgtccaggctagtctcagattcctgacctcaggtgatccacctgccttggcctcccaaagtgctgggattacaggcgtgagccaccgcccctggccgcagcttattagttctgtgaatgagttacttaactgctctctgtctattcatatataacatgagcatcatctgccccttagaattattgcgaggttaaatgggtcaacacatctaaaatagagcctgactcatagtaagtactcagtaaatgttagctgatggttattgttgttagacacattaaaggcaaataatcatctcatctttgtattttattattgagaccaataatattgtctaaagccagagaccttggtgaaacgctgggtgcccagctagctataatatgatctttagttccctctagtggaagaaaattagataggctctttgcataaacatgctgcttttggaattgtgatcatttaacctaataaaattacccctgaataattaaccaaagacaatatccacatacataaatggatttaagaaattgttaaaacttacaatcttaaatattctttccaagtgaaacttttttggggacgtgtaatttataatattaaataatatagtatataaaccatccagtgacataaaaagttaggcatatattacttttgtttaaaacaagtgcattcagtagtagtagtaccttgaagttttccattttaacattcatacccagttatctgcaagtagatggcatttcttggtcattctctgagaagtctttaatcattgtgatatgccacctggagtagatttccttgaagttttggcatttttagtatcctcttccacacagcctatggggtaacagaaagattgctagattgggaatctgagacctgggttcatcttccagttctgctatgaaatatctgtgtgacttcgggcatgtcttactagggcctcattttccttctgagtaaaatttgaggatagagaggagcatgtgatgatgactgtcttgctgtcacttctgtttctaacattctctgattcagtgatacatacactttgatgtgagacaggagatgtataatagatgttgagtctaagttgggtaaatgggtcctgtatgcttgatgttgccttctagcaggattggcaggaatggaaatcaccagcagtggaatgatttggtaaatgccaagatcttgaggcatctatggaggcggttgctagattgcagcagggtatgcctccctcagcttgggagattgttaaagagaactttgaggcaacgtctaagtgggatcttgatgaacaagtaggggtttaccaggcagagaaggaagcacgtggagtatcatacagagggaacaacatttgtcaggggacagagagcagggggccggtgcacaagctgcgggtggttcaggattggggtcagggaggctgaaggaagaagctactggaaaggaatgtataaatgtgtgacttcaaaaaaaaaaaacaagagctaaattgtttgactaagaagccggagagctagcttctatttccagttatactgttaaataggtctgtgaaccctagttaagttgttggacttaaaagattttttggaaggctttcaaagccatgcttagggattataatgtcttgctgtatggaatggagctcagtgaaggttttggaataatataatatctgttttagagtaaaactatgatgacactttaatgagtctaaagagaagaaactagaggcaaagaaacccatttaaagatctttgctgtgatccagtcaagaattgttgagggctgaaactagggtaaccgcagtaagggaaagatagttttgacaggtgttgcagaaatagaatggacaggttttggcagctgcatataggaagtagaggagaagtggtagatggtgtgaagatgactccaagggctgtctggaagattaataattttggtaatcagtaggccacacacatacagctacatgggttctgttttacttttcttaactagtgtccttattattaaacattttgagtgtgtctagtttttttcccaaataaccctatggtcatcttgaggttttttacgaaatatgtgatttcccaaaaaactgtagatgaaaaactgcaaagttaaagtaggcatagaactacactatatatagcagtgtggtttactaatagatgttcacattgctgccttcttggtgtcaaactcggtttgattgacatttgttaaacatagaatgatttccaccaaaaatgatgaaaggaaaagaaaacaaaacttattgtgcatgtgcactctcacatactttattaatcatccaggcctaactacaaccctgtataggagttgttatcttactctttctattttacaaatgaggaaacagatgttctaaggttatgcagctactaagtgatgaagacaggaaagacaggtcttttgactacaagtctattgccctatctattatatcataactgcctgccagcagaatgtgttagtgcttaaaaggatagatgccagatctgtggaagtagggtgaccagtcatcttggtttgcctgggaatgagggtgggttctcagaacccaggactttcaacctggaaagatcctcggtgccacaactgagaaagttccaggcaaaccaggacaggttggtaccctgtccagaaaagtcacttatatgaaataaaccattatctagaatgacttaaataaggtatttactgtatttctttcccataatattgtgtcatcaatgctaaatgacaaatgattcctaagtgaagaggagttaaggccccgccttccttccatctgtttgttttcactggctctgagcatcctgccttgctgcagttacactcaactgtgtgtgaatcagatactagatgcctttgcttctaagtcagttttattttattttttatttttatttatttatttgtttatttttagacaggatctcactctgtctcccaggctggagtgcagtggcatgatcttggctgactgcaacctccacctctcgggctcaggtgatcctcccaccccagcctcctgagtagctgggactacaggcacacgtcaccgcacccagctaatttttgtattttttgtaggaacagggtttcaccatgttgcccaatctggtcccaaactcctgggctgaagcgatccacctgcctcagcctcccaaagtgctagtagaattacaggcacgagctaccgtgcctcgtctctaagtcagtttttaaggaaacttatgctttgcccattccaaatttgatgaaatggcaaaagagctattcagggaaaaatcaaggagggctgtcagtatctgtgatttcaaagtatttatcaaaacaattaactcatttttcttggtcctttttcaaataagtatcacatattggtagttatttctttacgataaatttgttttatactatttttatgagactttgttgacaaaaggattctgtagctggatggggaaacccatattattaaaagaaaaaaaaacctcagataatcatttcactatgccgtacagaatttttacctcattcattttttacatattgaaacagaccacaaattgctttctgggaaaagttttggccctgctgtcagtatttcctgggctggccccatcctggaagaagatttgggggagaaatgggtggtaaggaaatctatcctgtcaacgtgtccttgttgagctcctcagctatcagttaataaatatagaaagtaaattatagataacacaattatgaaagtataaagcacaggtatgtgaagaacattttttttctttgacatattagttgaattcccattttatttcagtaacttctcgtttgctttttaaattttattgaagaacgtgtatgcacaataaaatgtacccatctaattgtacacttcagtgagttttgacaaatgtatgcattctgtcatcccacaaagttccttcgggctctaacatgtatgatttttaagactttaatattgaaaagtaattgagttataaactgatatttctctaattttcttgtataaagtaaggaataccatgttgaaataggtgtctggtttttctaatagtcaaatgccctgatcttcccccctttggtttacatttcccaaaatgaaaagcaacagagcaattgcaccttttagacaaacttagagcattgtatttctatttttgtcatatacaaatttgttacacttatcagaactgaaaactctttgggaaatatattaacaaaaccccattaatttgtaaatgcttaatgcagctaagattgatttctaattaatacacatttgcctatttaagaaaattttcacatcagtcaaacactgaattaatggtatgctgcttcctttctttattcacctgatgatgatatttggggccataggaattttttttcaatgggcaagaattcaaagaaattagaaggtgcttggatttctgtttgtgtgtgtgaaaaaagacaacaaaatgtatagagctagtagtgaaacatgtaaaaaagaatcaaagaaattatgagtttgcagttgacccagatttctatggtggcctgtctaggcctctactcttcactagctgaggtcaactttcctgaaggtcaatgaggaagatagcctcattaaagccaacctgacctgtgttgttgccaaaggcagctgggatctttattcttcaacttgattatgagataaaggtagaacccagcagcagaaattgactttgctactataatccttccaaggttctgcttggattcctttcttaaagtatcatttggtcattcatttcagtacactaaggaaaaatatgttgagtcaataatgactttcatttacttattttgttattaatatttattgaaatgaacacattagtacttgtcctagttctttctatgactagattagaatattctttattttgattttgagtccaggtcagctcttagcgaattttgtttaactgttgaatttctaacacaacctagacattgtttggaaatgaatgagaatacttgtatatttgttaggaaaagcgcagtatctagtttctgactatcactagttacaatgcagctgaaataagccggttctgtaacagtcttgatagcctgtcattcaagtcagtattaccatattagcactattgtgtgattggatcttaggatatataaaaactatgcagacccaggaggcactgtggtgtgatgtaaagagcaaagggctttggttattagtcctgcttcctccacttactagctgtgtgatttatatcattgagccctggacctcagtttctacctctgtaaaatggggagatatatgtgcatatatatgtatgtgtatatgtacatgtatgtcatgcagggttattacagtaacaaatgaggacttatagaggggcactttaaagtctcagagtttgcattagattaacaatagtgaagaaattccagatttagttattaaatgatggatttgggttattaaaagaagctataggatttccttctgtgaaagtattttttaaaaacacatctgtttgaatttagattctttttggaatgactgacattataaatatctgtaagaattacagaactcacaatcaggagaggataagaattaaagcaagtcaacttatctagagtggcaccattccaatttggtagacactagccacatgcagttattgagcacttaaaatgtggccagaccaaattgagatttgctataagtgtaaaaatacatgctagatctcagagataatagtacaaaaaaagtaacttattttattaattttagtatgattatatgttgaaataatactttgtatacattgaattggataaaatatgttatcaaaatgaattttacctgtttctttttacttttttaatgtggctactggaaaatttaaaattatatgcatggcttacattatacttaaattggatggtgttgatcaaaatctttattgagctaggtgcagtggctcacacctgtaatcctaacactttggaagtccaaggcaggaagattgattgaggccaggaattcgagatcaacccgggcaacatagcgagactctgtctctataaactatttaaaaattagctgggcatggtggcacgtgcctgtagcccagctgctcaggaggctgaggtgggagcatcccttgagcccaggagttcaaggttacagtgagctatgatcacaccactgcactccagcctgagcaacagaatgagaccctagctcaaaaaaaaaaaaaaaaaaatccttattgaatgctctcgagcaaacgaaatcttaaatttagatcttttaagttcagatacagatagaatgaaaagttctcctagttcttcaagaaaaatagtagtaaaataatactttacaggaaaatcatttttaaaacagaccacttgaaccagcttccctaactttcccttacttgaccagtctgataggcagaccctggtgggatacttgctttactattgttggagagcccaaactttttaggaaaataatagtcattctaatgccatatggcaggttgatttcatttaagtttctaatttgggttagaaaattaaatattgctacctgtattactagttccccttttaaagggaaataaattgataaaataaatataggcatatagttaaatgtaaggacactaaacacagaaatagattagtttaaaatatttttaaaatttcctgagaaattacaaaaaagaaagtacaacttagccataaaaaggaacaaaataatgccattcacagcaagctggatggagttggagaccattattctttttttttttttttaatctgagatggagtctccctttgttgccctggctggaatgcagtggcgtgatctcggctcactgcaacctccgcctcccaggttcaagcaattctcctgtctcagcctcccgagtagctgggactacaggtgcacgtcactacacccggctaatttttgtatttttagtagagacggggtttcaccatattggtcaggctggtcttgaactcctaacctcaggtgatccacctgcctcagcctcccaaagtgctgggattacaggtgtgagccactgcacccagctggagaccattattctaagtgaagtaactcaggaatggaaaaccaaacattgtatattctcactagtatgtcagagctgagctatggggacgcaaaggcataagaatgacacgatggactttgggggaagggtgggaggggaggtgagggataaagactacacattgggtacagtgtacactgcttgggtgacgggtgcaccagaatctcagaaatcaccactaaagaacttttccatgtaactaaacaccacccgttccacaaaagctattgaaattaaaataaaaaatgtactcattaaaaaaaaagaaagtacaaaggagagtgaagagaggtaccagttactagtctgtaaacaaaacaatacttcaaaatagagatggtaaccctgggtcatgtcattcccaggtacattttgtgctaacatctgtaagcagtcagataatcaccactttaaatcatattttcatcacctgctttcaaattccttcctactttgcctctagagttgatttgtaggcaaatagtgtttttagtttgctatatcagcgtggacttaatagcacttaatacatatatctttaattcacattcatatttagaaacaaacattttgagtttaatattcgtggaatctatagttggaatggatatatttgtgtttttaattgtgctatttgagctatttaatttatacttgaattcaggaaaacatgaccacaatttttctagatcattgcccttatcatttgaaatatatttttatgttgctagtttcatactagcaaatcaagtcaaatcagtgttctgactttagttctgaaatgtcagatccggtgacatttaaattgctttgaaggctggccccccagcaattctgcctttattttgagagtgggtaggtgataagagactagaccaaggacttgttcagccatttaccaaatcaaaatgtgaggctcaaatggagccaaatgtgtggcagaaatggagcatccatttctgcttacaaactttcagtataaccaatgtatcacatagcaaatggtgaatgtggagataaaaatacaatttagactgggcacagtggctcatgcctataatcccagcactttgagaggccgaggagggtggatcacttgaggtcaggagttcaagaccagcctggccaacacggtaaaaccccatctccaggtgctaaagttgaacgagctgatggatatgaaccaccagtccaagaatctgtttaaagttcagacttaaaatagtggcaaataaaaagtcctcatttgtgatggtttgcttctgaaagaaaaaaaaaagtctctactaaaaatgcaaaaaattagccaggcatagtggtgcacacctgtaatcccagctattcaggaggctgacgcaggagaatctcttgaacctgggaggtggaggctacagtgagccatgatcacgccactgcactccaacctgggcaacagagcaagactctgtctcaaaaaaggaaaaatacaatttagttacatgaaagaggcaaaatagaaaataagctgaaaataaagagaaaatatcagttttaattgtggcaaacaccaaatctgtttacttcatgactcctgtgtcacaggatagagttaaaatcaggcttttgattagaatagagaggaatggaaagagaaaaacttaagtcgaaaacagaagatatgaaagggtgagttctaataaaaatgggaagctagagataaacataaaaatgagtaataaaaattttaagcttttcctagaattagaaggcagaacactcctggagaggaaaaatctgtgcaggcatgtgattgatgttgtctggctcagcctggccctccagcacacttgttaaaagctttcctcatggttatgacttcccagcacaaaccccacagctgcttcacatcctcccctcctgcggggccttcctaactacttttggagatggaggcatctttcctgtgcctctgatctcttcctttgcagtaaacactgagcccccagccctgccatgctgggctccaaacatccagcttctcattagaatcttaacactgccctctccaactgatttggtagactctgcaggtaccacatcacttgtcactgccccatttcattgactctaagaaagtcatttgtagaagttagcagtcagcttgcagatggtaggacaaaggcaggaccagcaccatattttctgactccagatcctgtaggcttttcctcactgccacttacaaacacacagagtgcttcctttaaaaaaacaaacaagtaaaaccttctcttgaccccgctatttctttcctactgccagattcttctaatatgatcgtgttcaaacccagcatggcattattggaaggactgctgactttggaattgggcaggccagggttcaaaacctaccctcatgatagctgtgtgatcttgaacacgtttctaagcctcagtttctccatctgtaaaatacctacctcacagtgtggttgggacatcaagtgacagtgactatattaagtacttagcccaatgagaggtgtgataattttaactgattattacataattgtctctggcatactgacctcaaccctgactcctccccaaaagttgatcttgctcaggattctcattaccttttctggctgaatcttgtggtcttttctcagctttcagccttctccagctatttacaacttaatttcctctactctcttgattttcttaatattattgattcttcctttccttgtggcttctcttttgtcaaattttctgacttctttttctcattctacccttatgtaagtcaatcttctaaggttccatctacgatcattgctctgttgacaagactaagttgaattaataaatcagaaaggagataatattatctattttactttctgcagtacatccttagccttggttcttccttacctgtctcccttcgactttctaatataaaaatgtcacattggattttaagtcatcagcaaacgggtaaagccccagtgctattagcactggatggctttcattattctattccatgtagacatggcaagcgatttccatgcccaaactgttttgtatgatgatgatgatgatattaacaactttgttttccaaatagtattatagagtttacacagtagtcctacatacattatttggatttgttcttcaaagtaacattgtgaggtaggtagagtttggaattatccaacactttttttttttttttttttttgagacagagtttcactctttgttgcccaggctggagtgcaatgacgcgatcccggctcactgcaacttctgcctcccgagttcaagtgattctcctgcctcagcctcccgagtagcagggattacaggtgcccgccaccatgcccggctaattttttacatttttagtagagatgtgatttcgccatgttggccaggcttgtctcaaactcctgacctgaagtgatccacctgtctcggcctcccaaagtgctgagattacaggtgcgagccaccacgcctggccccagcacattttataaatgatattttaaaaattctgactttgactctaggaatagtgccttttctgtttaaaccatactattttttgttccctattccgtataacttccctgataggtctataaatgctagattttaggctaaagaatagacaacatatttttattttatttagggaaaactaagaaaaagaggtaaaaatcaaaacagtaaattgagttattagtttattagcagatcaaggaagagttacaaatttggaggctaagattttattagaagagttggggaaagtatttgtggtttgtttttttttttttttttgcttttggggaaagtattaagaaatgtgtactttttttattaaaagctcactctatactgtatatagatttaagcttgcaaaaaatatgaaaagctatagtcaaagattttaaagggtaaaaagttaagctaagtttaaatgggggatttcatctctctagttagagaagtatccatgttaccatagatcacatccattcattcatcattcactctaattgtcttttgttcctacctaatgaagtatgctgtatgtttgttttacagatctaaagcgggaagccagtatctgtcatatgctgaaacatccacacattgtagagttattggagacatatagctcagatggaatgctttacatggttttcgaattgtgagtgtgtattttaattcttaaagggtaaaacttgaagcaatgttggtgttggataatgctaacacttttctcttgaaatttagcagtagttgtgaacttatctgttcagaaagacctaaagtcacaagaaaaaaggattatgtcatcataaggtttacagtggcaaaggaagcaaaagctgggcatattcagttactcttcatgctttcagcatgcttcagagaagagactccaaaaggaaattgagttcagaggaataggaggaccccaaactataaacttctgaccagtagaagtcttagtgaagaagagtaggatgaaagtggaggcatccatgtagcaagactcttggcaactaaaaacaagtaacgacagacttagttcctcttttgatataatcaccatatggcatataagggcaattttatagatcacagtgtatcttgatttcaataagtcacttgatatgtctgtcgcagactttttgttggtaagatggagaattgtgagctaaggatagtacaactgggtcatccagctctggtcggatgattgtgtccaaagagattatataaagctttataggacagcatcctacagggttttatctttgatcctattctgttcaaaattgtaatcaggccgggagtggtgactcatgcctgtaatctcagtgctttgagagtctgaagcagggaggattgattgaggccaggagttcgagaccagcctgggaaacataccaaaacctatctctatttttttctaaaaaaaaaaaaaaaaggttgtaatcagtgactttgattaggaaaaaaaacagaagatatacttgctaaatattcaaaagataccaaggtcagaggttatattcattacctattgcttcataacaaaatgccccaaaatgtaatggcttaaaacaacatacatttattatcttagtctctgtgcatcaggaatgtgtgttccaacttagcagggtcctctggctctgggtctctcacaaggtgataataaagctgttggccagagctgaagtcattttgaggctccactacaatgtggatctgcttccaagctcactcacatgattgttggcagtcttaccttcctcacaggctactggactgagagccacaattccttaagagctgttggcccaagcctcccttggttccttgtccgttgggcctctccatagagcagcttccagcatggcagctggcttcatcagagcaagcaagaggacaagtgagagtatgagcaagacagaagtcacagtctcgtaacctaatctccaaaattacacaccatcacttctgcagttagaaatgagtcactagatccagcctatacacaagggggatgggattataccagggcctgaatatcaggaggtgaggatcactgggaggcatttcacaagttgccccctacaaagggctagctaacatattggctgtctacatcaaaattcaaaaatatttttacaagtttgtagcaaaggagctgaaacaaagaaggtgaaatttaagaccagttaatgttaactccttcattcaaatatgagtaagtgcaagatcagtgtgaatttagttgtgattatgtgaaaaaagatgtaaacattttagttgttgtttgcaacagcttaaaaagcgctgaatggaaggttatgctacattaattaggagtatatagtattcagaacaaagtcatactcctcccgttcaccctggaccattcatagtaagcaggacactggaatgtctgcagaataggataaccagaatggaaaggagcctgaaaattgtgtcatagagacacagccttcaaaatcttttctggcaaacctgctaaaagaattttgaggccaggcgtggtggctcatgccaataatcccagcaccttgggaggccaaggcaggcggattgcttgagctcaggagttcaagaccagcgtgggcaacatggcgaaaccctgtctctacaaaaaatacaaaaactaggtgggcatggtggcacacgcctgtagtcccagttacttgggaggctgaggttggagaatcacctgagcctgggaagtcaaggctttagtgagccatgattgcaccactgtactctagcctgggcaacagaacaagaccctgcctcaaaaaaaaaaaaaaaaaaaaaagaattttgaaaaacgtatgtaccccttcacatattttttaggttgatatataaaaacttttattgtgagaatataattctcagtatcttgaatattcttttaaatatgttttgtttgtttgtttttttgaacagagtctcactctgtcacccaggctggagtgcagtggcgcaatctcggctcactgcaacctccgccccctgggttcaagcaattctcctgcctcagcctcccgaatagctgggactacaggcacgtgccaccatgcccggctaatttttgtattatttagtagagataggtttcaccaagttggccaggctggtctcgaactcctgaccttgtgatctgcccgcctcggcctcccaaagtgctgggattacaggcatgagccaccacgcccagccttaaatatattttctacacaactgtagaattgcctgtttatctcattcactgtatggaaaatgtctgctatgtgacctacatggcaatgctagtccttattgtcaaatcactcagccaaatcagactcattttctgtcagggaaaaaaaaaatctgacttcatttttcaaacaaaattaaagtgttaaatggacatccctgtgacactcatcttagtattgattttgaattcttaaacagcttaccatgaatatattgcctggataaagtaaggtggaacctccctttttttctcaaactctctttgttttgctttcaaaggtctctccctccctcaggggctgtgcatttcccagccatctctttgaagttaggctttttgggttggaggagtagtttgccttttggatgggtaactggagatgtggagatgggtgattgtagttgtggagatgtaaaagaaaaaccgcagaccacagacttgtttacaaacagacaaaattatggaaaatgaagatatggaaattgattgccttaaaaatatcctagttcatgtgtctcctggaaggactttgggtattcccagagatacccaaatcctaggttgaagaccactggcctagaagagctgttgaaaagactgggaggctttggttatccacgaatgtattcgtttcattattctgctggaagagtccccaaagcagaagcccatagatagaacataatcaatgtccacagttatttgaaagattgtcatatataagactatatgcttattcagtgtggcatcagaggctgtaactagaatcaacaagtggcagacgtcacctctaactaaagaagacctttttgatgattaaacttactccatgaatgaagcagcctgtctcacagactatgtagtttctcactagaagcactcaagttgaagctggatccttccaaggggcctgaagataaggttttaattttggactagagatggcctctaacatcccttctaattttaagatattgtaattcttttgttttttttttttttttgagacagagtcttgctctgttgtccaggctggcgtgcagcggcgcgatcttggctcactgcaacctccgtctcccaggttcaagcgattctcctccctcagcctcccaggcacaggtcaccacgcctggctaatttttgtatttttagtagagacagggtttcaccatgttggccaggctggtctcgaactcctgacctcaggtgatctgcttgcctcggcctcccaaagtgctgggattacaggcatgagccactgtgcccggccaagatattataattcttttaaaattacttatctggtttaattttattctttattcaagaaatatatttctgtctgtatgtttattttctgagaaaactaagaacaagttgggtttgttttttgttgttgttgtttttgtttttaacagtctcactctgtcgcccaggctggagtgcagtggcgccatcttggctcacttcagcctccacctcctgggttcaagcgattctttgcctcagcttcccatgtagctgggactacaggcgcatgccaccacgcctggctaatttttgtattttttgaagagacggtgtttcatcatgttggccaggctggtctcacacccctggcctcaagtgatcaaccctcctcagcctcccaaagttctggaattacaggtgtgagccaccacgcccagcctcctaaaaagcaagttttacatactatataaagtaatgatcacagaaagcaaattttaaaaattcacctaaatttcaccatgtatgctaattgtatcaaaggggacttagtgacagtgtagtagagaaaaaaggatctttggtttcataaaacctgggttaacatcccagctctgtcacttttactaattatgtgaggttggccaagttttataagttccctgagcctcagtttgcttaccttcagaatcttcctaagattatgagaactagatgagaaactgtatgtgacttccctttgtaagtggtgaagtgctttttaactataaagtattatttccagtggctttaacaggatagttttagtccctcattgttgaagtagtctgtgtgggattttatgtaactaattttgtatgttgtgatggaaataattcatggttggctgtatatcgagatgagacctggttaaattggatattttccagtgacctgatcccagtgttaacccaaatcactagaacatggccttatgttttcttttgttttgttttcttttttaacagtgtaattgtggaaaatttcaaatgaaaagagagaatagtataataaaccccagcatactggtcaccaagcttcaatagttatcaaaacattttgccattcctattctgttcctcctgatgtctttttctcccctggagatttctaaagcactataatttcacctataaatactcttgtttgtatttctaacagataaggattttttaaatgatcatattattattatacctaacaaaatcaacaataattccttaatatcatgtcatgatcagttgatactcagttttccctgattgaacatgaattttaactgacagatttctgaatttagaattgttttattagctctagggacctgaaagtagattataaattcagttaaaataacttagttatttctcaaaagggccagaagcaaactagaaatagaaaattgttcttttgtatcattgttttgtaaattcacctcaacaattggccttgcacagttttttgcatcctccttatctcctgggtttcaaacaaaccaaaaatatcgattactctaagatttaaagtcatgtggagcaaaaaacaaagccaatgcacttgtgtatagttccacctactggctaggtgagagattgcttctatagctgctacgtagactaagctactccagaattgccctcatgtttctggcaacagatgtaattacccctggtatttaggggctcattgctcaggttatgggttatctggatcctttttacagtttttgtaacatgacacccatacagtgtagacaatgaaaggcaaaaaaataaaataaaattaggtcagttagttttgttgtttgttggctacttagaagcagcatttatcattttggtggagaaaaggctagacaaaacagcatatttggatcatgagtgagtttcttaatatggtgtccatatctgtctttgccacagactatgtataaccaacactcctttttttcttcctaaactgaagtcatgaaattatatggcccgagaatgttgtttatcatgttagaaaatccttagaactagttgatggctgggctcagtggcttacgcctataatcccagcagtttgggaggccaaggcaggaggatcacctaggggtttgagaccagcctgggcaatagagtgagacctcatctctacgaaaaaattttaaaaattagccaagcatggtggcacacacctgtagtcccagctacttgggaggctgaggtgggagaattacttgagccacagaggcagaaattgcagtgaaccaagatcatgccactgtactccagtgtgggcaacaaagtgagaccctgtctcaaaaataataagccggacttggtggcttacacctgtaatcccagcagtttgggaggctaaggtaggtggatcacttgaggtcaggagtttgagaccagcctggccaacatggcaaaaccccgtctctactaaaaatacaaaaattagccgggtgtggtggcacacacctgtaatcccagctactcgggaggctgaggcaggagaatcacttgaacccagaaagcagaggttgcagtgagccaagatagcaccactgcactccagcctgggttacagagcaagactctgtctctaaaaataaaataataataataataatagttgatatctacttaatcacaaatggtttataagtttaaagcatgcttaaaaacagagactcacaaaaccagaattttagatatggaaaagattagattagtaaatttcaaattttaggttagaaaatccggtataaaacttgttaaacaagcaggtacccaggtcccacctctagacattcacttttgcagatgtgagttctgaccgggcaggtcaagagatgattgacctttaaaatgggggtaatacaacataaaggctatatcatcattgtcccaacacacacagtagttttgtagacatctgcatatatttgcacatccattactttgggattacacttaaatttgaacctgtctgtagcaatttgctgaaacatattttaaatacaggttcagttttgaagacaggctgagttgggttatccccacaagttaaatatttatttctaagtgacacatttgggcttgtctttagtagtatctggtacttgagttaagctgtaaatcctaaattggctggccaaggaattttaattaccttattacagagcgattacatataccacggggagacttttacaataattaaatattgatttaaaacacatccgacatgatgtgtatcttttaaaataatttttttgtatcttttaaattttttatctttaatatttttaccttttatatctttaatttttttgtatattttaaaataatattagcagtttgtgtttttgtagctcacaaaggcgataaactgaaagctctttttttattattatttttttttggtctagtatttatgcctggggaagggagtgtttgtgaaatttatttatactgatagagtggaactgattactacttaccagcaaacttgctgcttaagggaaaatatgtttgtctcataccaagcaataaatatctgtactgtagcattttaatctatttgaagatttgctcatattttcatagctagtcttatataatctattttgattttttctttttatgtgtgatgatataaattgctatttgttctttcagcaaagtaaacatctcttttgactcacagtatcaaaatgtttagttgattttagttttgcaaactgtgtgtcagggatccccaagaccacccccaggcttgatgattcactaagaaaactcaaaggactcagcatatagtcatattcacagctatgatttattatagctaaaggatataaagagaaatcagcaaaaggaaaagatacattagctgaagtccaggggaaaccaggcacaagctttcaagggtctccccagcaatgagttgtgacaacacatgtgaaatggtgccaaccagggaagcttattagagactctgccctgggtttttattgggggctggtcacataggcatcttccacttggcacttaaccaaattccagactcccagaaagaaagcaggtgttcagcctaaatcacattgttagcacaaacagtttagacacagtgagtcagtcttttcagtcaggaatgtagaggaccgtcctgaaatccaagttcccagataaacctctcaagggccaaccttagtaggcctttcaagccttttatgagatagtagtttaggcctgctatattaactcttctgcacaaactaaaatagagataaatagaagaagggttttaaaagagttgatataaactcctggatctgcaaacaaaatataattgactgtaaagataatgacagggtttggagtttggggtttttttttttttctttttaactgtaaatacagtatcatttttatatctgttaaaaaacatttaggtggtcagatttttgtataaaacaaatcctggattgggatgttacagtatagaacagattttaaactttgaatgctatatgagaaaataaactattcagatgctactgtcttagaaatacatttgaaattgtcactccgataacttttcgtctatgacaactaatcttcaagccactaaaataattttgaataaatttgtgtacatataaaatctgaagaaaattcagttaattttctgttatttaaaagaagtatagtttgttcatttaaaaataaaagttattggccaggcacggtggctcacacctgtaatcccagcactttgggaggccaaggcgggcggatcacttgaggtcagaagtttgagactaacctggccaacatggtgaaaccctatcactactaaaaatacaaaaattagccaggcgtggtggcgggcgcctgtaatcctagctactcgggaggctgaggcaggagaatcacttgaacctgggaggcagaggttgcagtgagccgagatcacaccactgcactccagcctgggcaacaagagcgagactcagtcttgaaaaaaaaaaaaattcttagtgtacaacctttgccatatacataacttgtaaaaatttagaaattacagaaaattttgacaaaaaataatgtcttaattttgttataaaaattgtaacagaaataaatgtcattcacaaacattttggaccatttccttctattggaagcattttgctataccattaaatattttttggatacaatattttaatgacttcattaagacatctaaatgtgtgcatgtgccatgtttaataaattccctatagttcaacattaacattgtttttccctattagaaataatttataattaatatcttgtacataattacttgttcacgccccttgattgctttgtttcctcagaatacatttctgaaagtagaataactgggtaaaagagtatatgaatacatacaaatacatacatcatacttagatttaacctttttctcagtacaatgcctcacattttgaaaaatacattcacataaatatacaacttaaagaattattgtagaagtgaacaaccatgtaactataacccaagtcaagaaattttaaaactgccagtacctcaacagcccctgaattcccctttctcatgataatccccttcttctctcagaaataactaatctggacttcacttctgtgctttttatatccctagcatcaaaataggaattctcagaattctcaaataataaagttcactgtcgtctgctaaaatctattttttttttttttttttgagacgatgtctcgctctgtcgcccaggctggagtgcaatgctgtatcagctcactgcaacctccgccccctggattcaagcaattctcgtgcctcagcctcccgagtagctgggactacaggcatgcaccaccacgcccggctgatttttgtatttttagtagagacagggtttcaccatgttggctaggctggtctcaaactcctgacctcaagtgatccgcctgcctctgcctcctaaagtgctgggattacgggcatgagccaccacgcctggcctaaaatctttatttgaatggaatcctacagtatatactctatttttggtctctgagattcatctggttgctttgtgcagctgttcctttattttattgctatgtagtattgcagtgaacaaactcgcactatttattcattttaatgctaatgagtatttgggtgattcccagatttcactattttgtagagcagatccttccacgttgttcttcagccatgttttaagggatgtacttgtctgcatttctcatatacattttagaatgaggttgtcaatttccaccaaaacaaaaaaactattgagatttttgtcttgaattactatatcaaatcttgatagcaatttgagaataattgacatgtttacagtgttgaatcatccaattcgtgaacatagtgtctatcttcccatttatttagctctttgatttcttgcaataaagttttatatgttcctctgtagaggttgtgtacatctgtattagatttatgtattgtcagatttattcttaggtattttgtttttagggtaagtcagtttctctcattctcccttctctttccctttccttgtactaactttgtgttcctattcatcaggcttcattaattccaacaattaatctgtagaatcatttggattttctccatacataatcatatcatctgtgtataaggaggatttgatttgccctttccaacttttttacatcttttcttgcctttattacaatggataaaacattcagggcagtggtgatggcagttatctctgcttatttctgatcttagagtttgctaagcatgaatggatcatgaattttatcaaatgtcttttttctgcatatgcagtcatgcatcctataatgatatttcagtcaacaacagactgcatatacatgggtgctctcataagagtataatggagctgaaaaattcctatcgactagtggtatcatagctgtcataacataatagctcaacacatcactcacgtttgtggtgatgctgctataaacaagcctgtgctagcagtcatataaaagtataacacatacaattatatacagcacacaatacttgataatgataataaataactctgttactggtttatgtatatactatacttttttgttgttttgtttttattttaattttatttattattattataccttaagttttagggtacatgtgcacaatgtgcaggttagttacatatgtatacgtgtgccatgctggtgcgctgcacccactaacttgtcatctagcattaggtgtatctcccagtgctatccctcccccctccccccaccccacaacagtccccagagtgtgatgttccccttcctgtgtccatgtgttctcattgctcaattcccacctgtgagtgagaacatgcggtgtttggttttttatccttgcgatagtttactgagaatgatgatttccagtttcatccatatccctacaaaggacatgaactcatcattttttatggctgcatagtattccatggtgtatatgtgccacattttcttaatccagtctatcattgttggacatttgggttggttccgagtctttgctattgggaatagtgccgcagtaaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcctaccaacagtgtaaaagtgttcctatttctccacatcctctccagcacctgttgtttcctgactttttaatgattgccattctaactggtgtgggatggtatctcattgtggttttgatttgcatttctcggatggccagtgatggtgagcagtttttaatgtgtcttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggctttggttgccattgcttttggtgttttagacatgaagtccttgcccatgccttgtcctgaatggtaatgcctaggttttcttctagggtttttatggttttaagtctaatgtttaagtctttaacccatcttgaattaatttttgtgtaaggtgtaaggaagggatccagtttcagctttctatatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagttgggtagcgtgatgcctccagctttgttcttttggcttaggattgacttggcaatgcgggctcttttttggttccatatgaactttaaagtagttttttctaattctgtgaagaaagtcattggtagcttgatggggatggcattgaatctataaattaccttgggcagtatggccattttcacgatattggattcttcctacccatgagcatggaatgttcttccatttgtccttcacgtcccttgtaagttggattcctaagtattttattctctttgaagcaattgtgaatgggagttcactcatgatttggctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcttcttttcctaattgaataccctttatttccttctcctgcctaattgccctggcctacagtatgttttaagctaagtgttattacaggagtcaaaaaggttttaaaattttttaagtttattatataaaaaattatagtaagctaagatttattattgaagaaagaaaaatacttttatataaatttagtgtagcctaagtgtacagtgtctagaaagtctacaatagtagaaagtaatgtcctaggtcttctcattcactcatcacttactgactcacccagagcaagttccatgaatgcaagttcccttcatggtaagtgccctataccagtgtaccattttttatcttttatgctatattttgattgtaccctttctatgtttagatacccaaatatgtattacagttgcctgcagcattcagtagtcacatgctatgtaggtttgtagcctaggtgtgtagtaggatatcccatctaggtttgtgtaagtacactctatgatggttgtacaggaacgaaatcccctaactatgcatttatcagactatatccccatcgttagcaacacatgactatattgaaataattatataataccatccttcaatctattgctgtagtgaattgcattgattcttgggttaaccaaacctggtcatgatttatgatcttcataatcctttttacatattgttgggtttggtttaggctttctgtgtctctcttttttaatttatttttacttttttttttttttttttgagacagggtctcattctgtcatccaggccatagggcagtggcaccatcacagctcactgcagcctcgacctcctgggttcagttattcctcctacctcagcccctttctgagtagctggaaccacaggcgtgccaccatgcctggctaattttgtagagatgaggttttgccatgttgcccaggctggtctcagactcctgggctcaggtgatctgtccgcccagcctcccagagtgttgggattataggtatgaaccactgtggcttcctggttttcatacctagattacacttgcctcataaaatgaattggggaatgttctctcggtttttttgttgttactattgttctattgattgattgattgactgagatggagctttgctcctgtcgcccaggctggagcgcagtggcgcaatatcagctcactgcaacttccgcctcctgggttcaagcaattctcctgcctcagcctcccacatagctggaactacaggtgtgcaccaccacgcctggctaattttttgtatttttagtagagacagggtttcaccatgttaaccaggctggtctcaaactcgttacctcaggtgatccgcccgcctcggcctcctaaagtgctgggactacaggtgtgagccaccacacctggcctctattgttctctttatgtgatttgtagaactcacctctaaatccatccaggccagagttttcaatcttagttcaattccttaaatatttataggaatattcagggtttttattcattactgtgtcacttttagtaaactgtattttgctaagaatgagtgcattttatctaaattttaaacagttttggcataaagttcataataccactgcaggttctgtagtcatgtcttctttttcattcttgatactggtaatttgtgccttctctttttctttctcagccttgccagacatttaccagttttattattcttttcagtgacaacttgtagctttgtaattcttttttttttttttttttttttttttgagacagagtctcactctgttgcccaggctggagtggcgtgatctcggctcactgcaacctccacctcccaggttcaagtgattctcccaccttagcctcccaggtagctgggattacaggtgcctgccaccatgccaggctaatttttgcatttttagtagagacggggtttcaccatgttggccagactggtctcaaactcctgacttcaagtgatccgcctgcctcggcctctcaaagtgctgggattacaggcatgagctaccgcgcctggcctgtaatttctttttattgtgtgttgttttctattttagtaatttctacttgctgttatttccatccttttattttgggtttaattttctgggagctttttcccttttagtttcaacctttttgtatccttgggttttatttgtacctcttgttaaaggcatatagttgtgttttattccagtctctcaatctttgtcttttacttggatcatttagtccatttacatttaattatattttagtatattttgagttttatctatggtcttatgtgttctctatttgcaccacctattccatgtttttttctctcttgatttatttgaatcaaatgaatatttttatcattctattttccctctgttaattttgaagtttaagcactcttttctgttatcttagtgtatatcccagaaattacagtatgcttcgtaacacatcaaattctgatattgataccattattgtcctcctgaacagtgcaagtactgtagaacatgttaattttatataattccttccttgacttttaggctatgtttttcatgtatttaaattatattcgtgtgtataaaaacataaatcccatgtatttatatcatctcctatttcttatattatttgtatcgatttggatttacccacacacttatcctttgtttgttctttattctttcagcatctctaaggttttatctgggttcattttccttgtgtcagtctgctggatgcaaactttccatttttcttagtttcagagttatttcttatatccccttcagtcatgaaggatattcactgggtagagaattctagattggcattttctttccattagatatcattccactatgttctggcatccattgatgtggagaattcagctagcaggggctgtaacttctctgaaggtaatgtcattatttctcaggttattaaaaattatttcatcttttgttttctgtagtttgtgatgtgtcttaagagtgtgcgtatgtgtgtttgaaccttgccttaggttctttgttttttcaatcagtgtattgatattattcatggttttagaaaattctcagccattatttcttcaaatgttgcttctgcccctttatctctttcgtcagctttgtgaccaaattaaatattggtagaggtataccttgtggtattttctatgtcttctaccttcttttctgtattttgcatgtttttttttctccatgctttggtctttttgtttcttctgtcctctcttactggtctctttctcttcagtactgtttaatctgatgttaatctattcactaatttttaaatgttaattatatttttcagttttatgtttctatttcctttttaaaatctactgtattattttttggccgggcatggtggctcacacctgtaatcccagcactttgggaggctgaggcaggcagatcacctgaggtcaggagttcaagaccagcctggccaacatggtgaaatctcgtctctactaaaaatacaaaaaaattagctggacgtggtggcgagcacctgtaatcccagctacttgggaggctgagggcaggagaatcgcttgaacccgggaggtggagtgagccaatcagcctgggcaacaagagcaaaactccatctcaaaaaatagatagatagccagccagccagcctgggtaacaagagcaaaactctgtctcaaaaaacggatggatggatggatggatggatggatggatggatggatggatggataggtaggtaggtaggtagatagatagatagatagatagatagatagatagatagatgatagatagatagattgtattatttttggcttttattctcttgcaaaaaaaaaaaacaagctcagcttttatgttctagggcatagtaagcttcattgtttgataatctgtgctggataatctcagtatatgaagtccctgtgggtttgcttttattgtctgttatttttgctggttattggtcgagatctcttatcccttcatgtaccttattcatttttgtcttgtgctagaaattatgttgaaaattattggcctaagatgatgctttctttctccaaagaggaattttgttgttgttgttgttgttgttgagacagggtcttactctgttgcccagactgaaatgctgtggctcaatcacagctcactgcagcttctacctcctgggctcaagtgatcttcctgcctcagcctcctgagtagctgggatgacaggcacacaccaccacagccacttaattttttttatttttagtacagacatagtctcactgtgtttcccaggctggtcttgaactcctgggctcaaggaatcatcctgcctcctcagagtgctgagattacaggcatgagccactgtgcctggcccaaagaggatttttatttgctgcttctactgcgaaccttcaggcacctagctgtttaagactttcttactcaagatttaaggcttagattttcagtgccacctagatgtaaagccgggttgcaagtctgtgaaggggctgattgcttccagttcacccctagctctttagggcatcagctcagtgctggagagtagagtttatcagattctcttgaattctcactcattttcccttttgagcccaggaattagagaccagcctgggaaatatagtgagacctcatctctaaaaaagtttaaaaattagccaagcatgggggtatgcacctatagtcccagctactcaggagactgaggcgggaggatcacttgggcacaggagatggaggctacaatgagccaagatcatactactgtactccagcctaggcgacagagtgagactctgtctcaaaaaaaaaaaaaaagaaaaagaaaaagaaaagaaaaaagtactttttttttttacttatttagttgtcttcaatgggagacatcatctagtctaccattacaagaagcagaactctagcaatgtatttaaaactcttttaacgtagttttcatattactctccataaagatttaccaatttatattcacacatggtaaataaatgtatctatgtttacattttgataggtcaaaaggatgttttggtttaatttgcatttattttgtcattagtgtggtcaaatattttaaaagtaaatttacccatttcttttgcatctagtcactttcattagttgtttagttttccttagttgttttagttgtaagaattcttttttgtttgtttgtttttgttttttgtttttaatagagatgggctctcccttgcttgcctaggctggttctgaactcctgggctcaagcagtcctcccaccttggcctcccaaagtgcagggattacaggcatgagccaccacacctggcgaagaattctttatttgctaaagatatttacctttttcatgtatttgtaaatattttccccaaatctgcctgttttattttgcttgttgatttttttttaacatgcagaacattaaaattctgtcagaaaattacagataagcaatagggaaggctagaatgaactcttagctactagattagagttgaagacagcagtataatctcatattgaatttattatatgtacacacacgcacacatacacatatacatgtacagatatatacagaaatcataaattatatgtgcatacatgagttagtacacatacattcctagctctgtccacttagagagcctaaagcatacccacacctagatttttgtttctgaatgtcctcctctaatttaagcagccagggatcctcggaaaaatgattataaattctagggctggaaaagagaaaatataagataaacatgaagcatcttagagtgcctgaaggtaaggaagtattcaaaaagatgggggcatatcagagagacataggaaccaacctgaaagcatgtccagtggccaaaactggaacaatttgagcaaaaaataacacagtatagattacaatccaaagtataaaataaatacttatgagtgcatagtgatataaagaaataattagataaacaattgagagagaaaaaaagaagaattccaagtgttaggtatagataatttccctccacccttgagtgtaggttggacttagtaactcactttcaaagaacaaagtatggagagggaaatagtaattttacagtagagagaactaacagattatcttcaccaagtgatcacattagcattaccagtgatcattcctgcgtatatcatccgctccttgatatgatgtgatgagaagggcatttcacctctgatattcttcccaagaaacccataaccctgacctaggcaagagggagacatcagacaaacccaaattgaggaacattctataaaatacttggccagcatgctttaaaactatcaaggtcatgaaaaacaagtaaagactaagaaactgtcaccaaccagaggagactaaggaatcttgacgactaaatgcaacgtggaatcctaaatggcaagggaaaaagtatatagttgacaaactgatgaagtccaggtaaagtctggagtttagttaatagtaatgtaccagagttactcttagcttttacaagtgtactatagttacctaagatgataacactagaagaagttcatttagtggtatacaggaactctctgtacaatcattcctcagtatatatgcaggggattggttcctggaacctcacgtgtactaaaatccacgcatctcaagctctgcagtcagccctgtggaacccatatataggaagttagccttccatataggcaggtttcgcatttagcaaatactgtattttttatctgcatttggttgaaaacattctgcatataagtggacccatacagttcagaactgtgttgttaaaggatcaactgtactatctttgcaacttttacgtcaatctaaaattattctaaaataaaaagttttctttactctaaacaaacaaaaaagaaaccatgagtttacaccatttccagtttaaagtagcaattacagatttttatttacaagacagttattaaattataaggaattattataagtaattttggtattatagttatataacaaaaaagagttcttaccttttggagataagtactgaaatatttatgcataatgctcttgtttttgtttttttgaaacagggtctcactctgttgccccagctggaatgcagtagcccaatctcggctcactgcaacctccacctcccaggttcaagccatcctcctgcctcagccccccaggtagctgggactacaggtgcgcgtcaccatgcccggctaatttctgtattttttatagagacagcgtttcaccattttggccaggctggtctcaaactcctgagctcaagtgatccacctgcctctgcctcccaaagtgctaggattacaggcgtgagccagtgcgcctagccatttatgcataatgttttattgatgtccgggatttgcctcaaaatcaagcagtgggtaggcagtgggtactatgttggaatacaggtgaaacaagattggccaatgtgttgttaattgttagagcagtgtaatgaatgtatgaaactctgtattttctacttttgaaattttccataatataaagtttttttaagtgagaaagaaattacatagtttttaactttttaagttttatatttgtatatcttatctctgaaaatctgggttccttgccacattaatatacttatttgcttcatcctactagtttaaatatgcaataaaaataagactattgaatgcagattaggatttctttgcacttcttttcatccgaagggtatatcccacaggaatgcacaatcaaaaccctgggttttaaagaaattttaaataactcttctcattgtggttttgccacaagcttgatatagatagatttaagtttgtttgtttgtttcagtttgtttttttatttacatagtttttattacaattttagattcacatacagctataagaaatatagatccttgtagactttgcccaattcttcccaaaattaacattctgcaaaactactgtgtcacagccaggatattgacattgatacaatccactgatcttattcagatatctgcatcagtttgtttttaatttttaaaattgtcttttttttctccttgctttaattttggttttagattatgaaaaacatgtatatgattacacaaagtcaaacctgtgaatagggttcattcagaaaggtctagtttgcatccctgtccccattcactttcttgccctaaagaaaacaatttttaaaaattagttattttatttttccattatttttatttgaaaatatgagaagatatgtatatgattttgtgccaccccccttcttacacacttccatatattctcatctaaaccttgatttttaaaaaattttaatatgaaaacactggggatcactccatggcagtaagtagacatcttcttcattcctgtttatgcctgctgaatactccattatggcaaagaattgtttattaaaccattcccctaatgatggactttgggattattttcagccttcttttactacatgaataaccttgtgcatacgttatttcatactgttgctaatgtcaaattccttcctcaaatgttgtgtcattttgcatcgccaccagcactgtctgagggttgtaggcttcaattttaaattgtgatttaaaggactaatctctgtcatataaattagtatatgtcttacttcattaaaaaactgtactcatatgtataaggctagacaaagagagtcatagataaattctgatttattttatggccctcatttatatctgtggacttgaccagaatgcttttaactagagtgggtttcttatcattgtaaggtcactaggtctaagaaaatttgtaatactcagaaatagagagaaggtcatttgtccctctgccatttgtttactttagatagtaggcagagtcattgaatcttattaggaaatataaaaaacatacttgctctttttgccagactcgaaaaagtactaaagctattcatatttcttatacacaccattgagagctcaagaggttcacaggaaataaaggcaagattttgatgggacttttaagacaaggcaaggatttggggtttatcttgaagatgtggatgccatcctaaggcatgtgatcagatcaccatttttaaaggttgtttttttttggctacagtatggctatagtataggaaggaacacatttggatatggggagaattgggaggccattgccattgttcagtatggatattgatggctaggatagatcagtgtcagcagagagcaacagaagtgaattaggaattagaaaggatagggtttgatgattagataaaggaagtaaaggaggaagaggagtcaaagctgacttgccgtctctggcttgggcacctgatatatgatggtgccactgactaacttgggcaaccctggaagcagatgatgcagtatactttggacatgctgagtttgaagtctctgtaagatatctgaatgaaaggactaaataggaagttagatatgtggattaggagcacagagagagatcttgggtagatacagagatttgggaatggttgctacttagatgatttagaagagtatatagagggagaagaaaaaaggacttgaggactgaggttcttccaaattttggaggttgtagaaaaggaggaatagctagcaaatgagatagagaaggaatagctgaagagatagaaaatcacgacagcaaggagttgcagaagccagaaaaaaaaaagtgtatcaggaacaatattataggaaaatgaagggtttgggtaattcttagttccatcctttactagattcctgtattcttcaactattgtcgagtgttcatgctctgcacagctcccattcggcctcatttctgagatgtgctgccttttggtatctattggtatctctttgctgccatttggtattcctatctgatatctcatttccttagtgagggacatagtgagtgaaagaacattagaggacaaatggaaaggcctatactgttgtcctagctctgtcaccaactttatttagtaattttgtttctttatgcctattatctgtgagatatagctagaatttcaggacagagatggctacacatggaaacaattacaatgagaagtaaggagagagaggaagagaaagagccgtcatagaggaggtgatactgagaattgaaggatgaccaggagtttgccaagtggtaatggcaaggatgaaactagaaagaagtagtaaatatattataaagatacagaaatatcataaagctttctttttgagacagggtcccactctgtctcccaggctggagtgcagtagcacaatcatggctcactgcagcctcgaccacctgggcccaagctgtcctcacacctcagcctccaagtagctgggactacaggtgcacgctaccacacgcggataatttttgtatttttttgtagagacagggtttcaccatgttgcctgggttggtctcaatttcctgggctcaagcgatccacccacctccgcctcccaaagtgctgggattacagacatgagtcactgcacctggcaaaataataaaatttaaagaaagaaaatagaatgaagccaggcctcataggaactaggaaaaaagatctcaggaatccaagttactgttctcttcattccttagggttttgtgtctactttgctctggaagaaccagctttctccagttactcaagcgcttgcacatgaccccaaaacgggcaccccagtttccaaaatttgtatgaccttgaagcccaagtaatttctttctgcttttcttacttcacattccagatagaaaaaaaataaacatgaatgagtgaatgtatctatctgattatctcagtttcccccccttttttctagaactgagtatcctaagttgttgacctgacccccctatagataaccttcttttgaatcagggatctgtttcatccagtggcaaacagaagcccactgctgtttccatgattgggctggggctttagatgggagagtttaatagaatatagatggcaaatcgactatatgagtgggaaaagagagaggcattacaggcaggcaaagagcatgtggaatgaatggccagaaatatgagccagcttgtgtggttgggacactgctaatagtggtgggctatgactttggaacaaggtgcaagatgagagaatggagattagcttggatgtgtacaaataaaaccatcggtaagtatgaaagagaagctgagagtcatagaggccagttgagaatatccaacacacataaacaggaattctagaagtagaacatagagggaatgatgaagaaaagagaccttattcaaaaagataatagcccagaactttcccaaattgaagaaacattgtaacctcagatagatgtaaggtttggagaagaaaattgctaattttcttggattatttgagtttatggtggttgtaggatacccacctgtaggtgtctactccaaactgcctgagtctggcccccaggagaagaacctaggctagcaataagagtttaggaggcattaccattagcacagggtccatttcacttcttggcacctcagtttctaccctagcaacttttgagaatgaaatgaagtgtaaaagtactctgataatcacaacactacatagttttaccattgtcttcattgtcattgtcataaattctattgagtatagagcctcagtattagaggagaagagctaaggaacctggagccagatttcctatattcaaatcctggctctgctactttgtaaccatgtgaccttggacaagttatataacatttgtcttaagcctcaatttcctcatctgtgaaatagtacctgtctcctagtgtttttatgaggattaaataagttactacttgtaaagcactttaaatggcacttggcatgtagataaatgcccagtaaatctttgctattagctattaaagtacctgcatttcacaggaaccttcagtatcttatttcagaggagtgactaatgtaaaaatcatagtctatgaggataataaatttaggtatctgtgtcttcctgtaatactcaaaggatcagtttagttaactgctggcttttgtctatgtaaagagttttgtggttgtttgcaaattgctcatgatgttatttgaacattcaaggacttctatttttttcttggtaatgtctgaaacttggaaataattcatgggcatatgggatattctcctgaggacacaataatggttccatttttcttgctaagttggaacaatttaatcttgagcaaatacctatgcttgtgcttctgtttttgtttatatctgtatacatctatagttttacaaataccaatattgacattttcattttagccagaaacttgcctaaaagtaagattacacgagctagtttgatttcagagtgcaaatggcagtaaaatgaaagcagaaaataaaaaattaaccatatgattattttgtaatccccagtgtgtttgttcaaggtgagatcattttccagattcatccttcacctgtaccaccttcctgatctgcaaggccatatcagggctggcatggttatttacagttatttagatgttctgtgaggcagataaacagaagacaggacacaagtagaactgtcaaaaaaaaaccccaaaatccatgaattccacaagcgactagaaggaacttgttgtggttttcatatctacatcgtttgaaagggcactccctctcctagagatcaggagctgtactgttagtgatggcaggggctgcactgatacacctgcctctgaatgaagagaaggttttgaggagcaagaaggagaacttatttctagagagaagaatggaaataagggctagagagacttagaaacaatcgcagatacacatccataccagagttacaagaacttacacaggatagcaagcaaactgatgcaatggttatgactgatttggtttggggtggcagaggatccatcccagcttctacctgcaaaagtaagtaggactaggtcaaaggtctaagaaacttaaaaaaaagtgtgtttaaactagctgaactaatacatccagtagataaagaattgcacataaggtatttgtataataattttttttgaattaatgaagttaaaaaatttggggagagagggctgggtagaagagagagaaactcgagaacttgggcctttaaaccctgcaagcataactggggccatttaactaaccaacgtcctagttgaacagagctcattttgagtacagaaacaatagtagcttggaaacttagttctacctaaccccatgaaaccctgtctgtctcctggtcagttgggaaagaacttgtgaggatttcagtaattaaaaaaataatccccttgaagaattagaatgtcactgttctctcgataacccccgtaagtccaagttaaggcaatagcagcctcctccttcaaaaaggtgaacaggaagcatggagttatacagcgggctgagaatcaagagactgaggttctagtcctatctgctattaattagttactaacctaaagcaagtctcttaaacttccagttctaagattctgtgatgtaactcatcgtgatttatatctggaggtccctccccctcactttagtgttagagattagggaggtgggtgtttagctgtgaggattagtgagtacactgaggactaacagtgaagttcctacatggtagaagctagaacagaataggggctattgctcttatctgccttgctttttttctggaaattattagaaagccatacagatatgtatgttaacgtaaacaacaaatccagaggtcgtcttagaattatttgctatcccttgtagctggagcttccttatccactaggaggcaccattgtcaaacaacattgattaggggtcaagagctcttgatcatttaagcaattggagaggaaaaatgtctagaaagaagaaaaaagaggtaaatataggaccctggaaattgtgaaaaatcaatctttgttatctagatggacattagaacagttctcagtttctaaaattcgataaacagtatttcagactacatatcaattttagaagtggcaaaatctttcaaggcagtctttttttcgaagaaacaaataagatatgaaaaaagaccttagaaattactgagccaaatcccatctttattgaggagtcatgatcaacccagaaaggttaagtgtcatgaccaagatctgccaggcttgagcctaaaaccgatgtgtagggggggcatttctcattgattttggccatcccaacacctgaactctcttcaagtatttggagaatccctcattttaagagccttgataggggaaaaaatcccatattctactataaaagctaaaaatggcagatatttgcactactaaacatttagacccacagaactaccacaggacacacttggcatcagattcacttagaaggatacaggacagggggaaagaaaaaacagctttttagtcaggcagcaccaggcattcctctgcagtacgagtcctttcagtagtatatacaataaagttcagtaaatataacagggaaaagaaagatttttaaatagtgttgagaaaacaagttaacagttcagaaatcaatttagattcacccttccccacacacatgcacatacaacaaaaatactacaaacaaaatagagttgatagaagctaatcaaatcataggaaagctagcaaaagataaaattatttaacagatctttagagagcttttaaaacttcaaagaactgggatccacaaagaaaaaaggtatcaatagatttaacaaaaattgaaaaaactagaaaattaatttgcttcaatcttgacataaaaggtttacattctatcgaacataaagagttcaccccaacgaaagggaagatattaagcttcatacacaaacaggcaaggacaggaatagacagcttccaccaaaagaactacaattggtaaagaggcatttgaggatatgctcagtcattttaatgtctttgacagtatatcagaattgctttattaaacagtgaatattccctttctccattgaaaaggtgaaggtttctatctacttgcatatcttaattaacaatcctgaataagcaccattcatattgaaaaaatatgattatatcctatttacagtatcagtgcaagaggaggccttagctccatttatagcacctcagacattcccaaccccaaacccacctactatgttgacacatttcctggtgctccaggccttattgttctttgtcggaacaaatgccttgaaatgctgctgtcctcttaactaccatgtagtcaccaccactcccccatgctctcacccttgcttcttgaggacctgtctcagaggctgactactccatgaagactttctttttttttcctttttttttttttttttgagatgaagtctcgctcttgtcacccaggctggagtgcaatggcatgatcttggctcattgcaacctctgcctcccaggttcaagcaattctactgcctcagcctcccgaatagctgggattacagatgcctgccaccacacctggctaacttttgtatttttagtagagacggggtttcaccacgttggccaggctggtctcgaactcctgacctcaggctatccgcccgcctgggcctcccaaagtgctgggattacaggtgtgagccactgcgcccagcccatgaagactttcttaatctctccttctgtaatgtaggctcttagaagatgggatcttcatgtaactggtccttctatcctctacaaatagtagatgtttaatgattgaatactgaatgaaacataatccccccacaaatacggagtagtttagatggggaaagggtgaaaaagattatgcgtacatgactcctttctttcagaaatgaattcgccaccaacaaatatttgtatatattcatcaatatgtgggatagtatgctgaagacaaaatacctgtttatgctctctatttgtctatagacaattgtacagaccagaaggcacctacccatgaaataaataatagtaactgccaggtgcagtggctcacgcctgtaatcccaacacttcgggaggttgaggtgggaggatcacttgagaccagcctgggcaatataacaagattccatctctacaaaaaaatttaaaacttagccagacatggtagcactacttgtgaggctgaggcaggagaatcacttgagcctgggacttcaaggttacagtgagctatgattgtaccactgcacttcagcctgggtgacagagcaagactgccattcattgacttataaataaatacatacgtacacacaaacaaacaacttgtagtgtaggtctaaatgaccgtagagaggtacagattgttagggcctcataagttcattggaagaaacagttaggagctagaataggcagacaggcttataggaagttgataaagggcatcagcaccagtgtaggagtcagatgggtggaaaggtgaagaaaggacatcccaggcaggagcataaagaatgcaaaagtgttgggaaaagatggtagttatgggacatttgtgaagacatcaaaacagtaccacaaacaaagccctgaattagaaaaaaaacagaattaaagatttttttaaaaaagactgatttgtgtatgcaaggattacagcatttatcaacaaacttactaaatatagacaattcatttaaattatatcaataatatagtattcatatgtatcatctggaaagatggggacataggctctgtattttaaaaatccccctatatggttctggaacatggggcccccataataggcatgaaaatggatttcacatatggagcctttctttacattatgattttacctacttagttgtaatctcttgtcttccattaagtaactgaaagcctggagcagaagtgaggaagtttccctctttgtaacctgagcattttgtggaggataatgcatggactgtaagtcagcttgcctgagttagaatccaggctctaccccttacaagctgtgtgatctcttggtcaagttacttaacttttgctgtttctcagttttctcgtaagtaaaataggggaggtagtcataatacctatgtcgtagacttctcgtgtaaacattgaatgagttaatgcatataagggacttagaaaatacctttcacgtagtaagcactcaataaatgctagctttaattatttattacagcaaaataaggttacttctgtctttgaactgtatataaaataaaccaagcagtttaggtttggctacatctgcttcactcagtattttgtcttcaggattcagccatattcctttgtgtagctgtaattaatttcctttcattgctatatagtattctatacccattttatctattctactattgatggacattgggttgttcacagtttgtgaccattgtgaacaatgctgctataaacattcaggtacacatatcctggtccacataagcacacatttctttgaagagactgtgtttgcccagtatcctcctttgtcataaatcaagcctctatgtatgtatggttatgtttctaggctctctgttatgttctactgtgctgttgtctgtcctagtgtcaatatcatacacttaattactgagctttgtaggacattccatacatagtacctgtggacatggaggtgggggctaaattttgaaatcaagtacagcaaaaactccaagaggtgttattcttccagaatatcttgagtcttcttggccttctgcaattccatatacattttagattctgctttagagtttccacaaaacctgttgggattttcattcaaattctgttgaatctatgcttcaacttggaagacatcggctgtttacaatattgagtcttcttgtcagtgaacaggataattttctctccatttatttcatttgtttaatttctcttaaaaaaatcatacttttctccacagagatcttatatacctttcttttagatttatttctacattcttaaagaaacactcttttaaaatttcatataacttacaatgattttgctgaactctgcttagttctaattttaacttagattattttggatattctatatataccatctgtaattagtgactgtttcttccttttctattctcatacattttatttctttatcttgccttactgccctggctaggacctccagaataatattgagtttaaattgttagagtggactttcttggcttgttcctgatctaagagttttttaagttttttaatcacaaatacatagttttaagtgttttgacatttattgacctgaccacataatctttcatctttaatctatcagtgtacacaattatattaattccaaatgttaaaagttttgcattcctcgggtaaactcaatttggacctggtgtaattcttatatattgcctgtttggggttgttaaacttttgtttaggttacttgcatctatgttctttagtgaggttgtcttttaattgtctcatactgtccacagtaggttttagtatatggattaaactattttcataaagtgagttggaaactattcctgctttttattcttttatttctccttagaatgttcaatagaacttgtcagaaatgggctgggtgcagtggctaacacctgtaatcccagcactttgggaggccgaggcaggcagatcacgaggtcaagaaatcaagaccatcctggccaacatggtgaaaccccatctctactaaaaatacaaaaattagctgggtgtggtggtgcactcctgtagtcccagctattcaggaggctgaggcaggagaatctcttgaacgcgggaggtggaggttgcagtgagccgagatggcaccactgcactcctgcctggtgacagagcgagactccatctcaaaaaaaaaaaaaaaaaaacttgtcagaaatggcatctaggcctagagttttctgtctcagaagattaaattactgattcagtttcttgaatcagtaaaggattattcaagttttctaattctttttgttaattttggtgagttttatttttctgagaatttgtcggtttcatatacatttttaaatttgtgacataaagtttcagtatcatcttttatttctgcagcatatgaaatgatatctccttcattgttaatactgggtgctatatgtgtcttttctcttttctttttgttatcagtcttgccagagattcatcatttcacagggaacaacttttagctttgttaatttcttgaatatgtttgtcttccatttcattaatttctgcttctatttcctttcatctaatttctttgaatttaatttgatgatctttatgtaacttatacaggtagatgtttagttcttaaatgtttagcccttctctttttttgagtcagggtctcactgtgttgtccaggctggagtgtagtggtgcagtcatggctcactgcagccttgaccttccaggctcaagcaatttggccgtctcagcctcctgagtagctgagacaacaggcccctccatgcccagctaatatttttattattattatttgaagagatgggggtctcactatattgcccaggctggtctcgaactcctgggctcaagtgatcctcccacctcagcctcccagagtgctgggattacaggtgtgaggcactgcacttggccagcctttcttttctaatatgtacatttatagcagtaaatttccctctaagtactgctttacctacattttacaagttttgatgtgtttactgttattattattcagtttaaaatattttctaatgatttattctgagatacatgtaataaaagtatattgtctagtttccaaatgttaggaattttctagatttattaattgctttaaaatttatttatttacttttttagagatgaggtcttgctccatagcccaggttggagtgcagtggtgccattatagctcactgcagcctcaaactcctggattcaatcaagccttccacctctgcctctggagtatctgggactacaggcatgtgctgccatgcccagctaatttttaaatttttagtagagaaggagtctcactgtgttgcccaggctgatatcgaactcctggcctcaaatgatcctctcaccttggcctcccaaagtgctgggattataggcatgagccattgcacctggcctttattaatcatttcagagaatctatttgttgctttgctttttctctattttgtctctttacttcattaatttctgcttattatttccttctaccttcattgggtttaatttgctgttttttaaaacatgtctcatgatgagatgtcactgacttggtaacttttcatattttctaatattttaagtcagcattcacaatatttctattaaatttctaattaaagttttaaaacaagtttatggatacaaactactttgtaagtaccatttcatctgcattctgctttttttttttaacagaactgatttcctatgacaaaagtatagtgcctattcatttttttaaaagtaaaggtaaaaagaagaaaacaaaaaatttcaaatagaattctacccagtctttaacaccccattttaatagcaaaggcttcacactgcatctacttatacataaatatgcatatatatgtttatacatgttaatgtattatgaacatctatgtcaataaatatatgtctataacatcatttaatggcaatataatattctactctagttaccacaatttatgtaaccattctgttgggaatttaggttgcttctaatttctccctattataaatagctgtgataaacccttgtcattaaaacttgaccagtattcctaattatttcccttggaaggaaataattgagccgaaggacatatacatgtttaaggtttttgtcacacattataaaattgcccttcagaaagttgtattggtgtattgttctatcaatagtagattacctactttaagcaaggtttctccagtgccaagttgtgtatgtaacatggatcaccagcttcttaacctgtaagattggacctatgcccctcctcctttcagccatttttctatatttgtgggtctattaatggcaaaaccctgatcttgaaatgtaacgtaccaatcctgtacaagttttgatagtactcttttcattatcattgttaggaatatgttctgctgggcatggtggctcatgcctgtaatcccagcattttgggaggccgaggcagaggggatcacttgaggccaggaactcaagaccagtctggccaacacagaaaaaccctatctctactaaaaatacagaaattagctggacgtgaggtgtgcgcctgtaatcccagctactcgggaggctgacgcagaagaataacttgaccctgggaggtggatgctgcagtgagccaagatcatgccattgcactccagcctgggcaacagagcaagaccctgtcttggaaaaaaaaaaaaagttctaattttcattatgatgatttcttatttgattaattggctatttagcatgatttctcaatttccaagcatttagggttttctagttattttgttaatttatttctaacataactactttgtggttaggaaacatactctgagtactcgtttcttgcagaagtttttagactgagcttttatctccatagtaagcattgaggtttttggggtgttttttttttgtgtttttttttttggtgggtggggatggggtcttgctctgttgcccaggctggagtgcactgacagagtcatggctcactgcaacctcaatctcctgggctcaagcgatcctcccacctcagcctcttgagtagctgggaccacaggtgtgtaccaccacacccagctaatttttttttattttttgtagagacagcatctcactcttttgcccaggctggtcttgaacttttgtgctcaagcaatctgcctgcctcagcctcccaaagtgctgggattacaggcctgagccaccaccatgcccaaccagcattgaggtttttctgtgctaccaacatgacataccagaatttattctgtaccccatttttcatagtgcagctctatggtcccagccaggagcaaagggtgtttcatcagagccttaacctcttagatcaccctggtgcaaaagcaactggaccctgtcattctccatctgaccaccccaccccctcctacctctctagagttcctaaaagtacccctcctttccaaaacccacattcttcccctagggcagaagcagctcttgttcacctctttgagttgtaatcctttctctgttctcaggactagtttttcactcactatactgttaattctcacaagctttaacaaaaactttttgtttgactgggcacaatggctcatacctgtaatcccagcactttaagatgagaggcccaagcaaaaggatcgtttgagcccgggaattccagaccagcctgggcaacatagccagatcctgtccctacaaaaattaaaaataaaaaaattagccaggtgtggtggtgcatgcctgtagtcacagctacttcagaggctgaggcgggaggatcacctgagcccaggcattccaggctgcagtgagccatgattgtgcccctgcagtccagctctaggtgacaaaacgagaccctgtctccatttaaaaaataaataaataattttaaacatttcatacagtttttgtagttggcgtttttgtcatcctcagaaaaaatgctggttggaaaaatccagatttgctctgtacaacagtgttcttcaaggatatttgcagataagtaccaatctgtcaccagtctgccatgagatacatacagaaattgacagtaaacatttagaaactgttacagcaatttgacattgctgtgaaatcatagcacgtgattttgtgccttcaactccagataatcctgttgccaaagcagcatattttggagtggcatattctgatctccctcaatgtgcagccagtaataccttgtgcctcaagacctgtgatctgttttgtttatttgatgagtttggttttggataatttcttaattatataaataatgcatgtttattataaattttaaaaattcagatggatgaaaaggagagacagctaagctcattcataatcccattacttttcacaattcagactaaactgcccttaatttctctctgcatacagtatagaagtccacctcccccatactcttccataggagggtttcttctccctctcctttcattccctcagaatggagccaactaggaaaattcacaatgtgttctttgggggttcttgacagccccagaagcaccccaagatgggaagccaaagagaagagcaataaaagatgccttgtcagtttgtagaatcattatattatcaaataaagtttatcaaagaattgagtcatcaactttgttcaaaaggttcaaggttaggatatcaggatggtatgtattatgaatatgtgtattttaaatttcgttgaataaaatttgcataaataacagtatttttagtttttatttctatatctcatgaaatttaaaattagtagattgcttcttttactttaatatcaattaatattataaataatcaaatagctttaataatagaaaaatattttcacagtgatgcctctctttcagagtaacccttcaaagaatgtgcctgtatatttactaagttgcacaggtggttttgtttgatatctgtggttatgaagcattgaattaaaaaaaaacatataatggctgaaagatcccatttacaatagcaactaaaatataacatgtacagggaaaaagcctaataataaatactttaaaccaatataaagaaaatcgtaaaactataacttagagacatgaaaggaagtggagagacatatcatgttcattgatgagaatattagaaaatgttaatttctagaagttaacctatacatttaccatctgaatcaaaatacaaagattttttatagtttgacaaaatgattttaaaagtcaactgggaagaaaaaaatcataagaaaatgttggtgaaggccagttgtggtggcttgtgcctgtaatcccagcactttgggaggccgaggtgagcagatcacttgaggtcaggagttcgagaccagcctggccaagacggtgaaatcctgtctctacaaaaaaatacaaaaattagctgggcatggtggcaagcacgtgtagtcccagctacttgagaggctgaggcaggagactcacttgaacctgggaagcagaggttgcagtgagctgagatggcgccactgcactccagcctgggtgacagagcaagactctgtctaaaaaaaaaaaaaaaaaaaaaaaaaaaattggtgaagaataatgagatttttttttgccaaatattaaaagctgctactacagtattttattttgtctgtccatgtttttgtttttgttttgagatggagtctcgctctgtcaactggagtgcagtggtgcaatctcagctcactgcaacctctgcttcccgggttcaggtgattctcctgcctcagccttcagagtagctaggactacaggcgcaggccaccatgcctggctaatttttttgtatttttttagtagagacagggtttcaccatgttggccaggctggtcgcgaactcctggcctcaagctatccgcccgcctcggcctcccaaagcgctgagattacaggtgtgagccactgtgtccggccctacagtattttaaatggtaacttgatgcaagaataggcaagtcagtggaagaaagtagaaacctaaaaatacccccatgtgtgtatgcacatgtgtagagattgtcatttcaagtaccagtatttcagatatgaccagacaaaatggattgatccttgctgataattatagcacagggcagtaaataatttccaagtatttctcacggactggttccctccttagtctttatacttctcaccactttgctgcctcctccccaggctccgtcttttccctcatcccttctgggtccctccagaaagtcctctagctctcagaacatctcccaaattctttttggaaacaccagagtccattgaggcattttatttgtaagtatatattacatccctagaaaaagaattccaggattttccctcctatatgttttcatcttgcttcttcatggtccataatgccagctgaggtcgttagtacagtgaatccaaactggtgggataggaacaggttattctgccattttactagatctttgggttgcacatcaaatctgggatctggggctgatcactccacacttgtttaacctacctcaggttcacaacaattttcccagctctatgatcatcagtgatttcaaattcaccaatgtaaccatgcttcatcatcacagttagaaactggacagtaactttggagcacaacctaataagaacctggtgtttgcctctttttggtattgttgatgctctggatagcatcagccaggacattcatgcacaccattatggcagcatggagagatggcagaaagagcctaaattcttattgcttcattatgcaatcagtttagctctctccttttcctaacccctctctcatctaagttgaatcgtgcttaccctcatatatcacaattacaaaggaaaacgcctaagcaaaactgattccttcgctatgagatgttttttagtcctcatagatcaactaaccagcttaaactacagccagtttttaaaatagcgtttcttttctccccacaggacaaagaaatgaaaaatatttactctctgtagtaatcaaggaaatgcaaattaaagcaatcatgaatgacttttttcctcttatctaattggcaaagatggaaaaaaaataatcattatcctagtagagcaagggacacattcacacatggtagtgggagtataaattgttaaactgtttctggtcttgtgtatgtatcaaaagtgttattgtaggccgggcgcagtggctcatgcctgtaatcccagcactttgggaggccaaggcgggcggatcacgaggtcaggagatcgagactatcctggctaacacggtgaaaccccgtctctactaaaacaaatacaaaaaattagccgggcgtggtggcgggcgcctgtagtgccagctacttgggaggctggggcaggagaatggcatgaacccaggaggcggagctcgcagtgagccgagatgcaccactgcactccagcctgggcgacagagcaagactccgtctcaaaaaaaaaatgctattgtatataccccttgtcctagcaactcagcttgtaggaattttaccatacagataatcagagttgctcaccaagatgcatgatcacgttcatccaggctttatttctgatggtggaaaatgagtgctgccatactagggagtagactagaccattataataatgtttatagtagactaggcaactataaacattattttggagaagaatcctatttgacattggaaaatgttccttaggtgtgaaatggaaacttggtaaagtttttagagcctgtataaatgtgaaagtattttcattcatttatataaaaccacaccgagaatcaaataatagaatcaactgttcattaggtgtctacagtgtgtcttctgctgagtattaggtaggggtacattgaaagtataaatatattttttcttgttctttaggactttacactatcatggaactgttgtagggcttaaagatgtgcatttgttccttgcacacccagtaggtatagctataatcaatgggaagagcacaggacatagctagacagagatttcgatcttgtccctatcacatacttgtccactcacttagacaaattatttgaaaatgatgctgacctcatggggtggttataagtatgaagggaggcataacaaggactgcttcctatgatgcctcatgaataggaagtatgttagttcctttactttcccttccagaagtttctatttcctcagtataatatctgcagcaggtatattgggaaactgaactactgaatgaatgaatgaatgaatgagatactggatttaaaaatatgttataagccttaaagcattatgaaaatgttagctgttaatatttgcatagtttcattaatatgtataatatggcaaaattcatgtatacatatataggtgtatgtggggggagggggaggtgtttgtatgtgctaaatgttatggaccatatagagttgttatagaatgaaaagcaaaggaaggcattaatatggctggtaatcattgagggggcttccagggaaggtaggattggaatgaaaccttgaattaaggtaggttttgaaaatgaaaagcaatatatacaaaagtaaaaaagaaaatggtgtactcagggagtgataataagaccattctgcctagagaggaagattttcttgaaacatcagtggacaaggtaggtagaagaggcaaggtgtggccaagacaacaagaggccttacttatctagtaagaaatagaaaactactgtaagttctaagacaatatcgtgacattgcgttaccaacacatctatgtgttacaatatgtttgtagcgatgaactttgggaatggcagtgtaaacaaaaataaattttattttatatatgtcattgttttttccttccacagtatatagcctgaattttccatttagtggtaataacaatagcaagattgttttttaaatccttgtattctacataactgaatatttttggaatttgacttaaaaatatgcacacaaccctagcattgctgttttctgatgcttctttttgtgaaaacctaaagaaaaattatagtcaattttatatactcaatgttatttgatattactgttagcctactcttcctgtttctttccctgcagattttcaatgtgaagatgactgtcatgccctttataatttatgtctatatttcattgaaagaaaggagatttaaataacataacccttagcagtaaatcaactaataacttagttacaatgtattcactttcagtgttgtcttcctggaatttcctcttttcttatgttctttttcacatttttttacagtatggatggagcagatctgtgttttgaaatcgtaaagcgagctgacgctggttttgtgtacagtgaagctgtagccaggtatgtattgtatatctaatcaccagaggtcaagttgaaaataaaaaaagaaaatgacaaagacatcacatgacaaactgataaagagcatgctgctgctctttgctacagggaacatctctgttttagtatgtgttagtagaaccgatagtcactggaaatgcaaaataccgaacaatgagtttatctattaacatgggtttataggggccaggcacggtggctcacgcctgtaatcccagcactgtgggaggccaaggtagacagatcacaaggtcaggagatcgagatcatcctggccaacatggtgaaactccttctctactaaaaatacaaaaattagctgggcgtggtggcatgcacctgtagtcccagctactcggaaggctgacgcaggagaatcgtttgaacccaggaggtggaggttgcagtgagccgagattgcgctattgcactccagcttgggcaacaagagcgaaactcagtctcaaaataaataaataaataaaatgaaaacgtgggtttataatacaggcttacattttcagtactgctgtctttcccatttctgatgatttttgtacaggaagcggggatctaatagctcaggaaccatgtagaattctacttgggtttttttatttttgttttggcaaatctgcctcattagttcttcattttgccttttagtgatatcaaattatctcacaataattaaggaaaagtaaagaacagtaaaaggaagagaaataaaagcaccatttttaaaaatatatttgcttcaggccagtgtgagacctaccaatcaaatggcagctgttgttctaagtggagaagttgtttgtaaagacctaatgactcaaaataagaaggaaatatgggccgggcgcggtggctcatgcctgtaatcccagcactttgggaggccgaggcgggtagatcacgaggtcaggagatggagaccatcctggctaacacagtgaaaccccgtctctactaaaaatacaaaaattagccgggcgtggtggcgggagcctgtagtcccagctactcgggaggctgaggcaggagaatggcatgaacccgggaggcggagcttgcattgagcagagatcgtgccattgcactccagcctgggcgacagagcgagactccgtctcaaaaaaaaaaaaaaaagaagtaaatatgaaaaatcacaggagccatgcacgtgctgggccacttgcttatacatttagagcaacacagctttctgttttggttacattcaatcataattacccactcctgtaggttgcctttttaatacatggaatacagcatccctccttagtcaccagccatagtatgttgaagggttcaaactcacaaacatattaagtttttttttttttgcggggggtgcgggcggcgggggacggagtctcactgtgtcatccaggctggagtgcagtggcactatctcagctttctgcaacctctgcctcccaggttcaagtgattctcctgcctcagcctcccaagtagctgggattacaggatgcgccaccatgcccggctaatttttgtatttcttttaatagagatggggtttcaccatgttggccaggctgatcttgaactcctgacctcaagtgatccgcacgcctcaacctcccaaagtgcttggattgtaggcatgaactacctactgttcctagcctaggatttatgaaaactttttatcatttgaaaaacagttatattaaatgatttcctctgtcttaccatttcttttacaattatagcatcttagacaaacatagctggaaacaacttggagaccaccttaatacagctttgagctcagcatgacttgaatgtcttcaaattcattgccctgactccttctggctgaagagcaagggacctagtctcagggatggagcagccatggctatggcacaaaataaagaatatgctcaatgtgtggtcgctgtgtttttgtactgctggggctagggcgaaggagcaaatgaaagtttatgtgtgttctttaggcttctgatctatacgcggtagaactaaagctaaatattctcttttcttttgtgcaatgttctctaaagcacattccagggtttttttaaatcccatcttctattattttgagtttttattacaattttaaatttttattctttcttgtccctcaaaattttaaagcattctttcataccaaaaatagtcaatactagtgaaactcaatggaagaaggggatttttcccttcttgaaccacaataacacggggatacctggcaggtatgctgacaggattgatgtgaaaccagtaccacttttactctggtccccagtcatctttattgcttttccttaacttcaagcctatctctgccactgggctacatgtcaggataagcaggatggtagtgtgaagagatgatgtcatacaatgacatgacttgtggtctctcctaatcttgagatttatagaaaaggtagatgtttatacacatcaaaatgaaagcctattgatttttaaagccacctgtataagctgttaaaatggtgaaaggaactttccagagtggaccagaaaagagtagcattgggaccagtagatgacattgcaaagagagaggtttggaggcagtttattaaaggttcttcctctgaacaataaaaaaaagtaggcggggactcagaaagtattattatgtgtgtttgctattgcagaggatcaatgaccatgcaacaagggcgcgtagattcttccattggtttaatgacagatgacttctaatctttcttcgtcctctctgattctgtgatttattgttaggaaattcagcttgtatcagtattctagtgagaccgactgcaagaagactctgagacaccaagtaatcaaattgataatgttgtttttctccaactggctgagcttcaagaggagcagcaaagcatggcataaaataaaactgtgttcagtccttagtgcaacccaattagttattacctccatcctttcaggggtgatgagttgtggagtgagctaacacacaagatcagattatcaaatcaaactctcagagatcttcttaactagtaccaagctttactaaataatctcaaggatacaggcagtcagaaggctcaagtgaagcagagaagggaagggcagccccccacgtcacttcttactgcctcagaaatgcacctctggcccagaatagatgaggtttatactggggtttgtgggtttccacacacaaaggggagcattgcaaatatcttcattttacaccccagagatttggatagctccattgacattctccaggaagccatctgtgcctcagagatcccgtgttctacttaccatagtaatccttagccagagatatcctattaagggcatttcagagataaggtctcttctgcctagcaaatagcattaggcttttcacctgcattgacaagaatagcagactgaatcacctctcttctaccatgctgcacccctgaaatgcctccttccaaaggcagtaaatgcattgctggccagctttttccttccatggagttattatcttgctgatccttaggaaagataaagataaacaaatatattgctgagtttctctgaaagcacaggtctctatgatgcttcatgaagtgaagttttttgattaaaagtttagtcagcaacttcctagaacatgtgggcagattttagttcttgttttattctgcttgcacactttgacatgcattgcctcgcaggatcatgactgggagggtggagaaagatagttcagttctgttataacttgggaagaaaaacagttccactgtctccacacacgccgcaaagattctgctgtgtacatacgtttgggtcaagtaattgagtgttctcatatgcaaatgaaaaaagcctcattcattgagtttggttttgtgttatgagactttgagataggaattttctttaggttaaagataatttaggtggctgtctcagtgctttgtatccaaaatagttcattctgtgggtacaagctatgtccactttaactaatttaaatttacccagtatttccatgttgacatctagatggacaaataagctgttcctaaatctttgattgaacttaacaataataatattgtactaataatgtcttaacctttgtagcatggtttagagtttacaaagcactttgacaggtgtagtctcttagccatttcaaggggttacagatcttccaaagcctgatttgaaccagtaatgggccacaacaccaagttaacccctcatttgaacaaaacttatggccaggcgtggtggctcatgcctgtaatcccagcactttgggaggctgaggcaggctgatcacttgaggtcaggagtttgagaccatcctggccaacatggtgaaaccctgtctctactcaaaatacaaaaactagccaggcgtggtggcgcatatctgtaatcccagctacttgggaggctgaggcgggaaaatcgcttgaacccaggaggcagaggttgcagtgagccgagatcccaccattgcactccagcctgggagacaagagggaaactccatctcaaaaaataaaaataaaaaataaacaaaacttaattacaggctacaatggcccaagcaaagagtatatgagcacaaccccttatatgtgcatttgcaaagtaagataaattaaaacatcagagctaatgattacatgagcctagctctctggcttaaagccccgttgtaaggagcctgtgattagtacaggaacaaggcttgtgattagtacaggaacaaggcttgggtttgtttttgtttttgttttttctcctacctttcatttttaaaatggaacctttccaattaattgtaatacatgaaataatgcatatgctaactagagaaatattcctgtgagcttgattaaatggtatcatgccaaagagggaacttgatggaaatgtcttttaattgtaaagccaggatagggattttttttttttttttagtcctgagtcacatacacatgttcaaggtcacttgtatcagaaatataagatctggaaacaaaacaaaattctataaatattatacagtgaacagtgttaagtctattgcatttctgtcatgctggttgggaaggaaaagggaaaaaatgagaaaagaaggggaataggaagaaaagagacaaatatggagggaataaaatacagaaaatgaaacagatactcagagaaagagtaatagggcaattatagaagaactttagaaataggagaaggaggttctaaagtggtactgaatcaactgctcttgtcacacatggttgctagttaaccccattaccattttttaattcctgttctttaaaatgctgatttcttctttgttcttcacctgtgctccatgagggctcctcagctggccatgtaaggagtcaggctttctaggacatgtgcctagaattaactccactttgttcaagggagccccaactaaaacttgattatgttacaaaaagaaattgtccgataagggtggctcttccctcatttgtcctcacagctaaatagaagtaagatgaagagcatcttattatttgctggcagatcaaaggctcccactgcttgagtctgaatccttggggcagccctgagcactgtttacataacgcagtccagtttaagtagaattacctgagtattggggaaaaaaattgtcatgttttaagcttgaatttttagtttgcaaagcaaatttacttatgaactatgtgtaattcttttgacttagatagcttagaaaatatagagcatactatttcttcatgaagcccataaacttttgagtctgccaacattttcattattaagcctcactttacaccaatcctgtctgctcaaatcaaatgtgtccatggacagctaatatgagagtgggagttataaactaggagcactgtatattaagttttaaaataaaaattgtttacagtttttagatttcttttgttttttacagccattatatgagacagatactggaagctctacgctactgccatgataataacataattcacagggatgtgaaggtaagtcatttgttatcactaactttaatgtttgtgaagaaatactgatataacaatgataatcaagaattcttctttaatattgtcataaagaacatcttaattttacttctaagtaaaaatgtatttaactgctttgtatttgggaagtcattgtactaattcttactaggaacactataatttcaatttatttatttttactgaagtgttcatgcaatctaaaattgtattatttctcttttgccattgtgtgtgagagagaaatgaaaaatccaataaataggaaaaaccaaacaatatcctatactgagttaattgggggggaaattagaatttggtttatatagtaaaagttaatcataacatattttcataatattgcaatgcagaatagtcagcattgtatttttttgcagatagtttttaaatatagtatgaaatcataattatacatgtaatacgattttatgcttggaataccggtattatcattattcagtctttctgcctatttcatcccagtatcgggttaatgagaactctcagttcctggttctttaacggtgtcaagccaaacatagagggaggcaagaaatgagaccagtaggccttcctcctgatccctagcttctcccaaggcccagaatcactagggagcccctgaggtccctttgaccctgggctacacttttaagctctgatattttgtcactggcctttctctaacctccagcatgcacatacatagtgttccttccctcaagatatattattaaaggcctggcttcttcgatgtatttaatactttaaatgattaagaaaattaagtagagtttaattaaagtgtctataatgtttgggaaattttcacagaaatccttgtagttaaaagctgagggaaaacatgagcaattccaaaaccatctagtaaaatattttaatagcaaatgaaaatcactggagaaatatacaaaatacacattagtgtaaattagttgtaaaatatctcactcatccttttcagatgtgttaagaaaatgatattgttattatcagaactcaacaccgagcatctcaatgggtccccctttatgaaaaagtattctggccaagcccggtggctcatgcctataatcccagcactttgggaggccaaggcgggtggatcacctgaggtcaggagttcaagaccagcctggccaacatggtgaaaccccatctctactaaaaatacaaaaattagctgggcatggtggcacatgcctgtagtcccagctacttgggaggctgaggcaggagaatcgcttgaacccaggaggcacaggttgcagtgagccgagattgtgccactgcactccagcctgggcgacagagcgagactccgtctcaaaaaagtattcttcagttatccaaaaagaaataaaagtgtggaaaggtaaaaggcgggaaattgtcaactgtagtagtttgctgtgcagttattttgcattaattaatgtaagaaagttcatatgtagagagtaaaatatatctctttgtatatattctaaactatatacaagaaaaaaatgataatttaaaaacctaaaatgtgttcatgtaatagcattatgttaagaactgttttgctcaagaggcaattttattttgaatgaattattctcgaaagataattatatcaacatcatataataaacaatgattgacaatatattctactgtaatactttcaataatgtagtcagcttttgattaactggtatttgatatgacaacctaaacctaattaatatccaaaagtagataatttgacctcaccttttaatttaccttctgatttatttatttaacaaatatttgagtgcctactttatacagattactgtgcttggagccctaaaagtattatggtctcagtagggagataaggctcggtatctcttatctactgtagcagatcaacacatgccaaaacatagtgacttcaatcaataactgctgcttacttgctcacaattctgcagtttgggcagagcttgataggactgctcaattctgtttcacaggatgttggtgacgtagcgtggctagtttccacataggcttcactcatttttctgacatctcaactgaagtgactagaacagctgggagctggctgggcgctctttgcggtctctcattcaaaacgtctctctctctccacgtggccctatctccagcaagacagtgtcttagggctccaaaagagcaaaaatggaaggtgctaggcctcctgaagcaaactgacactgtgtcacatcttatgcatttcattagttgaaacatacttcacaaaaaggtcacaaggctagtctgagttcaaggggaagaaacatagattcatattttgattgatggagtgccagatatatacaaggatgggagaacttgttcgtggccacctttagaaagacaaataattattgtgcaaggtagaaggtgataagtatcattaaaagatgaggtcagagaagtttcctgggggaggtcacattggagcttgttcttgaatcatggggtagttatatggagacaaaaagacatttcaggcagaaggaacagtttgtgcaaaggcccaaaagtagtcttacgttggagtatgttagattagtttattatttctaaagtacatgctaaatagtttagaggaagcacgtagaaacatgccaaggaatgaaaaagaagtaattctcaaactgcaaataagtaagaagaaaccaccccaaaaattgccattgttcagttgggagacacactcaacacagagcacacgttaatgttgatattctttttttgtttgttttttgtttgtttgtttgttttgttttgtttgttttttgatacagggtctcgccctgtcacccaggctggagtgcagtggcgcaatctcggctcactgcaacctctgcctcctgggctcaagcaatcctcatgcctcagcctccagagtagctgggactataggcgtgcgccaccacacctggctaaattttttttgtagttttttgtagagacgaggtttcaccctgttgcccaggctgctcttgaactcctgggcttaagcaatcttcttacctcagcctcccaaagtgctgggattacaggcgtgagccaccgcgcccggtgttgatattctttatatttcagaagccgaaatccacacatttttacatgggtgaatagaatactcacatttagttaattgaaaatttttaatgttggtgtatttttcttaagacattcatccaaaagatatttattgagtgcctactgtgtggcaggcactgtcctaggaaccggagctacgtcagtgaagaaaacagacaaaaatcactgccctcatggagctgacattctagttcagggaggcaatactcagtaaacaaatgaactacatagtaggctagaatgtgaaaagtatcacagaaaaaactagagtggtcagaaggttagggagtgtccagagaagggcttgcttttgtaaatatggtggtcaaagtaggccacattgagatgatgatatctgagcaaggacttggaagagaggaagcgggctaatctgacagctgagggaagagcacttcagttaaaaggaacagccagtgcaaagaccgaaagacaggaacacaagtagcctgctcgaggaacagcaaggaggccggtgtggctgaggcaaaatgtgcaaagaggagagtaaaaaggagacaggagatgatcctgcctggctcagaccagagtagtagcagtggaggtagtaaaaaaaaaaaaaaaattagttagattcctgatatattttggagattatgccaataggatttcctaatatatctttggtaacgtaggcaaaacttagttttattcaagaccctgttacaggggtattccaacatagtggtcattgtaaaacttcaagaacaatacatttcacatgctaataatgtaaattttcacttggtttgatttgttaatatttttgccaataaagcaacctatgagcttttctttccattcagatatatattcagtgacttatctgtatgtagatttggtttgtatgtagatttttgtttctgcagttaaagtttttgtctaagttttctttccttatatttaataacgaaaacagaagagcattgcaatattttatttctctaagaaaaatttattttatcatctgtttcatctagccaagaatattctcattctctctctctctctcataattcttggcatatgatccaaaagcattacatttcccaaggatcctgttattatatttattaatacttttttctttacttttttacaaaaggtatttccttttgtaatcattgtaactgagtcttaaaaggattatttggttagatttgaatatatggtaccatgtaatctatttttgggaactgcttgctctgaagaagcagtttcacataaaactgcataaaaagcaatcatataatcctttgaaattcgagagatgtgtgaacatagtgctgggcctccccacagccacacttagtgacatatcaggctatattctttgctgtgggaggctgtcctgggaattgtaggatgctgctaagcatccttcacccactagatgccagtagcatctccccctagttgtgacaaccaaaaatgtctccaaacattgctaaatgtcccctggggcacaaaaattgtccctggttaaggcccactgtcataatagactgttataattctcaagatttgcctccctacaggtattaattaaggcatgcatataaatttctatttttttctgtcatcttcttccctttaattctactttttcttgtgaaagaatgtgaaaactttcattatgtttctggtatttttttttcttcctctcacccctaaattaaaagtactttagaaagaaatagcacagttgtcaaggtaaatgcaactcctggctctttgccttctttcatgggctctactaagcactgagagtttgtggaattttctcctctctcctaactcttgcaggcagccttagatcatgaggttgtggggagacttagttttagacctttctgtcactctgacctactcatgtataattctaataactgaagttgaagtgaaacagtttctctgagaatgcaaattgctacccacaatcactttctattctgaatggtgcctgtgcccagaaggtctgggtgctgtttttagttcttagaactgtgcaaaccccagtcacacacacactcagccagaggccagagtgtttctgagtgtgcttcctttaaatggttttccttgctaacctgtgtgaacacgcctggctgctttttggttcccttctggtctcagttctccttttacctatttaaggccagactttatgataaatttgtgtttatcatataacactggttggcatgacattgtggatttcttaaagcattccgtagtctcttgttctccgttactgatgtttcttttacacctgataccacaactccccaaagtttatcatgttgtatagagaaatttaaattctcataaaacaaaaacgtatttattctttatttattttatttatttatttattttttttgagacagagtctcactctgtcgcccaggctggagtgcagtggcgccatctcagctcactgcaagctcaacctcccaggtccacgccattctcctgcctcagcctcccgagtagctgggactacaggtgcccgccaccatgcccggctaatttttttgtatttttagtagagacggggtttcactgtgttagccaggatggtttcgatctcctgacctcatgatctgcccgcctcagcctcccaaagtgctgggattacaggcgtgagccaccgtgcccagccactattctttattattatattaacattggttaatcttctgcatttcttttataagattttttaacataatgtgcacgttcagttttaatgtggcattttaataattgtacttaggaagatctcatggattacatgattattataaatttatcttgtgtttctaactgctatacttctctttgcccagcctactcctacaaaaaaagaaatcaactccttggttttaagtttctcagcctgagcaacatagtaagaccctatctctctctctccttttttttttttttttttgagatggaatctcgctctgttgcccaggttggagtgcagtggcacggtctcagctcactgcaacctccacctcccacgttcaagcaattctcctgcctcagcctcctgagtagctgagattacaggcgcctgccactacgctcagctaattttttttatatatatattttttagtagagacagggtttcaccatgttggccaggctgatctcgaactcctgaccttgtgagccaccacgcctggccagtaagaccctatctctatcaaaaaataaaaattagccaggtgtgttggcacacacctgtggtcctagctactggagaggctgaggcaggaggattgcttgagcccaggaggttgaagctgtaatgagctgtgattgtatcactgcactccagcgtgggcaacagagtgagactccatctcaaaaaaaaaaaaaattcttttgcttattagaagtgaatccttttactgttcctctccttctgagccaggagtagcgtgtgtgatatagccagaggtttttctgtcaggtgcaactatagctgtagtaactcttcccagtgttatcaattccatttgagtgtaggggccatcagaggaaggtttgtggcattaggctgctggattgaaatgcttatgcttagcagattaccagtgttccctctgttctccctttgtggtttgccggcaggatttcctttcaccttgtcttcccagatttgcccgtaactcccaccctgacagagcacaaggccagtgataggcctagagtcctcagcaaattgaacagaatgggccatcttcctcttctatccagggagtagaaacttacttccctgttaagttgtttatcctaaattttgtctagtcttaatggtttgtgttcctgattatagtttgaaagctgccttaatgagagtatgtgtatgcctgttttctacagtttaagataaaatcttgttggcctttgagtcaaaatttgagattcctgaaaccccaaatttgtgtttgactgtaactcacacagacacattaaaaacactgtttttttgaaatccaaactttaaaatagggtaagttttgaaggtgattttaaaaccaggcacagtggcttgcacctataatctcaaaactttgggaggctgaagcgggaggatcgcttgagcccaggagttcaagaccagcctgggcaacatagcaagagcacatctctacaaaaaaaaaaaaaaaaatacaaaaattagccaggcatgatggcacacacctgtagtcctagctactcaggaggctgaggtggtgagatcacctgagcccaagagtttgaagctgcagtgagctatgatcaccactgtactccagcctggacgacagagacagaccctgtctccaaaaacagaagtgatattttaagtaaaatatttactatgccattaaatagccagttcttcaattacataaaaaaattcaacatgatttaaaatcaactgtttaggaaagcatctatggtgtaaagatatccatgatgataatgagctgagtatatagttcattcttcagtataggaaattaaaatgtgagtttatcagaatgagtaacttaaagagaaattgcatatctcttttcctgcctttttaaatgtaagaatctctagaaatattttttgtttaaagtagtggtagagctgtaaagtgattgttttttaaataattatttttagaagttgtattttttgggttttttgtttttgtttttgagacagggtctcgctttgtcacccaggcaggaatgcagtggtgcaatcatggctcacttcagcctcaacctcctgggctcaacagatcctcccacctcagcctcccaagtagctaggactagagacatgtgccaccatgtccagctaatttttctattttttgtagagacgtggtctcactatgttgatcaggctggtctcaaactcctgggctcaagtgatccccccacttcagccccctgaagtgctgggattacaggcatgagccactgtacctgactggaagttgtatttttttaaaactcctaagtccagtgagattattacatgcagtatagcttatgttaaacaaacattactgtcttagtcggatgagttttggtctcaaaactcatgtaagaataaaactacttagtctgggcacaatggcttgcccctgtaatcccaacactttgggaggccaagatgggcagattatttgagctcaggaattcgagaccaacctgggtaacatggcgaaaccccgtctctacaaaaaaataacaaaaattagccgggcatgatggtgggcacctgtggtcccagctattcagaaggctgaggtaggagaatcacttgaccccgggggggtggaggttgcagtgagccagatcacgccactgcactccagcttgggtgacagagtgagaccccatctcataaaaagaataaaactacttttgtaactgtggagaaatctgtgcatctcaggaactctccctgatggactttgagttactctatgatttacatgtctagaaatcactagattggacacttccatttacagctagcattcagggcggtcacctcaagttcccaaatctcctttgtctctgcacattaatgagccaaaaatccaattactactataaacgaattgatactcactgtaaatatttgaagccagaatgtgttcagacttttctcagaacattttcatgtctcagttaagcatcaaagtagaaaaggaaaaaaaaatttactgggtttttgtgtgtgtgtgtgtgtggttttttgtttgtttgttttgcccccggaataacctctggtgatttttgaacacatggctcttgggcaatgtactgtgaattgcttttacagctctaactcaggaacaaaacatgctatgagattaaagccttggaaggattacgtgaacttactttaaacttcattttggacactgaagtaattactatgtgaagaaaaaaaggagtctttaagcagtctctaacaaagtggcaagttactattaatggttgattttattcagctgtttttgtttggttatctgagaagagaatatcagtaccatggaagtagaaatagacaagaagtttatagctccaaagtgcttatgatctctttgggcagatagtacacgcttttttttttaatcataatatatgtacttattacagaatatagtcaccatcatttgtctactgacaagattacatgaaagaaaagaaattaacattaagaaatgcttatctttaaatgttcacttaaatattagaaaaaattggggtgatttacttaactatgcacatatacatacatacatacatatatatatatatatatatatatatttttttttttttttttttttttttttttttttgagacagagtctcactctgtcgcccaggctggagtgcaatggcatgatcttggctcactgcaacctccgcctcctgagttcaagtgattctcctgcctcagcctcccgagttcaagtgattcttctgcctcagcctcccaagtagctgggactacaggcacacaccaccacgcccagctaatttttgtatttttagtagaggtgggtttcgccatgttggccaggctagtctcgaactcctgacctcaggtgatctgcccacctcggcctcccagagtgctgggattacaggcatgagccaccgcacccagcccacttcaatattttcatcagtaaattagtatactttagagttgtggtgattaaaataatatatgtaaagcatataagtagaatgcttggcaaacagcaagtgcttactaagcgttagctactcataatagtaacagctgatttaataataggatctgtaaataagatagtattttctgctctacaaatgaagaaattaacacgtacagaggataagttaatttgcctaagattgtccagctaaataaaaagtagagccagattgaacccaagaagtataacttcagagatcaatctcttaactgcaatactattacactcccttattattcattcatttatttcacaaaaaattaactgccaggtactgtttgtcactaataacattatttatattgaatacagaagaaaatatgcacaatgtgatgaagatgggcatataatgacatagctttttactttgacaaagcctaatccaaatatttaagcatttttataagtatcatctgctttaaaaatatagtcaatgaatattgcttctccccaataacatgagccagataatttcaaataaataatatgtttataaaaccttggatttttttcactgtattattcatgcatttaggtaagatgtgaatgaggatatttcttatttatttttttacttatttttatttttttgttttgttttatgagacagagtctcgctctgcctcccaggctgtagtgcagtggcacgatctccgctcactgcaacctccgtcccgggctcaagcgattctcctgcctcagcctcccgagtagctgggattacaggcgcccaccaccatgtccagctgatttttgtatttttagtagagacagggtttcaccatgttgcccaggctggtcttgaactcctgacctcaaaatgatccacccacctcagcctcccaaagtgctgggattacaggcgtaagccactgtgcccagctacttatttttaaagattttaaaattaccaataaacactagccatagattgacccttgtattctaactaccagaaagcagacaagtcataaaccatttgcttctttatcctagtcatgaaataacgtgttctgaacagaagcactgacagttgagtttaaacagaaaacagcctgttagtttcatatgagtgggatcctttcaatatgcttaatttttgcttctgaaagtttctgccatctcaacgttcagtataactgttttttgagttttatgaatatatgtttatttatttttaaaaaccaaagagattttcttggtgattattgtcaaccaagctgtgacatgttaatgatgtagtttagtgtccctaataaagtcacatgaatgcttttcttaatattgtggggttttccattcaaaagtcaaccatatgattgcatatgtgctgaattagactttgtaaagagattatatagtgtcttcttgaatgttttatctaataaaagaaatataatggggtctgtgctacttctggccgaagcaagacaggtgagaatgttttttgtttctattaaataattcaattgctgacagttatctctttggtgtagaacataaaaaatgggtttaaaaatactataaggaaggaagcaaactattagtagaatctggatgaccaaaagatgtcttttcacagaactgtaagtcaaatctttctccataatggacgtacaggttcttatttttctcagatggcttacaaaagagtagtatgatgttagtactactaaaaaggaaaatccaataaatgtggttccaatgagacctgcaatctgagagatcatggctcctagttccatctgccgattgtagcataggctctcttctccttctgtagcctctatgactgagtagtatacggtaactggaatgattatgcccagtacaactccccatatgtaaatgcatagttttctagcaaagttgggctggcgaaattttttcagtaaatggccataaaatattttctcatagcatgaagtagtctcttgcgaggaatccttttgcattaaggtagcatagcggcttatggcaatccaacttaaaattaagagactgacaaacatacttgcatgcatggatagagttcccagaaaattgaccactctgcattgagcagattgatattcccattggaaacctttcaggaaatagatactcatgaaaggcatggcactgcacacaagtaagtttgcagtcacaaggtgtgacaggtagatgtgcgttgatgtttttttacctatttttgttaaaaatatccattgagagagagtgtttccaaaaacaccaacaatacaaaggaggatgtaaatgattggtaaagccatggaagagatcatagatggttgaatacatgttgtattgttgttcatttatgtcaggttttcttgaattttgtcacaggagctagaatagaattgcagatatttaatattaaaattatttttggtacagtatttaagctgaatagtttttaaaaaagaaaaacattgaattaaataaaatagtaacaaaaatgtattggatggaacgggaaagtatagatggcttcttaccttttctaatcacgattgtccggttgaaataaagacaaaaagttacttattgtgatggataatgcctttgtctgaaaaacaaaatttgatgtgaatagttacatgcctgggatttataattttacttagagaaatgtatagttcttagattgtaaaacaatttgtaagtgatgattgatttttcctagaaatataatttaaaaaattttaaggcacatgtaaccaattcatgttggccaaagtattacagaagtattttgcggccacaataatagagagttgactggtttttaattaccacattacttatatatagttttcaaaatggtgtctttttgtggctaggctaaaacactcctttataacctaatactattagaagagtctcttttcatatttcagaagttaactcagttctacatgaacaaaaattcaggcaagatcctgaattgaacagaagtatagcaaccaaggacagactccaaaatcccagggtcattaccaaagaatatttaaaatgtcctttcaaatatttaatgttaaactgtcatacttcaataaaagtttacacatgtatgtcaaaactgtagttacagccagatgtggtggctctgcacctgtagtctcagcactttgggaggctaaggtgggaggaatgcttgagaccaggatttcaagaacaccctggacaacatagcgagaccctgtctctataaaaaatacaaaaactagaccgggtatgttggctcatgcctgttatcccagcactttgggaggccaaggccagcctgggcaacatggtgaaaccatgtctctacagaaaaattagccaggcatcctggcatgtgcctggagtcccagctacttgggaggctgaggtttgaggatcagttgagcctaggagttcaaggctgcagtgagctatgatcattctactgcactccaggctgggtaacagaaagagaccctgtctcaaaaacaaacaaaaaaaaactgtagctgctatgcttgttggttagagtgtccttgtgtgtaatttgctatctgagtttttcagaggattttttttaaaggatatgatgttttaatcacaacataaatgctggtttttacttttttctgtcttatatttaaatctttctcgcttcaaagggtacacatgaagtgctgaagaatcatatacaaactgcttttattcttatttttctccttatttcctcacttctttcaggtgagaataacaaaagttactggattctggtcaaataagaaccatgatctctattcagaatgtgccatattctctgtgttcttcaccatagccttctgagcaccacattctccactctttcatgatctagagcaaggtttctcaatcttctttttaatcatgttctcttttgataaacataaaaactgtaccatacacaaccctttgaaattcttatatccccccagcccctcagggcaattttactctctacccccttcagaattatggtttgatttattttctgcatcttggattacagaaattggggttttttttcaaatatgatattataattttataataactttttaaaccaatccacacccaaagtcttgaaaacttgaggactgtgcagtgtctgtgggtttaaataacaagattcttaattaatgtttaccactgtctttataattttatttctttgctatttttatttagaaaacagtccatatgcttcattgtaagtttgtatctgaatctagtgcaacctgatgaattataatctggtttcagttagtgtagaccctggtataaatatataaaacctaatctgtaacttcaccagttcaaaaatcagtcagacagtgaaatgagccagtttatttaagaaaaaattatctgctcacagtaggttttgattttacataaggattggagcttccttttatgatgctgttaaagaaaagcagtagctcctaccttgtgcagataatgcatagtatactaaaaactgcaaaggtaatggtgcttctgtatgaatattaaatgcttccaaacaaaagggacatagacttctgcagaggctagctttatcagacagaagttgagtctctgtaggactctcagtgtagcagtcaacaactaggtcaccatctttaccttcccaaacttgtatctactatgtacatctccttcaaaaataaacttggatcataaaactactagataactattttccagaatttggaaagtactattaagaaatcaaataaaaattacatgttacagatgcaaaactggtctccagaaaatgtctctaagtctatattcccctcaggagaatgtctatctcaagtcactcatgcatacattttgtctctgctaatttgacaaatgaaaaaagttctacaactcttaacttcagttactaatgactgtctacatagttaatatgctgactgcctttcttaatgatcagctttcaaaatttaaaccattaggtcctgtttatttttatagagtttaatttttaagctaaaaatgaataataatcactcttacctgtatgagtagtttatgccaactaaggttatattgttcagggcagtgatgccaaatttcagacttaaaattctctgatcttcactcttccaatatctttagtcagtgtgaatagattcttgcatgacaccaactacagtgggaggaaaaggggaaattaaacagaatattgaagaaattcaatagttatggtcaatgtggcaactgcctcctcaaaaaaccctcatttctctatttctgtagtgggaggaagtggtgaacaatatacatattatacttccttatgattatttcatgaactagttacactccagtaacctttgtttgcacgattgactgaagttaagttcacaggtttaatcccccatggccagttttatatgacacagtgatagaaggagccactctgtagtaacccaatacaaatattggtgcaaactcgtttgtaaaattgtttgtggatggcttatttgcaatccatctttatcaaaaatagaaacaaaactcaaagttttcttataacttactagaatcaaatattatagagctaaaatagaacttcatgatcatctgtggactgagaccctttgttttaaagttgaagaagctgaggcccagaggaactcactgtaagcacagactgcacccagggttgggtcccagtttggttactaatgagttaacccactctgtttctaattgccctgcactatctccatttgtcaacataatacactgtttggggcatttcataatggatttggcaaatcctgggaagtgccaagtatgcctcagatcaaatgaatagttataaagaattgtgaaaccatgactagtctaaaacaataaaaattttaaaaataaaaaatagaattgtgaaaccaatttttttgttcaggattgtcgaatcagtctgtgacctactaactaaatgaaagctaagtgtgtacatctggggaggaagacttgcatcaagcactccctctcatccttgagtagttaaaccagtgggagtctgaaaaagagaacagaaatctaatttcatcaaacctgagcattttagttatcagtaaatcttcacttaaaatttacagaagtaccttgccatttctcataaacccgcaatgcttaccttatttcatgtttatttcataaattctctatgatgtttgctaatatttctctccaaaacaaaagtgagaactgcctaaagtgtccagattgtgttctgctgctgttcatctttgccttgccaccatttacttaagaacagtgactcatccagggttacatggccgttcattacagagtagtttggcttttagaattcccatcacttttacttcagtaatgtatcatgttccaggaaggaattacatagaacaaaaaacagttttaattaatttagagaagaacagaaatggaatgctatttctaagtgattgaaagatagttgtaatattatctgttcaggcataagcgtctttggtccgaaaaaagaacgctcttgttttcctccattgtctccaaactcagtaaatgataccatcactccttcagttattcaagccaaaaacttacgaatcatccttaattcctctttctttcacatctcacatctaatcaattgctggtactacagcttctactatcactaccatcattcattagccacatttcatgagagcttactatgtgccagatatctcgctatgtgccttacatccaagtcttatttggttttcacaacaccctgtgaaatgtctcattttaaaggtgaggaaaactgaaactcagaaagatctcataagttgcccaaggtcacacagccatctgtcctcacaggatggtgattggctcacctcaaagcaactaattcaagaacaagtccatagctgcaatgcctttttgtgatctagcctctgaagtcaacagtgtcacttctgcagtattctattggtcacacagagccagccctgcatcagtgtgggacgggtaaatatcaggaggtgatgatcactgggagccatcttggaaactggctatcacagatgtcaatcaaccgttgaaacaaaggaagagtcagaagtactgcttaaaaaccgttgtcagtccactggttgtttattggacaagcatacctggataggtgtaagttttgccagttcttacactattttggtttttaggtctatttttgttaaacagtgtaattcattcaacaaatacttattggagtttctactatgttcctagcagcatgtggaggtcacagaagtaggatgtttagtcacaagctaattgagggtctctggaaattgagcagattccacaagcaagccaagaatttagattaatatgtgatacagatttcaaatgctctgtgaattagagaagggcagaaacagtgactcaaagtggttctgaaaggctttgtgaaagcaaatggaaggaaagagaggagaacataacctagtaagtgacagttttgtgccaggtatgggacagagcattttatgactaagaaccctagagatgtgtggtgggagtcccattttacacgggaggaaattgaggctcaaagaggttaaatagcttgcctagaggaatacaattagtaaattagctttaaaatgacctcattctctgccttagaaagaaattattggttgttctagcaggtcaataagggtaccttatggtactcacaatagggtcatgttttaagtatttttaactttgttcagatagggtttcctgttctgatttatgtatttgtgtatcctgttctagacttgaggtagcagaaactgaccatggaagaaatcaagtccagtttttttctgtctttgaaaactctggactttgttaagcaaactattattccaacaatggcagtataaattctttaggattcagtgattttgagttccccaattgaaatatatgtaaattttattttcattcttctaagaaattaggaaatattgttacaattggtaaaaagagtaaatgtcagggaatactagattaataaagtatgttacaagtattctgtaaaagtggcccctttggacttttctcattcaaatcaccaatagttttctttggttctcattcatcttgcccatccgtctcttcaaggttccccttctattgtccaagtccaaatgctcttggcctaacagttctagttgattcctgtatcatctgccaaatattgatctcctaagtgttctgctgtcacccttaggatttacttccttgaggtgttagagttatgtcctacaattgaagttctgtcttgtattaattttcctgcttttgagatggatttgtgtatcaagtgtgttttttaatctggccccaaaattcatctggagtggttcagtgagagtgtttcaaagggcaggcatatacttacctggcagaggagataccatcatcaaagggcaggcatgtggacatttattttggcaatccatggtgggctatacatagcaaggggacatgagagctttcctgactcacatggattgttggggttagaattagggtcccttatcaatttccctcagagccagaacccagaggacacaggacagcttagtcattcctgaagccatgtgcttcatctagaaattattttaggctatccaaactagtgtttaaactggctgcaactggcctcttaagtactctcactaaccaatcaggagctcagggcattgggaggctggtatgcagaaagagaagacatgactaatttagtacacattagaatatcatattcaaaagataattatttctttaaatcaggggcagtggtaagtaagccttgtccagttcaacatacacccaagccagtggttatctttaggaggagtgagacacagtgcagttactcaaagctatggtttgttcaaggctcactgagccccctgccctctccaggaagtggtgtctggccacagccttgtttccagtcacactgttctcaggccctcaccgcctgccacaagcagctctgatcgtgggtgtcccacccttaatcagagtgtgaagaaaaacctctccttgttctgaagagctggtttctcagcaagcaatgggagcgtttctctcaagaattacttttaaaaacagcagaaaatacagtctgaagtttgtaaatttataataacacagaaaagttatcagcttttgtaaaaagtaaagcagaggttcctcttcgaagactttcctccccatttaattaggaataaatagtaacttctcttagaagtgaaatttattcaaagacctgtgctaacattcttaaatatctgctagccgtgataaagaaatcaatgtactttatgttcttagctcccacaatttagcctaaatatttgccctggcatgcttatactggtgcaagcaagcattgggtcatagcctgttcctcttccttatttgcaggtttttacttttctcagcattccacaagttacttcctccttcttttgttctcctctgcctttgccttttttaagaagttctaagttgctagccaatcgggacagatacagaatgcgaggtcccgttccagccaatggaaaccggacacagcagtagggtggacacgtcagcttataaatgaccctgtctcctttgttcagtgtactcttgtggcaaaactgctggcgagtgtaccctttctgcaggaagtaaaaatggccttgctgagtaaattaaatttatgttcaagtggtatttctttatggtaccggggaacaagcatttcaaacgcttttaagaaaagactaatgacaaaacagaaatggacttggtgagttgaaaaacacatacacaaactcaaagggcattttcttattagtttgcatttccttgtgcatccagtgaaccaactccccaggagttggatccatctctaaattccgctagtaacttcaccttcagtaaccgattgcagcacagctgctgctccaaactgtgggtgaccacccaggaattaaaggttcctcatctcccaaccctttcatcctttgtcttaccaaaccacatgtttccatgaacctgaaccagggccattccagcaaaccccacttcattgacactgagaaagagtagagacaggcttggcttcagctcacctccactagagcactcccactgatcacaaaacccacaccactacctcaaatgctaatagttcttaaagaattccaggaattggccttatgagataactaagattgcctcaggaaggaatgctgaacaattgatttacagccttgttgccacaggccacgccaccaggtggcccattactcaagataaccatagcaaccagatctgctgacctgctttgctcagcccagcctgcatacccttcccctgttaccagttcctgcactttgcctaataagaaagccctatgactcttttcagaaggaagcccgggaattctctctctcttgtgctgcctcccttttgtttgggcataagctccagtgaagctttgtctatgaaagcgcttttggcctcatatcaatttctattgcattgagagtccaagaacccatgatcggtaacaatgccaattgagggtagaaaaaagaaaaaaaatcacacacaaacccaaagtgctttttctattctctcattcaacaagagtctaaacagatgacctctgtgaccaaatgtgtggggatttctcccaatgaacaagcaagcaagcaattcagtggacaccagctgtgtgtcctctaattcagttctattctgacactatctacctggagatagcgtcagatcccacaggttgaaggctgagtccccaagacttcttcctaccttcagatgccagtggcaagccccaggttgtttcacctgtgcttctgaccgacaggctataaatcaaagatcccacagcccctctttgggtccaattaatttgctagagcagctcacagaattcagggaaatacgtttaccgatttattataaagtatattacaaaggatacagttgaagagatgcatacagtgaggtgtgggagaagagagggacgtggagcttccatgccctcctgggcgtgtcaccctccaggaacctccacatgtacagctatccagaagctccttgaaccctgtcattttggggttttatggggacttccttacacagccatgattgattaaagcactggctactgttgattaccttaaccttcagcccctctcccctctctggagggttgggagtagggctaaatgttccaaccttgtcatcctgccttggtctttcctatgaccagccccatcctgaagctacctaggagctgccagaccgcagtcacctcattagcatacaaaaagacatcactttggagtttttgaggattttaggggttgtatgccagacaacagacgaaagaccaaatatatatttcatagtatccagtccaccctctgtcttggatccctcacatcaaaaggatgtacaactcaaaagataccgccaaattactagaatctcattcaatcagtaataatcagtccagcccatcatattgtatgaatgtctcccaaggcgaggccactcaggtttgcaggcttccattcagtcttgtcagagtgctctcggcaaacatatagcttcaccctttacagcagctggtataattaagctaggagacagatatcatttcttgctctaagcctctttcaaggtattaatataatactgggtttctttcatttcataacccatttattctttactctcactactatttttccttatctctataaactcccaaacttttccacctttggatgggacaatagaatcagccactgtgcttatctagattgcaggcaacaatgctagtctagcaagtgctgccccctcagtccactcccattcatgttagaaataaattttcggtgccacaaagaagaatcaaatcagcactcccgcaaaaagttttctcagcaaggcaaattaacttccatagaagcgtgcgtctcgcgggtggagcaatggcgagagcacacagaacaaaggaaagcaggggtttttattcctaatgcaatgagtttctactactgtgtcctgtctccattggatggagctggaccacacaatcgaaactggtcttggttggctaatttgaagtgtgcagggagggggttacactggcgggaagggcagttttgggggtaagagctgttatggcaggaggggtaatttgcagagtgagtgactaagggcaacgagcaagaaacagctgtggactatagactggcgggaaggttgtttacttcagtcaggggcaaggagacatgaagaacaaggaagttgagattgagaacaaagaacaagggagttaacatgccaaacttttgaagagaaactgattgtatctgacattcagatagagtaaggttccataggcacagcagaacgagtgggctgtttttaccaccagggagtatagctgcatttattgttagccccaattttgccagatgggataaggcacaagccaccccttaggagtccaccccacaatcagacccttaggaattctgactcaaagtttaaaaacatagttacagtttcttacttaggaattgcccctgcttccagcacttgtagttgcagccctggtcctaggaccaatgcatcaggtaggggaaatgtaaaaaaaaagttgaggtgatgtgggaaagaaaaataaagagtgatcattataccagtgtactcctcccttagcaagaaatgcatagtcataccagcatccttccacacctcctcttcccggatacctcagaaaagcggagaaatctattgagtggggaaattcccttagccccactcatgttgaatgtgagcacacacttgcgaaggcaaataaggcagctcttcgtgctttcatctccctctgttttagacaaccagtgttttcattgcctgttccactctctatcaaaccgttactctgaggaagatatctctctgcccattgctgaacattataggctatataatgtgttcctgggtctgaagaagtgacagccatccaaatctgtgcaatatcttctgctctagcttttatggcactctgagcaaactattattctgagaagaatatctctgcccactgctggaacattatgggctgtaccgtgtgttctttggcctgaagaaatggtgttcagctctccaaatatgtgcaatatcttctgttctggcttttttatggtattctcatcattcacatcttccaccgggcaagcaaagcccagtccagaatcagtgtctactcctgtcaaaacccatttgtggcctcccagggctaccagcatcagcctcacttgccagcttgttcagggctttcccaccagggaaatctgccccacagccatgggcaatgtctgtctcttttgctggcagacagaacagtttttattggcattttgtgcctaagatggtgcaaaagaaacatgtctaaatgcagcctatctctgcactgttgcagtacccgtttatccactcatttcacagacccaggtggccacttcaagggagcacccagggttgtctgcttgtgatatcaatcactttctgaaccaggatcttttttttttttttttcaagtcagagttttgctcttgtctcctgggctggagtgcaatggcgcaatctcggctcgctgcaacctccgcctcctgagttcaagtgattctcttgcctcagcctcccaagtagctgggattacaggtgcgcaccaccatgcccagctaattattttgtatttttagtagagacggggtttcgccatgtcggccagggtggtctcaaactcctgacctcaggtgatccacccaccttggcctcccaaagcgctgggattacaggcatgagccaccacgtccagccaagaaaggagctcttctgatgggcattgacatgttctactttaatgcactcctcaaatttccatagggccattctccatatgggcatccctttaataaataggccaggtttccactgcccttctgcctgaccatgtggccaggccactgagtcagtaaaaaaatcaaacacaggggtttttgctattgttcatttctgcagaatgcaattcagccaccaagctaatttggtcttaccttctttgatcaagagtggcatccttccaaacaagattgttcaccttggaactgtcatttacacaccaagcaactctttgttggtcagttgagagctgtttacggggccctgtccaagtctcagtagaatcccgcagttcctcacacagttccagagtcagtcctaggggaaaagaggctccctgcatgagagtatttcctctttgcacttcccagggaggatgctcctgtataaaccatttccattttattatggaagtgttctgggcactgccatccccatttgaatgtttctctgacatcatgtgagaaagcatgggtatttcaggtgtcaagatcattttatgtccttcagtcataggggttaacttcagttaatgtcccatagcaaggtagtaaatacccccaagtggaaattctctactgcaaagtcccagtagttgtcactgggagatgctcacagacttctgagtaagccccagtaaacgctgacaaaggggtagcaaatggagaatttgtccctatgatattccagcttctattctacagattgtgggcttgggtaatcttactggtttgccatttagcatgttcaattaatattgctacaagggtgttttacaatacaaggtaagagaaacattccccagtcagacacaatatccccataatacagtcaagtgaaagagatacaaccacttcatgtaaagtgtgttcaaatgtaccaacttaccttaattttctcaatgcttactttcctaactgtagcctctattacgactttaccaacaggttttgagtttacagtactaggtaggggaagtgttccccacccagacataatatccagttccatcaaacattcaggtaaaggagacataacttctttacataaagcctgtttataaacattctaaatctcgtattcctaccaacccttactttctgtcccagtcccagaatttctcttcttcactcccagaccattttaccattttctccttagaaaaaagctttgaatccccagcagagggttgagccaagggaccttagcccttttgtcaatctttgtcttgattaacctgcctcaacactgctccaagtaattgttggtcagctttctcattgtaatctcttcctctcattttttcaatttctcctaactgggataaatacaccaaacctgtttggatcctcttaccgttaggagaacagcagaatctccctaccaaccttctatagtgatgacctttgttttaaccccatcgatttccactttattcatcccattttttaatagccctctaaagactctaccctgcttagatgagtcccatgactctcctttctttttcctcttagtttcaccccatcaatgttttcttcattcaccttatttctcaataaccatttagactttccaccttcctgggatgagtcctgtgactctcccctctgcctttccccagtctcttgttaattacgctcatgttttcattggtgcccatacaaaagaggctcccttagccatagcatttactacagccagagtaatggatgtattcagtgagtgaatatctcagtcatcataaagccagtcccacatggtctacataggaagcaaatgagctgctgcttcagggtacaccacttggcatttataggtgaaattggacagtccccttctcagggtaaacaggtccagtccaccacgctggccattcccttggaaataacctcctgtgtgtctggaaatctacctttccatctgtgattgttcaataatgaactgcaggtcctacctcaaccaaacatgctcttccactcttgagcatttaaaaccaaagaaactgctctgacagttccttcacagtataccctccagtttcaatagtttatcagttttaccctttccccacattgactacccttcttgataaccacaggttgtgtaactgtccagtgggttcatcttgcccgctgtctagacagagctgatttatcaatacagggaaattgcaatagaaaaaaagtaattcacgcagaaccagccgtgcaggagagcggagttttattattactcacatcagtctcccagaagactcggggatcagagattttaaggataatttggtgggtagtgggctgtgaatcaggagtgctgattggttggctctggaatgaaatcatagggagtcaaagctgtcctctcatgctgattcagttcctgggtagggggccacagaactggttggcaggtccaggtggggccatccagttgttagaaatgcaaatacctgaaaagatatctcaaaaggccaatcttaggttcacgatagtgatgtaagttgcaaatcttatgacctccagaataatggctggtaacatttagaattccagcccctctcatccgtacttggtggctggtggcctttcattcgttttacaagaacagtttagcttttgggaagggctattatttaaactataaattaaattccttcccaaggctagtttggcctatgcccagtaatggacaaggacagtttagaggttagaagcaagatggagttggttaggtctgatatttttcactgtcataatttccttagttacagttttgcaaaggcagtttcaatcgtaaaggtacttcagtgtccttgcataatttttccttgggggtcagctttgaggctagtggcctgggctcagacagacaaagtctaacctagcattctcctttaatttcatttagctattagagataaacaccaaagaatttagtatttcactttttcatattagtctgcataccctcatgcaaccagtgaaccaactccccgggagttgcatccatctctgaattccaccagtaacttttacctttagtagctgattgcagcacagctgcagctcaaaacagtgggaaaccacatggccacccaggaatcaaagattcctcatctcccacctttttgacgcaggatttttcttggccactttgccaatcagggacctccatggccagcaacgcccccctacctggcctttgcttggccatgggcctgctgaggcgtcaggcccactcaccccacctgtgctatggcttgtacctgcgttcagcagttcccaagctcctgtccttatccacgaagaatgaggatacgctgacaatttgaagggtgaggatgggtagggaagaattttattgagcagcagaacagctttcagcagagaggggacacgggtggcccccccacccctgcagtcgggtggtttgtctctctcagtgtggctgggtccatggtattttatggattcagaatggggcatgtgtgctgattggtttgtgagtatgcagaaaaggttaaagcgaagacaccactcaaaggtgggcacaacagtgtagaaaaccaattagggaagggtaggtatatgtaaaataggtgaggggcggggatcaatcagaggaaagcacaccaaacaggaagacaggttctcaatccagtccatggatttacccgggacatgtaggtaggctttaaactgtcttcagcttgaaggtcaatttcactgaggactcgcccctatctgtctaggcattttgtctgcctcctgctgctgtcactttcattctttctcttcccaaaccacatgtttctgtgagccaagtccattctagcaaaccctacctcactgaaaccaattcatagtttggaaggaaaacaaaactcacaaagtacttttctactctttcaacaacaattaacacagatgatttctgtgaccaaatgtgtggggatttctccccaaccaacaagcaagcaagcaattctgcagttgacaccagctaggtgtcctctaattcagttatgttctgacactatgtacctagagatagcatcagattccacaggttgagggcttagtccccaagactggcccccacctttagatgccaatggctagccccaggctgtgtcacctatgcttctgactgactagctataaatcagggatcccacggctccctctttgggcccaattaatttgctagagcgcctcacagaactcagggaaccagttacatatacccgtttattataaaggatacagatgaaaagatgcataatcctggggcacggagctttcctgtcctctctggacagaggcaccaccatctgggaaactccacaagttcagctatccagaaactctccgaacactgtccttttgcggttttatggaggcttcattatgtaggcatgattggttaaacgattggccattggagattaatttaaccttcagcccctctcccctccttggaggttggggatggggcttaatgtcccaaccctctaatcctgcctagtctttcaaggctaccagcctcatcctgaaactacctaagggttccagccatcagtcaaccattagcatacaaaaagacatcattctggagtttctaaggattttagcagttgtatgcctggaaagagggttgaagaccaaatatatattttatagtatcacagacctgatcatcaaagtttcactatccttcagctttggcttttggcttttcatataagcttgagtgtgctggctaaacattgtcttttaggaatgcacagcatagaaactctagcgacttcagtggcagtcataagaactggaatcatttcaggggtggtagttgaaaagcagacaggaaattagcaggtttagaataggggagaaactttagcattgaattacgtgaggcaaaaatatatttgagggacaaattttgaattttgacatcttcaaatcagtcaaacttggttcatattatgcttcagaactaaccattcttttctgtagattctttaaaaagccaaaagtagataaagatttctatgaataaagcagttgaggatagaattccaaaaataatgctgttccattgtatcaccccaggtacaaaacacacacacacacacacacacacacacacacacacacacacacacacacaaaatctataccctgggaaacagtgacttggattgcagtgagatttagcgaatttaaaaggcatcatatatcagtgcccagaattctccacttcactgtctctttctagggccaaggtttcctggccattttattaccaatcacttcttttgaatttctagatacaattgtcttaaggtgaagtcccctgctccatgtaacttcctgtccttaatcaaggggaaaaaaagagatagatgtcaagggaagagaaagaagaattgaatatctcatgtcttccctcctatacccattagtgtctgtattcattttctcttaagcgccccaagcatgaaagtcacaggtttctctgagaaccacatttagaaaattaataataataagtgacagccactgatctgcttttatatatatattcatataattttagaaatatctctgagatagattctattattactgtcactttctagatgatggatgtgggtccacagaggataacttgcctacagtgataaaactgctctattataaggtctagatttgaacccagatagtctgactttagagcccacattctttactgttttatatggactctcataatatatgataatactcaatagaatctagtttattgctttaaataaggagaccagctatccccaatgaccaaaaatatatctcatttatgtacttgtttccaattttcaatctcgagatttattaactcctgccaactctccactgtaaaggtaccctgttttcattgtaattgataagtaatctgaaggtgatattttaagactctatgagtatactgtgtttccctttcacccactggattttgacattcttcgatgattctcttcttgcctaaatcagctgtttccttggtggtggcatcttggtaatcttttggtgaatggatatattagatttgaagtagtccttttaagacatcttttggtgagtggatgtattacatttgaagtagtccttttaagacatcactctaaacaagtcttgttgttttatattatttctcaaacagcactgtatgtggcatagtttctaatattttcatgttgcctcttcttccctttcctctatcaaaagccagcctaaaaatgtatggttttaataaacctacaaataaagtattgaacttggaagtataagttctctagagttccagaaatatctggagaaaaaaaaaactggaaagaagaaacctgcgttaaattttataataacactgaaaaaagtctttaagagggtcacttttttaatagtgccttggccagcagagggtaatatattaccagccctagttaaaccacttttgctgacgcataaactgcccacattgcactattttccagctagaaacataaagcaatagaaaagtttggggattttttgaagctctaatacaacaataaatttcttttagtagctgaaaaccactttacacatgatagaaaaaaagtaattgtatagacaatggatttctgtccttaagatgaaagcccggtgccactcatctgcccttaatagggtatgtcctttagggatagtttttgttttgttttgtactagtgattatcacaagagttacttttgtaaagtattcacaactacagttatcctagtggtagaaagaaagtcttacatttcagtatgtgaaagtttttattactgtatcttttagtttttctttaactttttttaatcatagaaattgatggacatagttttaaaagtcaaataacactgaaaagcttgtaataaaaacatgttatgtctattaataaatgtaatttaaagtattttcacctaatgaagacagtataggagaaatcacctctatcctcgactatagtcacttcctcctgtcagtgtaacaacttacgctacatatcccttccacttaagtggtaattttttttttttttttttttttgagatggagtctcgctctgtcgccaggctggactgcagtggcgcgatctcggctcactgcaacctccaactccctggttcaagagattatcctgccttagcctcccgagtagctgggattacaggcacgcgccaccacgcccagctaatttttgtatttttagtagagacaggatttcaccatattggccaggatggtctcgatctcctgacttcgtgatccaccaacctcagcctcccaaagtgaagagatagcttataataaccattccctctttattcagctctcttcatcagggggagcatgtacttgtttttatctcctagaacaagtggtttgttactaaatcttcagcagctccactactccctgcccttcattggtttggaaggtacattctgtctctctctctttctctctctcgctctctcatgcacacacacaaagctttcaagtaaaataactcaaggcattgtcttttttgttaaattactatatttattgtcatctttttagaaatcagtgctacacatattcttcatttatattttttatgcatcatttatctattgctgcatacttaactacccctagacttggtggcttaacacaagaaccatttattcactctcaattctgcaatttgttctagactcagctgggtagttctgtttgtctcacctggtggtcattcatgcagcttagtcatctgtcagctcagctgaggctagctggttcaacatggcctcactcacgtgtctggagcatcacctggaagagttgagcaggctgtgcccctctctccatgtgatctttcatcctgggcttctttacaatgtgatggtctcaggttccaagagggcaaaactggaagctgcaaggtctcttaaggccttattcaaatgtcatacaatgtctaccacattttattggtcaaagcaagtcttaatacctgcccagattcaactgggaaagtagactccacctctggatgagaagagtggccaggaattgggggcaatttttaatctaacacatttccttggatgtgctttcaactttaatgttctaactagacttgttatattttctccttgaaatgcagtgaattggctctttctttagggattactatagtatgtgtatctcagagttcgtagtttcctgggtaatattcctaaaagaaaaggaaattttgctttgtgagagatacccaccctgtcccactttggtcttggagctgtcatgttgttttggttgtttcttgtattaaaaggtatattcagtgtgccatgaatccagctgggtacagtggcacttgcctgtggtccctactacgtgggagactgaggcaggaaaatcgcttgagcccaggagtttgaggctacagtgaactatgatcgtgccactgcactccagcctaggtgacagagtgggactgtgtctctaaaaaaaagtatatgtgtatatgtatatataatatgccatgaatccatgatgtttcctttgtgctttttatcttctataaatcctctccctttaccttctctttccagaatattaatctaacttttcaataaaaccagaagaaaagtctgttgctcttgcttcccaatagctagtttgatcctgagagctggataagttcattgacatcttcaataccagagcttaaaaggatgtagaaagatgattagtctagcatggtggggtagctttccctcctaccatgcttattccctcctaccattattcaaggtttcattattttcaggatcataaatgtcaaactactgggccatgagacttgcattcacttacttagctgcatcctctccctacttgccacatctttttggaaccctgtaatcagtccccacaagagctgaccctgtgtgttcctgtgtttttcaagtttcactagccacaaaggggaactgaatatgaacatgcatgcaaacctcaccagttccctttgcagccagctgaaagttatttttcatgtagaggaaacagtgtttttcttttgagaacaaactgaatttccacacaaatatgaagtgtttcatcttctgacagttcagaggacccaagagaagagggcaccaaattgtgagaaaggccattaaaagagaaactaggaaaacaaagagacaaactgaattggggaagagagaggtgctgctgagtacaggaaaggaaaaaagcagaccacggggaggggtgccggggtgctagaaagtctcaataagtaatggcacacaggacaaggcaggaaatgtaggaaggaactgtctgcaaagggcctataatagctatgccagcagtattaatggaaggcattaagaacttttggtttagaaatttgctgttggacaaaatttcaaaatataccacatttacgtgattactgggcctgcctgagttcatgctatggagccaggtttagatgaaggtgccttgtcctcacttcagaatgcaatatggtgacctgtttggtgtctctgattagacggagaaaaaccaagaatcagatatgtattaacatctcttctaattttttttttttagaagatctctgtcacccaggcttgagtgcagtaacatgatcgtagttcactgtagcctcaaactcctgggctcaagtgatcctcccacctcagtctcctgagtagctgggactacaggcacatgccaccatgcccagttaattttttaatattttgtagagactgcttcgctatgttgcccaggctggtctggaactcctgagctcaagcaatcctcccacctcagcctcccagaatgctgggattacaggcatgagccactgtgcctggcccaacatttcttctaatggcatcctgccaggtgccctcacactctcctccttacttgctcaagtttcagagtatggttctgattagcataaaatacaatggatctgttacctctcctgtcctggacattgctattattagtgaaagctgaggctgaataaaataactctttctgagttacttcccccacctcccttgatccagatcaacttccactatgtatcttcctagttctgatgtttaccctcagcttctagccattccattttatgtattttctctgcctttcccttggcatttgggtatttagataccatatattgcatgtttctacttggccaggtacatttatttactcattgagtcctcctaacaaccctatgagttaggtactactataattcctgttttcttagtagaggaaatagagcttacccaatgttacattgtaagtgatggcagcagaaataactcaggcagtctgactgcatcattcacccttttaaccagtcttttatgctgcctctcagtttgttatttaataatgcttaatattattgggataagaaaacctattggattcagccttaccataattcttgccatggccttaatgatgggaccataataatccgtatacattggccaagatcaatcccctggactgtgttggatgggcaataccaacatttttctagcactttttttcttctaattttccctcatctcctagtgaacagccaattctttctgtagatatgctaatgcatttaatcaggtcatctcctggtctaagagactttctgtctctgaagttgttttacatatttgtactcaggtatttggattttgtagttgaactcttagaaaacatttctattttcatgttctcaaggaacacctgatttcgactcctctatactatttataactgaaataccaagctatctaattataagataatttcatctgcaagttctttagcttggtccttgaggaatgcataagtgccagtgtttatttcaatttattgattagaaaaatttttagctttgcttctagtgtctgacaaaagaaaccataagcaaagtaaaagacaagtgcatagtgttagaagttatttgcaaactatataaataacaaaggatttagaacccagaatatataaagaactacttcaacaattttttaaaaagaaaaaggaaaaaaaaagataagcaactcattaggggaaaagggagggggaggggtatagatatgaataggccattcacccaagaagaaaactgaatgagcaaaaagtatatgaaatgatgcttcatttcactagtaatcagggaagtgcaaattaaaaccacaatgagataccatttcatacctaccagattggcaaaaattagtaaatctgataaaaccaagtgttggtaaggttgtgggtaaacaggaactcatttctgccttgtagtgagatgggcatataaattggtaaaatcactttggaaagcaatttgtcaaaactgagataagctgaaaatgtacatacccttacaaccaagcatttctgcttttaggtgttagccataaacttcacacatgggcattgggtatacaaaagaattcacttgagcatggtttcaattagtggaaaaagtggaaaccaccaaattgcccattgttaggggaaatggagaaatgaaccattgtttattcatgcagtaaaacactacatcagtgaaaatgaatgaacaagacctacatgagtctacatagataaacaaaatttgagtgaaaagagttacaaagaatgtaatagtaagataccatttgtgtaaatttttaaaagaaaaagtgcatattgttatgcatatgtatgttgtaaaagcacaaaaatatacgtcagagtgatatacaccaacttcaggaaagaggtttcctcagggaaggatgtgaagtgagctttaatatatctaacattttggatgatgtatacgggtatgaaaaaacttttaagtaaaacgaaaatgttaacatcttttcaattggggtgatgggtacttagctgcctgttatgttgtgtttttccatttttgtatgtttgaaacgttttataactaaaaactatttatatgtgaaattaccaaaaaagaatataagtgtaacagttaactgttgctcccaaaaaacttgcatgacttattaaagcaaaaagagattccatgtatcatcaacacctgtatccaaaccataattagaaggcctttccatcttctgatggttctttatgcatttcatgggccagaagcaaaactaataagggtaggatgctctaatttgattccattttttttcttctattcaacctgtatgagtttgttctggattatcgtacatgtttcagagagagcttccagagtatataaatgtgtgatggttagaagactagttttaaagattgttttttgtttttgtttttgtttttgttttgagacagagtctcactctttcatcaggctggagtgcagtggtgcaatctcagctcactgcaacctccacctgccaggttcaagcgattctcctgcctcagcctcccgagtagctgggactacaggtgcgtgccaccacacccagctaatttttgtatttttagtagagacggggtttcaccatgttggccaggatggtgtcgatctcttgacctcgtgatctgcccgccttggcctcccaaagtgctggaattacaggcgtgagccaccacgcctggcaaagattttgtttctttggcatcacacaattatgatgagtggtaagcagaaatttttgcccccaatacatattaatggcaatttatgtttttttattttattgtaatttatttatttatttatgtttttgagacgaagttttgctcttgttgcccaggctggagtacaatgacacaatctcagctcaccacaacctccgcctcccgggttcaagcgattctcctgcctcagcctcccgagtagctgggattacaggcatgcgccaccacgcctggctaattttgtatttttagtagagacggggtttctccatgttggtcaggctcgtcttgaactcctgacctcaggtgatccacccaccttggcctcccaaagtgctgggattacaggcgtgagccaccgtgcccggcaaagattttgttttttttgacatcatacaattttgatgagtggtaagcagaaatttttacccccaatacatattaatggcaatttatgttttttaaaataaaagacatctcagcaatcaccattgtgcttggacagaactaaacaaaagtgaaaagcattagcagagacaatgtcagtagaatggaagtctaccaacttgcatccctacatatgtaaaatacagttgctgcttacatcacaatgccatgaagattaactgatgataatgcatgggaagcacctagaacagtgaagggcacataaataaacaaatgttactttgcttcccattcccttgcatgtgaacttgaagtggggaaataaaaggaaaaatagaagtttcgaacaaacttactacctcctttccagttctgtgctcactgttaccatccccaaccagctctccaagtcttcatctgaaaacatggactgactgaggcactatggcagccactcagctgggccatgtagctatgacagaggacactacatcatccaacatgggaatgccgcatagtttatctctcgtctgagttgacataattcagattatattccgagtttcaaatcttttcttccgattaaaaatacccctacaagcctctttacaagtgaagtttgtttgttggtggctgaaataaaaggctctccagtaaatgtcatatctgttgtgaatatttttcctgctttgtacttttgcttcagtttttatggtttgggacaaagaatctaaatttttaagtcaaatctatgaatttttccctatagttatttctattattttgtttgaaagttctttcccatctacagatgaactagtcattttttaatcttttatggtctcattatttacacttaattcttgagtgtccttataaattttggggtatgataaaaggtaaggctgtaaattggccttttattttaaataggcacagcactattatttattaatccatcccttccttcctgatgctttttgtgatgtttcctatatatgcagtgattttctctgagggaggagaatgtatgggggtcacctgagctttgcaaaaacacacttaaccccacctttgcaagattccagcacatcttgactaacaggaaccttttttttttttttttttttttttgagacggagtctcactctgtcgcccaggttggagtgcagtggtgcaatctcagtggggcatggtggctcaatgcctgtaatcccagcactttggaaggcaaaggcgggcggatcacctgaggtcaggagttccagaccagcctggccaacatggcaaaaccctgtctccactaaaaatacaaaaattagccaggcatggtggcacgcacctgtaatcccagctactccaaaggctgaggcagaagaattgcttgaacccaggaggcagaggttgcagtgagccaagattgcaccactgcactccagcctgggtgacagagtgagaccctgtctcaaaaaaaaaaaaaaaaaagtcatatacgtattttgtacttttctcatatatcatctaggatctgcttagacatgtgtattcagttccacagataagtttatccttgtgtctgctccccagtgttatccttactgaaggataagaatatattttaatatctgataaagtattatattttgaaaacctaaaaaataattagcccattaacatgttgctgcagcatccaggttgcttgttgggagaactctcttcatattgcttttcttttgtgggataactttcagtaagtctttcgttcaaatagttatattacctctacttttatgtcagcaggaataaagaatccattttttaaagttgaaaataaaactgtactggaagaggattgtctttttctactgacctaatcttagaaattcaaccaccatcaaacctggctctatacagcatacttttctaaaactaacagcaatattcaacactgaggtctcactctgacagccagacaattcattttgcccatatttggttttgcatgtatgagatgttatttagaaagctgttctgaaggtctttgcaaggtaaagatacgtatatacttctgaatttccttttcctgtatgcttctagaactaaaccttgggttaggagaggtaggaactgtttcctgcttgcaaatactaatgcttagtaagaaatgaaagattatatgtcataagtagccttaactttggtaagacagtagcatattttttctaaaaatttagaaaccttctcaggattcaagttactctaaggcatgttatcagatttctctcagtaagcaatctgttataaatagacagattgatttatatcaaaatgtattttattccaaataatatagcaataattaattgagtatactttaaaattttcttaagaatgccattgtgcagagctttatagtaatcatctagtataatgagacagcttctagaactatgagtgtatttatattcattttaatgtcccttaaaagtgataataattgataatataatttcaccaaactgtatacaatgagatatgtaagatgtttaccagtaatgtaaaataaatttttaagtttgaggacatgaaggaaaatagaagttttcataacttaaaaccatacaaacagaaatgctaaatttcatttagatggtatgtgttaacattgtcagggcaaagtaattaatataattttgtcacctttttctgaccctctaatttttctgcaaatttcagtatttatcctcaaatattacttatttttaaaatatacttttgctttgacttattctttattcagttaattatatttgcgggcacttattgaaatatagttaactggccgggcgcggtggctcatgcctgtaatcccagcactttgggaggccaaggtgggtggatcacttgaggtcaggagttcgagaccagcctggccaacatggtgaaatcccgtctctactaaaaatacaaaacagccggtcatggtggcgggcgcctgtaatcctagctacccgggaggctgaagcaggagaatcacttgaacccgggagacagaggttgcagtgagctaagatcacgccactgtactccaacctgggcaacagagtgagactccatctcaaaaaatatatctatatatagttaactgagcactgtatacaagccaaatctcattaaaataaactcagttctgatcaaaatcttcatggtcattcacattgatttctcagccaatggcctaccttaagttttaagaagtattctgactctaaaaaaattttatacaccatgatagaaactttcagatgagtccttggagtttgtcctaagatgcttttacataaattcagtcaataacattcaggttctgtgtatgaccaaagaactggacaaatgctggccaaactttcaagaatgtttgcctaatgacaccccctagattgcaactgtatggtgttctatacagctatattcaaatggactaggaaaaaagctaattactcccaactttttttcttgtaagcaccccttccttccctttctccctatcttattcatccgtccattcttcttaattattcaataaatgtgtattgatctcctatagccaagaaacatactaagctccagggaggcaatgacgaacaagactaagaccgctttcttttagagcttgctgtcctgttattttttaatgtacatgaaaattgcagagtttgctccttttaattctaatttgcaggtttttattgttgtaaagtatttcaaatacccaggagtttaccaaaaataatataatcacgtgcctactacctagatttaagacattaacattttgccatatttgcttcaaatttctccagatataaccattaagttggtatgtatcttgtatatattatcatacatgttttgtatctttattttatatgtattgatccataagaatgtggtattgttttctaccaggcgcggtggctcatgcctgtaatcccagcactttgggaggctgaggcaggtggatcaccctgaggtcaggagttcgagaccagcctggccaacatatgaaaccccgtctctactaaaaatccaaaaagtagccgggcgtggtggcatgcgcctgtaatcccagctactcgggaggctgagacaggagaatcacttgaacgtgggaggtggaggttgcagtgagccaagatcaggccactgcactccagcctgggcaataagagtgaaactctgtctcaaaaaaaaaaaagaatgtggtattgttttatgtttttatattttacataaatgatttcatgcagtacatacccttttgcaattttgtggggttttttttactcaacattatatttgagatatacccatgttgatgcatgtgagtgtagttcatttcattgcatcgctacatgatattccatttcgtgagtaaaccagttcacttctccatgcctttgctgttatgtccttatttccagttgtttcgtattatgaatgttagttcactgagcatcattacatgtttcttgtgtacgtatttgaatgattctgtaagatgtataccttgtagatgacttgctggatcacagaatatgcatgttcaatgttactttatcaaactgtggctgaaatgaccctattgtttataaacctgttttaagtaaggtgtggttttaagacctattgctaggctattgaatcgttagcttatctgttaatttttactatacagtatttaaattctttccctttttatctaagcagtgatagatagtgggtgatctcattttttaattaggattttattaattatcttttcatctgttatagagatttaggcataaatgaatacagtggcaaattatacaagattttaaaatgataaatgaacatatattttctgacacattgtcagttcccaaatcatttacttttaaacacacttcaaattagtatcaagtgcttgattttaataactactttagtcacttgagaaactatggcactttaattattttgctgttagagccataaatttcacttaacttcataatctatgttaagagtattagcttaaaaatgtattttgaaaagattttacatacagatttaaaagttagtaccttgaaatggtttacagttaagcaaatgaaatatcacaaatacaagcagagctttgagatctgagttttgtaaatgctagaactttgtttcctaattttttagttcttcaaagaattaagaggctgcattatataattcattttagtatgtttacctcaagtacttttagaactagactgtattttcactgccacagatgtatcatgcagggagtatcctggtttaaattctgaagtgctttcactcctacttggttcaccttgaaatcgtctaaaaagaagttggcacattattttgcgaatgttactggacatcaggaaatacatgactggatctaagcaactattgaaagatgagagaaccagcatgatctcattggttttgtgaacaatttctttccagtagcaagatgatacatttagctgtgaagaaatgtagatgaatcgaaaggcatgatagggaacaaaacatatagtaaaaatgataagtacaataaaggagttacgagctgtagtggcatatttaccagaattaggaaattttgacctccttttagaaatcctcaatagattcttcccaatcttaatatatgaaaggattattagtaagaaaattagccagaacattaccacaagaatgaagttaaaaatggcttctccttttgcgttatgcttatctctgtaatggaaacacattgtggaattatgccctcctttcttaagtgttaaaataatcatagttaggaatccaccaagagcaagcatccatactatacaacagacataaatactttgtttggttgttattgccttccgttgctgtatagaccgattaatttttatatagcgatccaaactgatgaatccaagcaaaataatgctaatgtacatgttcatataaaacagtgttcccacaaccttgcacagaatcacacctagtgtccacttgttttggttaatatgatacattattcggaaagggaggcagaagatgagtaggaggtctgcaatggctacgttaagtagataaatttgaatggaatttcttttacggtgaatacccagaaatacatagagggcgattatgttcccaaccagtcccacgatgaaaataacagagtaggatgtggttaacacagtagatagcaatttttcatccatgggacaggtagtaacatttggtgttgctgagaagttttgtggcggttggtcgctatgattggttataaagcgcattctgtgggaggagtaaggccagctgctgactgaagttgtcgtcattgttatggtatgacttctcattgtcttctgtggagatcaaaaagtgaaagtgctaaatgacatattcctcatgtgtagttcttatgtcttcagatttttcctacaacggaatgccaaacattgagtcatttgctattttaataacagttactttaactaaaagtgtaaataataggctgggcttcccagcacacgcctatggtcctagctactcgggaggctacagcagaaggattgcttgaacccaggagttcaaggctgtagtgagctataattgagccactgcactccagcctgggcaacagaacaagaccccatctctttaaaaaaaaaaaaaaaaaaaagacagtgtaaataataaatgatttattttcagacattgcgagaaactttacttttatcctactgtatgtagtaacattattgtatcattaaacaagcagcacatagtgtggtatctcatggagtttcatgctctaacctttcctgtggccatggcctacattgaagttctgtttcatgtattatattaaaataactcaatttatgagatcatcttctcttagggaagttcttatgggaatacagatggtggtgaagagaaatgacagctcatatttctcaaagatgagcatcagtttctctaaaggtatgtacagccataagagagctgggcccactgctggccctgcccagcttcagaaccacttcctgccttgactttttccctcatatgtggcattcattcattttgacatgtattgctacatggcgtgtgacttgtggtggtctcattctataagtgggaataaagaagaggatcctaaatttcttttcagcctaagaccaaggtaggggtcttagggcatgcaattaacataatagactaagagaatacagcacctgcaaggttacacagactcttgtatcactggacaggagaaaaaagtaaccaaacaaaaccaagttagctggcagctgccagttagccactcctaacctagaagcatagagtaataacgtagatgggaaacagcatgtgcaatccaagattttgaaagtaacctgaccaaagcttaaatgtgccctgggttcaataatttgagacttgctagaaccttcgaagagatagtgtttgaattctacttgtttgtggcagcagagaatatttgcaaagctacttattattggcccattgactgctgtaaagagcttagtctgagagctggtcataacaagtaaagaaagcatttctggaggtctcatcacattcctctcatagagtgactgccctatttctctacagcagccacttagcagggttaacataaagatgcccagagcaaggttctcaaaatcagacccaactaacttgtgaccaagggcaaataacttaatcttttctatgccttagttttctcatttgtgaaaatgaaaaatgcataagaagaacttaatcctggcacatagtgactgcttaataaaagttagctttaataaacaccttttgattaatctcattttagtaaatatctcacacttggctaagtactgtgtgggaaaggaaggtgaataagacagagaccctattagtaaacattttggaggagtggacattcaaaccctgactgctaccatgcaaagtggatttgaattacataaattaagtccctgatttgatcttatacacagagaaaaatagcctttcttaaagctctacacataatttgattaaaaacaaagcattttggtagagggtaacattaagatttaaaatgttgtaaagttggggagcattgattccacagaagaggaactggctggtgaagaggaagttatgtaatccctggtaagagcctgtttccagaattcaggaaagtggagggagaaaggaagggagcggggaaggactgagtctagtctgtcatgtgtctcaactgcaggaagacaaatttcagaaagtttatagaaaggtataggcatgtttcttgtgatctaagattctggtttttgtttgtttgtttgttttgttttgtttttgagacagagttttgctcttgtcacccaggctagagtgcaatggcgtgatctcggctcactgcaacctccgccccctggcttcaagcgattctcctgcctcagcctcccgagtagctgggattacaggcgcccgccaccatgcccggctaatttttgtatttttagtagagatggggtttcaccacgttggccaggctggtctcgaactcctgacctcaggtgatctgcccacttcggcctcccaaagtgctggaattacaggtgtgagccactatgcccaacctgtgatctaagattctaaaaggaaagggcaatctagaaagaatgtcaggctaccaaaaatgaaactgataatgcaacctgcattaccaggaaaaggaaaagggtgtctgtagaggaaccacctatattgtgtggttatgtagggagctctcataggttcagggaattgaggcacaagaagtaatgtgattttgagagctcaagtagctgaaatgacgtgaaaaactcacctgtgagtagttattttggattttttttcttctctcatgttagaatttaagttccattaggattaagaaccaagtcaattttgttcggctctctgtacctaatgcttagcataataaatattattaaatcaaagagggaatttagtagaaatgtatatgaagttctacatgtggatattaaaagcagctgtacaagtacaggaagagctttagctgcattaacaaacacaattgcaattgctctatcactagcgtagtgtggtggcaacgaaaaacccatctttagttgaattcctagatacgtgatgtctgaaatgaaaattgttactactatgctgcttctgtcccaggctggtagggtctcacctggaatgcagtgtttgatccacagcagcacacttagaaaaggccatggaccaaatggagagaagaactcaaatcatgtcaaagaagcaagttgaaggaaataggcacgttaccctggagatgagaatgctttacaaagccatagagaaaagggtttcactttgttatatgtgtcttcacaaagcaaaacaagaaccaatgatagaaattgcagagacagatgttgcctccttttaaggaaatcatttttttctaatgaaatgatctctcttgggaggcaatataaggatcttaccactggagatttttgagactaccaccaattgggttctttgtagaagggattatcagtggttctcaatcctggctgcatattagaatcctcttgagggttttttaaagataccagtgcttggctccttccccagatattctgatttaattggtctggaatgggtttcaggcactggtttcctttaaaagctccttaggggattttaatgtgcagtcagaattgaactcttaagctagatggccaaaccattaactaatatttatttagtactttctgtgtaccagacactgtgttaaacacatttatattacttcctttacataattcttgcaatactctgtgaggtaggtatcacaaaagaggtaatgaaagatcaaaaggttggccaggtacagtggctcacgcctgtaatcccaacactttgggagactgaggctggagaatcacttgagaccaggagttcaagaccagcctgccagccaaggcaacatagcatgaacctgtctctaaaataaaaaaaggaagaaagaaagaaagttcaagaggttatgatctttactcttggccacacaactctttttttttttttttttttttttttgagacagagtctcactctgtcacccaggctggagtgcaatggcatggtctcagctcactgcaacctccgcctcccgagttcaagcagttctcctgcctcagcctcccaagtagctgggaccacatccagctaatttttgtatttttagtagagacggagtttcactatgttggccaggctggtcttgaactcctgacctcattttccgcccgcctctgcctcctaaagtgctggggttacaggcgtgagccaccgcacccggcaggccacacaactcttaaatgacagtgcccaagttaggactcagatctgacttttagagcccatgatgcttttcaccaaatctcactccttatcacatagggtcagcattttctttattaatattgagttctatcagcagtattttgacatgattcctttaacatacactttaacaattttaagaacaggttatgccatctagctttacttctttggaaagggtattaatcttatttgctatgtccattattataaggaagtaaatccagagtttacagaatcacaaatcattcatcagaatgattgccactacccacagagcatatctttttaaacttctagacccgatagccataatcaagatgtctccagaaagctgttagcacaaagcacatatcctgaaaccatttgcctcagctctaatctgcaaataaaataagtaatagttggacaaatctgtcagtaagcatttctggttttgctttagtcttcagtttaaagagcataaagcaaagccagtgcatttgtttatgttataatagtggccatcatttagaactatgtattagacagctagcatacaattattgattcacaaattgacagctgagcgccatggttcatgcctgtgatcccagcactttgggaggctgaagtgggaggatcacttgagttcaggagttctagaccagcctgggcaagatggtgaaaccctgtctctacaaaaagtataaaaattagcgggtatggtgacgtgcgcctatagtcccagctactcgagaggctaaggtgggaggatcgcttgagcctgggaagcagaggttgcagtgatcctagatcactccactgtactccagcctgggtgacggagtaagaccttgtctcaaaaaaaaagaacataaaaaaaaaaaaaattggccgggagcagtggttcatgcctgtaatcccagcactttgggaggccgaggcaggcaaatcactggagtccaggaattcgagaccagcctggccaacatagcgaaaccctgcctctactaaaaaataccaaaaaaaaaaaaaaaaattagcagggcgtggtggcacgcacctgtagtcccagctactccggaggctgaggctggagaattgcttgaacccgggagacagaggctgcagtgagctgtgttcatgccactgtactctagcctgggcaacagagcgagagtctgtctcaaaaaaaaattttttttttaattaaaaatcacaattacattctgttttaaacttggtgactgtttttttttctcctttgaagttggttagtacattacaatgtcattcactatataaggctatttactgatattttttaaactacctgtttgatatgttaagaattgcttgtgaagacaagaaacaaaccactgtgtttacataggggattaatttcccagtgggcattacttgtgacccatgtgctatattgaagtggtcacaatagttttgtaatagtagatagtgttttttaaatgttgttacttggcaaatcctattcacaagttcaaaaacctagtattagtgcattgtacccccgcaccaccacctactcctgcagttttttttcaactggctcatgtaggagtactggacccagagggcaggacccaacagattccactgtgactccagatgagcagaagcttttaaaatgcagtttgggtatgtttgtgaaaatatcacattgctatgttgaaatacatacctatttggtaatagtcgcaacctttcaccgtttttagtttgacttgataatgactgaatctattcagggcatgcttcaaaattgcattaactgctgtataaaaaatgaaaattgaaaacatattactttggaaataatactattaatagtgtgttaggttttgttacaaatttaactgtgtccctagaaacacattttaaaaaattattatttgaactaaagcatattttgctttctctcttatctaatattcaccttatttacttctgaaacaccaaacttaaatgttatatggtctggtaatactataaaatagtaataatataataaagaaaagacagtaatttaaaatagggagacagcataacttaaagtcaataagttataatttataatacattagaaataaaatgtattgcatatgaaaataacttttaattcatgcaagtagatctgcaaaatcttgatggcagtatccaaatgcagtatcaacaatgtgactatattgacagtaggagcttaaataccttgaatgtcttaaagtacttaaagtaactaaaaagacagtctcatttgaaatcaaggcagaggtgtcattcaagcaatttactcagtagttctaaaagcgaataactgctgacattagagtagccttatcaccatgaatcacgtttcactttgaatgttcagataatcaaattttagctgaaataaaggttcatttatgtagccgaaatcaagaaatactcacagttcaggttcgcctgaagtaaaaggagcagaaccccaagcttccctagacactgagactcgtcttggttgtgtcagctgggctcttccatccggtcgtggtgcaattggttggggttctcttcttttttatgttcatatgtggtggtagggttttttttttccccctctttttttttttcttttttcggtatgacaactctcagattccttttgaaaatattaaaaagccctactaccatggaacaactttaagctcaaccaacactgaactttaggaaattatttatatcttctttatgaataccttccaacttgacaattgtggaatgttttcctccccccgctcaaaatttaaaagttttataaattctaagcagaaatatgtattttctgtgttttgtaagaaatgatacataatatgctatatggactttcaaagcacaagcactgaatttctgtttcttaagttttcatctgtacattattttagcatattttcatgtattcctttaagacctttgctaaaacaaacttgtattattaggactagatgagatttctgatggtgttctccccttttgatcactatgataaactctcccgagcaaattaaaacatcacctgtattttaagcgaaataatgatgggattctgcagtcttggttttgatcctagtccaaaatttaaccactatctgtccatctatgtaactgctggccctgcagtttagtgttatttccctttttttgttgtcatttgaaatgaagaagttagtttttattctccccataattgttatcctgcagcttgtttgcactaaatatttgactcattgggctgtatctaacattctaattatttctgggtacactcttctgaacattatattctccagagctttttgtttgttataaatatgatttatgggacaggatatttttaaattaatagaataaaaatgttttgtagctcttacttccccttagaacctctgagaaggaaggtggttgctgtattagtcctgcaatattgttgtattggcaggattttattttattgtggtacaatatgtaacattaaatttaccatcttaacttttttttttttttttttttttgagacggagtttcgctcttgttgcccaggcgacaagagattgtacaatggcacaatctcggctcactgcagcctccacctcccaggttcaagcgattctcctgcctcagcctcccaagtagctgggattacagacatgcaccaccatgcccggctaattttgtatttttaatagagacagggttttgccatgttggccaggctagtttcaaactcctgacctcaggtggtccacccacctcagcctcccaaagtgctgggattacaggtgtgagccattgcgcccagccccatcttaaccatttttaagtatacaattcaatagtgttaagtatattcacattgttgtgcaacagtttctagaagtttttcatcgtgcaaaactaaaactcttcaccactaaacgatttctctcctctccccctgcccttgacaatcatgattctttatgtttcattgatttggactactttggacacttcatatgagtggaatcacacagtatttgtccttttgtgacatgtttatttcacttggtgtcatatcctcgaggttcatctgcgttgcagcatgttacaggatttccttcttttatcaaactgcattatattccactgtatatgcaccacattttccctatgcattcatctgttgatggatttttgggttgcttccacctcttgactaatgtgaataatgctgcagtgaacatgagtatgcatatatctcttcaagatcctagcaggaattttttaatgactaaataggcatttaactacgtgcattctatttcatataatctagcatgaatatatttttttctatattattttcctacacctaagacaacccttttcaaaacactaattgttttaatcttcagtttcctcatattgtgaccacattttctcctcaatgtgagtcagcacagctaccaccagatttgagtataatctttttctagttctttctttatataagctttttcctgttcattctgaacattctggtttgtctctgcgttcttagctcattttcgatatgtcctcttcccttcacgcttcctctttctcttgttgggattataaggtatttatattaagatagaagtagaaaagaacaaatgtatacgcttgtttggtgccatctattactgatatcactgttctctttaaatcccaaccctggttaaattcagctcaccacctactccaggcctgaaccttgccatgtaaaatgaggactgctggatacaaacactcaatgatgctgattggtctcacttcaaattcatgactacaaacctcaagtgggcccctgggctgccaacagtcctagtatatttccttagtccagtggttctcaaaacaggggtcccaaacgagttgcgtcaacaccactcagaagcttgttagaaatgtatgttcttagctgggcatggtggcgtacgcctgtagttccagctacttgggaggctgagatgggaggagcacttgagcctgagagtttgagtctagcctgggcaacatagcaaaaccttgtccctaaaaaaaaaaaaaaaaagaaagaaagaaaaggccaggtgtggtggctcacgcctgtaatcccagcatgttgggagaccgaggcgggcagatcacctgagggtcaggagttcgagaccagcctgaccaacatggtgaaaccccatctctactaaaaacacaaaaattagctgggtatggtggcacgcacctgtaatcccagctactcaggaggctgaggcaggagaatcgcttgaacccgggaggcagaggttgcagtgagccaagattgcaccattgcactccagcctgggtgacagagcgagactccgtttcaaataaaaaaagaaaaaaaatgcatgttcctgacttcatcccagacctgtgagccagaaattctggggatggggctcagcagcctgtgtgattctgatgctaaggtttgaggaccactgcttaatcagttcattcttctattccttgaaaatactttttcacacctgtactcttctcagactgccaggaacccctctccttcctcactcccacctggtgatcactttttatttcactgagaaaatagaatcactcagaagagaattttattgtcttccagtgtccacctctgctagtatatacaaatgtctctctaagaaacaaaagccgggcgcagttcttcatgcttgtaatcccagcactttggccagctgaggtgggcagatcccttgagctcaggaattcgagagtagcctgggcaacatggcgaaaacctgtctttaccaaaaactacaaaaattagccgggtgtggtggcacatacctgtagtcccagctactcaggaagctgaggcaagagggtggcttaagccccaggaggtggaggctgcagtaagccatgattgtgccactgcactctagcctgggtgacagtgagaccctgtctcaaaataaataaaataaaaaatttaaaaacctccacaaaaaagctctaggtactactatggaattacctgtagaatatattgttatgtggaaattttgaatatttgtacatattttcttatttttaaaaaactgaaggataaactgaaaactgataaaaatagttaccaatggggaagaaaagattgggagtgggggaagagtgcaaaagctagacctctctgaatagtatctgttttacagtttgtactttagaacctatgtacatgttttatacaattaaaacaccaaattaaggcaaaatctagttgaaacaaatgaacctcactctattgcaaagtgaaagcataaccacaaggagaattatttttggtaacttttaaaatagggtaggggtttttgttttgtttttacgtaattttagacttatagaaaagttatgagaacaagtacgaggattctagataccttttactcagattctctatgttaacattttttccttcatttgtttaatccttctcaatctctcactcttatccatttatgtatttcctaaaaatagggaattcctttacatagctgcagtacagttatcaaaatcagttaatttatgttgacctaatatcattatgtattctacagaccttgttaaaatttcatcagttgtcctagtaaatatcctttataacaaaaataaaaacaaaccgggcacagtggctcacacctgtaatcccagcactttgggaggatgaggcgggcggatcacttgaggccaggagttcgagaccagcctggccaacatgccaaaacactgtctctaccaaaaatgcaaaaaattagtcaggcatggtggcacgctcctgtaatcctagctacttgggaggctgaggcacgagaatcgcttgaactcgggaggtggaggttgcagtgagcagagatcatgccactgcactccagcctgggtgacaaagtgagaccctgtctcgaaaatatatatatattaaaaacaagatctatctttttagtctcctttaatcactttaacctggaactgtatttgaagaatataggccagttactttctagaatgtccctctttgggtttgcccagggttccttcatgattagatctcgttatgtactttggcaggaataccacagcagtgttgccaagttctcaatgcatcatatcaggaagcacatgctatcaatcagtcccattagaagcagtgttaacttcgctagtttctgctgggtttctcccttgtaaaattactagtttcctgtttgtaattaataagtatgctgtagggagatatttagagatcacataaatatcttaccactcttcaaacttccactcacaagttagcatccttgatgattcttacctgaatcagttacgataatgaaaactgacagattccagcatttcttctacatttaattgattttctacttaaagcttttcctccttccccattcatgtatttgtttatttatttacatcagcatagactcatggattctttacccagtagtaaaatgctattttgaccgggcatacctagtgggatatatcttaaggacaaaaagaaccacaaaatcttaaacagcattcagtggtgttgttattgataatgtaggtattactattattttaaaactttcacacacacatacacacacattctgaagcacaaagcaaatgagtaattatgttagtatcattaggtaccaagattacagttgacccttgaacaacatggggattggggtactaatccccgcacagttgaaaatccatgcataacttttgactcccccaaaacttaactactcctggaagccttaccaataacatagttgattaacacatattttgtgttatatgcatcaagggagcctcaagtgatcctcaagtgatcctcccacctcgaccttccaaagcactgggatcataggcatgagccaccactcccagccggtttgataattatagaaagaggtttggctttaaaaatgtcaaaatagcaggatgcagtggcacatgcctatagtcccagctactcaggaatctgaggcaggaggtttgcttgaacccaggagttctgggatgtggtgcattatgccaatcaggtgtccacatgaagtttggcatcaatatgatctcccgggaggggggtaccaccaacttgcttaaggaggggtgtgaactggcccaggttgtcagcggagcaggtcaaaactcccgtgctgatcagtagtgggattgtgcctgtgaatagccactgcgctccagcctgggcaacagggcgagactcccacctctgaaaataaattaaaattaaataatgtcaacataacaggaggatcagtttttgtcagcaaagaggcagcagatgagttctcagatgccattcagaaaagtattgaagaggagcaatatctgcctgaacaggctgttaatatggatgaaaagtgccctattctggaaagaaaatgccacagagaacatctattaataaggaacagaagcaagcaccaagatttagggcaggaagggatacactaactctaataagcatagtcctgatataattccaactgcatttgcacaaaacagtagagtcagcctatctgcctcacttgaggtcaggagtttgagatgagcctgggcaacataacgagacactctaaccccccaaaaaatgtttttaattagccaggcatggtggcacacacttgtagtgccagcttctctggagactgaggcaggaggatcgcttgagcccaggagttcaaggctacagtaagctatgattgcaccaactgcactccagcctgggtgacagagtgagaccctgtctcttaaaaaaaaaaaaaaaatttatcaaactgtcttttgccaccattgcattctccagcttttagatccttcattttttttttttttttttttttttttttcctgagacagtctcattctgtcacccaggctggagtgcagtgtcagcctcctgggtttaagcaattttaccgcctcagcctcctgagtagctggaactacaggcacgcgctaccatgctgggctaatttttgtatttttagtagagataaggtttcgccatgctgcccatgctggtctcaaagtcctccactcaagtaatctgcccaccgcagcctcccagagtactgggattataggcatgagccaccacacctgaccccttcaccttctttttgctttaagttgctatttcgctttttctcaaattatgttagaatctataggtatgtcttttttatacccacataaaagctgcattttcaatactacttaaaaaggtatttcacaaaaagtgcaagattttagcacctactggtgttagctgcaggagtagcttcatgaatttcctttcctttttttttttttttttttttacaatggtccttatgttggattcatttatcttgagatggcagccaattgcagttgcagacctcaatctacaatacatatcaagcaattcagctttttctttttttttttaagatggagtctcgctcttatcacccaggctggagtgcagtggtgcaatctcggctcactacaacctccgcctcccaggttcaagcagttctcccacctcagcctactcagtagctgggatttacaggcgcctgccaccatgcccggctaatttttgtgtttttagtaaagatggggtttcaccatgttggccaggctggtctcgaactcctgacctcaggtgatccacctgcctcagcctacctttttcttgtaatgtcatgactttcctctgtttcttaggagcacttctagcatcaccaatggcactttttatggatcctatggtttaaggtattgcactaaacacagtgaaaataatatgagaactgtgagattacttttactgtgatatgcaatttattggagagatgaactgctcaagcaaagataagtagcatcacacaacatattaggtgaatactcgcaagacttgagctcactgcaacagcaacaggagggagctgtgaaattattacagtagtataatatgtactacagttaattttatggttatgatttaatattgcattctttgtatttgttcacatttctcttgactgaatggcaccgtttacagtctgtgtaggtgtaagttttgataaattttaactctttataatagatttgtgtacatttttatagtactaaataataaaatagtatctaaatatgttttatgcatttatgatatagctttttcttaattttttattccagaagtcatccttcacctttttcttaatttttaaaatagttctaggcaacatggttggtccacgagttttttcaaattgttacgaatctccaaaaaaaactttcaatatattttgttgaaaacaatccatgtataagtggacccacacagttcaaacccatgttcaaaagtgaactatacttgccaaatcaaagaattaaagtaaaaatgctataattgaataggaagaaatattagcttgaacttgtggtttatttatttattttttttttttgagaccgagtttcgctcttgttgcccaggctggagtgcaatggcatgatctcggcttaccgcaacctccacctcccaggttcaagcgattctcctgcctcagcctcccaagtagctgggattacaggcttctgccaccacacccagctaattttgtatttttagtagagacggggtttctccatgttggtcaggctggtcttgaactcccgacaggtgatcctcccgcctcggccttccaaattgctgagattacagacgtgagccaccacgcccagcatggtttatttttctcctaaaaatgcattcttttttcagcactgtccactgaaaagccaaagtaataataacccagtaaaaataatatgcctagtacccacatcatggatttatttatatattttattttatttttatttttattattattatttttgagacagagtctcgctttgtcgccaggctggagtgcaatggcgcgatcttggctcactgcaacctccgcctcctgggttcaagcgattctcctgcctcagcctcctgagtagctgggactataggcgcatgccaccacgcccagcaaatttttgtatttttagtagagttagggcttcaccatgttggccaggatggtctcaatctcttgacctcttgatccgcccacctcggcttcccaaagtgctgagattacaggcatgagtcgctgcgtccagccaattttttttttttttttgagacaaggtcttactctgtcacccaggctggagtgcagtggtgcaatctcagctcactgggttcaagtgaagctactgcctcagcctctcgagtagctggaattacaggcatgtgccgccacgcccagctaatttttgtatttttagtagggacaaggttggccgggctggtcttgaactcctgacctcaagttatccacccaccttggcctcccaaagtgctgggattacaggcatgagccaccgcacctggcccacatcatggatttaaatcgttttttgcactaaaaagaaacagggctacttagagaaatggctgattccagatctggggcaagaaatggacatgacaagcctggaacatcatcttgtgactgaaagcaaggaagttatcagacttctggagtcttacaaaaatacagaagaactgacttaaaggggctcccactggcccaaaatgggacaatttgagcacaaaaatttgtaaaggcagcaactgattaaaacacattaaatatataaaaatctgtaagttcataataattaaaaaaaaaacacctcatcagtcacctttggaggttgcctagaaactaacttggtattctggaaataaattataacagctttattcataatatccaaaaactagaaatagcctaaatgtctgtcaacaggagaatggacaaactgatatattcatacaatgcaatacttacggcagtagtaaaaagaaatgaactactgatcacaacaaaatgaatgaatctcagaacatgctgaatgacagaagccttacataaaagaatacatacttacggttttgtgtctatcaagttctaatataggcaaaacaaacctatggtgaaaaaaatatcagagtagtggtttgcactgggggagatggcagcagagattgaatgggaaggggatgagggagggaggtttgtgggataatgaatttttttagggatttgggttacacaaatgtatgcagttcatcaaaactctaatggtacgcttttgtgcatttcacagtatatacattttttaccttaagcataactttattttttttttactttttatagaagttttaagagacagggtcttgctgtcacccacgcaggggtgcagtggcacaactgcagttcactgcaatcttaagctcccaggctccagtgatcctcctacctcaagttactggtcccaagttactgggaccacaggtgcacgccaccaaaactggcttttttttttttttaagtagaggcataattttaaacaaatattaaatttcaatgatatgtgtgctaaggtgtattaaaaagtaagatggatagaaggataaagagatagatatttgataaagcaaatgtaacaatatttaattgtagaatctaggtggctctttacaatataattctttcaattttctatatgtttgatagttttcataacaaaatgttgaagaaaacctccattttggcacctctaattatgggtctaggcatcaacatctgctaacatcattgagtgaaaagttgatggtgaatcttataatgatgggtcaggcagacaacacctgaacccactgctcaatcctgtcactaaaagtaggatagccaggtgctatgttcttcctgttgcaatacaatagatatatcacctatgaagtattagtgcataaaactaaaattgaatctgaatctaatcaagattctagatctaactacaaatttacaggaaatacaggagagtaaaaaacattaaataataccatgtaggtaccattagtcaagtacagattgtgggggatttcacaggaaaaattacctagtatcttaacaaatcaatggcatgaacattggaaaaaaaaaagcataaggaaggggatctgttacagagtaagagacactcacaagacatagtcatcaaatgcaatgtacagaccttggatcctgtctagaaccaaccaaccgtaataagacctttcttctttttttagtctgttctactccttcaagttattggtagagaaaagacatttttgagacaatcaaggaaaactgaatgtggactgagtattagatgatactaaagaagtattgctcattttgttggacttaataatgatattatggttatttttaagtcctgtgttagaaatactgaactattaacaggttaaattacatttatgttaaaatacttctggggaaaaaaagtaaacagttggggatagatgaagcaaaaatgaaagaatgtccttgtttttgggtttttcgtttgtttgtttttgttttatttttgcctggagacgggcaagttgcccatacatcccagcaggccaggggaggagctgaaagaatgtcagtaattgccaaagctgggtgatagatacatggaagtttattaatctattttctccacttgtaaatgttaaaaagaggcatcctcagcttcacactttcttctacatcccatttctccatttttactacagtaagactgtgaaagatatctgtatttactgtcactacatcatctcctcccattctctcctgaacctggtccaatggggatttttgcctccatcgtgccaccaaaaccactcttatcaaggtcaccagtaacttccaaattgccaaatctaatggtcagttctcagttctcattttaaatgacctttgtaacattgatgactactaatcattcctacttgaaaaagtttcttcacttgacttccggataccaaactgattttcctcctgcttcactgtctagaccttgttttctttgctagattttttcttctgacttcagatattggcgtgcaccaggactcaatcctctgactcttctctatgatttcctaagcaatttcattccttaccatggctgtaaatatcatctgtgtactgttgattcccaaatttacacctctaatcccagcttccccttaatgtcatcttataaaatctcaaactcaatacgtatgagaccaaattcttttttttttttttttcatttttctataaaatagagatggggttttgccatgttgcccaggctggtctgaaactcctgggctcaagcaatcttcccgccttggctccccaaagtgctaggattacaggtgtgagccaccgcacccagcctgaaaccaaattcttgatccaccttacaaactcctccctcagtgttccctgtttcagtaaatggcatcttcattttcactcagttgctcagaccagaaaactaattgttataattgacttgtgtctttctctcacgctcatatccagtagcaattcctgtcagctttacctttagaacataaactgaatttgactacttctcatcatctctgcttctgtcactctagtctagtccaagtcaccatcttctcttgcctgtgcaactgcagtagcctcttaattggtctcctttttccctgtttcttcacaatctcctcacacagcagccagagtgatccttttaaaacctaaaactgatgatagtactcccctgttcaaaaccttatggtgatttcccatctcgctcaacataaaacccagagttcggagagcaggccagagcccaggcccggcccagcggcgcccgccaggtagacccaggcgaggccgcgtgccggcgcgaggggagcccactgcgggaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttttaggagcccgtaggtcatcttggagggtcgtctcaagtattgaacaaaagacggaaggtgctgagaaaaaacagcagatggctcgagaatacagagagaaagttgatacggagctaagagatatctgcaatgatgtactgtttcttttggaaaagttcttgatccccagtgcttcacaagcagagagcaaagtcttctctttgaaaatgaaaggagattactaccattacttggcagaggttgccactggtgatgacaagaaagggattgtggatcagtcacaacaagcataccaagaagcttttgaaatcagcaaaaaggaaatgcaaccaacacatcctatcagaccaggtctggcccttaacttctctgtgttctattatgagattctgaactccccagagaaagcctgctctcttgcaaagacagcttttgatgaagccattgctgaacttgatacattaattgaagagtcatacaaagacagcatgctaataatgcaattactgagagacaacttgacattgtggacatcagatacccaaggagacgaagctgaagcaggagaaggaggggaaaattaaccggccttccaacttttgtgtgcctcattctaaaatttacacagtagaccatttgtcatccatgctgtcccacaaagttttttatttacgatttatgacaggtttatgttacttctatttgaatttctatgtttcccatgtggttttcatgtttaatattaggggagtagagccagttaacatttagggagttacctgttttcatcttgaggtggccaatatggggatgtggaatttttatacaagttataaatgtttggcatagtacttttggtacattgtggcttcacaagggccagggtaaaactgcttccctgtccaagcaaagaaaactgcctacatattggtttgtcctggtggggaataaaagggatcattggttccagtcacaggtgtagtaattgtgggtactttaaggtttggagcacttacaaggctgtggtagaaacataccccatggataccacatattaaaccatgtatatctgtggaatactcaatctcaatgtgcacacctttgactacaactgcagaagtgttcctttagacaaagttgtgacccattttactctggataagggcagaaacggttcacattccattatttgtaaagttacctgctgttagctttcattatttttgctacactcattttatttgtatctaaatgttttaggcaacctaagaacaaatgtaaaagtaaagatgcaggaaaaatgaattgcttggtattcattacttcatctgtatcaagcacagcagtaaaacaaaaacccatgtatttaactttttttttttaggttttttgcttttgtgattttttttttgatacttgcctaacatgcatgtgctgtataacaatccaagcataattgttaagaacacatgtattaaattcatgtaagtggaataaaagttttatgaatggacttttcaactactttctctacagcttttcatgtaaattagtcttttggttctgaaacttctctaaaggaaattgtacattttttgaaatttattccttattccctcttggcagctaatgggcttttaccaagtttaaacacaaaatttatcataacaacaaaaatactactaatataactactgtttccatgtcccgtgatcccctctcttcctccccaccctgaaaaaaatgagttccaatttttttgggagaggggagattgattagaaaaaaatgtaatatgttccatttaaaattttggcgtatggcattttctaacttaggaagccacaatgttcttggcccgtcatgacattgggtagcattaactataagttttgtgcttccaaatcactttttggtttttaagaatttcttgatactcttatagtctgccttcaattttgatcctttattctatttgtcaggtgcacaagattaccttccttttttagccttctgtcttgtcaccaaccattcctacttggtggccatgtacttggaaaaaggccgcatgacctttctggctccactcagtgtctaaggcaccctgcttcctttgcttgcatcccacagactatttccctcatcctatttactgcagcaaatctctccttagttgatgagattgtgtttatctccctttaaaaccctgcctatcctgaatggtttgtcattgtctgcctttaaaatccttcctctttcttcctcctctgttctctaaataatgatggggctaagttatacccaaagctcactttacaaaatatttcctcagtactttgcagaaaacaccaaacaaaaatgccattttaaaagaggtatattttttcttttagaatgtaagctcctcaagagcagggacaatgttttctgtatgttctgttgtgcctagtacactgtaaatgctcaataaatattgatgatgggaggcaaaaaaaaaaaaaaaaaaaaaaacacccagagttctcaccacagtttcaaggccctacacctttgatcatccctcagatcacatttcccaccgctctgccccttgctctcatgcctttccagacacactgggcttccttcttcttctccaaacaaccctccttattcctgtgggcctttgtattggctgttcttctcatctggaacttgcttccatgtggcttgctttttcacttcgttctggtctctgttcagatattacccattagagaggccttctctgaccccaactaaaatagcaattccctagtccccatccctataacacctccttaccagcttaattttacttcctaacaagtaatactacctggctttacattctgttaatttgcatttatggctctatttgctttcttaaattcaactctttaggccaggcacagtggctcatgcctgtaatctgggcactttgggaggccaaggtgagaggatcacttgagaccaggagttcaagaccagcctgggcaacatatcaagacccctcatctctttttaaacataaattaatttaacttaattaagttcacattttataacttgtcttaaggattcaagaatgactgaatctacacagaggagaattatataaattcccttgtaacattaacttaagcctaaacatcatcaacatactattaagggcatacagaactttggagttctgatttcagcttctactccttcctaaggtgataacagttacacagccatggccagaagaccctgttggagtctagtttgcacttttttcttctgtatcatgttcattcttttctaggcttgctcacttgctgtgtcccatactggaatcatgctaggggtattgccatcttagtctgttgtcattgttctctctttgaaccaacagaaagttctaactaacagcagtctatcagttgatttcggtagaggtttgcctgctctcccatagactcttcttgctactttgtgtcatgctgtggtttgctcactattcatttctacacttgccttccttctttctctggctctcacatacacacttgtatttcctggctcatctctgtttgtgctagactattggaaaagtctttaaacttctttggacagaaagaataacttccaaagtagaatcctgatgctcccattgggcagagtaaggattcctcccacctgtgtgtcatcatcaaacacaggtgtaccagctcagtatgattgcaccctttttttatacctattatgttggctaaaactgaacaaaaactgtgtccttttatgaatgagaaaatataggagagaatttttaaaaaccttttgtcttctatgactaaagagacttgctttttttactagcccctgttttgagagccggtcagatgtagttttagtcatattggggaggacagtgtttaagcagataccagagctccccattatgaaattctttcctgacaccagccccaactaggtcccagtaagaaatagatgcagaggacaacatcctacaaaggaaaccctcattgttatcacaaagcatatgatataaaggagccctggtcaagcaggataccccttggggagaggatgtctttgccctggactaggaatcaggcaagtggttttctttccccttctcctttttcacctcccacccccacagagaggaaaagcagatccagagaagacatgcccaggaagagcgttgaagtccctgggaacaaggcttaattaaaatcattaaatctgacccatccatgtagtactccttggcttaagggtggaatgaataaagcaaagaaaagaggactgggcagggtggagaaagaaagggccatggctatcccctaacaaccaggatacaatggctctgtaggtaaaatcagaggtttcaagaaacattttggaagtgtaaaatatattttttcctaaagaaatctagactgtcactcaaaggaagacaatattgcatagtaaggcaaaaaaaatgtatctgtgtttcttgaacatccatgcttccttagtaattcttagcactgtactctaaccttacaagcaaataatacctaaagaacattggatggaacaggtatgtatttggagaaatcagccagacgtgagaatatgacaaataattcaagcatccagaataatttagaagtttttaatgtgtttctctattatcatgttatctaattttatgtaaactgcattgttcatcttcaatgaatccttatcttcgggtttgttttttgtttgtttgttcgtctgtttttcttttcagccccactgtgttctccttgcctcaaaagaaaactcggcacctgttaaacttggaggctttggggtagctattcaattaggggagtctggacttgtagctggaggtaagactgctttaaaaaaaaaaaattcttcaaaacctggtcacttgcgactggtataaaactttcaagctacatattagcccaacctcagtgtttcatacctcattccaccccaccccaactcccaaaaagcatcatcagatagtttttaatttaataactctgtagtcataactagaatcttagtcccttaagaatagactcttttttctctttgtacctccagtacttaagagactgtacaagattaaaacagtgttcagagaaaataagtttgaggcatagtgccttttaaagttgaactggccaaatgaagtcaaatctaaaatgtgtagattagccacttcctggtttacactgatggctaatttttaatttcatactgtttgcctttttccatttatcaaagaatcctgctcaagccatcagcctgtatattagcaaagaataagcagatgtgaatgcaggctgattttattattagccaaagcaaaacataatttttaaattcccatgtcagaataaaaagaaaaaagttacaaattatataatcttgcacagcacatttcatataactcaattccttatagctagaacatcaagcagtaacaacatagaccatcttcagaaaaatgagccataggtcatagttgtaatttttttttttttctttcagacaatgtcttgctctgtcacccaggctggagcgcacagtggcacgatcatggcacactgcactgcacccttgaccttccaggctcaagtgatcctcccacctcaacctcccaagtagctaggatcataggcgtgtgccaccatacctagcaaactttttttatttttagtagaggcaaggtctcactacattgcccaggctggtctcaaactcctgggcctaagcagtcctcctgcctcagcctcccaaagtgctgggattacaggtgtaagccactgcacccagccaatagttgtattctttaaataattttttcaccacagtgccctctaaaattaaattacattcaaattttcttttagtttcacattcttttccagttaatcatttccaataatatgcaaaactgcaagctgagtatagtttcaaagaatgctaattttttcccctaatttaaaactttctgttagtgattggaagactgaccaaagggtcaggtagtaaagcacagtttaatcatagaatctcaggactccaaagggccttaacttctccagtcttgtaactaatgattgaattcttccataatattcccaagaaaagattgagttctggtattaaacctcagagagcaaagtagtcactacatcccaagacagttcatttcatttttggataactccttaagtattaaaaagctcatctttgcatctttctgtaacttctacccagtcatcctaatcctgacttttgaaaccactctgaacaattttcatccttccgtatgataaccgttcatctgtttgtagacaactaccatgtccccctaggtcttatccaagttaacttccctagggtgatttggccattcttcatataaactggttcaaaatctcttcagtatccacaaagtacagggcctgaactgaacactctaactacaggtagtacagtacagccgatccagtgcacagtagcattgggctatcacttttttgtgttctgggccttaaatttccctcgagttccccaaattgcattagctttttggacaactacatagcactgatggttcatactgatcttgtaatcaagtgaaaatcctaaattattttttaaacaaatgtcactgttaagctaactctctcaattctggtacttatacagatcatttctatgttaagactacgtaattataacaaataatttctgatgattatattaccaaggttaatgggatgaaatgaaatgaatttattttatatgttatatactggccatatataatgactttgtttctgttgctctggatctatatcctgttggtatttagaatgtcatgttcttcgtattttattgtacatcttgactgggggggaaaatagatgcattatgtttacctggacattttctccatattaatctttttctaaagtccatgaacctttcacctaaattgtttatttttaaagctaattttgaactcccccccaccgcccaccgctggtatgtcagtattcaaaatgtatttttctccatgcttctagaattaaaatacttcctgatggtcaaaatattgtcatttcttagcacacctttttttgtattcttgaaataactgaatgttacgttttaaaaaatagaatatgaataaattagagataaattatttctcttagaaaaagcttttctgctgtttaaggtacttttgaaattttggtaattaaggttgggcacggtggctcatgcctctaattccagcactttgggaggctgaggcgggcagattgagcccaggagttcaagaccagcctgggcaacatggcgaaaccccatttctccaaaaagatgcaaaaattagccaggcatggtgacaagagcctgtattcccagctacatgggaggatcgcttgaacccgggaggcagaggctgcagtgagctgagatcgcaccactgccctccagcctgagcaacagagcaagaccctatctcaaaaaaaaaaagaaagaaattccgtcaatcatttaattatttatcaactttaaagcagaaagccattttcctgtcagtttgaaatcccagtccctagtcctccaaatagaaaggaattcatttctttatatgttgcatatagtaaaaatcatttaaacatatttacactccccctacctgaaactcagctatttaggaaacttacttatccagaatacaactagaaacctagaaaataactacaatagcagcaaaattattcctacccttaaaaatccactcatgctcctcacaattgagcatctaaagacactctctaaggctgacttgctcccatgttttaaaaagttgtatagattcgtgttccttcataccttgcacatgctattccttctagttggagtgccttttgttattttatctatctggttaactcctactgttctggaaggctgagctaacaattatctcctctttaaagcaggcttaccttcaccatcccgagttggatagccctattccttctctctatattcccataactatctgggctacatacctccatgtagcattggatgcagggacttacatcaaagactgtgatttgtaagagtaagggggaccatggctgagggtatctaggacctagcaagcacttaggaaattgctattaaatgaaataaactggttgctagtcaggttctagttaatagcagattataaaagcaacaaattaggagaacgcagaactaaagcatagtgagagaaaagaaataaaagcctgacaaaaatatatatgatatatactgagcagacaccaaaacttggaaagcgcaacagcctttcaatatgaaagaaatcaactcttgcatacctctgaagttcctgagggtgctttctgttctacagcctaggtctttaatcagtatctacaatgacaactctgagtcatcaagaaaaggttaaattatgagcagcattctgtgtaaaagaagtcaggaaattgtagaaagccatacaaaattatttaactaaggtgggcactgtgactcacacctgtaatcccagctacttgagaggccaaggcagaaggatcgcttgagcccaggagtttgagactagcctggggaaaatagtgagactctgcaaaaaaattattaaaacaaaaaggattgtgcgcataaagattcaaatcacaatgtatttaaaaatgtagctattcagaacaattctccccctgagattctggtaggaaggttttattgtattatcaaaatatataatatttaaatatttgtccaaaatatctcaaactgccatttaatttagtttgctaatttgtttccttttcttaaaattttgtggtcaaagtcctaaaagtcaagaagaagtatcagcaaaaacaaggatttttaggaagttggtgtatattaaagattaactccagtcctttttaccttctactgatttacatgaaataaaagagccttcctctacattctttctaccatggtttttcccctatcatctgtgagcaaattattgaaccaaacaacaggcatcttcccgaagattgaacactaattctccagaattgggtagtcttcgtctagctaaatggagagaaccttctcaggatggctgggactggccatggtcgctctgattattcccaagttaaggcccccattttgagtggcttggcccaggaagtggtaggagtcaagttgagtttcaaagcatcatccaaactgtcagcaggtacctaactggtaccctggtaccaattgaatgatactggtttcccctactcctgctagctcctgtccatcagaacaaggctaattctccagtggcccctccctgtccaggctattaatgaagtatggaaggcttagttcccatccctgcagcttcttcgtgttacttgaggaagcaaaatggggcaatacagaaataaaagtatttctctagccaggtccttctagtcaatagttttcactgatctatcgtacattttaaatgaaaatattttcactactggaaccctgaacttaagcttttctattatggggggaggaagggaaaccatatgatctgcagcaaaggtacatcctgatacacaagctaagagctcttttatctttctgcatcccaactgagtttcataatcatgaacagaacttgatatattctctctagctgaaccagaagatctctaaggtcttttaaaaccacagttctgagttctagataaagtattgcacaatcttcaaactaaaaattatcttgaactcagtatgatgaaagagagagacagagggaggaagggaggtggctgggcttgcatatatctagaagagctgccaagtctagtgggcagtgccccatcccacagtgatcttcctgccgggtacaagcctttcattccacaatagaagacttcttttgggatactgagttaaagatagttatgaatgtgcaaacagctagtatcagattccttacagaaagctaatttttgatagagaaacaaaagaaaactctttaaagaagatgaaagtcaaagaggattgaatgggaggagcttcataattttgcttttgtttatgccatatatttgctctcattctcttcatatgttaatgttaggaggaagctaaaaactcctactataacaaaatattactaactattgttaattgctataattaacccataaaatcaactgaacaggatttcagagtcaaattcatatttcaaataacagttctcagcatttggtttcattggggaatttccatttggcagtcaagtcatcttttttccaccgatttttttctcatgacttcctgccccctcctctcctttcccctgcctctgcctctgcccagggtaggcctcccaactctttcctggacagctacaggctctgcctgttgactctttcacctgcctctgctctatatatttggtgactttcaaccatgtgaaaattagaaaatttaaacttcttcatgaggtaagaaccacataaatacctactacgtagcatgcagaattcaatagggagtgccagtgtacaagacagaatacctattctgggctcaatgttttcaggaagcaattagataagtaatttttttcacctatgtgaacttgattttatggagaggtggaggagtggtgagagtatatgtattggtaaactttttatttggattgttattgttctattatttttagttttcaagtgaaaatcccattttatgtaaacatttttccttaatgttgttttaaatgtaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataaggtaatgcatcatgaacattttctttttccattgagattaatttatcctgaaaaatgtttttttgaagttactgtctgtctttgcccactaattgactgccaggtagttaccccatcagagaaaaggtctttgcttacatcattgatccagtggccttggtaggcaacataggcctcaagtaaatttctgagtcattgtcagctgagctatcaccctggtgaagaaaacatttatgaaccttctttgtgtaatttgagaaaggggcttcatttttaaagccttctgcttaatttgtaaagttaaaatggaatttcatccaggtataattttagtcattctttatcttaattttaaatttaggccagcacagctgaaaacatttgccatttacattccaggataaactgaaatgccaggatgacaactgcatttcatgatacaatatagaggcatttcagtgtggcttaaacattcctattcttctttggctattaggtgttggcagcctcatgtactatcacagacttgtgattagtaaatcattactttaactagtaaaaaattgaaaattcattactgactttatgaatagcgatatcacaaacacctaaggacttcttggaaataagtaagcttaaagttgatttcactaccccagcttttagactcctttgccctgtcccacaaggtacgactgacagtgactaggaggctgggcatgggaagcatggggatgtgtgtgtctgggtatcaggttaaggctgtttaagttggggaaattctttttcctctcattattactgaaactcatactttctattcaacctcatcactgtttcattttcagccatgactgacaacataaaaccaaaaacatgtgtatgtaacactggactctaaaactatgaggcccctaaagttttctcttcaattcctcggtaatgttagaattttatatgggacttggaaaaataaaatttaaaaagaagaaaagtaaagtggttccagagttacagtcttatccttttaagccataactgaagtttatggagatgagaatggtatatacttttgttggtttatttacctcactcaccatcagtttatgagtgcatataagtttgtcttttgttttagttagtttaagatatataccaaaactctgttaacagagaaagatgttttcagtgtagcatattctgctcctcccagagtcagctggccactggggaataaaatcaatacttaccaggtaactaaatgtctcaggaaactgcttgtaagtagtcatccctcttcaatccagggaagttgtaagttgctctcaggaatgcacagccaaattctggttgaatttagccaagtgaaatcacagatactaacgttttaaaagaaacatgattagtgatacatcagcataataataatactagcaataatgatagctaactcaggcatagcacatagcatagcatactttacataagtaaagtgcttagaatagtttaattcatttaaccctcacagcaacttgtgaggtaggtaccatataataataatcccccacctgcgtttttgagttataggcatttgctaataatagaattcttcctttgtgtttgttcagttgttaacttcctagtttccaaggcaatgtgcttcattccaacagactctggtattttatttcgtctatttttaaaacattgaatagttatttttgtttcttggtaaaaagacttagactattcacatatgtgcaaaaattaagtcatttaaaaattccctcttcctagtattatagtaagtcagatggatggtggcagctacatcataatttttttttgtacctggggtttgaagctttgaggttaataatttatttacttttttacttggctaacctcacctctcatttatcttcaggactttccttacaaaaagcctaggttttcaccaccttagtttgaagtatagatccatctctaccatctatgatgaatctcggcctttttcttttagtatactgtcatatgattctgtcagcatttatttttctatcttttattatcaaaaatttcgaacaaaaatagtagagagaatagtataatgagctcccagcttcagtaacacagacaatcttgttttatctgtattcaacatattattacattattttaaagcagatctcagctgggctcacttgagctcaggagctcaagaccagcctgggcaacatagggagacctggtctctacaaagagtacaaaaattagccaagtgtggtggcacacacttgtaatttcagctacttggaaggctgaggtggcaggattacctaagcctgggaggtcaaggctgcaatgagccatgatcacaccactgcacttcagcctgggcagcagagcaagaccctgtcttcccaaaaaaaaaaaaaaaatagatttcaaaaaaattatttcatcaccttggtggttcttttttgagacagagtcttgctctgtcacccaggctggagtgcagtggcacgatcttggctcactgcaacctccccctcccaagttcaggtgattctcgtgactcagcctcccgagtagctgggattacaggcgcatgcaccacgacacccagccaatttttgtatttttagtagagacgggggtttcaccatgttggccaagctggtctcaaactcctggcctcaagtgatccacctgcctcggcctcccaaagtgctggaattacagctgtgagccaccgcacccggccacatttcatcaccctaatggttctgagcaaaagaactattaacaaaattcttgatctctatggatattttaaagaaaagtttgatgacaccttttaaatgcagtactttttttttctttttttacctccagcagttgcaaatgtgagaccacattagaaaatactgtttcactggagtatatgctaacacttaacctcaattaacttctttgtaaagggcaaaaatatatttcccaaaccatatataagaagtgtaatgtcatatcattattacagataaccagttagtatatacacagcaagattctaagctgctatgggtttggtattcaaataagtaagattgttttatagccttattttgttcccccgtatagattcaatctccccaatttgttttagctactcttctcagctgaaggaatagaaaatcctgtgttggactgtcttgtaaaaaggacaagggagtatccttctaaacctctactcatttcagaaatcttaccacccctttcagatgatttctcaaccactttgtcaaggaaaaattattcagactttaaagagcacattcgctccaggatagggagaggaaacaagtctacccaagccctgtctaatcacttacctcatttcaaactggtcagttgaccacaatttcactaggatgaaaagtgtgggatttcatccctcccaaagtgtgggattacaggcatgagccactgtgcccggctggataatgataattaaacagccttatggcattagtcttaatgggatttgacaagcagaagtggctactatttgaaattctgcctgttggggggaaaaatgaagcacacttcaattttaagggctatccccaacataaagacacttttcactccccatcttcaagtacaaagtctcacattagtcagagctaatgctagcccttgctcaaattgtgatgattcatttatactgcagtgcaagtactgcagtttcatttggctttaaaatgttgtggagtttattcttcatctttcttccttagaaggtgatgtaggtctctgcctgttaaagccatggctttgcttgaaggtcctggcactgggtagctcacataaactcaccccatcagtaaacctgttgatattgaacaaggaatgagaccctactctgtctctgtctcctttccccacttgccttcccaaccccatgccctaaccactctgatttttttttaaatgattctgggtctcagacatatcccttttcccaggagccttctagcacttggctcacagatccacagcctttctcataagtcctgtgtcttttgaacaattcataattatttttgtttgattttaatcaatataccatgtggcttagttgtctcatctctaaaagagacaaaagtaacttcactgaggacagtattcaagcaaatctgttattctgtgggacctacggtagtagaatactttttcctaaacaccgaagttgatatgcagtgaccaaaatatcctattaaaaactttgcacagttcacaattattgctaacctcgattttttaaaacatatcttaaaaatatttctttaaaaattttaagttttattttagttctttctggatcgatgtattctagtctccctagctaaggatctaaagatagaaactggaataatgaacattctagtcttcaattattgaaaatattatcacttacataacaagaatatgggtatggaatatttactaacacaaattcttatgtagtaaagaacaacagaagaattgcatttgtccttttcttagaatgcaagcctttagaatcaaatttctgttctttgctctcagaattttattcacattgaagcaatataggaatattaaataatagtgaatgttaatgtctcatttaaggtaactatgtagttttcctttcctcctcctcagatgaatccaaggcagtggagccatatctctgaaagtgccaaagacctagtacgtcgcatgctgatgctggatccagctgaaaggatcactgtttatgaagcactgaatcacccatggcttaaggtacatgagcattcacaggtcaccttctacactttgtctgaacacttccagtgacaggaatgcgttgctctatgagatggtcctttttaccttttcttttttctgagcagttttcattagtttttttcatcttgtttgctgttcctgcacatcatctgtgaacatctgaatagaagacataccatttgagtgtcatgcagctatcagagggtaaaaaacaggattaagacagaatatatcaggggaaggcctcttttttctctgccaacatgtgttccaaagatatgcaacatcaacaactgaagtaataccatgttataataaattaactatctttattttgggtgtgactgtgtgctttatagcattaactatttttcagtagatactaggtataaattttctgtcttaggaaaacggcaggtttttttttttttttttagacaaggtctgacaacattgcccaggctggagtacagtggcaccatctctactcactgcaacctctgctcctgggctcaatcgatcctcccactttaacctccccagtagctgggagcacaggcatgcagtaccacacctggctaatttttgtattttttgtagagatgggggtttcaccatgtcgcccaggcttgtctcaaactcctggactcgagcgatctgcccgcctcagcttcccaaagtgctgggattacaggcatgagccactgcgcccagccaaaaggcagattttaaaagttcattttatatcccatcttgccagtgagtattaaggaaaattataacttgggacagcagtgaaacagtactttttgattaaaacattatacagcccaataattccaggcaattttcattttagatgttagaaagactaacgcttggagaggttaagaatttgcgccaagttggccgggtgcggtggctcatgcctgtaatctcagcactttgggaggccaaggtgggtggatcacaaggtcaggagtttgagaccagcctggccaatatgatgaaaccccatctctactaaaagtacaaaaattagcctagcgtggtggcgggcgcctgtagccccagctactgaggaggctgaagcaggagaatagcttgaacccgggaggcagaggttgcagtgagccaagatcgtgtcactatactccagcctgggtgacagagcgagtctccgtctcccaaaaaaaaaaaaagaatttgcaccaagtcacagaagttgtcagtggtgaaaccaggattctaattcagcctaccactaccctttgattttgcactagatcctatccctttttatttgaccacattgacccaacaacttcctcccttcctgcatcatcagagttctctctctgttggatctaacatgctataggttatttgtattatgcacactcttatatagacataataccttctcctgaccctacaaccccctccaggttttgcccctattctttgcttcccttgacagcaactcctgaaaagagttgtatagactactcacattgtccagtttcccattcctttcccatgaacccagtctagtcaatatcacaatcttatttattccactaaaacagctctggtcaagtcactactgaccttcatgttgctaagtccagtgttcaaatcccagggcttcttcttggcctgtcagcaacatttgacatccatccttctgaaacactgtcttctctgggcttctggaacacctgctctcttggttgtccttctacctcctggctgctccttctcagatcctactgattcttcctcatctcccctctcccacctcttcacactggaatgccataggcctccatccttgctcctcctctttttctctgttgaagctgaaaaaactcaaactgctctcacaccacacagcaacaatcaatacagaagacttctgtgaccagaagtgtggagatttcttcccaccaacaagcaagcaatcaactctgcagcagactgcagctgggtgtcctcccaactaaattcaaacactatctacctggagatagcatcagatcccacagattgagggctcagtcccacaaccctcacctcttcagacaccagtcataagtccaggccgctgaaacttctgccaaccaactacaaattggggacaccacagcctcttcctctttggggttggttaatttgctacagcagctcacagaattcagggaaacatttacttatgtttaccggtttgttacaagagatattacaaagaatatagataaagagatgcacaggacaagttacaggagaggaggggagcagagcttccataccctccccaggcacaacaccttccaggaacctccatgtgtacagctattcaaaagctccccaaatcctgtccttttggggttttatggaggccttattactataggcatgattgattaaaccatcggccattggtgatcaacttaacctttggtacctctcccctacccagagattgaggggtggggctgaaagtcccaaccctctaatcctgcctgggtctttgtgaccccatcctgaagctgcctagaggctgccagccatcagacatctttggcgtttctaaggattttaggagttgtatgccaggaaatgagctagaggaccaaatatatatttcacagtatacctctggtcttcaaacctggattccttacattaaaaaaatataggccaatgtggtgaaaccccatctctactaaaaatataaaaattagctgggtgtggtggcaggtgcctgtaatcccagctacttgggaggctgaggcaggagaatcgcttgaacccaggaggcagaggttgcagtgagccaagatcacgccatagcactccagcctgggctacaagagcgaaactctgtctcaaacaaacaaaaaaaaaagaaatataaaagaatatataattcaaaagacactgccacattactagaatctcattcaggcattgataattagttcagtccatcatcataatgtatgaataggtctcccagcatgaggccactcaggtttgcaggctttccattgatcttgccaggttctaaaagcaggaatggtcttggtttcaccgtttcagacacctgatataattgagctaagaaacagtatcctttcttgctctgagtctctttcaaggtgttaatgtaatgtgataatggatttccctgaattcataacacatttatttattcctttactctcagctgttaattttttcctcactttattaataacctttggaagaaacattagaatcaacatcgtgctggtctagatggcagacagcaatattagtctagtaattacctcctcctcagtccactcccatgcagggagactaaggttacataggtgccaatttagtggaccgtttttaccaccaggcaatatagctgcattcacaattaacccgttttgcacaacccacccccatcaggtccttaggaattctgacacaaggtttaaaaacatagttacaatttcttgtttaggaatcatccctggttctaacactggtagttatggctctggtcctagaaccactgcatagggaggggcagggggagtttagatgatatgggaaagaaggaaagaaaaaagtatagtcattatatcagcatactcccctcttgtcaagaattgcatagtcataacagcatcctctaccaccccccttccccagatcaatcagaaaaacgaaagaatatctagtggggacactcctttagccccactcatgttgagtgtgagtacacactggtaaaggcaagtaagccagcccttcctgctttcatctccccctgttttagacaaccaatgttttcattgcccattttagtctctatcaaactattactctgagaagaatatctctgcccactgctggaacattatgggctgtaccgtgtgttctttggcctaaagaaatggtgttcagctctccaaatatgtgcaatatcttctgttctggcttttttatggtattctcatcattcacatcttccaccgggcaagcaaagcccagtccagaatcagtgtctactcctgtcaaaacccatctgtggcctcccagggttaccagcatcagcctcacttgccagcttgttcagggctttcccaccagggaaatctgccccacagccatgggcagtgtctgtctcttttgctggcagacagaacagttcttattggcattttgtgcctgaaatgatacaaaagaaacctgtctagatgcagcccatctctgcactgttgcagtacccgtttatccactcatttgatggacccaggtggccacctcgagggagcacacagggttctctgcttgtcaatgtcaatcattttccaaacccagaaagaggctcttatgatgggcatcaacatattctacttattgcacccctcaaatttccatagggccattctccatatgggcatccctttaataaataggccaggtttccactgcccttctgcctgaccatgtgaccaggccactggtgactgtccatgagtcagtaaaaaaccaaacacgggagcttttgttattgttcatttcttcagaatgcaattcaactgccaagctaatgtgatcttaccttctttgatcaagagtggcatccttccaaacaggatgctgtcgattcaccttggaactgtcatccacacaccaagcagctcttcgttggtcagttgagagctgttcacggggccctgtccaagtgtcagtagaatcccacagttcctcacacagttccagagtcagtcctaggggaaaagaggctccctgcttgaggatgtttcctccttgcacttcccggagaggatgttcctgcataaaccatttccattttattatggaactattctgggcgctgccatccccatttgaatgtttctctgacatcatgtgagaaagcatgggtatttcaggtgtcaagatcattttatgtccttcagtcattagggatagtttcagttaatgtcccatagcaaggtagtaaatgcaccgagatggaaattctctagtgcaaagtcctagtggttgtcactgggagatgctcacagactttggccataagccccagtaaacatcctgcaaagggcgagcagatggagaatttgtccctaccagcactccagcttctcaactccacactgtgtgagctcaagcaatcttactggtgcctagttagcgtgtccaattaatatttctcgaagtgcagatttacatttcttctgttttacaatactgggtaggggaagtgttctccacccagtcataattatccagttccataaaacatttaggtaaaggagacataacttatttatgtatatcctgtttaaacattccaaatctcatactcctatcaaccctcacttttaccctttcttgtttaaaaaaaaaaaaaaaaaatgttgagtccccaacagcaggttgagccaagggaccttgccccttttgtcagtctttgtattgattaacctgcctcaacattaccccaagtaactgttggtcagctttctcactgtaatctctgccttctgactttttcaatttctccaaactggggtgaatacagcaaacctgtttggaatcccttaacattgggagaacagcagaagctccctaccaacctttgatagtattatattgagatctttgttttaaccccatcgatttccactttattcatctcatttctttttatttcttttttatttttttgagacagagtcttgccctgtcacccaggctggagtgcagtggcgcaatctcagctcactgcaacctccgcctcccaggttcaagccattctcctgcctcagcttcccgagtagctgcgattacaggtgcccgccaccatgcctggctaatttttttgtatttttattagagagggggtttcaccatgtttgccaggatgctctcaaactcctgagctcaggtgatccacccgcctcggcctcccaaagtgctgggattacagatgtgagccacagcatccggccctattcttcccatttcttattagccctctaaagattccaccctgctgggatgagtcccatgattctcctctttcttttttctcttagtttcaccccatcactgttttcttcattcaccttatttattaataaccatttaaactttccaccttcctgggatgagtcctgtgactctcctctctgcctttccccagtcttttgttaattacgctcatgttttcattggtgcccatacaaaagaggctccctcagccatagcatttactacagccagagtaatggatgtattcagtgagtgaatatctcagtcatcataaagccagtcccacatggcctgcataggaaccaaatgagccgcttcacctggggtactccacttggcattgataggtagagttggacagtctctaccttctcagggtgtacagaccttacagtggcttttattccattcactaggctgactgttccctcaggaataactccctgtgtgtctggatcacattatacccattgttgattgttcagtagtgagctgtgggtcctgcatcaacccaaacatgcctgtccactctgcagcatttaaaaccaaagaaagtgccctaaattagttattctcacaatccattttagtaaaggattttcagtaaactgatgataccaatctatgaaatgagacaatttcttcacactgtaccctctggtttcagtagtttcttggttttgcccttccctcacatcaactaccttcgtggtaaccacaggtcgtagaggtactgtcatccctgtataatttttcctttgggggtcagcttgaaggctagtggcctgggctcagatagactgaaatctgagcttggtctagcatcaaggcctcatccagcatttgtttcatttctgttcagctattacagacaaccaccaccaagggagtgaatatttcatctttttcttactagtttgcatatccttatgcatccagtgaaccaactccctgagttggatccatctctaaattccactggtaacttttacctttagcaattgattgcgacacagttgcagctccaaaccatggaagaccacgataatgaaccaggaatcaaaggttcctcatctcccaccctttcattctttctcttcccaaaccacatatttctgtgagccagggccgttctagcaaaccctacttcactgacactaactgaaggtggaaaaactcagaactgttttcctctgctctcgcaccacacaacaacaacaatcaacacacaagacttctttcaccaaatgtgtggggatttctccccattaagaagcaagtaatcagccctgctgctgggtattctctaattcaattctgacactatagtatcacatcccacagtttgagggcttggtccccaaggcctccccttcccaccctttcagacaccagtcacaagtccaggcctccagaatgtcagactgactggctacaaatcagagatcctacacctgctctttgggttccattaatttgttagatcagctcacagaagtcagggaaacacttttaccattgtgttataaagaaaattacaaaggatacagatgaagagatgcattgatggaggtataggggtgaagtgggaagcttccatgccctctgtggatgcaccaccctccaggaacctccatgtgtgcagctatccggaaactccctgaaccctgtccttttgggtttctatggaggcttcattaccattgaccattggaggtcaactcaaccttcagcccctctcccctccctggaggttgggggtggggccaaaagtcccaaccctctcatccctccttggtctttcctgtgaccacccctcatcctgcaactgcctaggggctgccagccatcagtcagtcattggcatacaaagatagcccttacgccattctaaggattttaggaattgtattccaggaaacggagctgtagaccaaatatatatttcaaaatatcacgtccatctacactccggcccttggagagctcatctagttttgatggctttaaatgctatctgtacaacaatgactcctgaatccaggcctctccccctaggtattctttcttaattctgtatacagtttggctccctgacacttgactcatgtcaccccttcctactctccctgcttactccattcccatcatatcagcctccttgctgttcttcagactgcaggcacatttcacctcagcacctttatatgacccttccctagaatactcttccctcagatatcatggcttgttccctcaccatcttcaggtctttgcttaggtatcagcttcttagtaagaccttccctgaccaccctatttaaaatgtgggggaaggaatgccaccagtattccctatcccccttcccctcccttatctttctccatagcatctgtcaccctaagacatacctatatgttacttatatgtttattgtctgtctaggtcataaaatataagctgcataagtctagggatttttggctcttggttcacttctgtctagcacctagaatgtatctggcatgcagtaggtgctcaatgaatattaatgatttaatcaatgaatgaatgttcgttgtattataccatgctacttcctcagattatgcaaaacaataaaatattttaaaagtagattaataatgtatcttaaggtgatgacatggaatagtattacaggacaattttgagatttcagtggatcttgattctccttaagaatattacttctcagcctgggcaacatagggaaatcccgtctctacaaaaataaaaattaaaaaattagccaagcgtggtggtgcgcacctgcagtcccagtgactcaggagcctgaggtgggaggactgctacttcaaaaatatgcattcacctctctgatactcagtgctagttattcctgatttcccctagaaaagagtagtgaacaatttttagatactttctttgttttgttttgttttttatttgtttgttttgccctcccagatatataatgaacactttagaggtaattcctatttctcctttacttttctcactttctccataacggggatcttttgttcattcaaagctggtttaaatgccaaataacaatgaaaatggcaggcattttagtcatttttcaaatctcttagaaggtggtttaacattataccatacctacttacagtgctttcaaagcttatcttggctaatagcatatttatttttggaaacctttgttcctgccaatgattatagttctcgttctaagtaatttgagcttaatacataataaatttctagcacaagaaagacaaaaaatgtcagtaacttaaatgaaaaagtttaagacggctctttgagctgagtatcgcatgccatgtctaaacaacagtttaacttcactacttatgtcatctgaagatggaaaaactcaattagaatgttatccagctggtaagagcaggcttatgttatatttcagtatttgtccatgtgtatttataaatcattactgtggatgtaagaggtatttttttagaatggttgaaatttaaatatgaaaaacacctggataccttgcaaattgaagaaataaaatgatactggttgcagtggcttgagcctatagttgtctcagctacttgagaggctgagtaagtaattactgagtaattactctaagtaattagagtaaggtgggaggattacttgagcccaggagtgaaaggctgcagtgagctacgaccatgccactgtactccaacctgggagacagagcaaaaccctgtctccacaaaaagaaaaaaaaaaacaaataagatgaagaaaaactttgtaatgaaggctacccaaagtcataataccattgctttgtgtcaaaaacaaaaaaaaacaaaaaaaaaccacaaaaaccaggcatgatgccatgcacctatagtcccagctatataattttttaaagttcacagccactgcaaaacatgccaaattgtaaagaccatcgatgctaggaagaaactgcatcaactaacgagcaaaataaccagctaacatcataatgacaggatcaaattcacacataacaatattaaccttaaatgtaaatgggctaaatgctccaattaaaaaacacagactggcaaattggataaagagtcaagacccatcagtgtgctgtattcaggagacacatctcacatgcagagacacacataggctcaaaataaagggatggaggaagatctaccaagcaaatggaaaacaaaaaaaaagcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacctagattcaaaaagcaggtccttagagacctaaaaagagacttagactcccacacaataataatgggagactttaacaccccactgtcaatatcagacagatcaacgagagaaaaagttaacaaggatatccaggaattgaactcagctctgcaccaagcagacctaatagacatctacagaactctccaccccaaatcaacagaatacacattcttctcagcaccacattgcacattccaaaattgaccacacagttggaagtaaagcactcctcagcaaatgtaaaagaacagaaattataacaaactgtctctcagaccagtgcaatcaaactagaactcaggatgaagaaactcactcaaaactgctcaactacatggaaactgaacatcctgctcctgaatgactactgggtacataacaaaatgaaggcagaaataaagatgttctttgaagccaatgagaacaaagacacaacatactagaatctctgggacacatttaaagcagggtgtagtgggaaatttatagcactaaatgcccacaagagaaagcaagaaagatctaaaattgacaccctaacatcacaattgaaagagaactagagaaacaagagcaaacacaattcaaaagctagcagaaggcaagaaataactaagatcagagcagaactgaaggaaatagagacacaaaaaacccttcaaaaaaataaatgaatccaggagctggttttttgaaaagatcaacaaaattgatacaccgctagcaagactaataagaaaagagagaagaatcaaatagacgcaataaaaaatgataaaggggatatcaccaccaatcccacagaaatacaaactaccatcagagaatactataaacacctctactcaaataaactagaaaatctagaagaaatggataaattcctggacacatacaccctcccaagactaaaccaggaagaagttgaatccctgaatagaccaataacaggctctgaaattgaggcaataattaatagcctaccaagcaaaaaagtccaggaccagatggattcacagcccaattctaccagaggtacaaggaggagctggtaccattccttctgaaactattccaatcaatagaaaaagagggaatcctccctaactcattttatgaggtcagcatcatcctgataccaaagcctggcagagacacaacaaaaaaaaggagaattttagaccaatatctatcgggggacttgccccgataatcacgtaggttcttttctatttttcttaagcgtcggccggcatgataaataaagggacagagtacaaaagagagaaattttaaagctgggcatccaggggagacgtcacacgttggtaggatctgtgatgcctttcgagccacaaaaactagcaagtttttattagggattttcaaaaggggagggagtatgcgaataggtgtgggtgacagacatcaagtacttaacagggtaatagaatattacaaggcaagtggaggcagggcgagatcacaggaccacaggactgaggcgaaattaaaattgctaatgaagtttcaggcactattgtcattgataacatcttatcaggagacagggttttgagatcaactggtctgactaaaatctattaggcgggaatttcctcttcctaataagcctgggagtgctatgggagactggagtctatcttacctctgcaatcttgaccataagagacaggtacgcctcggggtgggcgggggccagttcaaagacttactcctaggtgcgcattctctttctcagggacgttccatgctgagaaaaagaattcagcgatatttctcccatttgcttttgaaagaagagaaatatggctctgttctgcctggctctccagcagtcagagtttaaggttatctctcgtattccttgaacaattgctgttatcctgttcttttttcaaggtgcctacatttcatgttgctcaaacacacatgctgtacaatttgtgcagttaatgcaattattacagggtcctaaggtgacatagccttaggctgacaggattaagagattaaagacaggcataggaaatcacaagggtattgattggggaagtgataagtgtctatgaaatctttacaatttatgtttagagattgcagtaaagacaggcataagaaattacaaaagtattaatttggggaactaataaatgtctataaactcttcacaatccacgtttttctgccatggtttcagccggtccttctgtttggggtctctgacttcctgcaacatctctccctttctttttatataaatgtgccatggcgatgaaggcttgttcgttctctcgattttgacgcaggattctttgactggtccagcacactaaaaacaaaccgattaaacagagaaacttaattctaaaatttactacagtggagcccccaataggcttaatctaagtcgtggggtttaatctataaagattttctgccacctgatctaacgcctcagctccaggcagaatggataagtgagcttgagaggcttcaaaaatttgtttctttaattatgtctaatgataaattatcttctttacctagaaggtgtcctttgactttttcctatgaattatcagtctcattataggaatacggggtgatgcagaaatccgaagtattccaatcgcactgcatttgcaatgcgatgttcgagactcactacttgatctctaagccaaataacagactgtcttaaatcattaatttgatttgccaatttttgatcgatgccttgttgagaattccacatttgggtggaattggcttgccaatcattaacaaaatgagccctttgaatagattggtgtaatgccattctagcagtggtggccattgcagtgacagtaattaggcctatgataacagcaattaaagtgaaaacaaatctcttagatctttttttagaattcgctgtagcacttcattaattaaatgtattgagggggaggatacctaaggtctaggtaaagttaccggaacctagattccttcttgagctcgaaccaacattacacttttcctggagtcaaaatgggagttaatacaagtgtatagatgacaattgatgcatcggacggtttgattattcgtctaaattttgatatttcctactaacagtgtgtaaggaggcttaacacaactctgtatgggaatagtcaggttggaggtaagtaaagcagaatgtctgggtctacgttgatactgagagagtgggatggtaatgggaacaacagtcgaaatagttttcttttcctatactggcagtccagacatggcaatagccaatttttaaagttctgggtgttctgggctcagaatggggagtatcatacgaggcctgggggtgggtaatgcctttatcttcctattttaagagaaagaatgagctgatcctcgtatgcacagtagaatgatgattctcattctcctgataagaagtaaaataagtagcctccaggcattcctttccaccagaggagcaattgttttttaaatagccttttggtgcctagtctattactagaccatatgagtcattttttagtattactgcatgtgagttaacacagtcttcctaaattaaagttttagatgggccctcaaaatttttagggcatggttttcctgcaggtttatattgaaagtatggggtatctcctattactcctcctttcatttgttttaaaggagaaagggagagaccagagactaaatgtcctgttttatctgtagctgatgtttccggaagataagcagcctagacttgagttcgtagatggatgcaactaggtgcatgtccgaggcacagaggggggtatttataacctatggtaacattaaatgcagtgccttcttctcctggttgagcagggcaacggtcatctgtggctctaggcatccacacactatcgttagtgtagatttctgcaggagcatctatctaggtgagaggtcgaataagtggaggaaaaggcacataagcctaataagaataattatgtgtagcaggtaaatcagtgtgagaggaaactggtgagacagaaagtataaggaggagaatcattaaataaaacctagtgtaagcgagattgagtgctgaaggaggaagagaagaacagagggatgttattttcaggctaatagaaatggtgagatttttaggtttgtaaggagaaaaagaaaagtaatcaggagaagtgggattagttagatgggtctccattgccttcagggaggattgatttacacctattgtgatttgatgtgcctgtttctgaggaatcagcacagatctcatcatatctgaaggcagtctctgacacagacgtcttttctctgtggttttgattgtcagtattcacctgaagcttgagtcttctggtgggtacttagacaggggattgatgatctcctggtgaaacacaagcatatcctcttcctcatgttataattgtgccaggttcctaggtattggtttgggagtttttccataacactggcttgccttcgtttaaggaaaattttttgcctgtataatggcattcggctgcagttagagtattatctttaggaacatttaaaaaatttaaagtaaacaatgccaaatgtaattgggagtggggagttgttaaatcatgttttggttgttcagactgttgggacaattgggtttttaaagtgcgattgtaagggattctagtagtaggatctgtgatgcctttcaagccacaaaaactagcaagtttttattaaggattttcaaaagaggaaggagtgtgcgaataggtgtaggtgacagacatcaagtacttaacagggtaatagaatattacaaggcaagtggaggcaaggcgagatcacaggaccacaggactgaggcgaatttaaaattgctaatgaagtttcaggcactattgtcattgataacatcttatcaggagacaaggttttgagatcaactggtctgactaaaatttattaggcaagaatttcctcttcctaatgagcctaagagcctataggagactagagtctatcttacctctgcaatcttgaccataagagacaagtacgcctcaagggggccagttcaaagacttactcctaggtgcgcattctctttctcaaggacgttccatgctgagaaaaagaattcagcgatatttctcccatttgcttttgaaagaagagaaatatggctctgttctgcctggctcaccagcagtcagagtttaaggttatctctcgtattccttgaacaattgctgttatcctgttctttttttgaggtgcctacatttcatattgctcaaacacacatgctgtacaatttgtgcagttaatgcaattattacaaggtcctaaggtgacatacatctttctcggctgacaggattaagagattaaagtaaagacaggcataggaaatcacaaaggtattgattaaagaagtgataagtgtctatgaaatctttacaatttatgtttaaagattgcagtaaagacaggcataagaaattacaaaagtattaatttgaggaactaataaatgtctataaaatcttcataatccacgttcttctgccatagtttcagccagtccttctgtttaaggtctctgacttcctgcaacaaatatccctgatgaacatcaatgcaaaaatcctcaataaaatactggtaaaccgaatacagcagcacatcaaaaagcttatccaccacgatcaagtcagcttcatccctgggatgcaaggctggttcaacatatgcaaatcaataaacataatccatcatataaacagaaccaacaacaaaaaccacatgattacctcaatagatgcagaaaaggcctttgacaaaattcaacagcgcttcatgctaaaaactctcaataaactaggtattgatggaacttatctcaaaatagtaagagctatttatgacaaacccacagccaatatcatactgaatgggcaaaaactggaagcattccctttgaaaactggcacaagacaggaatgccctctctcaccactcctattcaacatagtgttggaagttctggccagggcaatcaggcaagagaaagaaataaaaggtattcgattaggaaaagaggaagtcaaattgtccctgtttgcagatgacatgattgtatatttagaaaaccccatcatctcagcccaaaatctccttaagctgataagcaacttcagcaaagtctcaggatacaaaatcaatgtgcaaaaatcacaagcattcctatacaccaataacagacaaatagagagccaaatcatgagtgaactcccattcacaattgcttcaaagagaataaaatacctaggaatccaacttacaaaggatgtgaaggacctcttcaaggagagctacaaaccactgctcaatgaaataaatgaggacacaaacaaatggaagaatattccatgcttatggataggaagaatcaatatcatgaaaatggccatactgcccaaagtaatttatagattcaatgccatccccatcaagctaccaatgactttcttcacagaattggaaaaactactttaaagttcacatggacccaaaaaagagcccgcattgccaagacaatcaatcctaagcaaaaagaacaaagctggaggcatcacactacctgacttcaaactatactacaaggctacagtaaccaaaacagcatggtactggtaccaaaacagcatggtactcgtaccaaaacagagatatagaccaatggaacagaacagagccctcagaaataataccacacaactacaaccatctgatctttgacaaacctgagaaaaacaagcaatggggaaaggattccctatttaataaatggtgctgggaaaactgggtagccatatgtagaaagctgaaactggatcccttccttacaccttatacaaaaattaattcaagatggattaaagacttaaatgttagacctaaaaccataaaaaccctagaagaaagcctagacagtaccattcaggacataggcatgggcaaggacttcatgactaaaacaccaaaagtaatggcaacaaaatccaaaattgacaaatgggatctaattaagctaaagagcttctgcacagcaaaataaactactgtcagagtgaacaggcaacctacagaatgggagaaaatttttacaatctacccatctgacaaagggctaatatccagaatctacaaagaacttaaacaaatttacaagaaaaaaatcaaacaaccccatcaaaaagtgggtgaaggatatgaacagacacttctcaaaagaagacatttatgcagccaacagacacctgaaaaaatgctcatcatcactggccatcagagaaatgcaaatcaaaaccataatgagataccatctcacaccagttagaatggcaatcattaaaaagtcaggaaacaacaggtgctggagaggatgtggagaaataggaaaacttttacactgttggtgggactgtaaactagttcaaccattgtggaagacagtatggcaattcctcaaggatctagaaccagaaataccatttgacccagccgtcccattactgggtatataaccaaaggattataaatcatgctgctataaagacacatgcacacgtctgtttattacagcactattcacaatagcaaagacttggaaccaacccaaatgtccatcattgatagactggattaagaaaatgtggcgcatatacaccatggaatactatgcaaccttaaaaaagggtgagttcatgtcctttgcagggacatggatgaagctggaaaccatcattctcagcaaactatcagaaggacagaaaaccaaacaccacatgttctcactcataggtgggatttgaacaatgagaacacttggacacagggtggggaacatcacacactggggcctgtcgtcgggtcgggggaggggagagggatagcattaggagatatacctaatgtaaatgacgagttaatgggtgcagcacaccaacatggcacatgtatactataagtaacaaacctgcacgttgtgcacatgtaccctagaacttaaagtataataaaaaaaactataacatgaaaaaaataaataaaagtaaagttttttaattaaaaaaaagataggaattatttctttgataaaaccaccaaaaaaaagttctattcacttatttcacatcaaaaaagaatttgagtgttagaccaagtaatatgttaatgtcttatgactgttaaatgatacctatttaacacctttatctctctgaattaatgatacttggtgtgaatatttattccaacaaaagtaggccatctaagattatattttcctcacagatggttgagctcttctcacaccctctatagccttaatatatagactgtaaagtatactgtcattttaaaaaaagtgaaaaggatatttatatcaggctaatcaatttgaattttgggtaatgaacacaccaattacccgtgttttccaaatctcatgtgcacaagggactatgaatcatgtacttcattaaagtgcaaggcacattactattgaattttttctgaattcatattacattattattattagtgtcaggagatactatttaattcagaaaaaacagcctggacaacatggtgaaactccgtctctactaaaaatacaaaaattagccgggcgtgatagcgcatgcctgtaatcccagctacttgggaggctgaggcacgagaatagcttgaactgagaatgtggaggttgcagtgagccaagatcatgctactgcactccagcctgggcaacaagagtgagtctctgtctcaaaaaaaaaaaaaaaaaaaaaaaaagacgagataccttaacagacttttttttaaatcttgtgattttactagcttagaaaataattgatatcataattgaagcataattttatttaaaaaaatacattttgactctgtcctcacctctctttccacatcaccttagtgaatggtgagcagaaaaggtgtttgctaaaaatagagttcacagtcagatatgtagtaaacttaaacatatttgcaatatgtaaagaattctcaaaactcaataataagaaaacatacaaacaacccaattcaaaatgagaaaagatttgaacagatacttcaacaaagaagataatacagatggcagataagcacaggaaaagatgttcatcattagtcattaggggaatgcaaattaatgccacaatgagatacctgtaaacatgttttacagtggctaaaatcaaaaagactgaccataccaattgttgacaaagatatagaacaatggaggccaggtgcggtggctcacacctgtaatcccagcactttgagaggccaagacaggcagatcacaaggtcaggagatcgagaccagcctggccaatatggtgaaaccccatctctactaaatatgtaaaaattagccaggcgtggtggcaggcgcctgtagtcccagctactcaggaggctgaggcagaagaatcgcttgaacccaggaggcagaagttgcagtgagccgagatcatgccactgccctccagcctaggcgacagagcaagactccatttcaaaaaaaaaaagaacaatggaaactcataacactgttagtaggaacgtaaaatggtataaccactttggaaaacagtttggcagtttcttaaaagttaaacatactcctatcatatagcccaggcattctactccttagtatttacctaagaaaaatgaaacacatcttcatacaaagacattaatattcatagcaactttatgtgtaatagccaaaaaatggaaacaactcagggtccatcagcaggtgaaaggataaattatgatacatgcatacaatggaataccactcagtgttaaaaaggaatgaactattgatacatgcaacaacatggatagattcaaaatcattatgctatatgaaagaagctggacaataatgagcacatactatatgattcaatttatataaaagtctagaaaatgcaaactaagtgacagaaagtagatcagtggctgactggggatggggatgggggctacaaaagggcatgaagatacttttgagcatgatggatgtgttcattatcttgatcatggtaatggttttatggttgtaaatatatgtcaaaacttatcaaattgtacattttaaatgtgcagcttattgtatgtaattatacctcagaaaagctttttggagaaaacaaaaaaatatatattcagagtctatctctctttcaccctttttattatttccagctggtttcatccaccatcatctttcacctggattactgtaaaagcctcctaactagtcttcccgctttttttttttttttaaaccctcatctccttccaatctattctcggcaaaactactaatgtttatttacagttcagggttgaaggctgggcgtggtggctcgcgcctgtaatccgagcactttgggaggccaaggcaggcagatcacgaggccaagagatcaagaccatcctgcccaacatggtgaaaccccgtctctactaaaaatacaaaaattagctgggcgtggtggtgcacacctgtagtcccagctactcgggaggctgaggcaggagatttgcttgaacctgagaggcagaggttgcagtgagccgagattgcgccactgcattccagcctggcgacagagtgagactccatctcaaaaaaaaaaaaaaaaagttgagggttgaaaatttacctattagttctgtaattgctctggcttggatatcttgtactgtgttgaataaaagtgagggaaaacaagaaaaattacctattgaatacagtgttcactatttgaatgatgggcacactagaagccaaacctcactgttatgcaatataaccatatagcaaacctgcatatgtaaccccagaatctataaaaataaagtcagatcatgtcactctagctcaagaccctccactggcttcctctcctactcagaataaaagccaaaggcccgcatggcctaccccagccttgtcatctctctgatctgacccgctattctccttgaccccttcacatcacttcacacacattggtctcctggctacttcttgaaaattccaaacatactccctccattgggcctttgcattggttattttctctgcctagaccactccctcacctcttctaaatgtcactttctccattgggcctactctgaccacccaatttgtttttgtttttgttttttagaaatggggtcatgctctgttgcccaggctggagtgcagttgcagtcatggctcactgcagccctgacctcatgggttgaagcaatcctcagcctcccaagtagctgggattacaggtgcatgccaccacgcctggctaattttttaattttttcatagagacaggttcttgctagatcttgaactcctagcctcaagtgatcctcccatctcagcctcccaaagtgctgggattacaggtatgagccaccacacccagccaaccaccctattttaaatatcaaggtacccaatccctcttacctgctttacttttttgccttattccatagtacttttgacatactctacaatttaccttttttgtgttttctcatcttcttgcactagaatatgatctacatgagggctggaatctttgttggttttcctcatgtatgccaaatgcataggacaatgcctggcatataatcagctcttgaaatatttatgaaattaatgagtgcttatagcatatgaatcctcaagatacattggcaaattagagtaggaccaaagtggggagaagagtaagaagaggtttaaaatacacatgagggaccaggcacagtggctcacacctgtaatcccagcactttgggaggccaaggtgggaggaccccgtgtgagtccaggagttcaagaccagcctgggcaacatggcaaaaccccatctctacaaaaaatacaaaacttagccaggcatggtggcacttgcctgtagtcccagctactcaggaggctgaggtgggaggattgcctgagccagggaggtcgaggctgtggtgagccaggatctcaccactgcactccagcctgggcgacagaatgagaccctgtctctaaaaatatataaataaataatgggggattcatttatttttgagacagggtcttaacgctgtcacctaagctgcagtacaatggtgagatcctagctcaccacagcctcaacctcccaggctccaacaatcttcctgcctcagcctcccaaagtgctgggattacaggtgtgagccaccacacctggcttgcagtgagctatgatcagcccactacactctagcctgggcaacagaggaagaccctgtctcaaaaaaaaaaaaaaaaaaaaaaaaaaaaaaaagcgtgtcctaattagaagagtctgtaattgttatagtccatgacaacgtagaatgctgaatcagttgtggaattgatttttcaaatgcttgttttacctggcaaatcatgtcaaaggtaacctgaggccaggcagagtggcttacacctgtaaatcccagcactctgggaggccgaggcggaaggatcgcttgagctcaggagtttgagaccaacctgggcaacatagcaatactccttctctattaaaaaaaataaaattagccaggctggtgcacttatatcccagctactcaggaggctgaggtgggaggatcactttgagcccaggggtttgaggctgcagtgaggtatgattgtgccactgcacgccaacctgggcgacagagtgaaaccctgtctcaaaaaaaaaaaagtaacaatgcctttataataattacgatttgttattttagccacatagccatatatatgaaatttacgtgacctattatttcagccctttattgctgaaaatgaaatattattttattactatcagtttaaccttaatatccctcatttcagattgcttaccagtatcatggaataaaatctccaatctaaaattcaatctgagttttatatttaagaattttagctttattatttgttttagattaagcttctgcacttttttaaacggttatatatgttcattatctttcatcttacataggagcgggatcgttacgcctacaagattcatcttccagaaacagtagagcagctgaggaaattcaatgcaaggaggaaactaaaggtaaattaaacaaatcagcaaaaaagccaaacagatatagttaatgatcatgtttttattctattttggtgcccataaatatgtactaatgctggccattgtttttgttgtagctaaattctcatttccaaaaattaccaccacttcaataagattttggctttttaaattatttaaggtagtatatcagtatgagtctgaacaataaattataatagaagattagttgtattttagatttgtcttaaatttatagcagagatatattattatccattattattgaatatgaatctagaccatgttttttcaaacttaaatattttgacaaatgtatgtttagttcaatggaaataactttgaattagaattggaattaggggccgggtgtggtggcttatgcctgtaatcccagcactttgggaggccgaggcgggcggattgcctgaggtcaggagttcaagaccagcctggctaacatggtgaaaccccgtctctactaaaaatacaaaaattagctgggcctggtggcaggcgcctataatcccagctactcgggaggctgaggcaggagaattgcttgaacttgggaggtggaggttgcagtgagctgagatcacaccattgcactccagcttaggcaacaagagcaagacttcatctcaaaaaaaaaaaaaaaaaaaaaaaagaattggaactaggattgaacaactatcagaaagcagtaaataaaatcttacactaccttgatctactagaaaatattttcagctcagatcacttttctcaccttctttattcttcctaggtgtctttctccctcttactactctccctatcctccacctcaccaaaaaaaaaaaaaaaaaagaagaagaagaaaagaaaactggtaatcaccccatatggggagtccatttgactttaaaaggttctgaaaaagaccagacataaagtaatggaatcttttcagcactgagagaaaatgctgagagaccatcccccacccaaccctccagagtaacaaagggaaattgattatcttaacttcttagaattaatttatgtttgacttacttttgatactgaaaaatgttaactgttctctaagtggttgattagatagtagtcttccttagtcacatgactcctgccaactataaaacttttcttcttaagtattttcagatatgccataaattctaataataccattttatttttcaacccctgaaattagtgaattattatgtataactctagacttataaaaacatttatatgaattttgaggaaactattaggctacaatattatcctatagacctgaaacttttaacatggtacccactggccacatgcagctatttaaatttaaattaattaaaattaaataaaattaaaaggtcagtttcccagtcacactagcacatttcaagtgctcagtaaccacagttggctagtggctactatattagacagcacagatgtagcttgggacatttccatcattacagaaggatctattcaaccatgctactatagaacaagggaaatattaacatatcattgttggtgttgattattcccattttagcctttcttctcactgattttgcagtcaagggttcaaagtgactcttctctatttgctttaaaaatccttggccaaaataattattaatgataagccattattgagatggtagccaaagaagtttcccaaaacttttattctttttgccttgatatccacctaaacctgtgtagcctacaaataaaaaactcttttattattcaaagtgaaatttggtcaactgtttttgaagttagtttcctccccaaagaaactattattacacttttttgtcaacttttctataagtcattctaaacctaattgctttggcctcatgtgacattacgctgtatggggttgaacctttcattgcccaaatacaaacatttcaccagagagcttgggcttgccccatcacaagaaacacatgctgtacttctcccggggccacagaatcagacttgggcctaaaatagccaaagtggtgactaagattcatttggacagggccaagctgtcaaaacagagaggggtcatgtggatttaccacatccccttgcagggctatttaaagttttaagacccaccaaacaacctagaactaggaacatcagcagggtcattagtgaatgtgtttggcttctgataaggctgtattcttttgagtagttcagccaccttgttaaaacatgttacacctaccatcctcaaggaactaattcccattctgcctcttcagtggacttctagaacagagattgcaacttccttggctttcagagtccaccacacactttattttcacacaactaggtgctcatcctacccagacactattcttaacctcctcagtggtgggtgacagtttaatttgtaatgactcccttggaagtgattaaaagggagttcacagaaagcggtagaaaattacttttgtggccaggcacagtgtttcacacctgtaatcctagtacatttggaggccaaggcgggcaaatcgcttgagctcaggagttcaagaccagcctgggcaacatggtgaaaccccgtctctacaaaatatacaaaaattaaccaagtgtggtggctgtgcatgcctgtaatcccagctattgggggcctgaggcaagaggatcacttgagcctgggaggcggaggttgcagtgagccaagatcacgccactgcactccagcctgggtgacaaagtgagaccttgtctcaaaaaaaaaaagagaaaaaagaaagaaagaaaattactttggtaacttagtcatgatggaatgatggaaaatgtattttccccattttggttaccacatgtttcatgtgtcgagttttttcctcctaattcatactaagctctggaattgtaatacttcattaaaaaaaaataaaaaaaaagaatcctctagataacaatactttctttaataaactacatcgttctgagcacagaactgaatatgaggacattttctcaaactgaatattaggatacatgagacagactgcatgatctccaggctgtgtggaaaatctgtgctctgtggtctggggcttttgagggggcacacctgtactctaaccctggctgtcatctactgaaggaggtactgaggaaagtggtaactgttgttatctgaggatgtctatccagagaagagactcaggagggaatgtattctgaagtcatccctattgcttcttcaattatttctacccctagaaagcaaattccccacagtgaagtgtgttgaagaaattctatacaaatagaagcaatattctatgtttgggtaagtttattgcagtccatttaagaaatggtgagtcgagtccacgtgattcagttaagaggataaaatcatttatttcctatatatacagaaagcaaggatttctaataactttctacagtttttctttattattattattatttttttttttttttttgagagagtcttactccatcacccaggcttagagtgcagtggcgcaatctcggctcactgcagcctccgcctcccaggttcaagtgattatcctgcctcagcctcccaagtagctgggactacaggcaccaccacatccagctaatttttgtatttttagtagagacgggatttcaccatgttggccaggctggctttgtactcctgacctcaagtgatccgcccgcctcggcctcccaaagtgctgggattacaggcataagccaccgcgcccagcctttattaattttgcaaattgcaaaagtattctctgacttactgattggtcacttgtgttcctgaactgtgcataactacgaaaggtttgtttaggagtgccattttctaatactgtataaagctgtactatccagtacagtagtaaatagccatatgtaactgtttacatttcaattttaataaattaatattaaataaaaagtaaaatttggttgctctgttgcgctagcacctttcaaatgctcaataccacgtgtgactgatggctactgtattagacagcacaggtttagaaaatttccttcatcacagatagttctattgtatggtattgctatagagtcttggtaactgcagagtaatgcttatacataagcagcactttttgataggtcaaccaggaagctataatagatattttttggcaattttctttctgttagttcaacaaaaactaacttaaagatttatcaaagacctttgtaccgtaatgaaacccagcatttacatacagtcctctctgtagtaagggtttgtacaaaggcagtaaattgagatagcagtcgttgtgggcttcagctaatcagagcattaaatctggtatccaaaaggtaacctttgagcctgagcaacataaggagaccccggctctacaaaaataaaaaatttgccgggtgtggttgcacacgcctgtggtcccagctacttggaaggctgaggtgggaggatcacttgagcctgggaggtcaaggctgcagtgagctgtgatcacaccactgcactccagcctgagtgacagagtaagactctgtctcaaaaataagcggggtggggaccttaattctaaaaactgaaaacttattctggtatgagcagttccgcaaatattctggtatgaacagttccacaaataataagtgaagtgattttgatcttacatattgattttacaaatcaattaatttgtgattttttttaagaaatacatatataggccaggcacggtggctcacgcctataatcccagcactttgagaggctgaggcgggcggatcacctgaggtcaggagttcgagaccagcctgaccaacatggagaaacgccatctctactaaaaaaaatacaaaattagctgggcatggtggcacatgtttgtaatcccagctactcgggaggctgaggcaggagaattgcttgaacctgggaggcggaggttgcagtgagccaaggttgcaccattgcactccagcctgggcaacaagagcgaaattctatctcaaaacaaaaaaagaaaagaaatacatatatagatatatgttgttttttcttttttaattgagacagggtctcactctgttgcccaggctggtctcaaactcctggactgaagcaatcctcccaccttggcctcccaaagtgctgggattacaagtgtgagccaccatgtcccaccagtttatgattctgaaatgtagaatatattacttcctgttgggcaatagattttgaaaattatgtacatttaagaccatctctataaaatacttttacatagacccaaaagaatttctaagatatctattctgtgcaattactcttaaatataactatatctagtacacttacaagtctcatttttcattttctctagagaaaatactgcagcctcttttagtcatatatcctgactgaaaattatgaaattaaaggttttagacctatgtttaggttatgtttgagtattatatatgtataggctatgctgactaaactgaatgataactctggttttggctatatggagacatatcaaaagttctgatttaattaatcatctcacctaattatcatctaggacctaattattaagtataatcaacccaaattctttaacatctctaccttgaaatgattttcttgacttttggtcatctctgttcagcctcaacctctccaaattctccaccctttttagggcttttgagttcagtcgtctgaattctaataggatgattatctttcaaatttctttgtcacactcctattggtatgttctggtgatacactttctcccctcagtatatttccctgttcactcaggaatatgactatatattaccttgttatttaggtacaaagccaattattctatatctgatacttgtatattttgtatttagatgttttaaaatgtaccctcctgccatgactgtgtattgccttgttatttaggtacaaaaccaattattttatatccaatacttgtgtattttgtatttaaggtttaaaaatgtacccttctgccattgtgcctatcaaacttcatgatgcgtgtttctgagctcaggaaataccaaaaagggagtattcggtttttggtttttgtcttcaagtcagcaatacatctttgttcagctcttgtgttcctcaataactttgttccctccttaagtgcattcagtagttaaacttagcagaaatctgacctaaccattttcttgttttccacttccttaaatgccacacagaatcatctagccagaagcataccattttgatgtttgacatattgacatttcaagaaaactataattatgattaagaattatttctagttcttaactacaaattaaaaacttgtggtgctctttttctctgaatttataatctgccttctcctttctaggttaatttgcttgatagaaaattacaactttaatattatttatcttaacagattgtgaatagtctaattaactcaaaagtattatgtttcgcccttaaaagatactaaattataccttctaaattaaagcaggtagaaaacttctttgtcaagggtttaataaaccagaaagtttgaagaactacttgtataaaatctgattttttaattgttgtattacattattgctatcgatgagcaatattacattattagcaatcagtagcaataatgtaatacaggggttggcaaactatgacctgggggtcaaatccaacccactgcctattcttgtatataaagttttattagaacatagcaaagtacattaatttgcatattgtccatggctgctttcacactacagtggtagaactgagtagttgcaaaagagatcatatgacctttagagcctaaaatacttactgtctgattatttacagaaaaaaaattgctgacccctagtatagtagaaatccttgaactggggagagtagtcattgaatgtcaattatgtctactcttcattatgtctctaagttgacagagaccttaacaggttgctaagcctctctggacctcagttttctcgtctgcaaaatgagtcccttagaatgaataatctctaaggttgattctcaaactaataaaattatatgaatccgtgacctatttcagaatgatgttgctgttttacataatggcttgcattgaatatttaaaccatctatagtcactgggttcagacaactaaatattaggtggggcaccatggcttacacctgtaatcccagcactttgggaggctgaggccgtaagagtgcttgagccccagagtttgagactagcctgagcaatatagtgagactcagtttctattatttaaaaaaaaaacaaactacgtaaacaaaactgctagtcataagacagataaatttaaagcatactactattgtttcaaaagcatttgcatctcagggctcttttagatactgttttcctagtagtataggtatttattacagatctttgacaatagtagcaagaacaggccttgaagcgtataactaacatcttaagaaatacagttgtacttcatttggaaataaaaataaagcatctctaaaagcctagtttccgtgtgtgggaaacgtgatttgatatataaaaattccattcccacccagcttttaggaaacatgtataatacgtaaagtaaaataagtttttataaaaagaagaactcaacattcactactgttttttcaacatggtaactataattctgcataagaacctttcatgcgtaactttagactttcagaaatctcaaaagttacctggaatgttaacatcaatatcacttctctctttttgcccttccctttctacagtaagtaaactttgtggaaatatattttattaatgttttctggccaggcgcagtggctcacaccagtaatcccagcactttgggaggccgaggtgggtggatcacttgagcgcaggagttcaggaccagcctgggcaacatggtgaaaccccatctctacaaaaaaatacaaaagttagccaggcatggtggcacacgcctgtagtcccagctacttgggagactgagatgggaggatcacttgagcctgagaggttgagactgcaaagagccgagattgtgccattgcactccagcctgggcaacagagcgagaccctgtctcaaaaaaataataataatgttctcatattagcagatacctaaacacaaacaagttttatctttccagaaaaattcaagagttaatatttaaaatttagacttagactacttaggtgatttgataaactaactaaatgagtgattctacatagaccagcaaaaggctgtgctcatgttctagatctttattagtagagttagtaatgatatgcacttacagaatgctttacaatttgcaaagcactttcattaatacattatgacttttgccaatcctgtaagataagtccattttaatattctttttttttcttttttgagacggagtttcacttttgttgcccaggctggagtgcaatggcacgatctcggctcaccgcaacctctgcctcccgggttcaagcaattctcctgcctcagcctcccaagtagctgaaattacaggcatgcgccaccatgccgggctaattttctgtatttttagtagagacggggtttctccgtgttggtcaggctgatctcaaactcccgacctcaggtgttccacccgcctcggcctcccaaagtgctgggattgcaggcgtgagccaccgcgtccagcccgttttcatattcttactttacagataagaaagcctagagaggttaaatgatttactcccaaataccacatgttctcccttataagtgggaactaagctatgggtacacagaggcatgcagagtagtataatggacactagagactcagaataggggagggtggaggggcaagggatagaaaatcacctgttgggtacactgtacactactcagaagacagattcactaaaagcccacacttcactactgtaccatttatccatgtaaccaaaaaccacttgtacccctaaagctgtttaaataaaaaataaaataaatatgatttactgaagcagtaactcccaacatttttccactctacagtcctaagggatgtcatgcactcaaatggcagtgatttccaactaggaataaggggaggctatgcatatagcttaaaagagtcatatgtagttgattctgttgtgtggcctgatggagaattactatacaaaagtaagacattgtcattgttaaaacaaaaagagggaaaaaagattttaaaaagaaaaatgacacataatcctaccacccagagataattaataacattctggtgtatatgcagtcttttatatccatattaacttttttacccaaaaatgagattataatatacattgattttaaacctttttcatgtaattaatcacagacatcttttcattccactaaacacccttctacaacatcattttataataactgcagaatattccatcctgtgttacatgtttgaattcaagatgtaagtggtttcatatacttctacaattcccgattagtgttattctggtatatgcatatgtaatttatttcaaggaatctgaaataatttaaaaactacctctcttctagccatcatctcctatatatttgacttaatggataatccttaagataaataatttgttaaataacttatttatatttgtgtatttgttttaataatctattttttcatctctttgttttagggtgcagtactagccgctgtgtcaagtcacaaattcaactcattctatggggatccccctgaagagttaccagatttctccgaagaccctacctcctcaggtaattggataattcacttattcacctgtgtgggtcatttggcatttacatccattctctcccattgtgaataaacttttcctgtgcatttagttaaatcctccaacggattctaaggaagtttgtcagcaaccaaatcctgtctacatgtgtcttgttccttttcattttaataccaaagttgctttctcctgtggctccaaaaccaacacttcatttttttttcttttcacctcagtaatacttcttcccctttccacactctagacccagcattgcactccatccaatccaacatcctagtcagtcttttgggatctttctgattaccttctctctcaacaaaaacttctaatataagcttttccccaggtcagtcgtattagatcagactgtgggcagcactgctttgaatggaatctttcagtgtagagctgtcttgtgagttatctcctgaaacagttaccaagttcttctttctgtataaaaatctataacacggccaggcatggtggctcatgcctgtaatcccagcactttgggaggccaaggcaggcagatcacctcaggtcaggagttcgagaccagcctggccaacatggcaaaaccccatctctgcaaaaacacaaaaatacaaaaaaaaaaaaaaaaaaaaaaaaaagccaggcgtgctggcctgcgcctgtagtcccagctacttgggaggctgaggcaggagaatcacttgacccgggaggcggaggttgcagtgatccgagatcatgccactgcactccagcctgggcgataatgcgagactccatctcaaaaaaagaaaaaaaaaatctgtaacacatgcatacaagtatccaaaggggaagaacacagaagagttatttgttttgatgaactgtatataagtacccctgaaacaacctgccagtgttcacaaaatcattttataagccagtgcagtggtgtgcatgtgtagtcatagctactcaggaggctgaggcacccggctcagggggatcacctgagctcaggagtttgaggatgcagtgagctgtgatcacaccactgctctccaacctggacaacaaaatgagacctcgcctcttaaaaattaagagataaaaggccaggcacagtggctcacgcctgtaatcccagcactttgggaggccgaggcgggcagatgatgaggtcaggagatcaagaccatcctggctaacacggtgaaaacctgtctctactagaaatacacaaaaattagccgggcgtggtggtgggcacctgtagtcccagctactcgggtggctgaggcaggagactggcgtgaacccggcaggcagagcttgcagtgagccgagatcacgccactgcactccagcctgggcgacagagtgagactccgtctcaaaaaaaaaaaaaaaaaaaaattaagagataaaaaaataaaaaaccaaaaccattttataaaatgctcagatttccatcttaccagtgtaatattctcaagaatcatttactaaaaacccatagggtccatttatatgtatatgtaaatgcgtgtgtgtgtgtgttctaaatttttatttatgcattttttatttacttaactcctgaatcatgtgtcctctggcctcagctttttttctttctttcattagagccactccatatttgtcatctttgatttttgtactcttggactagcttcatcaatattcatatattaccactgggactgaggccctgggcccttcctaaagcctgaggtttctgtcccacagttagtaatataggaagaattaatgtgctaatgcttctttcctgttggtaccatgagcatctgtcagtatttatgcttctcctctcctctgtttatacatgtgtgtgcacctacacattcacatacacacacacacaatttcttaccaattagtatgtgcttgtaccttgtgcaaaatgacaagatcttgaggtgatggataccccatttaccatgatgtgatcattatgcccatatcaaaatgtctcctgtaccccataaatgtatactatgtacccacaaaaatttagaacttttttaaaatgacaagatcaactttcccattccagcagttatacagttcctcattttgacctttaccaattaggatgtgaatcttcctcttttgagtgaaggtgatttccaaaaacattcagaaatgggaatcttagagaagagactgaggagaaagccttgccatttttctcttgtgctgacttggtcattatccagagcccttcccacatgaaaggcagggatctagttgtgtttataggtgtggtccccagtgcttcttattgtttcacgtctgtcttttcttccactccattttgttccctccacctgtaacttcttttgttagctgaaacctctgtcttctctcctcacactcagattacagtggaccctatttaaggggagtggatccagtaatggtttgtattgtcatactgtggctgtatgatataatcacatgcttataatatatttaggataaatctctttgagattttaggtcaagatctctactaccattttcatctttagaaatggagctaaaggctgggcatggtggctcatgcctgtaatcccaacagtttcagaagccaaggcaggaggattgcttgagcctaagagtttgtgaccagcctgggcaacatagggagaccctctactttgtaagaagtcaaaatattagccaagcgtggtagcacacacctgtggtcccagctactagggaggctgaggcaggaggatcacttgagcccaagaggtcaaggctgcagtaagccgtgagtgcatcactgtactcaaaactggatgacagaacaaaactctgtctcaaaaaaaagaaaaggggccaggcacagtggctcatgcctgtaatcccagcactttgggaggccgaggtgggtggatcacttgaggtcaggagtttgagaccagcctggccaacatggtgaaacccccatctctactaaaaatacaaaaattagccaggcatgatggccacgcgcctgtaatccacctgaggcaagagaattgcttgaacccaggacacggaggttgcaatgagccgagatcgtgccactgcactccagcctgggtgacagagcaagactccatctcaaaaacaaaaggaaaggaaaataaaaagagtaatactctatgcatttaggaaaatatgaatatttaaaataacagtttaaaaacttgtcatctaataagaagtcaaacatgtttaggtatattgtttacgatgtaaaacaatttttctataaatgataattttctattttgattattgaaattcatacattatgcatttactagaattcatttaatcttatgatgaactgtgtattgcttgaagtggggctgggcacggtggatcactcctgtaatcccagtactttgggaggtggaagtgggtggatcacttgaggtcaggagttcgagaccagcctggccaaaatggcgaaaccccgtctctactaaaaatacaaaaattagctgggcgtgatggcatgtgcctgtagtcctagctaccaggagggtagggagccagggctgaggtaggaggatcacttgagcccaggaggcagagtttgcaatgagctgagattgcaccactgtactccagcctgggtggtagagtgagaccccatctcaaaaaaaaaaaaaaaaaatcaatgttgaaatattcttttctcatatttcaaatcaagtaattcagaatcagaacccaacgtttgatgtctgaaatcccaaacagttccagtgattgtactcatggaacatgagggctcactttggggtcagctgggggaccatgcttctggtggctcatgtagtgggccgaactgtggcttgataacctgcttgttctaaaatcatactgtttgttgtttgtccatatgctgccttcctcctaggacttctagcagcagaaagtaggtatccctttgttttcctttaaggtgtatcttttatgcaaaagtgtttggctttgcatggttcgtaatcagcttgactttttccttggctgtttgtgtgtagttgtttaagtattaattttaacactgcctggtcataaaattaaaacttggatatattgatttttgaggcattgttgcacaaacaatattaagttctcacttctttcataagaggaaaaaagacagtgttaaaatttcaacggcatttaatacttcacatctgaatttcacatacgaatacattaattctggggaaagagtaacatttattttagagtttgctttcaagaaaactttcagggtaagtgaatttttctttgacaattacatcacctgtaagtggtctttattgcttcctgttactgagtccattttcagtttatttggacctgtgaaataaattctgaaatcatatctcttaacaacttttaccatcagatagaacatttataaggaataatgtaatagctagattttaattacaaaggggcataatttgagtttgggagaaaattaaaatgtaagaaatgtacacacagttgagtacatgtaaaactgaggcaatctgaataagatgggtggattgtatcaatgtcagtattctggttatgataatatactatcgttttgtaaaatgttaccaatgggggaactgagcaaagaatacaagggatctctctgtattatttcttacaagtgcatgtgaatctacaattatctcaataaaaattctaattaaaaaaataaacctttacctcaaagataaatgagaaagcctgggtactaatgattgaattcattttcacattttcttacattagttatctgtagctcaaattgcagctgatttaatataaatcttatagtatattagttacctattgttgggtaatgaattaccttaaaacagcagttgtcatctcacagttcctgtgggtcaggaatctgggcgtggcttagctgtgtgcctctggctcaagatctctcatgagattgtggtccagtgctgctatctcaccggaaggcacaactgcaggaggaatcctcttccaagctcactcacatggttgttgccaggcttcggttccttactggctgtggtcctcttcacagggctggctgttcacagcatggcagctcacttcccagcacgaaagataaaagaggggggcaaaagtgagagacagtgcccaagactgaagacacagtctttacagcctaatctcatagtgacgtcttatcacttctgcactattctgttcattagaaatgagtcagtaagtccagcctgcactccaggggaggggactgattacacaaggctggaaataccaggagaccaggttactggggcccatcttagaggctgcccaccacgtacaaattaataactattaaaatgtaagattcttcccgtctagatttagcgctcctcttttttttttttttaaatcagccaacctgtcatgttatttgagaatgggcatcttggatgtatcagtagtgattttccttagttgtaaagctttacacgagtgggtacttaatagcagaatgttattaaagtactttgaaaaatctgtgctcgaagatgtttctatatggaagcataaactattttaataatcataatggcattagagattataacatctatacgctgacagaatacatatgcagagtttacttcctttaataaatttcaaggtatctgtaccataatccacatatggagaatctaaagcatgtatcaccatatgtaagttctcataacttgagttggatatggcacagatgcttatgtccaaaatacagtttccattacaggattcattattgcttataacttgattgataacaaagaatttgctttgtgcagtgggaataaaaagtgttgaacagggtgtggtgatagagggaagagattggctgcaaagggacaagagagaacttttttgaagtgatgacagtgtacacttaaatggcgacttttaacttaaaacagtataccttagtaagcagattttttttaaaaagtattgtgcttgcaaggaggggctttgattgagtaggtgataatgtgtgtgtgtagtaatacaatgtattaattgatcgctaatataatagaaaaggtattgattactcttagaagaagctaggctaggttcagattctagatttgctcagtgatgctgagtttcatagctatacattgtaaattaagaaatacacacacattgagaatttaatgtgttattttgtgaaaatctgagaagcaggaatgggatttaatgatctcaactgtcatccatctgaaaaacctaacttgtgattttaaataagatggcatactgccttccactattcccttttaaaaacaggaaatgtccctgcttttatctttatgaagttttatttatgaataaagtttgtactatttaaaaaaaaaagaaatacacaaatctttattgaaacaattacagtgaaaacttgggtatatcaaaactcattgaatggtacacttaagatttgtgtatttcattctatgtaaattttacctcagagagaaaaataagcattgcaatctttgctgaagtctttaagggtgaagtgtactaatgctggccactgccatttaatttgaaatgaatgaaaaatacgtgaactgatggatagatgggtagacatgtgataaagcaaatacagcaaactgtcaacatatgtaggatctaggtggtgggcacgattctttcaaactttctgtatgtttgaagcttttcgtagtaaaatgtaaggggaaaaacttttaagacatactcagcctactttaacactgagaactttttagtctaaacatttgactgtttatttttctgtcctccttttggtttatttttacttggtcaacctttttatgagacttccactctcgtaatgagattattctagactcaaagcttttattgaccttaaaagcatatttctctttaaagaaatagaaacattttttaaacagttgacatatttatgctttttttgactattatttcataatagtagcagaaaacttttgaaaaacttgtttgtactggtgagattatttgaaaaagtagaagtattcaaagttaaaatgtgcaggccagtcatggtggctcatgccttgccagcactttgagaggctggggtgggaggattgcttgaggccaggagattgagatcagcctgcacaacatagtgagatcccatctctatttaaaaaaaaaaaaagtatgattataaacctgatttttagatacaaactttattgccaaatgaattatgaaaacaaaatactattctgaaggcagggcattatagtatctaataagttcatgaatgtggaagtttggaccaagggctaggaaaaaaccttatatggtaaatcaaattgagattaaagagagaacagaaattaggcatcacgcctgtaatcccagcactttgggaggccaaggcgggtggatcacgaggtcaggagtttgagaccatcctggctaacacggtgaaaccccctctctactaaaaatacaaaaaaaaaattagccaggtgtggtggcgggtgcccgtagtcccagctactcgggaggctgaggcaggagaatggcatgaacccaggaggcggagcttgcagtgagccgagatcacaccaccgccctccagcctgggcgacagagtgagactctgtctcaaaaaaaaaaaaaaaaaaagaaattggacatcacctcattaccaaatgcaaatcattctgatgcattgctgaggataaaacatgattttgtgggtgggggacagtctattatggaaggaacactgaattaggagtgagacctgggttctaggatttgatcttctgcttattgcctgtggcccttggaaaggttatttaaccctactgagcctctggtttttcaaatataaaaacacttgctgaccaagcatggtggctcaatgcctataatcccagcactttgggaggctgaggcgggaggattgcttgagcccaggaatttgagaatagcctgggcaacagagagagacccccaactctacaaaaaactttttaaaaaattagccaggcatggtagcgtgcctgtagtcccacctgtttggaaggctgaggtggaaggattgctcaagcccagaaggtcgaggctgcagtgagccaggatcacgccactacactccagcctaggcaacagagcaagatcctgtctcaaaacaaaaaaaacacttgcctgcagagacagggttattgtggaatcacataaggtagtaagtataaaagcactttggaaattataagctgttaatacaaatataagtattaaaataatttcaaatgtggctttaaggaaacagtactataaaagaaattgttttctgtggttaagtctttctcatactttgttttcaattcttcagaatttactcagaaaaaaatcattttaatcaggccattttatgaagtgtcttggtacaaaggactctgcaaagtacaccccagaatacagaggtaaataggatacctacagtcctgccgttaaatcaactgccctctgaggtgaacttgtgtactttttattgattgattttgttttcaagatagttacaagtttattcagaggttttataggaaaaacagcctttttagtctttgagaaaaatagttattttatatgtgacagtattgatcttcaaaatgaaaactagtaacatcttaattagcatgtgctgcatgtgttatattaataatcactactgcctcggggtttaaaatctaaaacaaatagcaatggagaagcccgagaagtgtctttgtgtctatttatatcttataatgaattgaaacaccatgggatttttagatggttggtactgaactacagatatcaattatacacacatctatccaaccaagaatgtgttctgtggttctgtttgtcatacccaaagaaagaaataacggaactagaacaggtgttaatggaaggtgttaaaataatcaagggtgaagacagattttgaggttaagccaaaaatatgtatttattccatttgaaaagatgaaggagaaatggaataaaaactctaatttttctacctaattacagaaacttaaaaataggggcacttttcagagcttgaaatagacaacttgagtacaactagggaagtgcttcttttcatgattgagaacccatcaagttaatcatatttgggtacaagataagactataaatcagttcagaagaggtgacagatccaaggaggtttaatagacctgttggaattgtggctcttgcctactttaaatgcctgctaacagatgcctttgtgctttccagcaaagtatctgctggtcctgtcaacacagctttgatcctgtgtgggggtggtgaattcctgctcatccacctctctgcggctccccaactcctccctaggcagcctgtgtgtcagtttgtttttacctcttctataccgtttacttcagggtataatatgcctacttcacacaccagtctgagagccccttcctcagggccggtgatcatatctctgatttctctgaagcccttgcctagtacctagcaaaaagcaggaatattcaataaagattttggggccaggcgctgtggctcacgccagtaatcccaacactttgggaggcctaggcaggcggatcactcgaggtcaggagttcaagaccagcctggccaacatggtgaaaccccgtctctactaaaaacacaaaaaattagctgggtgtggtggtgtgtgcctgtaatcccagctacttggaaggctgaagcaggagaattgcttgaacccaggaggcggaggttgcagtgagctgaaatcatgccactgtatgccagcctgggcaactgagtgaaactctgtctcaggaaaaaaaaaaaaaaaagattttggttattgtctgacccaatagggcattgttcaagttcttttccaacctccatattcatgcataaaccacacaacttcttgttgaaggtttcctgtatgtttcctagcatagcctattagtgtagtaagttaggcaaaacatagactttgaagccaaacaaacccaggattgagtcctggctccaccatttactagttatgcccttccatgaaccttctgaagctcagttccctatctagaaggtgggataatatatctgccttactgtgttgtcctgaggatgttcctggaacataataaacactcaagaattgggagctgctgttagtgtttccttaagtacttaattcagtgcatactttgtagatattataaaatgaataaaataaagagctgccttaaggaccttacagctaagggaaaaaaagagtgaacaagcacgcacataagtaactcatggagtgcgctggtggtacaggaatggcatggagcacttgggaagttcacagaccaacaaatgatacatccctggtctggtacagccaaaattgcttcctggtcttgagactgaccatcttagtattcacttgataaaaggttgtttttgctttaatcttatattattaataaactgctacataaactgtatatcagcatgagcaatgctggtaaaaggccgagcacagtggctcaggcctgtagtcccggcactttgggaggctgaggcaggcggatcacttgagcccaggagttcgagaccagcctggccgacatggtgaaaccccgtctctactaaaaatacaaaaattagctgggcgtggtaacctgtagtcccagctgcttgggtggctgaggcacgagaatcgcttgaacccaggaggcagaggttgcagtgagctgagatcatgccgttgtactccagtctgggtgacagagtgagactctgtctcaaaaaaaaagaaaaaaaaaactcagtaagatttcagtaagataactgagtgaagatgataattaggtttctgtggtatcagctgaattttttaatatacaaaaaaggcacttgattagtatttttgttattgtggtttcataagtccagaagtttagaactggctttagtaacttgataaacctagcatcatttaattctgttgttgatgacatgctggggtcaggggttcagtgggacatttgggactaatttcttcacatcatctcttgctttccaaggctttcagtaaaggatgaagagaaaattggcttttaactaatttccagattttttgatggaggggggggcactctgaacaaagtaaatcctgagaagatcaggtagaaggaagtggattgggttaatacctctttaggaataacagaggagatgaggactgatttctgccatttatctcttttatcccacttaatatccacttaatgttttcagtgaaaggataccaatagcctggcaggcataattcaaaatttaatattatccagccgggcatggtggctcacacctgtaatcccagcactttgggagctcaaggcagaaggatcgctttagctcaggagtccaagaccagcctgggcaacatgacaaaaccccatctctataaaaaatacaaaacttagatgggtgtagtggtcccagctactctgggggctgaggtgggaggatcacttgagcacaggaggtcgaggttgcagtgagccgagattgtgccactgcactccaacctgggcaacagagcaagaccctgcctcagaaaaaaaaattatccaggccaggcgcagtggctcacgcctgtaatcccagcactttgggaggccaaggcgggcagatcacgaggttaggagtttgagaccaacctgaccaacatggtgaaaccccgtctctactaaaaatacaaaattagctgggcgtgttggcacgcacctgtaatccccgctactcaggatgctgaggcaggagaatcgcttgaacctgggaggcagaggttacagtgagccaagatcatgccactacactccagcctgggcaacagaacgagactctatctcaaaaaaaaaaaaaaaaattatccatagttccttcaacagacgaatggtcaaacaaactggtacatccacacaacaacctggatgaagccccagataattatgctaagtgaaaaaatgcagtcccaaaaggttacatactgtatgatttcatttattctttttattttattttattttattttttaatttttagagggactcctccttgcagaccagggctaccccataggcagtatgcccagaataggagcctcatttattatcaaaatgacaaaattgtagaaatggagaacagatgagtagttgccacaggttaggaggggatagggtaggaggggaatgagcatggctataaaaaggcagtatgagggatccttgtggtaatggaatgttttatagctcgactgtatcaatgtcaatatccaggttgtgatattgtactacagttttgcaagatgttactattggaggaaactgggtaaagggcacatgagacctttatgttattttcttttacaactgcatgtgaatctacaattatctcaaaataaaaagtcaaattttaaaaaatagctacagtaatttccacgtggacagccacacagtatgtggcttaagacccaaatctttaacataattaaatagagctacaaaaatcagtagcttatatagcattttgttttgttttgctattgtagaaaaacttggaaagtatggataagaacagaatgaaatagaaataggacagtaaagataacaactgtaacacttttgctgtgtttcattctgttttttgtttttccggagtttgcatatatgttttgtttggttttttatcgtaactgggaatatacagtttatttagttttgcattctgctttcttgaattcttttttttttttttttttttaattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaagaggatcccaaggcagaagaatttttcttagtacagaacaaaatgaaaagtctcccatgtctacttctttctacacagacacggcaaccatccgatttctcaatcttttccccacctttcccccctttccattccacaaaaccgccattgtcatcatggcctgttctcaatgagctgttgggtacacctcccagacggggtggtggccgggcagaggggctcctcacttcccagtaggggcggccgggcagaggcgcccctcacctcccagacggggcagctggccaggcggggggctgacccccccacctccctcccggacggggcggctggccaggcagaggggctcctcacttcccagtaggggcggccaggcagaggcgcccctcacctcccggatggggcggctggccgggcggggggctgacccccccacctccctcccggacggggcggctggccaggcagaggggctcctcacttcccagtaggggcggccaggcagaggcgcccctcagcttccagacggggcggctggccgggcggggggttgacccccccccacctccctcccggacggggtggctggccgggcggggagctgacccccccacctccctcccggacggggcggctggccgggcgggggtctgacccccccacctccctcccggacggggcggctggccgggcagaggggctcctcacttcccagtaggggcggctgggcagaggcgcccctcacctcccggacggggcggctggccgggcggggggctgacccccacctccttcccggacggggtggctgccgggcggagacgctcctcacttcccagatggggtggctgccgggcggaggggctcctcacttctcagacggggcggctgccgggcggaggggctcctcacttctcagacggggcggttgccgggcggagggtctcctcacttctcagacggggcggctgggcagagacgctcctcacctcccagacggggcggcggggcagaggcgctccccacatctcagacgatgggcggccaggcagagacgctcctcacttcctagatgggatggcggcggggcagagatgctcctcactttccagactgggcaagccaggcagaggggctcctcacgtcccagacgatgggcagccaggcagagacgctcctcacttcccagacggggtggcggccgggcagaggctgcactctcggcactttgggaggccaaggcaggcggctgggaggtggaggttgtagcgagccgagatcacgccactgcactccagcctgggcaccattgagcactgagtgaaccagactccatctgcaatcccggcacctcgggaggccgaggctggcggatcactcgcggttaggagctggagaccagcccggccaacacagcgaaaccccgtctccaccaaaaaaatacgaaaaccagtcaggcgtggcggcgcgcgcctgcaatcgcaggcactcggcaggctaaggcaggagaatcaggcagggaggttgcagtgagccgagttggcagcagtacagtccagcttcggctcggcatcagagggagaccgtggaaagagagggagagggagaccgtggggagagggagagggagagagagagggagagggagagagagagggagagggagagagagagggagagggagagagagagggagagggagagggagagggagagctgctttcttgaattctatatcatgaagatttctctgtgtctttgaaattcttcaaaaacaattttcatttggctacatattccattatatggatattctataacctacgtaatcatcctctattagatttattttccattttgtatgataatatcattatatataaatcttccatttttttccttaaggtgggtttttgtaaatggaattactaaatcgaagtgcatgaacatttttaaggctttttgatatatgttaccagattgctttctggaaaagtggtactgatatatattctcaccaataattgcatgagaatggataaggtctaagtcaggaagaattagaaacagagttctggagcataaagatttttatctttatcaaaaatataatttctcaaccacagcactactgacattttgggccagataattctttgttgtgggggctgtcctgggtattgtaggatgtttagcagcatccctgacctctacccactagatagcaatagctgccctcccgctgtagttgtaacaaccaaaaatatctctaaacattgggaaatgtccacctgggtaacaaaattgcccctggttgagaaccactgatccaaagacttaaatgtgcaatgagacacttattcttagagtttctctactgtgtactaatgttctgaagcttagctccttggagctctttttttgtggagtatatatgtgtattctgcatattgcctgcaatgtaaaagaggctgatcttttttttaaggctgtgtaaatggctttgttactcctcattgtgtatctttccctactgacatctgcctggtttcctggttatgagaagaaacttaaagtgatggcacttccatttgctttgccctacaaaaatgatttgccttgaaatttaatatggtatttggaagtgtcagtcagcgtccctatactttgtctttatcttctgagtaagaagggtaagagtaaaacagaatgagaatgactttggatctcttgagtctgtatgtaaaggaaaaaaaaaggagtggactgggatttttgttaactaaagttcaagtcttaaaaactaagaagcctattttaagcagcaggagttcccagttgaaggtctgttccctgtatctacagctggctttaccttcagttcttgatggaatgcacctgggtaaaaggccaacctcgtttctataatatttcagaacatcttggagtcctgaaacccatactctcttcctgacataaaacttgctgtgtccagatcttctagtgcttaggttatacttgataaatttcattaattcaaagaagataagctgcagtttcctctgaaaaatgaagagcacacaaatacattaataagaacatgaactctctgaaaatactgtgtccttaaattatatgaaactcatttaagtctatccttcagtaaagacactagcctttgaagttctgatatgaattcattgttcttaagtgtaagatttaggtttaaaaagttagtttgacattgactttctatactggctgtttcttttctgtttgtcccccttaggagcagtctcacaggtgctggacagcctggaagagattcatgcgcttacagactgcagtgaaaaggacctagattttctacacagtgttttccaggatcagcatcttcacacactactagatgtaagtctgtctttttattattcttcttttttggtgaattgaatattggccgggcacggtggctcatgcctgtagtccaagcactttgggaggcagaggcgggcgtatcaggaggtcaggagactgagaccatcctggccaacatggtgaaacgtggtctctactaaaaatacaaaaattagccaggtgtggtggcgcatgcctgtagtcccagttaggactgagctgaggaggcggaggcacaagaatcacttgaacccgggaggcggaggctgcactgagccaagatcacaccactgcactccagcctgggtgacaaagcaagactctgtctcaaaaaaaaaaaaaaagaaattgaatatttagcatacctttttactttacatgaattctcagatgtctatcataacaattcttttcagttgccttaagcctatgagaaatgtgggaaatcatccatcaaaaattcatgattgaaatacagtatatggccgggcaccgtggctcatgcctgtaatcccagcactttgggaggccaaggcgggtggatcacctgaggtcaggagttcgagaccagcctgaccaacatggggaaaccccatctctactaaaaatacaaaattagccagttgtggtggtgcatgcctgtaatcctggctactcgggaggctgaggcaggagaatcgcttgaacccaggaggcagaggttgcagtgagccgagatcgctccattgcactccagcctgggcaacaagagcgaaactccatctcaaaaacaaagaaaaaagaaatacagtatatgtacagtacaaatgcaacagagcctagcaggctacaatgggaaaaaatttatatatctttatatttataaattatatgtacataatgcatgcaagtggtatgtgagttttaaaaaagagtagagtacaatcctactttactgaattatcttgtatttctgttaaaagaatccattgaggttagctgtgattactttttattgctttgcacattactttaaaacattatacctccagcatgagtataggagagagaaaagcaaatgagatactttgcaataggctgtattcccacacacatttcatatttaacattgttttgttccatagattcaatgtcttctccttaaaacataagcatatactccatctttaaatattacaggctccactgacagcagactgggatacaaaggaaaaaacagaagctgaccattttcatttcagtcacattttaagtaaaatacctttcttagagaacttggttcacttcagcaatgaaaactcttgggtggtttcgatggtatttgaacatgttagtctttttacaagaaaaatcttcccttaatgagagaatcatacttgctttggggtgcctagaactgtttggtgctgaataattcaccatatgatgtaaatgaagctaaagcaaaatttcccagaatgtgttctacagagcatggctctgggaggttgctatgggtgttgccatggtgggagggggaagtagatcttaaatttattggttaaattatttattgactaaataagtttgggaaatgctacattctttagtctttttatacagatccacaatgggtgttggtatattgatagctctgagatgatctaaagcaaagaaacctttttaactttctttatcagcatttctcaaactaatttgggcacagaacttttattcacaatcctgttgagttctgttttgatgaggaccagtttgggaaaagctcagctaagagtgtttgttgcattatgcttcagctttacactaaatgcagccgtaggtatctaacagttgcttctttccccaaatgtggtcagttcaaattaattatcagattttcatggctagtttggcctttgtatatagtgtacatattaattagggctgactaactgttataacatgtgattctaaaatttgagtggcttaacagaatagaagtttacttcttgctcacttcacagtccaatgcaggtagatgagggaggtcttttccacaccgtcattcagagacccaggcctcttccactaggtcacactgctatttcccagggtcttggaatcttctactgtatcctttgtacctagccagcaaatgagagaagagagaacatggagaatcttgcagggtcaagcttggaaatgggtttatctcacattctttggcaactgctagtcacgtgctcacctggatgtgagagctgaggaacgtagtttagaaatgtgctcaggaagataaggaattgggtcttctctttagtgtaatttatcttaagtagtatctattcactgtcattgctgcagaaagttttcacaattgtgtatttcccactgaagtttataccctttactagaactagttagtgcaatatttagaaaaggctacagcagtgtgtggagattttgtttattttattgtggtcagtgcttaggtcattgccaggtagatttactgaccttcttttgaatcaaggactttttgtaacaaagactttttgtaatttaaacactgagagaagcccaaattggtttcaaagttgtattttttcttactgatatagcaaggtatctgagcacatcaagcttgagattgcaggggagaagcaggaacattactggcttacacaaggaaaggggcagctattcagacacgaataactgctgcactgtttggtataaattgtcacaatttcagaagagattcttagatgttagtgagaaaaacatacttaactttcctttgcatttgtttacattataaagaagtatctgccttattggcatctgccctgtcagtgcaggtcaatttgaaagaggagctgttggactgaaaatgaaccatgcctattaaaaaggtgcagtataagaccaggagtagtggctcacacctgtaatcccagcactttgggaggtcattgtgggaggatcacttgagcccaggagctcaagaccagcctgggcaacaaagcaagaccccatctctacaaaaaatttaaaaagcagctgggcatggtggtgtatgcctgtggtcccagctactccagaggctgaggctgaaggatcacctgagcccaggaattcaagggtgcagtgagccatgatcacactactgcactccaacctgggcaacaaagtgagactctatctctaaaaaaaaaaaaaaggtgcagtatcttctgaattttgtaaacaggtgccatacatgagctccagtcaaattaatgactatgaggccgagccctggacaatatttgcatgcatgtggttctgaatctccaaactgagctatttctaaatgaaagtttaggccaggtacggtgactcacgcctgtaatcccagcactttgggaggccaaggcgggcggattacctgaggtcaggagttcgagaccagcctgaccaacatggtgaaacccatctctactaaaaatacaaaaatgtggtgggcacccataatcccaggtacttaggaggctgaggcaggagaatcacttgaacccaggaggtggagattgcagtgagccgagatcgtgccactgcactctagcctggtcaacagagcgagactccgtctcaaaaatgaatgaatgaatgaatgaatgaatgaatgaatgaaagcttaatcatcatgaatgaaataaaccatcattagaatgtgccctcataccctacatcccataaataaggcttattaagctcatttcacagctaacaggctacattttaataatataatcaatgaagaattcaagtgactgccatatagagaaatctaatcatttaaaaaattttaatatttaaatgtttgtggtatacattaaggaagaaaaatggctatgacgaactcttgaggagcagctgttaaaatgttggattttcagtctgggtgcagtggctcacttctataatctcagcactttgggaggccgaggcgggaggatcacttgaggtcaggtgtttgagaccagcctggccaacatggtaaaaccctgtctttactaaaaatacaaaaattagctaggcatggtggcgcatgcctgtagtcccagctacttgggaggctgaggcaggaggatcacttgaacgcaggaggtggacgtagcagtgagctaagatcacaccactgcacggtagcctgggagacagagcaaaactctgtcaaaaaaaattgggcctttcatttttctttcttcccatgttccacataccatggttgatttggaattgttttattttgcagaatcaaaacgaattcttctgcctttttttgtttgttgtttgttttttgtttaagacagggctctcccaggctggctcactgtagccttgaccttctgagctcaagcaccctcctacctcaaccacccaagtatctggaccacaggtgcaccaccacactcagcccttttttttttttgaagagacaggtctcaccatgtttgcccaggctaccaggctagtctcaaactcttgggctcaagcagttctcctgcctcggcctcccaaagtgctgagattacaggcatgagtcattgccccagcatgaattcctttttaaggattccaagtagggacacccagggggcatagttttatggaccatgaattaattaaggctaattaatcccactgagccattttaggaaatatctttaccatttttatgttatttctgttaactcaataacattctaaatagctaggtatgaagccataattttaaggctgacaaaaagaaacaggattaagttcctaagaaaaactaaagattatctatgacttctttattttttctagtcatgttcttaaaataataacaagctcaaaatttgaagaagcattattagaatttgtttacaggaaacaaaactgccaaactgaaacatttacattaaaatggagaagtactgtgattctactgaaagggaaatgctttctgaaaacctttgaatttgagtaaaacacatttagtttaatctgtagttagaaactgatacagaaaactctaaatatttgctatccaagtggttccagcctggcacacatatgcagcttctcattttgtgggaagaaatacagaggcatgaggaactgcttggtccagcttgttgcagtatgcctgtatttaaaaattaaaagcactggtgctaagatgatcttcgtatgaaatgtatagatcaattagtaaagtacaatttgacattagtttgctaggactgccataacaaagtaccacaagttgtgtggcttaaaacaacagaaattgattgtctcatagttctggaggctggaaagtcctaaatcaaggcattggcaggggcatgctccctccaaaggatccagggaagaatccttccttgtcttttccagtttctggtggttgcctgcaatccttgtcattccttgacttgtagatgcatcattccagtctctttttccgtcatcacatgtcattctctgtgcgtgtgtgtctgtgtatttacatggccttcttagaaggacaccagtcattggacaccctaatctagtatgacatcatcttaattaattacatctataaagacacttatttccaaataaggtcacattctgaggttctgggtaaacataaattttgagtgagggacaatattcaccccagtacagcatggaaaactgatttaaccctgaattaattcttcacgtgtgagtgcaaattacacaaatctaatataaaataatgaaatgttaccctgtcatccattaattatgctttattgggaattggtgttaaagtgttatttatgtcttgtaatgatattttgaatcagttatggattggaatttgtatgtgatacattggaaggtcagtgggtgggtgagtttttgatggactgaaaagccatgttttttggattaaaaacattttacaaatattatttggtagtagttttcagtcttctcagtttctagtataaattttcctattaaaataataaatgtttagtttgtaaatcaccagtgttacaaaacattgttaaatgacacatctctctgccaaactttgacaactaagttttaaacattaactggccatctgtcatacctctgaacagctgttagcatttgttacgcactgctgtttccatagtaaatgcccccacctaattaagattatttttgtaagaagtcttaaaattgtggtttctgaaaatataatgggtgattagattaatatagcaatttattgatgaatttttaaaattgcagtagcaattaatttaggagtctttataatattaatttataagtagacttttataatagacttagtaacttttaaatattgcattagcaattaactgatacttggaatctttcatattttgtatggccaacatctttattataattttttaccgtttagggagagttagcatttttccatctggcctggagttagccatggaaaactacaattcttgatttactatttcgcttttttgagatgacattaaattagtagccatatttagaagagcttatttttagaactcagaagtttcctaaaggaaaaagatggaacttctacaataatctggagataatgtttttgagcaatttggggtctgagaagtaagttaaatacaatgttaggtttggatatttaaagagattgccaatcaggaaatgccaaagctaagtttcccaagaatttgtagtccagccaatttgcatttaaatgtctagaataataaagcctatctgaggaccttcagaggatgagctactagtaatttctcagggccccatccagtcttaagagtcagctttggcaattatgaaaccagctgcacagtgggcccctgcccagtggtggtggtctttgtgcttcttgcctcctggggctgtagactgaagcgcattgctgttccctttgaatttgagtgtctctccactgttttctaactggaggggcaaaacctcccatatctgtttctctccatgtattgaagtagtattgtcagtgtaaaagtacggcatgaaacaaaatacctgaaagctagaaataccatatgtcgtgaatattctcaaagtatttttccttctttcttaatgtaaataaatgtcaataaacttagcaaaaaaaaaaaaaaaaagccgctaagcatatggttctttgttaagcagcaatagaaaactgatagaaccaggaacaagatgaggattgtccactccccacttctattcaccattgtcccagagactctggccagtgcagctaagacaagaaaaagaaattcagggcatgaagattggaaaggaagaagtaatatcatcctttcccagagttgttatcttgcatgtagaaaatactaaggaatccacaaaaaatctaatagcattataggcaagcttagcaaggtcacaagataccagattaatatacacacattatctaaatttctatatgtgagcaaaaaataacccaaaaataaaattaaagaaatattcacaatattataaaaagaataaaataggaataaattgaacaaaaaaaatgtaggatttgtatactgaaaactaaaaaatgctatgaaagaaagatctaaataaatgagcagagatatactgttggattggaggacttaatattgttaagatggcgcttttctccacattgatctatagattcagtgcagtccctatcaacatcccagtaggatttctttgtagaagtcaacaaggtgatcctaaaatttatataaaaatgccaaaacaattttgaaaaagaaaaaaattggataactgatttcaaaacttactataaggctacaataatcaaaatagtatggtgttggcataaggatagatatacagatcactgaaacaaaaaagagtccagaaataaaccctcacctttatggtcaatttattttcaacaagattgccaatgcaattacatggaaagggggatagtctttttttttcaaatggtcctggagcagttggagatccatatgcaagaaatgaacttagaccctgtctcataccatacacaaaagaaaattgcctcaaaatggatcatagattcactttaagagcttaaaactataaaacttttaaaagaatataggaataaatcttcattaccttgggttaggcaaagagttcttagatgtgacacaagggaatttggggggattacggaaatgttcttaagctggattgagatggtggttgtacaactatataaatttactatcatcccactagatttcacagggccattacactaaattaaaatttagctttgtggctaagaatttaccactgattcaaaaatactaaatatggttttttctcccaagaactgttttattaaccagcgtgtagttgtgccttatggaagaagtccaaattgtgttttttgtttgaaaatgttatgaattacataactttatagattttcaatatggaagacaccttagagcaacttattttagttcattccttctacattcaagtacatatttgccatttccaaaaattcacagctttttgatacttttttaacatcaattttttggtcttttttgttgtggcaagatatatataacataaaatttgccacttgcaccatgtttaagtgtacagttcaatgacattaagtatattcacattgttatacaaccatcatcactatccatctccagaactctttcatctttcccaactaaatgtctgtacccattaaatactgactcccattcacccctctccttagcccctggcaaccacccttctactttctgtccctatgaatttgactactctaggtaccacgtatataagtgaaattatccagtatttgcccttttgtgtctggcttatttcatttagcatgatatcttcaaggttcatccatgttgtagcatgtgttagaattttcttcctttttaaggctgaataatattccatcgtgtgtgtatagtacattttgtttgtctactcatccaatattgatgttttgtggttgataattatgtactaggaaaaaccaaattctcagaataaggctgtctaatcgtagggaattctgcctcgttccatctccacacaattactctttctaggatgcaagttaaatcttatgctatacatcttcgtgaaggaatgtgtgatttccactgaaagtattaatgactacggaagtccctccaattcccttatttgttcagataaattacttcttaaagcagggtttagaatttactctagaataccaagaataatgaatcagcttgtcaccagtatcagtgttacccactgagtgccattctctttttatgacaccatgatcaactttaccaaaaggcaaaggaatttgcagaaagccttctaagtacaataagcactgattcttctttatgctatgctcaaggaaaggaggggtttccccctagaaaggaatgtgatatgctcagttaaagaatgttcgatggagtggcttgcagcattcataatccaagaacatagctgttttcttctctttgtggcccttcaaacatgatctcataaaactcttctgccagactgcctttgtgctattctctttaaatttttcatgacagaaattcatttttgctacagctacaccaagtacaaatgcttggtgtttacctatgcaaaataaaaaaggtagcaaaagccaaaaataattaaataaaatattatctgacacacctaatgtaacataaatgttaccttttaaagcagcacattaataattgtatgttcatttaatgtaaatatcatttaactcttgtagttgcttaagaagagccaagctaggaaatgtgattttaacactttaaaaaaatagaaaggaaattaatatcatagtgaaaatttctcatagttgggcaagctcttgtatctgatactaaaaagtaccgtatttcagaagattttattaaaacaagataaaatctgcctatattatatcatgtaactggtttttttcctcatgctttcttttgctcaagaataggcattatgatttgtgttttacagggcttaattttagagttatttgaccacttgaaaaaggcatagagaacagtcaagctaggtcatctgaggccagtgtttgagtttctcagaaatagctgccaactgaccagaaatctgccacactggcctatgttgttaggccaccaaaggcacagtcttcttggattgaactaggaggtcaagcaagtcttaatttcttgaattcaaaaataaatccctgtaagtgcgatgttctaataggattagaacaaaagcagccctgtatacagacaaataaaacctaaacaaaacaagggcctccttagaggttcttttgctgtcaggatccaaaggatttttgcagctttttcaggaaatcttgtactggcccagatgtactgattttttaattgccttttttgctgacagaagaaaactttaataatggatttagagcagcgtattactaggccagctgcactccttcttgcaccttcaagtaaggatatattccccatcatgattttactaaaacttgatttaagttagcatttcactgctaagctattaaactaaagctttcccggaacacctaactcaagagcatccaggaacattcttcttggccattaaatacagtaagcagttgtccattacatgtccatcttcaacttgagttatgtagtacaaactgggccatggtattgggagcagccctgaaccttagtccagggaaaatctaaattccagggtggaactcttgctccttgatttcagtcactagatttaggaatttacacactttttaagatgagaaacaaatttagtgtaagatttgtaaaattttcaaaatgaatgaaatgaaatcttcaaatgaattcccttcaaatgaatggagtttgctatctccatgcagatagtcatctgtatgactattatttgagtgctttcaactatttaaaataaattgatttttagcaattttgtagaatataaaatttcaagaaaaacaatttttggtgcaggtaggataggcattctttgcacgtcaaaaaagaaaaatggcctgagtgattttgatttctttttgtaacttgtaatatcccaatgatacagaattgtgtttagatttgtaagaaggacaggttatagaagttcttccagccgggtgccatggctcacgcctgtaatcctaacacgttgggaggccgaggtgggtggatcacctgaggtcaggagttcaagaccagcctgtccaacatggtgaatccccgtctctactaaaaataaaataaaatacaaaaattagccgggagtggtggtgcgtgcctgtaatcccatctactcaggaggctaaggcaggagaattgcttgaacccaggaggcggaggttgcagtaagccaagatcgtgccattgcactccatcctaggcaacacagcaagaccccgtctcaaaaaaaagaaaaaagaaaaaaacttcttcctagtgtttaattgtagctccttaagtttttgaaaatgccattttaaattttgcaatgtttctttcacacttacgttgcccatcatgcaatctttaggccactgctaaatacactgctcttctccaagcttgaactacatgatgtttaatgatgccaaggatctttgaaaggactctgtgtgtgtgtgtgtgtgtgtgtgtgtgtcagggcctcagtctgtcactccggctggagtgcggtcatgcaatcatagcacattgcaacttcgaccttccaggctcaggcaatcctcccacctcagcccttcaagtagctgggattacaggagtgcgccaccacacctggctaatttttgtattttttgtagagacgaggtttccacatgtggcccaggctggtctcaaacacctagcctcaagcagtctgcccaccttggcctcccaaggtgctgggatgacagatgcaagccactgcacctggcctcaacaagtttatatgtaaacttgagcaagaaaaatagatttttagatcttacaaagttttctgtgatctccaacttcagaaaatcagttccagtacagtaattgaatatcagttctctgtgtttcagtattaaatcagctttccctaatattttgctcaatttcaaatgtatatgagaaaatacctgttatgtattgatggctgatctgctcagttcactgaaaagatgtgacattgaaactttgttcctatttacccacgtaattcacagaaactgaagaaagttcttaataagatagtcagtgtttccagaacaagttatttcaatggtcattattgctacacagtgtaattccgtgcacactgttattatctgttttattaggatcatcacagacacattcattaaatattttgcagctaaatatttgattcttgcaaactttcattcttttccagcaggaaacttcttcagtatctataaagtaagtgataagatgatggttgctaatgaacatcaatgttctttgcaaccctacaagcctatgcctacagtatagttgcaaaagttatcaacttgtctgaaacagtatacattctggtccttagatttggttttctctgtgcaaaaaaagttagtgggacatacaactcagtgataattattttatagcttcttaccatgcattccattttaaatgttgatcttgataaatactgcacataaactatgagcaaaacacaggtttctatttgataactaagaaatcagaagataatgtgatataatgagtatgataaaaaatgaaacttgatttagtgctttgaatgtaaataaaaggtgacatattaactgattttatcatctttatgtttgaaagtacaatctcaggagatttgaatttaatatcactaccaagtttattctgcttcatttgaaaacccatgtcaaatgtagaatgtgttctctttatggaactgtggcgacacttcctaagacagaaagatgaatgaagcgtgtcggtgtaggtatgtgtggtcatatctgactcagtaccagagatttgcagagagcaggcctatctgtgagacaatatgagacagtctgtttcccttgcagctgttcacatttccttgttttgccctggtgttgtgtgtacatgttttttgttttttgttttttttaataaaaagtgctgaatttgggtaatgataatttcattagaaaaagagagtaaacagtaacagattcattcttgttttccctctagggataatttattaacattcttccttctctcttcctcccccttcacacctcagctttacaaatacacctgataccttcaaatttcaggaaagcaaatagcaaaaggaaatacattttgtcattccaatataacttgaatttaagcttctagagcagggattcacaaactatggccctcaggccaaatccagctggccacctgtttttgtaaataaagttttattggaacacagccatgctcattcatttatggattattaacagccgccctcatacaacacaacagggtttagtggctgtgacagagatcatatggcctgcaaagcctaaaatatttcctatcttgccaggataggattaggatcctgatattctttttttttttttttttgagacagagtctcactctgttgcccaggctggagtgcagtggtgtgatctcggctcaccttaacctccacctctcgggttcaagcgatcctcctgcctcagctaccttagtagctgggactacaggcatgcaccaccacacccagctcatttttgtatttttagtagagatggggtttcatcatgttggccaggctagtctcgaactcctcacctcaggtgagaatcctgacattctttaacatggcaaggcttgtaattgagtagctaatagttttcaaatcatattgagtgtatttttccctgcagcctataaatagaattttttacagcttttttcccaagtatttgccaaagatatctccctggcacaaggcattgtgtattactgaattctagtaacaagctgaggagatctggatgagagaaaggacagcatatcagcagggcagggtcaggtccctgctactctggctgtatgaccctgaccatgacagttcacctgactggaactcagcttttgactttttaaaatggaggagttgaatcatgttgacatctaagatctcctcttttttttatttttatttttttggtaccccaaacagagtctcattctgtcacccaggctggagtgcagtggcacaatcacagctcactcatcctgggctcagggaaccctcctacctccccatcttgagtagctgggactacaggcaatcaccaccacacccagcaaatttttttatttttttgtagagacagagtctcactatcttgccgaggttggtcttgaattcctgggcttaagtgatcttcctacctcgtatggcctccccaagtgctgggattacaggcatgaaccaccacacccagccctaaggtctcttttaccttgaaagttgtataaagtaagtcagacttaaaagatacaaaagaaagaattaaatatagtcaaaacacatttcttaattttgagggaaagtttttaactgcacatgcaggatcgaagagaaataatatctggttcctaaagaaacaagctgaaataaatattcctggtgtgtttattttatgttactctgaattttttttaaatctatttacaatttctatgtactagtccaaatataatacttattttttctagaggaagcatttcttaaacactactatgtactcagcctcacgctaggggctattacctaatgtcagagaacccgagtctggtcgtgggaaagaaaaagaaccacttaaacagcatgttctataatgtacctcagacattcagttccctcttggctgttgatgcccttggtgtggcagacaccccagtgttggctctgtcctgagttgcagacgtgtggtttctgcatcgtcagtatactcagcacctggtctcagaaacgttctcgtcccctgcccccaggggttaccacatagctttttacttctgagtcctcttgtcctcctgggcagggctgtatccagatggctccagccaggctaccttctgcagtgtctccttgactcatgggaaacacacacatgcttaactcaacatacactacaagcatggcctgccccaggcggcctccagtcatgaaagaggcaggcaccagtctctttttgcttaggaccccaaatgctacatgtcaagctgccccaaggactctctctcacacagagatcctttctagtgtaccaaggtgggcctataagttgctacaattcagcaagcatccctccagagaatgagatagtgagctcttctggctggcacctccagtgtctaatgcgtggttcttttggggcatctaccatccttcactttgtatgagggagggtgcaatcccctctcctttcctcccgaacaagaaggagaagggaataatcaaatacttgctcttcttagtcctgtgactcctacaaatcccagacttctgcctctataggcagaatgaggggtcctggggtgaatatggaagggccattttgactgcctttcagcaagcccaggagaagtggtctagcagctttatagcaggttcagtgccatttacttcctcttggccttagctttgggctttagctgaaagtccaagactactggtaaggtcccaagtaacattttatatattctttatatatgatagaatggggggtgggtaaagggtaagaaagacaagctgcagtcttcctttgttctcaaaacccagctacctttcatttgccccagaccttgacaaaactctacctagatttgaaatttgagtcctgcatatctttgcaggcagcatataatatgcagatgacccatgagaatgagaaatccaaaagcactatgtttctaactactgtttttaaacacttcaatgttacatcgcattcgaacttttttccattgatgactttttatttacctgctttgccatatttctcaaatgctttgtatatgctatggatatcactaaagtattttgagtctctaagacaaaaatgtagaaattggtgggggaaatgaaggttgacatattatgcatatacatcaagatactttccaacttcgggttgcccactgagatcattgccagttgttattgctggggaccaaactacttactctctggtctccaaagggttgaatccttcatacatttctgggcctttggttatacagatttttggaatttgtgagctctttgaagacagaaactcatctttttcatctctgtatccctagtacatagaaccccacattttagtacctagtaagacttcaataaatattgagtggatgggtatgtggatgaaccaacaaagggtcacttctctctgacagtgacaaaatgagcccattcctcactccctcctgcttcagttcttacttgcccttttggttgatgagccagcagccgagattcacagtgtattctttgccacatggacaccatcctctctatcctgtggctgccttgagaggtgcagtttctaggacttgagagctgcagtttttagaagaagcagagcccaatgcccccacctcaggtagaagccccaccttttaattccttcccattgtatctgcctttcatattaagcatcccacctccccctcatcctgccactacttccactgaactttaggtgagttgaatttaatttaagtgattgaactggatcagaccagaccaaaggcgtggaaaaaaatttggtctgagtattttccttggagcagtgcctcaaaagagattccaggcacttgtgtgccacctatgaagttgtatggatagaacagcggttctcacttgaccactctgtgcctcatttttctcatcttaaagtgagaatagtaggggtaaccaactgcgtaggattgtttgaggttaagtgaatgagtatatgttaagagcttagactagtaactatcatctagtaagtgctcaataaaagtaatattgttgctattagtagtagtactattagtactctcaaaagttagcactggacataagattttcaaatacctaaggagtttattaaagcacagatttctggacctccttcttaaattctgatgttgtaggtctggaggggggtccaggaatctatgttccataagtactacatctgattcggccacacgttcttaagaaattacagatataagacctaaggaactgtatatgacatagtaagaccaggtcaaaaattatctccaatttggggagttgtgggattattttttctttgtgagaaaaattgatgtgcatttattaaatgtttaaatagaaacgaaccataatcatagttgaaaatgttggaaataatagtccttgatcaagaaaaaggcaaaacttacagtttatcatggaattagacattataaagtgatggtgctatcaacttgtaaagcctcaaattaaatttgctttttttctcaaacaggtttgagattttttttttttttttttcgagacaaagtcttgctctgtcacccaggctagagtgcagtgatgcgatcatagctcactgcagccttgaccttctgagtagctgggaatacaggcatatgccaccatgcctggctaatttttgtatttcttttgcagagacagggttttgccatgctgcccaggctgttctccaactcctgggctcaagcaatctgcctgcctcagcgtcccaaagtgctggaattacaggtgtgagccactgcacccagccgggtttgagattttataaaaatatttttatgtattcacttagattatttaaactttgcttgataatattatgacacgtcagggggtgactaaatgtgtttttaaagtgttatgtatttttttaattgtgataggaacacttaacatgagctctaccctctcaacaaatcttaaagtgcacaatacagtattgttggctgggcacggtggctcacgcctgtaattccagcgctttgggaggccgaggcgggcggatcacaaggttaggaattagagaccagcctggccaacatggtgaaaccccgtctctacttaaaatacaaaaaaattagctgggcgtggtggcacgcgcctgtgatcccagctactcaggaggctgaggcaggagaatcgctcgaaccgaggaggcagaggctgcagtgagccgagattgagccactggactccagcctgggagacaaagcgagactccgcctcaaaaaaaaaacaaagtgcacaatacagtattgttaatgatagacacaatgttgtacagcagatcactagaacttattcatcttgcaaatgtaatgtagtgtgtgtgtatatgtgtgttttatggtttcttagtttttttggttttgcattttgtttgggtttgggtggtggttttttgttgttttactattttttattgcatgcatgcagtgcaattcatttctataggctagtctggaaacctaatcactatttataacattatttttctgggaaaatatgatcccagttacaacattgacatttctttagagatagaaagcattcagaagatggagactgcccacatatattttacagggatttgggcaaacttttgtggacgagccacaaatcaccatttccctaaaatgttaatataatgttttaaatagagcagcattttactagtctacttatactatttatttaatctctgatttagtagtgctttcttaattaatacatcatttaaaaaattgtccctgctctatcttcacattgcttttgttaggcatttttatgtatgatgtggcccaaatatttataagtcataaaaatttatcttgcattagtataagcaaatctgactataatctgaagaatgtttatagtcagtatttgacttctcaactagcattggtgtacagagtaggtgaagaaaaaaaaaagaataaaaccgaccacgaaaatccccacctgttttagagaagttaggaaataaaagtgttcacaacagccgaggtcatctttaacttttcacttttcaaagcagactgttgactatgaaacactttatttgaggtagaaattaatattttaattgtatttctaaaataattaaatgtatgttcttcagaaagctgaactttggatcatttaggtttgtggaattttagaaatatatttagtttctttcttttttttttttttttttttttttggagacggaatctcgctctgtcgcccaggctggagtgcaatggtgtgatctcggcccactgcaaccttcacctctcaggttcaagcaattctcctgcctcagcctcccgagtagttggggttacaggcgcccaccactatgcccggcaaattttttttgtatttttagtagagacggggttttgccatgttggtcaggctgttcttgaactcctgacctcaggtgatccgcccaccttggcctcccaaagttctggcattataggcatgagccatcgctcccagcgtatatttgctttcttttcagtgtcttctccactctgaattggcagagtcaaaagaaaaaaagtttatgtccttgacttcctgctgaaggataccagcactgattctgttaatgaacagccctagtaaaacaaccataagcctttgtgagaacattccttcctagaaggagttgggtttgccctttcccaagatttaggtttctgtgaaaattcttccagacgtgccttggccagaaagcattctttcattttactccgtgtagacgtgccttggccagaaagcattctttcattttactctgtattcatgctattgaaagttgcttctgtcagaggaaacaaacactgtgattgaggaaatattgatgaattttaaatgacaaggaaattgccacattgacagaattttggtccatctatttaaagatgattttttgaaaagatatgcataagactcatattctgacaagtttcacagaacaattcagaggttattaccaagaggatcccactgaaatcatcagcctgcctttttaaaagaaaaatattgtttagtgaaataataaatatgaagctctgatttttagcaaagaattgtgagtgtttactggattttcttctttgctttttagctgtatgacaaaattaacacaaagtcttcaccacaaatcaggaatcctccaagcgatgcagtacagagagccaaagaggtaagtgatatattttatagaagtatttggcatcatcatatttgccacctttattgaagacatttctgttgcacattaagaggcagtttccctggagtcacaatttgactcattatattcagatttagtatttctaagtttattactgaacatacagaaaagaaaaaagatctctgcagcaatattgcctagatttctagttctggttctgcgatgtaaacttgaatacattaccatcaattttacttctctttttctgttttttaaaaaagcaagttattttacaacacttggtggaaatagacatgctataaaaatttgagttgctttttgaaggtggtaatgtttgaaagttaattaaatttctgtagcaattaaatatactgagttcaaagaagtcatttttgtaaattgtcaaggtatgtggctatatctgtcacaaacttttaaaaacctatttatgatagaaatacaacattgcagaaagtttggaaaataaaaatagatccataatctcatcaccctaacacagtagtttccatttttatatatcgttttctagtcactctccatttgcatataaatttttttatagttgtaatcaaaatgtgtcttttttaacctaccgttatataataagcatatttccatgtttctacttgatctttacaaatataacttctaatgactgcaatatttttctttgctgttattaaagtataacatattagcaattctcccattgttagacacatgggtttttttttttttcattttttgatcatgtcagtctttgtgcaaataaacatttttcttttagaaaaattatttcttataaagtgaaattactatgtgaaagactatgaaggacataatcccttccctaccagattttagacagaaagtctgtactggaagatggtgtacgttcactgagaaatgagacccatgcagtggaggctgcccggcctgcccacttggtcaggactagcttggaggggttgtctctgacttcaccaccaagggctcatagaagggaattaagatatcgctgatagaggcatgaatcaccaccctgtcttcacaatacgcagatagaagcagagagactctggggacaattctttggctcaactggacagtgaaaacctgctggtttccccctaaccctgcttaggtggaaataccacacctctgtatttaaaaataaactaggagaggagcaaggacccagagagagtatgtggttttgtcctctcatttcactaatagagaaactcggagcataaaatacaccaaggataattggtttatcatcttgaaacaatatgaattaacagcataaccagcactctaatgaacagggtattcggataagaaagctctgtcatttttgcttgtttgtttgttcttccctgaggcagtagttgagtagcacagaacattctagttatgatgctaaaatctaaggctcgggccatgtgacctcacaacatccccctcctgccccagtaggaagcttttgtatggttttcacaggttgaggtgagagtcctcctggatggatggtggtatgatcctgccatccagttgtgccaaagcaatcctttattggcttaatggttggaattcagttgagtgtaatgcaaacctctgaatccagccatatgcagttagaatagcagcaggtgtttactcagaaaaagaacagaggctttttcatgggttcatgtcccataaataacttacacaggtaaactccatcctggtggtaaaggagaactttttaaaacaattttatttgaaaacaatcaattttacctgtgcagaaaaatgttaatgactaattagtgaagaaaatttgagtggaaagagaaaataaggctttaaaaaattgttctcttaggctccctggcatttaaccctaagagccattagcagaggcatgactttctctgtgtgggcagatgactatggggaaaaacattgatccggcaggcatttttgcattttctacattacttaaagaaaaattacttgtgtattcttaattaagtagtctaattaattagttctgttcttgaaatcgtttctatttgtgcctgtgtcattttgacatttctaaagggaattggcagtgctgttaatataaaagaaaacttcttattaactttttgtccatattgatttttatggtgagtttggaaaaggatattcagagatactcttccgttaagtttcataaatctgtaataaatatatgttgcagccttgtcattttgctttatatttttcaataaccttttaggttatagttgacagacttttagaacaatttgcttcatttttattaccatcaatactgttcttctatgtattaataacatttgaataaaatgaaaagtttttcaaaataattgttttgcctgccataaaaatccactcataatttttaacttaaaagaatttaacattttgtaaatcttgtgtcatgtttgtattattgtatatcttgtttattttttaggtattggaagaaatttcatgttaccctgagaataacgacgcaaaggaactaaagcgtattttaacacaacctcatttcatggtaagtaataattaaacttccatagaactgaaacctcactttcaaaagaagtttttaaactaccctcataaaatgtagccagcttcatctcatgcatttttatccatatcatatgagactattaagattacaataccaggtaataccaaatattttaagactgttttgtttactttgtgtcacaactgtaaagatactcttggtgaagtggcttttcagggactgtactcatcagacaagggattttctttcttatggggtagtcctttagtcactggaactgtttatgttacttaaaccacaaagaactaaaattagagacagttttcaataataaggaatcgtctgaatctaggtgatatattggaagaattacatctcttttgacaatgcaaaactgctgcactttcttggttcatttctactatatggaaaatggggataacacctgtatttagccaaatataaagctaaatagctaaacaaagctcaaagctcaaaatagataagatactttgctgtggaaaaaggtccatgcttatctacctaactgcaatacaaaaacacaattacagatggaaattcatgttgaatataccattttaaaagcattagccacatcagtttatgtgaaaaatatgtgaaaagtggaaaatttacctcactgccctttgggagaaaatctgacttaaaagccttgttcttataactactattacagatgatactttgaatttttatttatttatttacttttgagatggagtctcaccctgtcacccagggtggagtgcagtggcgcgatctcagctcactgcaatctccgccttccaggttcaagcaattctcctgcctaagcctcccgagtagctgggattgcaggcgtgcaccacgacacctggataatttttgtatttttagtagagacgaggtttcactatgttggccaggctggtctagaactcctgaccttacctcctgcctcagcctctcaaagtgctgggattacaggcatgagccaccatgcctggccacaggtgacacttttaaaataatagtaacagtataatatgtgtatcaaagcaattacctgtgagttattatatatatgctgttttatgatagtgtttctttttttctttttcttttttttttttttttgagacggagtttcgcactgtcgcccaggctggagtgcagtggcgcaatctcggctcactgcaagctcagcctcccgggctcacgccattctcctgcctcagcctcctgagcagctaggactacaggtgcccgccaccacgcctggctaatttttttgtatttttagtagagacggggtttcactgtgttaaccaggatagtcttgatctcctgacctcgtgatctgcccgcctcagcctcccaaagtgctgggattacaggcgtaagccaccgtgcctggccctttatgatagtgtttctaaacttttaaccaagttattgaaataaagtttttttcctaaaagtaactacctggaaagaagcaattaccatattcatccttcctaactctcccacccaagcattaaaggctgaattcaagtataatccttgagagtatttgactttattctatggtaacagcactgtccagtgaaatacaattaggatacaggttctaatgcctgtagatgagtgcatttttacaacctaggtgtataaacacagaacttcgttcaaatctcacctcttttatcaaggtatcttgtaacctctctacccttctcttgaactttctcttctctaactcttttccacttgtttgtattcacctgcataacattctaatgcttgctggcctgccagagcaggtctcttcccagtgaatgagccagggcaatttttctttgtccttccatatcccagcccagttttgttgttctcattgagcttatctcatttagtcattgtgattatctctatttcacagagcaggagaataaagaaactatatgctttattaataatcctcaaatgtgatgaatcacaaatatctgcagttaaattaccgttaatattaccttgttcactgtttcatgcatatgtgctgtgtttccccagattataattcattcccttttagacagcatgtcttctatagcaggggtctccaacccctgggccactgaccagtacccatccgtggcctgttaggaaccaggccacacaacaggaggtgagcagcaggccagccagcattaccacctgtgtccccctcctgtcagatcagcctaggcattaggtcctcataggagtgggaaccctattgtgaactgcgcatgcgagggatctaggttgcatactccttatgagaatctaatgcctgataatctgaggtggaacggtttcatcccaaaactattccccgacctctatcccccacccccacccaccctgccatccgtggaaaaattgtcttccacaaaatgggtccctggtgccaaaaaggttggggaccactgttctatattataaaagtggttaaagatgtgaattcagatgacctggggttgaactccatccttgccaccgtaactttatgaactctgactctgagtcaacctcgtggagtcagaataagaattaagtagctgatatatctactgtgcgtagcacaatgcttgacatatgcttagtgcctaatagatgttatctgatacctattattagttgctccatagtatctatcatgtatagggcacatagtaagttatcagtaaaacattgaatagattaggaacctgcccgtttgcagataggttaggctctccttggctgactgctctgtgcagtgttccatagctagaaacagatatataataaattttggaccaggcacagtggctcacgcctgtaatcccagcattttggaaggccaaggcaggaggattgcttgaacccaggagtcaaagaccagcaacattgggagaccccatctctacaaaaaattaaaaataaactagccagacatggtggcacatgcctgtagtcccagctacttaggaggctgaggtgggaggatcacatgagcctgggaggtcaaggctgaagtgagccatgatggcaccactgcacttcagcctgggcaacagagcgagaccctgtctcaaaaagtaaaaaatgccaggaactgtggctcacgcttataatcccagcactttgggaggctgaggaatgagagtcatttgaggtcaggagttcaagaccagcctggccaacatggtgaaaccccatctctactaaaaatacaaaaaaaaaaaaaaaatagcctggcgtggtagcacacacctgtagtcccagctacttgagaggctgaggcacaagaatcacctgaacccaggagacagaggtttcagtgaggcgagatcacgcctctgcactccagcctgggtgagagtgagactctgtctcaaaaaaaaaataaaaaatgaatttggacagacatgtctttctataaattgctaagtaaactcagctcaattcagagaatgatatagggccgtatgagaccaatagatctttcagatttgaagtaagctaaataaattaacatatacccaaataggagccttttttttcatcaaaatcattacggctcatatagcccattgtatgacagcttatctgtcttctaagtctcgatatgttttgcttttctgaagtcagagagaagttaatatgtgcattgctattagtaaacattttcagaaataataagtaatttttataatttattgaatacctagctaggtgcttaaaagacattttcattcatttatcaaataagtaaatgcctactgtatgccaggcacactatgccaggcactaaggacctagtaatgaataagacaaacaagatccctgccctcatggaacttccactctagtggaggtggggtgggaggacaggtaggagaggtagaggtagacaatgagcaagtaagctaacaagataatttcatatggcaataataactatgaagaaatgaaaggataatggtgcagagattatagtaaagtgggagctgctttagataggggaaagcccctctgaggagtagacatttgggctgagactcctttgaggaagagcaaatgcaaaggcccagagacaggaaagagctttgtagattcaaggagcagaagtcctttgtggctgagatacagttaacaagggagagagtggtacttcctgtaccaagagaggtcagcagaggccagaccaatttatttatttttttaatatataaaataaggccaggcatggtggctcacgcctgtaatcccagcattctgggaggccaaggtggacggatcacgaggtcaggagttcgagaccagcctggccaacatggtgaaacctgtctctactaaaaacacaaaaattagccaggcatggtggtgggcgcctgtagtcccagctactcaggaggctgaggcaggagaatctcttgaacgcaggaggcagaggttgcagtgagttgggatcgcaccactgcactccagcctgggagacagagcgagactccatctaaaaataaaataaaaaatataaataaataaaagccttccaggccattgtaaggagtctgcagttttctcctgattgcagtaggatgacactaagtgatggcacgcaggaaaatatctaatctgtgccttgctggagctgatgtgtagagaacggactgtaggggggataagagtttagggagaccaattggaaggctgttgtgagaggttgtagaggcttggagaaaggtgaggatggtagaacatgggcagatggggtttctgtgttggagatggttacatacaagaggacttgctgatggttgggatgtaagctggtgtaattaaacccatttcacaattccgagaggaaattgtgccctaacaaggtaaagagacttgcttaaggtcactcaccaatcagtggcctcaatgaggttcaagccagatcctgctagcgccaaagcctatgctcctaaaagtcagttgatttataatgctaatcagatttctaataaatttaagttgagctcattggtcattcctaaataagcttttgtgtagataatatcttatgtgggaaatataattctgagatatatatatatatatatactatattaaataagcttttaaatgctggggctttctatcttataagcgtttttaaaatcatggcttcaaaatcttggtatttttaaagaaatattaatagctaaggggaaatatgttaatacttacaatttttttattatgccaaggtttgggagttattcttggcatatttataatttcacacttatttgctcagtcatccgaatttttctttgctttctgattattataacatgaggatttaacattgaattacccaacactgaaaatccagatacttgtagatatttacagtaactaaaggaagaggaaataagggtaaatttaaacgactttaaaattctgtgttttttttttttaagagacggggtcttgctctattgcctagataggagtgcagtgacaccttcttagctcactgtagccttcaactcctgggcaaagcaatccttctgcctcagcctcccaagtagctgggactacaggcatgcaccaccatgcctgtctacttttttttattttttgtagagacgggggtctcactttgttgcccagactggtcttgaactcctgagctcaaacagtcctctttccttggcatcccaaagtgctgggattacaagcatgagctaccacacctggcctaaaatctgtatctttagaggtcatcataaaagaatattatctcactgattacttttttagttattccatttgaaaggctgactttttaaaaagaatatttcctttgcttattgcagctgtaaaatatgaaacattaaatagtcagattttttccactctagtctgatgttgttagttgtcttatacatatccttactatagtacaaaaagtgaaagtgtttttttcctattacacgattgttacgtagttaaaactgacagctatttcagcttagtgacaactgctcactcatacgtcttaacatatttgaagaaaaatgttcaaattttggtttccctattttttattttatatactcttttaagcttttaaaaagatagtctgtaagtggccccctttttctgtttggatatgaattagagctttaggttaagtttcgttttgtggtagcaatcatttacagtgccaaattgtggttaatatcgagtatgaccttatttggtgacatcatttaagcatttttcttttagagtccagtttgagtattattttatgattgtgggcttaatccttccttgtaaataatgcattaaatacaaatgtttgcttatataatttaaaagaatgagtagaggcctgtaatcccagcactttgggaggccggggtgagtgaattgcatgagctcaggagttcaagatcagcctgggcaacatgatgaaaccccgtgtctacaaaaaatacaagaatgatctgggtgtggtggcacatgcctgtggtcccagctacttgggaggctgaggtagaaggttcacttgagcccaagaggtcaaggctgcagtgatatgacgaacataattttagcaaatgaaatgttccagtttttatgttactgatttttgctttttgccctaaatcttggtttcttatgtgaccacaattaaatcagaaaaagagggatttgcccacataggacagcctctatacttgggctcaggagtaccagtacaaggtgcagttagggcactggtgaggaagccaaggtccccagggccatcatggagcactactttcaagctatatattgcttagtgccccttggtgctcctcacccaaatcccagtttagaccagccttctgagattgtgaaaatatctgccatttccattagaaactcaactgtgtataatgctcaaagcatattctttactggtaacaaatcagcattatcttctttatgattttaccagattgttaccttttttttttgcctcgtatgcatgcctttaaaattaaatagccaagtcatgacttttttaagccttttaataaaataacttaatttcagatgctatgagttattatttttaaagcaattttaactgcatttcattatctgcagatattaccgcacagatcccaaattaaaatagaaccaaatttatagttagcacataagaaaatataatctttgtataaagctccagacattttgatagctgtagattctctttgaaatagaaatgttcaaatatttatgcttaatagaaagggtttattatgatggcacaaaaagtgtggtgagtagaaggacattcttttttagggaaacaagggacattttattgttgaagttcaccaagctgacaaatagagatgtcagttcaaagaaatcactttctctttgttaataggctttgcaaaaagaagtcataataataattctcaacttattttttatttaaacaagtgctccaaaaaatataatgaacaaaaaaatttaacatatttagagtttgagttccatatcatacgtgatattttggaagattacgtttttaaggtacatctgtgtgtatttttttctttttctaaatcatatgctataaattattttcatcctttgggttatataaaagcgtcattgtaaatgccattgatgaaagatacttgctcaatactccaattattgcactatttctttttaaatttgtttcaattctaagccccagcacaaatttgccaactctatttatagatgattcttttagctaaattacttgaaattgtaccgtctaccttcatttgaacaagttagttgataacacctctgacccagataatcatcaaacacatctcttcattgattcactcatttattcacttacgttttaaaaaatctatttatcatgattgtcacaaaaaaattgagatagttggatgtcgatattacacactttatgttctctttagatgaatgatacctttgagaggaaaagaatgagatatgtttatagaataaatttgtcagccccatgtctacaaagaaaacatttaaaaattagccaggtgtggtggcatgcacctgtggtcccagctacacagaaggctgcaaaggaaggatcgcttgagcccaggagatgaagcctgcagtgagctgagatctcaccactgcactgcaccctgggtgacagagtgagaccctgtctcaaaataaataaataaataaaataaatttctgctgaaatagtaatgttattaataatttttttcttcataaaacactaggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatggtaagtaggaagagaaagttttcaatactctcataagatcccagcatgagttatatcaactaacttcaacctatgctactaggagttggggagggaaggaagacatggatagttttaaagaaatcagtttccagatcttcagttcccccctgcccttcttttctagaattgttctgcctgaaactgtcttaggcattccggttctctttctcacctctcctttcacaattgcccttcaaccaaaaaaaggggaacatactgtaacattcctccagggtgtaaaaacctctggggcagcaaagaaagggacaatttgaaatattggtattggtattgagaaagtgaatgtctagtaacattgtaaaaatcatccttttataaatcttatagttttcagatcttttgccttcaacaaaattagaggaagattaattcagggggcattcaaagaattgagtaacactgctgaaataaatttcttccactcccagctacctacttaatatgaatcaatttactcagtgcttgggagtagagctggaagagaattgatgctgaaccttgcctccattctcatagaattctcgtagactgagaagatcaaggaaaggctccttgatgttaactgaacagagcaaggggagtgaggggaagcaggggaatactattcagcaaaccaaatagcacatgtgtaaacctggtagtaaaaaggctcttatcatagtttcccaatggaaagaaggcaccatggctgaactgcagacagcaaggtgagtggctggaacagaatcatacaagtgttggaagacatgttaaggattatgttcattatcttaaaaacaatgggaggctattgaagactttcaagcagggggataatattagatttttgttttagaaatatcactctagagaatgtatgagaggggtcaagagtggatgtacagaaaccagttaagaggctgttattgcagcagtgcagggcagatatgatggaactctgaacttgagggatggatgtcaagatggaaagaagtgaacacatttaagaaataatgaaagagtaggtaatatcagtaagccttaacaatggattgacagtagaactgagggagaagcaaagatcaagcacagcccttaagctttagtcttctaaaactgaatggacgttgagacagggaacattggataagttccaagttggaggagaaaccatatctttagaagaggaaaaaaattcaaatttatgcattcatatctttttcctcagaacatagaaaagggatattaggatatagaaaaacaaattacctacttctgaaagttgccttttagattaagggaaaagttatagcagtgactctatgaccatgatttttggagagccctcagcttagacatttctggtcctaatcctcatttagtaatctttgccagttatacaatattatcttgcagcacatggggggcatgcagatcacctcaccccttctggtactatccaggcaactctttggcttaagagcataggctacagcaggttttgggtgtcttgggcaaatcacttcatgtcagtggacctcagttggctcatctctaaaagcatagttgactaaatgaatgatccccaagatcccacctagctctgaaagtctaatattccattcattcattttatatattcattcatttattcaccaaatatttttgaagtccctactaagtgcaaatcactcttattagatgccagtgatctattgtcagataagacactgccccttactagagctcacgttccacagggctggctacattaaacaagtaaatttgtagcttagcacggtttacttaacaagcccagttatgacagagctggagaggagagaaagctgtgttggagaggcaggaaggtgtgatgttcagccaggcaaagcaggcaagaaggtagaagggaccacaagaaggaggcctcagagtgtcttgggatcattaagttctcaagcagtccagtgacagctgcttgattgtttgtgtgaagactcactacatagaaacatagactgaattggcccggtgcagtggctcacacctgtaatcccagcactttgggaggacgaggcgggtggatcacgaggtcaggagttcgagaccagcgtggccaatatggtgaaaccccatctctactaaaaatacaaaaattagccaggtgtggtggtgggtgcctgtaatcctagctactcaggaggctgaggcagaagaatcgcttgaacccgggaggcggaggttgcagtgagccgagatcgcgccactgcactccagcctgggcagcagagtgagactccgtttcaaaaaaaaaagaaaagaaaagaaaagaaaaaagaaacatagactgaataaaagcataaaactacatccctgagttactttttcagaaagcgtaaaatggtcttgagtctcccctaaaagtctccttccaaaagcttttctgtcttcgatgatcctagtgaagatgtatatttcttctccttttgatgggtttccatgaaaacaggaattattttatgtgaaatataaaatatatattttcaataatagagtgtcaatctctaatgcatttaatacaactttatttgctttcttagttgtcttattcaaagcattatgttactgtgcaggatattcctatatgatctgttttgtttttcagaccctctgcaatgtgtccattcctcaagggtgacatactcctgttacacacctctgttttcccatttgtagcatcatactcataatttttttttttattgattggaattcccatagttgcaagtgacaaaaatcaagcttgaactagcttacaaaatagaggaaaggcttatataaacagggaaaggccaggagtataactttcctaatatctcccctcaagctggtaggttcaggagtaggcacctaacccaagctatgccaatgccttccctagaatttgtgaacttgggaacagagagaaagtgaatcagttcctctctacagagaaatgtttgggacctacagaataataaatgttaactacagttggtttgaggtgaacttctcctggccatgggagaccctttttgtctcatttgctactgtacctagcagagtgcctgcctcatagtaaattcacgttaatgttagttgaatgaatacatacatctattagtttcaagggtggaagctgtattgtactatcatttcccttatgaaattagatttgacttacacactaatttacagcatttttccaggaacacttttcttagtaaccatacaagctgattgaatgtacaagttggaaatgaaacttgaatattacaattgaatcttaggactggaaatattttgataaaccagtttttcacattgctcacctaccacttctgaaaactgcaaaataggaacaatgcaaagttatagtttgtggagtggtacaaattaagtttagagtataaagtctcagatatttttatcaagctttctgacagtgttattctctagtgaaaaataaaagacacagtccctacccttaactgtctcaaattcaaggccactttccagcaagggagcctgttaaaaagtacagatttccgggctccattcgaggcctcctgagcttaaatctaaagagtgggtttaagagtcagcattatttaaaatttccctgtgtgattcttaggattaaccagatctagtgcaaaaaatatgtttatgaatgcttgttttttttaatagtggataatcagaaaacaaaaagtaatccactctgtagaatagtattctggcattaaatgtgactatagaactttcatttctgtccaagatagagtaactgggaccagatttatcctctcatttgaaacaacccaacatataaaaaacaaaatatcatgaaagaacagttttcaagacattagacatcaggcaactaaggacagtgatctcttgtgagacaggaaacaaggtgacccatatgaatgccccaccatgctgccttgagagagtttccaggccacagcacagggaggggaactaaggcagagtaggcagactccctaaattgaggggacagagctgagagtctggggtgaccaaagcaactagagttcataggacagagtactgaagaggagagagctgcacacagacagaacctcagatctgcagaggatctccctcaagtattcagcagagtatcgatcagtgcatgtctaataggaaattccccaacactgagaaactccccaacactctccactttggatggaaaaaaaaaccatccaaaaggattggaaggaacagcgcctgcactacctgttcccaccagtcagactagaaaaatttctaattcatggctcattgtgtagagcgctcagggaagtcttatctctgtaatgagaagtaattagccccaaactgacaactgctccagacctgcctaatggatcatgaacgcaagacccaaaggatcaaactatgtccgagtaactgatctaagtctcagaacaaaacataagaatatttttaggaatacaaaaacatcaactatgcaacaaattcacaatgtctgacatctaatcaaagattactaggcatgtaaaaagaccagaaagtgtgacctataatatggagaataatcaatcaaaaatgacatagaactgacagataatagaattagcaggaaaatacactatgggattaatggcagattagacatttcagaagagattagtgaacttgaagacagagcaataaaaactatcaaaaatgaaacacagcaagaaaaagaatttttaaagatgaaaagagcatcactgagccgtgggacaacttcagtcagcctaatacatggttaattggagttcatgaagaagagaggaaaagaaagaagaaatgtttgaagaaataacgcctgaaaacattccaaacttgatgaaaactataaacccacagatccaaacaccatggcaaaccccaagcacaagaaacatgaagaaaacaataccaagctacatcataatcaaactgcttagaacctatgacaaagagaaaatctgagaaacagaccaaaaaaaaacaaaaaaaaaaagaaagaaattgggagacagaggtaggagaattgcttgaccctggtaggtggaggttggagtgagccaagacatcatgccaccgcactccagcctgggtgacagagcgagactccatctcaaaaaaaaaaaaaaaaagaaaaaagaaattttacacacagaggaacaaacataaggatgacatcaatgtcttatcggaagcagtacaaacaagaacagtgtcataaagtactaaaaacaaacatttctcaacttagaattctaaaccaagcagaagtatctttcaagaacaagaaggcaaaataaaaatgtcttcagacataccaaaactgaaagaattcagcagacccacactataagacccacagtatatttaggacattcttcaggcagaaggaaaacgataacagattgaaatctgaatctacaaaaagggaataaagagcactggaaatgatagctatatgggtaaatctataagttctttttcttattacttcaatctcttataattggcaatttaaacaaaaataacaatgtgttttagagtttatagtatatggaaaaataaaatgtatgacaacagtagcacaaaggtcaggaagaaagacatagaagtactatatactattgtaaggctcttatatgatgtaggggggataagggttatatgtgaagtggtataatatcacttgaaggtacactgacaagttaaagatagatgctataaaccctaatgcaaccactaaaacaacaaaatgaagagttgtgagagaaaacacaggagagaaaacagaataaaaaataatacaaagaaaggcagaaaaagataacagaacaggtggaacaaatagaagtcaaatagcaagaatatatatttataccagactgtatcaatcatcatgttctgcttgtaaaacatgcacttcatacacaaagaatagtttcaaagtaaaaaggtagaagccaggtttggtggtgcatgcctgtagttccagctacttgggaggctgaggcaggaggatcacttgagcccaggagttcgaggatgcagtgggctatgattgcaccactgtgctccgcctgggtgacagtgtgagacttcatctcttaaaaaaaaaaaaaaaagtaagaagatagaaaaagatatactgtgataacattaatcaaaaggtagctggagtagctttattgatatcaaaatatattctcagaccacactgggattaaattagacatgaataacagagagagataaatcgccaagtacttgaaaattaaataacacaattctaagtaacccatgaattaaagaggaaatcaaaagggaaattaagaagtattttgtaatgaattaaaatgaaccacagtatgtcagaatttgcaggatgccactaaagcagtacttagggagaaatatgtaccattaaacacctatattagaaaagaagaaacatctcaaatcaatgacttcagcttataccttaaaagtaactaggacaaaatggagtaaattaaacccaaaatgagtagaagagaagaaataataaagatcaaagtagaaattaatgaaatagaaagcagaaagcaatagagtatcaataaaacagaaaatactttttctttggaaagatcagactgatcaggaaaaatggctatacaatcacggggaaaaaaaacatgaattaccaacatcaggcatgagagaaggggcatcactacagagtctacagatataaaaaggatgataaagaaataaacagatttatgccaataaattcaacaacttagataaaatggaaaaattccctgggagacagaaactactaaagcttatttaagaaggaataaactgaattgccctatactatctgaaaattgaatttgtagttaaaaactattcctcaaagaaaactccaggtcaagatggcttcactggtaaattctgtcaaacatacaatggagaaataataccaattctatacaaactcttttcaaaacattgaaaaaaaaggaatttttcccagctcatcctagaaagccagcattgccctgataccaaaaccagttaagacattacaaagaaagaaaactatagactagtattcctcatgaatgtagatgtaaaaattctaaacaaagtcttagcaaagcaaatccaacaatatatgaaaaggttaatatgttctcacttcagcagcacatatactaaaatataaacagtacagaaaatattatcatggcctctgtataaggatgacatacaaatgcatgaagtgttccagatctttaaaatatatatatgttatgatcaaatggtgattaacccaggaatacagctttacttataatagcccaaaccaggaaacaattcagtgggtgagtggataaactgatatgtccatacaatggaataccactcagcaagaacaaagaacaaactactgatacatgcaacatcatggtggaatctcaaaataattatgctgagtgaaaaaaacaacaaaaaagagttcatactgtatgatttcatttatgtacagtgcaaacaaatctgtagtcagcaaaagttgactgtatcagcctttggtcgacaactatattatcagctttttgattgtcacattagtagttgcttagggatgtggtggggagggtatggagggatgggagaatattaccaacgagcatgaggaaacttttgggaatgatagatatatcactatcctgattgtggccatagtttcatacatatgtcaaacttatcaaattgtacactttaaatatgtgtatgtcaattatatatcaatgaaaactgtttttaaaaataataggcaacattaaaaatggagcaacagggaaaataatcataattagaagatttaaaagcactatcggccaggcatggtgactcacacctgtaatgccagcactttgggaggccaaagcaggtggatcacttgaggtcggcagtttgaaaacagcctggccaacatagtgaaccatctctttccttaccctcgtctctactaaaaatacaaaaattagcttggcatggtggcaggcacctttaatcccagctactcaggaggctgaagcaggagaatcacttgaaccctggaggtggaggtagcagtaagctgtgattgtgccactgcactccagcctgggtgacagagtctcaaaaaaaaaaaaaaaaaaaagaaaaaagaaaagaaaagaaaatagtgtgttaaaagcattatataaaatatatgtatatagcaatcaaaaaatcaaaaatagtatttttgtcatggagcaattttgtgtgcgtggcatactggatggtcttctccattttccatattttctttaattttttttaactggtaattaaaattatctaccgcaaaatcacaaatattaagagaagcactgtcatagtaattctacttttgctgaactttttattttttttttaacagggaatcactttaaaaatgaatgaactaaatcattgtattgttgcaagaattatgcatgggggcatgattcacaggcaaggtaagtttcatatatatttctttctttgccttccttaattttttttccctgtagcctagtgaagaaaatgtttttgtttgttttgtttttgagatggggtctctcactatgttgcccagactggtcttgagctcctaagtgcaagcaatcctcccgtctcagctttccacaggtgcatgccatcacacccagctaagaaagtataaaggatacatataaagaatcttttaaaatcatctttgattttaatcattattggcctccattgtttcttattcatctgcacaggctccagcatgtagataatgaagggagaatatattagagttctgttagccagagcatctctgtattagattactacttacggggaccacgggagataaagcaaataattacactgggcctcacgatgtaggagagacatctgttctagagtaaaagatatatgtaaataaataaccatttaagaagtgttctctcattcatttaggaattagatatgctatttataaattaggacatcatagagttaaataatacaaaaattaaatggtaagagatgtcaaatcgatgattaaattattaatacctgccatggtgagtgcagtcattctgtggagagaattcactaagaactggaatagacaaagaatgatgtgggggttttttttgagacaaggtctggctcagtcacccaggctgtgcaatggcacaatcttggctcactgcaacctctcctcccgggctcaagcaatcctcccacctcagcctcctgagtagctgggaccacaggtgcacaccaccatgcctggctaacttttgatatttttgtagagatgggcttttaccatgttgcccaggctggtctccaattcttgaacccaagcaatctgcctgcctcctcccaaagtgctgggattataggcatgagctaccttgcccagctcgaagaatgattttttaagaaggtgcatcttcagttaactctcaaggatgggcagggtttggatatgtggatttaggctttttctttgaaaggattgagttatatgcactagtatttagaggatgttccaaaaatgattcttctggcagactctctgtctttgagatagggttatttttgtacttaacacctctttccttacccccagagagcgagaagtaacactctaagcattttagtgccttattctcctcttgagaataagaggagatcactgtgtacacaacatgatgtctggcatcattgctgctttcagaggaatccttgtaggcgtagagggtgtacagcactcccacaggaggatatttggttttagattccagtatgtgttttttgtttgctatttttaataatttttatatgttcagtaaagccacaacatcattctttcttttttttttcttttcttttttgttttttattatactttaacttctagggtacatgtgcacaatgtgcaggtttgatacataggtatacatgtgccatgttggtttgctgcacccatcaactcatcatttacattaggtatttctcctaatgctatccctcccccagccccccaccccctgacaggccccagtgtgtgatgttccccgccctgtgtccaagtgatctcattgttcagttcccacctatgagtgagaacatacggtgtttggttttctgtccttgtgatagtttgctgagaatgatggtttccagcttcatccatgtccctgcaaaggacatgaactcatccttttttatggctgcatagtattccctggtgtatatgtgccacattttcttaatccagtctatcaatgatggacatttgggttggtcccaagtctttgctattgtaaatagtgctgcaataaacatacgtgtgcatgtgtctttatagtagcatgatttataatcctttaggtatatactcagtaatgacatggctgggtcaaatggtaattctagttctagatccttgaggaatcgccacactgtcttccacagtggttgaactagtttacagtcccaccaacagtgtaaaagtgttcctatttctccacatcctctccagcacctgttgtttcctgacattttaatgattgccattctaactggtgtgagatggtatctcattgtggttttgatttgcatttctctgatgaccagtgatgatgagcattttttcaggtgtctgttggctgcatggatatcttcttttgagaaatatctgttcaaatcctttgctcactttttgatggggttctttgtttttttcttgtaaatttgtttgagttctttgtagattctggatattagccctttgtcagatgggtagattgcaaaaattctctcccattctgtaggttgcctgttcactctgatggtagtttcttttgccatgcagaagctctttagtttaattagatcccattagtctattttggcttttgttgccattgcttttggtgttttagtcatgaagtccttgcccatgcctatgtcctgaatggtattgcctaggttttcttccagggtttttatggttttaggtctaacatttaagtctttaatccatcttgaattagtttttgtataaggtgtaaggaagggatccagtttcagctttctacatatggctacccagttttcccagcaccatttattaaatagagaatcctttccccatttcatgtttttgtcaggtttgtcaaagatcagatggttgtagatgtgtggcattatttctgaggcctctgttctgttccatttgtctatatctctgttttggtacgagtaccatgctgttttggttactgtagcctcatagtatagtttgaagtcaggtagtgtgatgcctccagctttgttctttttgcttaggattgtcttggcaatgcgggctcttttttgggtccatgtgaactttaaagtagttttttttccaattctgtgaagaaagtcattggtagttttatggggatggcattgaatctataaattactttgggcagtatagccattttcatgatattgattcttcctatccatgagcatggaatattcttccatttgtttgtgtcctcatttatttcgttgagcaatggtttgtagttctccttgaagaggtccttcacatcccttgtaagttggattcttaggtattttattctctttgtagcaattgtgaatgggagttcactcatgatttggctctctatttgtctgttattggtgtataggaatgcttgtgatttttgcacattgattttgtatcctgagactttgctgaagttgcttatcagcttaaggagattttgggctgagacaatggggttttctaaatatatagtcatgtcatctgcaaacagggacagtttgacttcctcatttcctaatcaaataccttttatttctttctcttgcctgattgccctggccagaacttccaacactatgttgaataggagtggtgagagacggcatccttgtcttgtgccagttttcaaagggaatgcttccagtttttgcccattcagtatgatattggctgtgggtttgtcataaatagctcttattattttgagatacgttccatcaatacctagcttattctgagtttttagcatgaagggccattgaattttgttgaaggccttttctgcatctgttgagataatcatgtggtttttgtcgttggttctgtttatatgatggattacgtttattgatttgcgtatgttaaccagccttgcatcccagggatgaagctgacttgatcgtgttggataagttttttgatgagctgctggattcgacgttccagtattttatggaggattttcgtatcaatgttcatcaggggtattggtctaaaattctgtttttttgttgtgtctctgccaggctttggtatcaggatgatgttggcctcataaaatgagttagaaaggattccctcttttctgttgattggaatagtttcagaaggaatggtaccagctcctctttgtacctccggtagaattcggctgtgaatccgtctggtcctggactttttttggttggtaggctattaattattgcctcaatttcacggcctgttattggtctattcagagattcaacttcttcctggtttagtcttgggagaatgtaggtgtccaggaattcatccattttttctagattttctagtttatttgcatagaggtgtttatagtattctctgatggtagtttgtatttctgtgggatcggtggtgatatcccgtttatcatttttaattgcatctatttgattcttctctcttttcttctttattagtcttgctagcggtctatcaatttttttggtcttttcagaaaaaccggctcctggattcattgatattttgaagggttttttgtgtctctatctccttcagttctgctctgatcttagttatttcatgccttccgctagcttttgaatttgtttgctcttgcttctctagttcttttaatcgtgatgctagggtgtcgattttagatctttcttgctttctcttgtgggcatttagtgctataaatttccctctacacactgctttaaatgtgtcccagagattctggtacgttgtgtctttgttctcattggtttcaaagaacatctttatttcagccttcatttcgttatttacccagtagtcaatcaggagcaagttgttcagtttccatgtagttgagcggttttgaatgagtttcttaatcctgagttctaatttgattgctctgtggtctgagagacagtttgttgtgatttttgttcttttacatttgctgaggagtgctttacttccaattatgtggtcaattttagaataagtgcagtgtggtgctgagaagaatatatattctgttgattttgggtggagggttctgtagatgtctattaggtccacttgttgcagagctgagttcaggtcctggatgtccttgttaaccttctgtctcattgatctgtctaatattgacagcaggaaacatcattatttctttaacttctctttgttatattactgcactggctaggaccggcagtctttcaaggagtggtatagtagacatcccgtcctattcttgtttttaaacggaatctaaagttagccgggcatggtggcgctcacctatagtcccagctactcaggaagctgaggtgggaggattgcttgagcccaggagttcgaggctgtagtgagctatgatcacgccactgtactcacctgggtgtcggagagagaccttgtctctagaaaaaaatgtttttttaaaaaggaacctttccaatatttcttcattaagaataatgtagatttttagtacatgccttttattagggctaaagaagttcctttatattcttagttgctgagcattttaattgtgaatgggttttgaatttaatcaaatgctctttcagaatctgctgagatgatcatttgtttttttccttttatctgttaatgtggtgaatgtcttttaaagatttcctaatgataaactacccttgcatttctcagataaactcagcttagtcattacatattatcttttttatgtactgcccgactgtctgctaatgttttgtttataagatctcagtatgtgcatttatgagtgagactggcccgtagttaattttcctctcttgtatttctctgattttagtttcaaagttatatctacttcacacaatgacttggagagtattccctcttcagttctccgagagattttatataatattggaatgatttgtgtcttgaaagtttggcaggacttgcctgtaaagtatcacagcctagtgttttggtttttagttttaagaaagttttgtttttgttttttaacaactgcttcaatttctttaacattaaaaggccatccaggctttctatttcttgagtgagttttggtaaattacattttcctaaaaaaaaataagttttaaaatattgcagagagcttcttcatagtattctctcatctttttattctctgccatctttgtcattatgcccctgttcatttctaatattgtttatttgtgcctactctttttttcttgatcaaccttgccagaggtttgttcagaaacccactctgggtttggttcattctcttcattatatgtttattttctgtttcattgttttatgacctaatttttattatctcctttttttttaactttctattggttttggctaactttacaaatttgacacatagttcatttatttccagtcttttttttttttttttttttttttgagacagggtcttgctccatcggccaggctggaatgcagtagcataatcatagctcactgcaacctcgaactcctgggctcaagtaatcctcctgtctcagactcctgagttaggactacaggcaaccacactcagctaatttttttaatactttgtagagatagagtcttgctttattgcccaggttggtctcaaactcctggcctctagtgatcttctcgcctcactcagcctccgaaaacactgaggttatagacatgagccaccatgcccagccttcttttcttttctttttttttttttttttttttttttgagatggagtctcgctctgtcgcccaggctggagtgcaatggtgcaacctctgcttccgggttcaagcgattctcctgcctcagcctcccaagtagcggggattacaggtgcccaccaccacgcacagctaatttttatattttagtagagacggggtttcaccatattggccaggctggtctcaaactcctgacctcatgagctgcccacctcagcctcccaaagtgctgggattacaagtggaagccaccatgcctggcccagccttcttttctaatatgtgcctttaagactaaactctccctctaagtactgtcttaatgtatcccaccagttttgacatgacgcatttttataactcagttctaagtatttttatatttctattatgatatttttcattgacctatattatttataattgtctgttacttttcacacttaacaggattttctgtatatctttttgtaatttacttctaacttaattacattgtggtcagagaatgtagtctgtatgacaccatttctttgaggtttgttgagacttgctttatggcatagcactttaatcgtttttataaatggcccacgtgtacttaagatgaatgtttattctttaattgttgcatgcagaggtatctttttgtaatgaagccaggtcagtgtgtacatttctgcacaatttataaataaggaagcaacattgtaaataacactctaagcattggttcttggtcatttctttctagctgaagtattacaagatgctgaaatgccaaccaaaagattaaattatctttaacagaatttgctgttgtgtagatattatcatgtcacaactcttggaaaattgacaaccttcgtatcatatctggtagataacgatagcagccaacactgtcatggtgcttggtatgtgccaagaacagttctaagccttctgcatttattaaatttgtttagttcttaaaacaatcctatgagatgggtactattttcatctccattttacaaatgtgaaaactgaggtatggagagtttcagtaatttacccaagatcttaaagctagtaagcaaggaagctggaatttgaacccaggcagtctggatccagaagccatacttttaaaccactatacataccacctctctcagaaaaatagatttctgcagccatccatcaaaactgtgccttccacaagtagatatatctgttttgatgaggttactacatgagttaaataattctgctgcaaccaaacttgtacctgcctctgaaatattggccctcaatattcaacttagtttttaaaaattacattgatgcctctggattttgttactatgaaagcatatatcatttcatgtttataatgttatataatttcttaggtacacttcatgttggtgatgaaattcgagaaatcaatggcatcagtgtggctaaccaaacagtggaacaactgcaaaaaatgcttgtaagtaaatgaaagtttttcctttcctaaaattgacttttactttgttagcttgtttttaaatatacaaataaggagtattcttctgtaatcagagaatttctggtaccatatttatgtggacttgaacttatataacattcataaaactgacaactagaaaaatgttgaaatacaatagagtttacaaacattttgcctgtctttagcagtgtgggctttaacactctccttttatcctttatctcctgtttcttaccaagcagatgattaaagaaaaccttttcagtgtttgtacatgtgaactagtttctcactgacctcaactctcctgacatcagcagtgtcagaaacctctttcctgttgagctgagtcatagccagctgtcgtggatttctctacagcatagaagggaggaaagccacggtagaccaggccatttttgaccatacatatccaaaatctgtattcaaattaggctttggattttttaaaaaggcaaaatgacagcctttgcctatgttcattgtcatagcaagcagacagaggtgtttggggcctctgatcccttttcccactgcagtgtagtagcacccaggttatgaatacctattaagtatgaaataagcttcacagactcaccaaacatttttttttcttttttttgagacggagttttgctcttgttgcccaggctggagtgcaatggcgtgatctcagctcactgcaacctctgccccccgagttcaagggattctcctgcctcagcctcccaagtagctgggattacaggcatgcgctaccacaccctgctaatgtttgcatttttagtagagacggggtttctccatgttggccaggctggtctcgaactcccgacctcaggtgatccaccagccttggcctcccaaagtaccgggatgacaggtgtgagccaccactcccagcccaaaatttttttttaaaaaaaagccaaaattaataagcaaaaagtggctgggtgcggtggctcatgcctgtaatcccagcactttgggaggccaaggtgggtgaatcacctgaagtcgggagtttgagaccagcctggccaacatggtgaaaccccgtctctactaaaaatacaaacattagcaaggcatggtggcgcgtgcctataatcccagctacccgggaggctgaggcaggagaatcactggaacctggaaggcagagtttgcagtgagccgagatggtgccactgcactgcagcctggatgacagagcgagactctgtctcaaaaaaataaataaataaaaaatttttaaaagtaaaaagcatattctatggggtacaccattataatgtggcatactcaatgtaatttttatgtaattacctagtctattgtctaattcaatgtatattcacttttgaaaggcatgtcacttagaaagttttgtattcacatctataaaaaggtgaccattgaagatctgtgagaccattgctgtatgagcaaaaggcaattggctgctgggcttttcccaggaacttactctactgttaactcgagcagtccctgcttcatgactacatttcattttccggctatgtgctctcagatggcttgtgctaattgcccccatgtgttttgagtggcttcttacatggttttgtgaacaattgtttgtaagaaaacttttctttctttcccaccaccccccctccagagggaaatgcgggggagtattaccttcaagattgtgccaagttaccgcactcagtcttcgtcctgtgaggtaatgactctaacaaaccacccccatctgctctgagttcttaactaactgtctgctgatggctgtatgtttttgctttctgggaaattgtttctgcctgtgctgttagatcactgcacaccaattttacaacaaagataacggaacagagtaggtcccatccacctactcagccctgcttccatgtggatctcctcagcactttgaactttttgcaggctgaaatctgagcaaaatgtagagaagttacaaatgatgacataaggcttaataaggaaaaaacggagtgtctgagggaaaaaaactaaaggccataattgcagtaatatttccaggaagttcattcacttcccttgttaagaaatcacatagatagttcttctttctaaggatctgagaagtgatctatttctgttgagatacagttgttcatacaattgtgacaggtctctagatggaagttaagtctgcaatgaattgataattgacttcactagagggaaataggcttttgcaaccttttgtaaaactgtttaaatttagaatggtatgtgatctgtaaacaagtaagttttctagagtaatacagccccaaagtttctttcttaaaataggcttatcctgtagaaattatagttcttccaacctatattattcagttttgtgttggttgttaaatgagattcaaaaatctattctttttgtattggaaatataaatgggcataaatgatatcatcctttggtcattgcacgttcagctcgagtgttatttattgaagcttgttctttcatgtgcatcttccgagagtatgtgcatcaatatgaagtacacacttcctaaagtttatttttaagactgacaggtaacttattggatttgtacttaggagaacctgagagagaattgtaatacttctagtctctagtgatggtgtaaatttcataagaaaaatcagaggcttcatattttttaaaagcctattgaagatacatattaaaatgtatagttttgtcaagtatatttttggtgagccatggcaattgaggtgtccgttgtaacgggtcttgagctcctcttggtggctttttatggaacttcaattaatagtatatttcaaaagaaaatgcagaattgcttctgttccaggattcagagtattgaaatttgttacctagaacacaaactttgctgggaaacaaagaatgtcacacttaacattctatgtaaataattttaatattccagagttacagatgtccttatatcatttctcatctgttgaagaaatttagtaaatacaattgacttttgtctttttggctaactaaccagaaggtactgttagttattaatacaacataagtttctctttttttttttaaatggtcgaactagtttggggtggaaccagtatcatagatgtaaattctatgttcttgagtaagaagaacccctcttaccttctttgcctttgaatagtagaaaaaataatgatacttctctcctagctccacctccagcctttttggccctcctgttccctggcagaattcaagcttgtggttggactcttcccagctagggcaatacttcaaaaaaaaaaaaagaaggctctctggccacctgcatctgcatcccccaggtccttggttaaagagtagacccctgcccctcaccctggctctactgacttgagtctctgcgggtggcacctggagatcagtcttgctcactaacatatgagaatgctcttctaagggatctcattacctttaaggctgacaggttctagaaatgctcttaagtcatctggggaaaaaaaatgtcttttaaaaagacatgcacatttctaaggcttaaaagaactctacagaagcaaaaattaaaaagtacttatttccttcctctccttgttcttatcgttaaagttgatttggacactaagggaatggagcctggaaaatattttgagtgtatagaatagtagagagaaagcaagcgatagaggagcctggatataggaagagtggctgtggctcctaggatctttgctggaagtgtaatattgttataggcttgagattattgttttaatcaatctgctaaaatagtcttaaaaaaagagttcttctctgatgtatatctcttttacccttactagtaataatatttattctataatagaaagattctgaggtgattgtaacatgtgaaatcttaggtttgtttctcttcagattgggtcagttagtaactcttgacacaggtactaaaaattattaaatacttttcaaacctaatctttaataaaaattaggcagttgggatcttcagcacgataatttatggtaatgtttgtcatcttatacttgatagggttttaatatcaagtcactcttctgggtctcattaaaagaaagaaaaggtatagaatgttagagataggaaagaattgattaatgaatgacacagtcatcacttaaaatatgtgagccttcgaactgcaaaatttttttcatacttctgtgaaatcatgcaagcaagtcagtatggcacctatacagctcaaacctcaaaggaaatggttgtcagactgtggttgttactgttgatgtaaatatctctgtgtttctgtgctggtgttctgtgttaatgaaccttgtgtcttatttcagagagattccccttccacttccagacagtccccagctaatggtcatagcagcactaacaattctgtttcggtaagaactttagctccacacagcaaagtgtgacaattttgttggtgctcacctgccatgagtgttctagttacatgtgttcagtggaaatagtgtcttctgctgatatacaaggctactacagctacaatgcactttactcctggaaaatctttttcaacatttccttctcattaaaaatccccttcaatagttaaatttgaagaaatatagttcaagactgctttggtcattctaaaaatatttctatgccaccccatttgtatgtatgactttgctcaaacctatgcaaaggatgtaaacggaaatttgtttaaacttctaaatattttttaatttgaaaaagataaatgtaagaattttgcagagtaggcatttgggtattcttgggctttgtagttttctattctgagtgatatcagcaacatgttttagtttccgctatctaagtttacgaattggtgtgccctctgttattgtggtacgtgcacatatttttgtgaattataagccttgcctggatatgaaaagcaaaaagaactggcttcaaactgcacttaagccacgctgttatcacatctttaacacaaagtactttatatttgacttgaacttggagttttaaattttttcagaactatccattttggaatatagaaagaattgtttttaacttatttaaacaaatggaagcacttaacaggtgcagactggcaatattttggttgctaatactgctgtttatgacccagttaaaattattgagagttctaataatgcagcagtattcttctttcctgacttttaatttgccctttgagaatatatcaacttttttatcaggtaaaattgtaaataatttagaaattatctcaaatggaatgatattctaagtatatcgtaagagaaattatgaaagaaaattgtctatgactttattttcaactttaaaataggctaccaaaggaattcattcataacagttaacatttaatacttttaagatgatgaaaagccatatagccattgaatttttcaaaatctaaatggttgcagtgactaagttgaaaagggcaacagctccttttatttattttttttttttaataggctgtttcacttgcagtggcttttgtgttgaagatgctgagttgtttcttaagaacacattttctctctgcttaaacttacctgctttcttcagcttgctgctaaatggcctgggtttgactttttgataactcaacatttctgataaatggaataatgtatattatctctttacaacttaaatctagctcatttttttaaccatattgtaacagaacacacaaattactttgtactcttgaaaaataaatgaaaatttttctcctgggttggctttattctacaggacttgccatcaactacccaaccaaaaggacgacaggtgaatagatatcctctatagaaacttctctaaactgagcagctaatagccaatcctttattaaccctttccatcccataatgtttgcattttggaccataacatttgagcattgagagcttgtaccatttcattttaacacattacacatgactaattctctataaagaatttttcctcacatctttgtagctgtaatggttattgtaatttcaacctgataattttatattaatggttaagaattcagcctttgggggtggctgtgggcctgcctctggcatgcaaaagaattttaaaggttataaaattcttagaattctaagactaactaaaaagttattcttaaaatgctgatgaacatttttaagcaaaaattttctgaagttgaaagctttttcttaaatttgtatttgcatgtgtatttctaaaagccatttgcaatgaaaaataagaaaagaatataaattatcttagcttcacatcctgatatacctgtgttagttcaaacatgaaaagttaagtgctgcctaacactggcaagtaactttcaaattgccagcactttagaggtatagattttaaatgcaaatgcagagacttgtaattttataggctggattgctgaaaataaacagaaaaatcacacagtggttccaaagtcttcaggttggttttacagtgacttaaacattaatattcaattttaatttcaagagatagaatttttatgggatttttatcttgaaatatggtattaaaaataatcagatttagtgttaagatatgtataaattagtacctgatagaattcacccataattttgtcttaagactgtataattgatggaacattgggtatgaattaccttatcttaaagcatttaaaaaataaaataattcataaaatgctgccatataataaacccttgaatgctaatctatttcctaagtaaactcacatatcataaaactcagagccttgaactatgcatgtcttgaagctctgtgctgatttcaagtgttacattgggggaagctagggttcaaattcatttttattctctcagaagagtaaaatacaaacctaaaacctaaattagaaaaaaatgaagctttttttaacttttaaaaaattgtttgagttacacttaactttatcagcaatgtgtagacacactgccagttgtcatataagcattctacagcaagataccaacccagagttcttgctaattttatatcgtgtgctgctttagggttaaaacctatcctgactgctagtatttatggcttaaaggctgccacgcagtcatgacaacgtatccataatgccagcatcaccaatgcaggtttaaaaaagagcgagcatacttttctataattagaggcctattctgttacagtaaaagcataaattaagtctttatttttattaaacaagtatttcaagtgttccttccaaataaaaacagcaaagttttgaagctatactcatcaaagattactagtacattgtttctagcggtagaagttttttgtgtcgtatttccatgcatcgtttttgctttcaccatctgatgtcctgtttgtattgtaactgttggtgtgtggttatgacattagagctaacttctctttcacatcactatggcatcctttcttacgaactcctgttttatagatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggtatgtttttatgcgtgttttgctttgcttggttataaaaacaaagccctgaccatccattttccaattttatattattttagagtgtaaaacctgtttgatatattccttcctttacgagccaaacaaaatttaaattagtcatccaagaattctatatcttcagtatctagtgagatcctagttgcagagtcagggcttcattttacacaaaaagaaaggaaggtctggaaagagattggatgagcagccctgagccaagtcatggtctcacagcagagccctccactcctatatgctgttataattgttttagaatggcattaaaaaaatgtacgttctccttgcccttctacatgctttcatgcccatcccattcccaccaccagcaaaaaatgtaggtgcagtgcttcagtgtcactcagagtatttgaagataaaatgtatttcactgttagaaggaggtagtcagaagctttgttctttaccttgccagtcctttaaaaataccttttctgctagaaagtttaagccctaaaagcaggctaaagttaggggttttaggcactgtttttaactgagagaaaaggagtcacagatcactgtatattttgataaaatctatttctgctattattgttaccgtttccttagttgaactgtcttttggaaaatattgatggttttacctttgttggtacttgggcaatataccagattatttctagcacaaaagagataatgtctgagttttgtttcatgtggcaaaaaataacagccattaagcatcctgccagttcctcctaaaatacttgaacccagctaaaagagaccaaagacattgagtccatagaaatttctacctgcttttatctatttttctcactagttaagagatttctcagttaatctcttttgcttgatcgcctctttcagctatcccatgtttccccaaaaaatagtattaaatttagaatgttggagctgatgaggacttcagatgccatcattttatacataaggaaacgtgggcccaaatggagaagcagcagccttccatctggcattgtctttcagtctgatcttcgagaaacagttcaagcataagcaggaggaaagcaatctttaagtcgttgccgtgatgatgccattatattcttactgatatttacattttacagaatgtcttctttaatgttaccatatattatgggcatttattgaaaataattgtgtagattccagacctcttctgcctagtcagatcatctatataaatgtttcaccaatttctagaactctgagtcctctggaggaatcctgagtgatggcagtgcaaaaagcagatttgcttcctatttcctgtaatggtggatgagattatttggataaatcctcctgatgaaaaaaaatgaaaagtgccgcagaaaatatgtttttcaaatgaccttgaaagcactgaatagctgaaaaggtatcaggggccaggcatggtggctcacacctgtaatcctagcactctgggacgccgaggtgggcagatcacttgaggtcaggagttcgaagctagcctgaccaacatggtaaaaccctgtctctacttgaaataaaaaaaaaaaaaaaaattagccaggtgtgatggcaggcacctataatcccagctacttgggaggctgaggcaggagaattgcttgagcccgagaagtggaagttgcagtgagccgtgatcgcgccactgcactctagcctggacgacagagtgagactctgtgtccgggaaataaaaaaaggtactggggagctcagtgaccaattttttttttttttttttttttttttgagacggagtctcgccctgtggcccaggctgcagtgcaatggcatgatctcaggtcactgcaacctctacctcctgggttcaaacaattctcctgcctcagcctcctgagtagctgggattacaggcacccgccaccacatatttttagtagagacagggtttcaccatgttggccaggctggtcgtgaactcctgacctcgtgatccacccactttggcctcccaaagtgctgggattacaggtgtgagccaccacaccaggcctcagtgaccaatttttatgtgaaagcctttaataagaatgataagtggaatatcagagttaccaagtggcccattttgcaaacagggcatttgtcattactgaacacttctgtgccagagaaccaaggttaagatctaaggccagtacaagttggggaatctgttagaagaccctcctcattgttaggagtgcaagaggcagtccccccaggctaaaaggaaacagataagcatacccttatttcccttcaacaccggaggactatagagaaagctgccttgtcactgagcaaagcaaaagatgaggaaattgggaacaaacttccaaattgtggccaccagtccaccttgaatggatttgcacccaggtacacacagcctggggcagccaggggagctgaagccatgtacttgatttgaagtttcccctttctttactaatagtttcagatgtatggtataaacagaaagtctctgaaggcaaacacttttatcctaacccccactaacttcatcctatccgcccgacataaactttttccagggcagtagccagcaagtcaaaattatcaggcacacaaggaaacaagtaagacccaacagaaatgacagatagtagaaacaaacccaaacctactgcatatattggaattaagagacaaagattttaaaaataagcttacgaagttggttcgtttgtttttgagacaaggtattgtgctctcgcccaggctggagtgcaatggcatgatcatggctcactgcagcctcgacctcctggacccaagcaatccacccacctcagccttcccagtagctgggacaacaggcgtgcaccaccacacccagctaatttttttctttttcttttttttttttttgtagagatgaggtctcactatgttgcccaggctgatctccaactcctaggctcaagtgatccttccaccttagcctcccaaagtgctgggattacaagtgtgagctaccacgcctagcccaggtttttaaaaatcaataataagcttgtaaaatatcttcagagagcagaaaaaaaatgttaatgacatagcagattttaaaaagaaccagaggaacatccagggggaaacatgcagtaacaaaattagaatctcagtggtcacacctattagaatggctaacatttttttgaagtttcatcagtgggtaaatagatcaataaattgtgatatagccatacaatggaatgccactcagcaataaaaaggatcaaactattgatatatgcagcagtatggatgaaacacaagatcattatgctgagtgaaagaagccaggcaaaaaagagaacacgctatatgattccatttacataaacttctggaaaatgcaagatgggggtggagggagggaggaattacagaggggcatgaggaaattctggaggtaatgaatatgtttttctttttttggagacggagtctcgccctgtcacccaggctggagtgcagtggcgcaatctcagctcactgcaacctctgcctccccggttcaagtgatcctcctgcctcagcctcccgagtagctgggattacaggcgcctgccaccacgcctggctaattttttgtgtttttagtagagacagggtttcaccaggttggccaggctggtctcaagctcctgacctcaagtgatctgcctgcctcagcctcccaaagtgctaggattacaggtgtgagccaccgcagcacccagccatttttattttttattttttatttttattcttctaaagtcaaggtccctctctgtctcccaggctggagtgccgtggtgcaatcttggctccttgcagcctggaactcctggattcaagcaatccccctatctcagcctcccaagtagctgggattacaggcgcccgccaccacgcccaactaatttttaaattttcgatagagatgagatctcactatgttggccaggctggtctcgaactcctgacctcaggtgatctgcccgcctcaacctcctaaagtgttgggattacctgtgtgagctaccacacctggctaagaatatgtttttcttgattgtagtgatagtttcatgggatgtttacagatatcaaaactgataaatttgtatactttaaatatgttcaatatattgccaaaaaactgaactgttaaagttgcaaaatatatagagggagaaaaggattctaactgagatgataagaaagaggcccactgggcagtgtgtaccccaagacctgaataggactttgggggtataggaagctattcctggcagaagagaaagatcaattttcctttgcttggaaactgaattggcctctgggatgtcagtgggcatccaatactaacaagaaagatttgaaacaattgtatcagccagacccccaaaactttgatcaaatatattgctaccaagtcacattcttcacattttctagatgagaaatcagttttttcggacccaaatgccttactctaggcacatcaatttagcccttcaatatattttagctcccggactctgtcatccctccccttgccttgcctacaagatcctgatctaagccatcaataaattggtaggcatgtgtttgaaatttccttccaggttgaccttaaccctaacacggtttctgtgcacttactgagctaaaagagctaatgtttatttctgcagtgtctggtaaaaatcaatttcattcctctgtcatcacaccacatgagactatgccacaattttttcctgggaacctgtatttttgttttaagcttaagaacatttattataagatactctctacattgtaacataagcttcacaaggtcacacgattttgtctcttaacctgtcaaaaaattcctcaattctgtttgtttccaaagattctatgccttttagttctgactaatagcacatattgacttgcaccaaaagaatccccaaagcaagcctttatcagcctcctctgtatgccacgtgggtaatatatggagatggactttgatactattactgagagttcgcagtattttccaataaatgtctttcccccaaccaaaaataaatacataaaaacttcagtgaacaagagcgagtaagagatatggaagacagcctctttaagaaaatagaaaataatacttcccaaatcattttatgatgtcaacattaccctgataccaaaattcagtaaaggcagttcaagaaaagaaaactacataccagtatctgtcatgaacacagaagtaaaaatcctcagcaaaatattagcaaattgaatccagtaatatattaaaaagataatatattatgagccagtggaatttgtactgggaatgcatagctggttcagcatttgaaaaccaatcagccgatccactagattaacagactgaagaagaaaatccacatagtcatatcaatagatgcagaaaaagcatttggtaaaattcaaaacccaatcagattaaaagtctcataaactatgaattgaggggaacttaacctgataaaggacatgtatagtaaacctacaactaacattactagaaagggaaaaaatttgcagatgatatgattctgtgtgtagaattcaaaggaatctgtagacaattagaattagtagcaaggtttagaaaggttgctgatataaaatcaatatacaagggactgggcgtggtggctcacgcctgtaatcccagcactttgggaggccgaggcaggcggatcatgaggtcaggagatcgagaccatcctgactaacacggtgaaaccccgtctctactaaaaatacaaaaaaattagccgggcctggtggtgggcgcctgtagtcccagctacttgggaggctgaggcaggagaatggcttggacccgggaggtggagcttgcagtgagccaagatcgcgccactgccctccagcctgggcgacagagcaagactccatctcaaaaaaaaaaaaaatcaatatacgaaaatcaattctatttacaagccacaagcagaaaataaaacttttaaagggtaccatacataacaccacttgcaacaccataatattataaagtgttcttgcacacacacaaaacaaaactggatctgattaggcctctaggttttattacctatttgcaggaaatacaaaggacagagagacatactaaagataccacagggacacagtcagaaaaatccagactctacagaaactaaaggacaaactagtttctacaacaaacaaattgtaagaaaagaaaaaggagggagagggaacctatagattttaaagggatttcagaagaaaactgtactcttggatttgttccaaaataatctatgataaggtggtataaataaagccaggcgcagtggctcacacttgtaatcccagcactttgggaggacgagacgggcggatcacctgaggtcaggagttcgagaccagcctggccaacgtggcaaaaccccatctctactaaaaatacaaaaaaaattagctgagcgtggtggcgggtgcctgtaatcacagctacttggaaggccaagacaggagaatcgctggaacccgggaggcggaggttgcagtgagccgagatcgtgccactgcactccagcctgggcaacagagtgagactctgtctcaaaaataaataaataaataataaaaaaataaaataagctatgactaataattgtcaaagcagggttgtagatagctgggtttcattacactatatccttgtatgtgtttgaaagttttagtgttacaaagtgtttcttaaaataccatttacaaagcctttattaaaaaatgaccaggcgtggtgactcatgcctgtaatccctgcactttgggaggccgaggtgggcggatcacttgaggccaggagttcaagaccagcctggccaacatggcaaaaccccgtctctactaaaaggaaaaaaaaatacaaaaattagctgggtgtagtggcgcacacctgtagtcccagctactcaagaggctgaggcatgagaatatgtcaatcctgaaaggtggaggttgcagtgagccaagattgtgccactgcactacagcctgggcaacagagagagactctgtcttaaaaaataaaataacctaggaataaatctaacaaagatgtcaagacatttacagaataaattataaaatttattgagaccgggtacagtggctcatgcctgtaatcccagtacttttggaggccaaggcaggcggatcacttgagcccagaagtttgagactgtcctgggtaacatagcaaggtccagtctctacaaaaatacaaaaattaggccaggctccgtggctcacacctgtaatctcagcactttgggaggctaaggcaggcggatcacctgaggtcaggagtttgagaccagcctggccaacatggcaaatccccatctctactaaaaatataaaaaattagctgggcgtggtggcaggcacccgtaatcccagctacttgggaggctgaggcagggagaatcacttgaacctgggaggacggaggtttcagtgagctgagatcgcaccattacactccagcctgggcaacagagcgacactctgtctcaagaaaaaaaaaatgggtgacatgcacctgtagtccgctacttaggaagctgaggcggaaggatcacttgcacccaggaggtcaagatgacagtgagccaagattgcaccaccgcattccagcctgggtgacagagtaagacttcgtctcggcgggggtggggggggaattatatctcgagacatttaaaaagatataagtaaatggagagacatactgtgtttaaggactggaagactcaatattgcagggatgtctattcttcctagatagatttcatagataagatgcaatcccaacagttttgaaattgacaagctaagtttaaagtctacatggaaatgcacaaggtcgggaatagccaaaatgctcttgaagaacaaggaaggaggtcttgctctaccagataccaagacttattataaagctatagtaaacaagataataaggtatgggtttagagatgctcaaatagaccagaaaggaatagagaacctgaaaacactctcatacgtaaatggacacttgatgtgtgacagaaatagcactgcacagcaatgaggaatggacaggcttttaaataatgtaggacaattgggtatccattaggaagaaaaaaggaattggacccctcctttacaccataagcaaaaatcagttctaggccgggcgcagtggctcacgcctgtaatcccagcattttgggagaccaaggcaggtggatcacacgaagcaggagttcaagaccagcctggccgacatggtgaaaccccatttctactaaaaaaatacaaaaattagccaggcatggtggcacacacctgtaatcccagctactcaggaggctgaggcatgagaattgcttgaacctgggaagcagaggttacagtgagccgagattgcaccactgcactccagcctgggcatcacaaggagaatctgtctcaaaaacaaaaaaaaaacagcagtactagtacattaatacccaaaatgtaaaagacaaaactataaactttgagaaggtaatattggagaatatcttctgggacaaggaaggatttctttttatttttatttattttttatttctctaaagtcagggtctctgtctcccaggctggagtgcagtggtgtagtcttggctcactgcagcctggaactgctggactcaagtcatcctcctgcttcagccttcctagtagctgggactacaggcacgtaacatcacacccaatcacacccagctaatttttttttgtttgttttttgttttttgtttttttttgtagagatagggtcttgttatgttgctcaggctggtctcaaactcctggcctcaagtgagcctccctccttggcctcccaaagtgttgggaaatcccctgctaaggatttcatttttgttttttttttttttttttttttagacaaggtctcgctcggttgcccaggctagagtgcactggcataatctcaaatcactgcaacctccacctctcaggctcaagtaattatcctgtctcagcatccggagtagctgggactacaggcacatgccaccacacccagctactttttgtattttcagtagagatgggatttcgccctgttgcccaggctcgtgtgaactcctgagctcaagtcatccacccgcctcagcctcccagagtgctgggattacaggcgtgagccatcgcacctggctgaggatttcttaagatatcaaaaatacttcccattaaagaaaagactgataaatttgactaaattaaaactaataagttgtgttcatcaattgataccataaagagagcaaaaaggcaaaccacagagtagaagaagatatctgcaacacgtatattaataactaacaaaagcataatatctagactatataaagaatttctacaaatctatgagaaaaagacaactgaacagaggaacggtcaaaagacttgaacagacacttaacgaaagaggaaattcagtagccattaaacatatgaaaaaatgatcagtcttactaatgagtgaaacgtaaactaaaatgtaaattaaaaacacagtggtattccattattcatccaccatgatggctaaagttaaagacagataataccaagtgttgccaaggaaatggaacaataggaatgttcatacactgctggtaggagtgtaaatcagtacaatgtcattgtaaagcaacctgccatttacaatagcaccatatggcattctgatcgtgattttggactcttatatgtgactcacttggggacccttggttggcccccatgagcaaaatcattaggagagcaaagtcttctgtggcaatattctgaaaggcaagtatttgtttagactgaacctgaaagagcaactttttaatatcatctttatgttaccaatgctggatattatagatcaaaattataatttcctgattgtggttataactgtgaatttaatcagagcacactttttatatcttatcttagaatctccatgtagcagtagtgccatttgttaagcatatactgtgtgcctggtactgtactagggacattatttacattttttgttctaaacctttacaatagccatccaaaaggctccaaaagtttaaagacactgcggatagaatattctggctaagatcatgagctctggtgccagaccttccccactctttcacttattagctgtgtgatttggggcaaattgcttaacctttcattctttcaatcccctcatctgtaaaatggtgatgcaattccctgtgttgttagaaagattaaaggagttaatacatgtaaagttcctaggaaagtgtctaacattaagtgctcagtaccagctaacaagtgacaaagccagaattcaaaccaggcctgtgttgaaacattctactgtatctcatggccacatgtttaggcatctaatctgagttgtcagtatatgttcaaggaataccatgccattttaatataagcctatattttaaaaacatttctaggaaattgtcatgaaaaccaaagaatagcctttgtccaaattttttaaaagattaggatgagtatggttatgctgttttatataaattcttcaaatggatgactcttctattttatcaaccagaattataaattcattttattttatttttctttttgtatgtgctaggcgagtagcttgcattgccatggagaagaccaaacaggagcagcaggccagctgtacttggtttggcaagaaaaagaagcagtacaaagataaatatttggcaaagcacaatgcaggtagggaaaagcacaactgttactgaggctgggttaagcatctccaagacctaaaaagatgtaatattttaattcagtcttcagtgttctctatccaaaaaattctaccatatgagatcttcatcaactttcaaaacctttaagaaacccctacctccaattaatatgttgattatttgctagatattttacagagctatactttataggacaaaaatgttattttgaaatagtatcctctggaatgaaaagaatccaacacgttaagtcctcccctgagaaatgaaagcttgagagtttgctgagtagccaggattcttatctatccttggctgggattggtcttgaacagatctcctcccgcctggctcctgcctggcccttgggcgtggccctgagataaacatctgagggtagaggtgtgctcttatcagagaactgtgccacaaatggttctgtggttggtttgagagagtacaaatgacatggacactaacttggttttgtccatttctgtgagtcgtcttcttccctcatggtatttccaagctaccacaagagcaagaatcttatcttggccttccctttatagtatgtatgtttgcccatatggaagtttgtattcaacttaagtcaaaatgttcacttgtcttgttgaaaactggaattaataccaaaaaggcatgatctgttgttgcaatagaatccccagaagattcacagggtgcaacttaagctaaagaaaatgcatggtgatacacaggagtgctaatacaagaagttattttcaataacttcttaatacaactccttttataaggaactttttctgaggaattgaaagtcctgactggcattaggttagttcccaaggtttcagaaataactccaaaaattagaaatgtggcccaaaaaatcaagtgaatctagtcatgcatacccagattgatggcataatgtttctgacaagtatgaaatgcatttttctctgtaaatgttataacgtactctgaattgttcatttctcaatcagagattaaaagtaaacatttcaaactgctgtataatgtggaatgaatgtgagtggccacatgggttaagtttaaatggctcagttaaataaggaatcattcccttcgcattagttacattgtaccacatttttatttccaaaaacagtgtaatttctggttatgtactactacagagcagtagtttcataatggcttttttggttttatgaagggaagaaataaagcagactagttacacaaaatgtagcaactgttaagcaaatgctcaagtatactatttgaagaaatgcactgcagagccaggcacggtggtggtgcctgtaatcccagctacttaggaggctgaggcaggaagattgcttgagcccaggagttcgaggccagcctgggcaacagcaataccctgtctatacaaaataaaaataaactaaatagaaatgcacagcagtatcagcagaatgttgcttcacacaaaacgtcagtggttattaccaagtctccttagttgcccttacttctgtcagcttctaacagtctaacacaatctaataggctcacaaggagatgtgttgacatataaattgagaaatgtatgcatctcaccttgtaatttgtacagcagtgttaaatgatacatagatatagatgggattgaaattaacttacacctagaaaagcaaagaaatggctggttcaggctgtcagtttatcattagatttatgctgtactaatagaggtcatgtaaacatgagtattcagtttgccagtattctttaattcagctctgaggaaagtaagaaattcattgaaaaactagaattctctaaatgctgtcaaagagtcaatttaatcattaatttaagaattttgccagagaatcagcatccgatctggcagccagtgttttcactttttccactctttcaccaccagggtatcactgatcttcttccattgctcccattctctgattcccgttagatggtgcacagtggtcctgcaaacacacctgtaagcttaataggcagctggagataggaccaggaattagcacacctgagtaaccgtgcaatttgggcaaatcacttcgctcctacgggccttgaaatgagggaattaggttagtcaatcaaggagatcttttctaattctaaagatcagtgggtctcaggttctttcatcactgggcctgacaaatggcgatcattcaatgaagccaagtattcttgtactgtctatctcaggctcttgctctctggtagacattgcctatccaggttgaaagctatcacccttgacatagaaggcaggagcctaataggggtagaacagaattgctttttcctctgtcttttgacatttacctcctatcccaaaccattgacctctcttaagttcttgtcaacttagaatgaagaaaggaggggttgagaggacaggggagcctactgccaccacctgtttggtatcatcagtattttcctaaccagcggccgtctgggcatcagaaccttccttgccatgcttaaggggttgttctacatgtcagtgtgtgtcactgtgtataaggccctcctttgaaagaaagtctgagcttcttagatggtccttgcagagccccttaagtgtctttgtagaactttgtgtttaggcctatttgtgattctctagtcaggatatcattgttaggcttccctcacctgcaaaataatcactgtgagctctctttttagtttctctttttgggagaagattcccagcttttttccttgactttctgaaatacactgcctgcaaagcctagcattcctttctgtcaccatctcttcaggtttcttctgtgtcatcaaccaactcttccattttgttcattagaaagtccagaagaaccatttgcttagtattacctttgctttacaagagatcatagggtcaagtatttaatcagctgttctgcttttagctacgatgaaaggtcatcccaatatacagaagtgtccttataaagaattgctctaaaagagtgagaaacaaatactcttgacttccattggtgaggcagttgctttgagaacttagaaatatcatagcctttcataccaaaccagatgggctcatgggccacagatcaaacaatatctcaaaaggatttttctggcttttttagaagttgatggtaaaatacagtactctgttcttctgttactactcagtaaattaaaataagggctgtatgttttgtttcctgcttcaaatctttgagaattcatcatatattgatggcaagatccaaaccttatcaagttctgacattatttgtatttgtggtacaaatgaaggttgggaattttgtcattatctagaactggtgggaatgataatactagaattatttccatttttgtcgttaggaaattctacatagcttgttaaagtggaattctgttcaaactgtgttacctacaactcccatcataaagtgacagcctattcgctgaatttgacccataagtaaattttgtccctctaactcccacacacacagtgtttaagttttaataagtcatcacgtgtgaaagtcaggatatttaacataaaaatttgggtttcagagttcccttagaagaacaaggaatgcagcaataccaggtccactttctcttttagtaactctgggtggttaatatggcctttgaatggacgctcattctccagcacacactgtccgcaccactccctgtttttgcacctggcccacttcattcaaccacattagctacctgacccctgcgggcattcaagtatgtactccttaacccaatgctaccagtgtgcaatgctcttttgaattggaggtctttatagtatttgaagatcttgatagtgtttccagctgagacaaggattcaatgttaatggcttttttatggaaaaaattcaacctggaaagtagttacataaatacttaaaagaagtgtctggaatgttgagtagtttagcagaaaatcagggtaatatgagcaaactatgctagacagtatttctgaatccttgggaatagatttgattatggtgtgtgtagcttttacagcaaatacattttctgtaacatacagaaggtttctagccatgtatacttggtacaaaaagcattgtggtgtggctggaacaactgaactctagaggcattgagattcctcagcccccaggacttccaaaagtcattttagatcaagttactagtgtaaactttttaaaaatgtaggaagtcttcattaatttggtttcttaaatgttagagccccgaaatactctatttacatacacatatttgaacataggggatttctacagtaccattcataggtgtgcttaaattatgcttaataccacaaattagtactattgactttaaaagctattcttttttttctggaatacaagcaactctaaaggaaacaaaaagtagcccataaactcactgccctgttggcattaaaaataataataggctgtgcgcagcggctcatgcctgtaatcccagcaccttgggaggccgaggtgggcagatcacttgaggccaggagttcgagaccagcctggccaacatggcaaaaccccatctctactaaaaatacaaaaattagctgggtgtggtggcacacgcctgtaatcccagctacttgggaggctgaggcaggagaatcacttgaacccgggaggtccgcggaggctgcagtgagccaagatcccaccactgcactccagcctgggtgaaggagcgagaccctgtctcaataataataataataataataataataataataataataaaagtaataggcacacatggttagaaattacacatggtacaggaaggtacaaagtgaaaagcaaaaggcttccacgtctacactctctgaagaggttttcttgtaactattctcgataaaatgtctatgcatatgctagtatataaaatccgctggcttttatataaggatattgtcgaatttctattaaaatgagtttgtttcttaatgtgatttatttgccttgtgtttagaatattgcatgataaagtttattttatacatattatacttttattttactaatatatgaaaagccatatttcaatgacccctgtacatttttcatgctgtctcactcccaatggcctctgtgcatgtaagtaacctgttgaatgactatgcctctgtgtttttggtggttttcttttattaagtcctttttttaatcagcaagcaacttaaaacctttaaaagctcattctttaagtgctttcctaatattatttgtatctcttattttaaaataccctttttttattgtttctcaaccctatgaccgtgtggcaatttcatttagaccagagtaacctcttcatgctgctcatttatggttaagatattgatgtttaacatatctgtttcatttcattttcataacatgtctgtttgtggttttgatggttgacatctaactcattcttatgtgttttttaaaaaaatgacaagtcttaatttggtaggatcacagttagggctctatagagggataggtgtgtgtatataccattcggaaagcttgtgtcatcatcatcatcttgctcttttgtgagatgcttgcttatttttattaaaatatattaaaacatatctgcttgtcaatgcacttcttctgtaagcatactttttcttgatggaaatatcactcagagggcaataggtctaaaaaataatgccatcagcactcctgcttttatttttgcaactctcatcactccattactactgcagtataactaactagccctaccacagagagcctcatgttcattttaattttgtgagtctgccattctgaacacagaaaacatttcttggtttttagctattgctagaggatatgctttaaagactttcaatcaacctttataaatcaagttatcaaaagaaaacaaatgtgcaaaaacccattaatatacactaacctctattttaatatatcgtgtttctttttttatatattgtgataatggtgctttttgtttgtttgtttctgttctattctattcccaagtatcttattttgcattttaagtgattgggcaaatcactaatgttaagaactaaggtgatattcacagtcatttggccatagtgtttctaggagtagaaggttctcttaataaatgattggctaaagtaatgcagatttcggccgggcacgatggctcacacctgtaatcccaacacttcgggaggccaaggccagtgaatcacctgaggtcaggagttcaagaccagcctggccaacatggtgaaaccccatctcaacaaaaatacaaaaattgtctgggcgtaatggcaggtgcctgtaactcaggaagctgaggcaggagaatcgcttgaacctgggaggcagaggttgcagtgagccgagatcgcgccactgcactccagcctgggtggcacagcgagagtccatctcataaataaataaataaataaataataaagcagcccagattcctttattacatcatcaaatcaattttactgaatttattttaacccctctaaaatccagggtttattcaatattctttaaaaaaagaaatgtcagtatgtaactgacagcatttgggtatgaccatacaaaaaatattacaggaaacacagacatacaattttagccctttgtgagaatttccaaatgtgtgtgagaattggaccatgttgaatttcaacaggaatgggcatctgctcaggaaagttttgtacattgcttgaaattgcttttatcatagtgttaagaggcaggtttcagaaaaatatttgttaaagtatttctcctcagtctgtagtgattagagaactccacttttgcaaaggtttctgagctcagactctgcttcatgattctttccatcctgatccaccatacacaggctgcccatgtaatgggcgacaagttttcaggcccaggaaagcatgtaactctccttacatattcaagactttccattgagtggatatctgggttacagtaaagcttgtgagatgctcattgataagcttgtgcaatagttacagaacttgccttagaatctagcatgccaccttcatcaactctgttgaaagaaagaaccatgaagttaaagaccagctgtccatgcatttctcatccatctctagaaatgatctagctggcccctctcctggttaactttagttgcattcatgctatattcatgttggtcactgtctgtagactttttctttttagtattgctgacttcttagaattggaaaaatatgaacagcatgtggtttcaaattaattcatatgatttgttggatactacatgaaaagatatgtagtatcttttagatttggacattttaatgcatgtgttcagcatctttggatgcccctggttctaaagagcattttcatgggcttaaaaatgaaaatttctccctagatgctatatgacttaaattacatgtaagccatatatcataagttggattcatatttttaagacatggttttaatataactgtagttttgccagtaaaattataatttatgtacatgaaatagtcattctacaaatttacctttcttctaaatctttgcgttttagtgtttgatcaattagatcttgtcacatatgaagaagtagtaaaactgccagcattcaagaggaaaacactagtcttattaggtaagtttgattgtgtaagtgagttgcttattctcactttcaaaacattttgtgaacattattaagagttgtcagttttaacattctttttttctaaatgacataggcgcacatggtgttgggagaagacacataaaaaacactctcatcacaaagcacccagaccggtttgcgtaccctattccacgtaagcaatgtctcaatctcttttcattatatttttcctatcacttttttaactctataatttatgtatttttttctgattacataaggtataactgttcattgtaggaaatttgtaaaatcaaaaaaagaacaaggaggaaaatgagttaacagtaatcccaacccctctttccctataataagtgctataaatattttgttgtatacccttctaggcttctctgttgtatacccttctaggcttgtcttagtacagatatgtgtataaagtgtgtgtgtgtgtgtgtgtgtgtgtgtgtgtgtgtgtgtgttttaaataaaattagttttatccattctgtttgtaacaatttttctaacaatatgtcatacacattacctagatgaattattcttcagaaaaataagttttcatagttgtacagtttctgatatgacaatttttttcccttagttaatatttaaattgttgatttcttaccactttttaaacccaatcaatatgctaacagttgtttctgtaaagattttcaaatctgtaagatttttaattctccttattttccgtatcttattcttaacctcttgccctcttcattttctcaattgtaaaatgaagtaattcaggattgcagagaggatttgagatcatgtgtatgaagcacttagcagatggtggataagtagaagctatctaccactatcatttcattattatcatcattattctaaagtttaaaattttaggccaggcgcggtggctcatgcctgtaattccagcactttgggaggctgaggtgggcgaatcacctgaggtcgggagtttgagaccagcctgaccaacatggagaaaccccgtctctactaaaaatacaaaattagctaggcatagtggtgcatgcctgtaatcccagctactcagcaggctgaagcaggagaatcagttgaatccggaggtggaggttgtggtgagccgagatcgtgccattgcactccagcctgggcaacaagagtgaaactccgtctcaaaaaaaaataaataaaattttaaccccagaagctttctagcagctcagggttggaagagctaaaggaaaattattttttaagagcaacaggagaaaatgtgaagattggctccattctatagggccttcacatgccttcctgaagcaatgtcaataccacttacagttatctgtacacctcagagagccaggaggcttcatgagaaaaccttcatcccaaaaccttgtctgatttacacaagaaaagaaatgtatccaatagtgtctcatttggcactactggggttttctagtaaaacactttgaagtgttcttttaattctccttatgtctagatcatgagtacagcaagcttagctaacatttagcttcttcttaaccacgtaacaactgaacttccatgttattaaatggccagttaactagtttggttttaaaacttacctttgatgatgtcaatcatgactagtctttgaaatatttgaccctgtatgtgtatataacatatatctaactactgagatgactgaagatagtacaacatcaatatgttatgtaagttcttggctgggcgcggtggctcacacctataatcccagcactttgggaggccgagatgggtggatcacatgagaccaggagtttgagaccagcctggccaatgtggtgaaaccccatctctactaaaaatacaaaagttagccgggcatggtggcacacacctgtagtcccagctattagggtggctgaggcatgaaaatcgcttggaacccgggagctggaagttgcagtgagctgagatcttgctactgcactccagcctgggcaacagagtgagaccctgtctcaataaataaataaatagtaacgccggttcttcagcttttgatgtgcctagagaaagggcttctcttaaaatgtccacattttgatgaccacgagcactttatgttctaacaaacaggctagcaggaaagggggattccccattagtttaggctcatgtatacagaagagagtagcataaatttgttctttctcaaagaaagaaggaagcaaagaaattgagagagagagggaaaaaaagggaaggaagggagaaaagaaaggggggtagggagagagaatattaaaaccagtgttcctggctcatctagaaaaacatttcctaaagtgtgttttgcaggatactggtcctattagtatccacagaactagagcttattggcatatacttcagttacactcacttaggtgaggggtgggcaagccttttctgtaaaggaccagatagtacacatttgaggctttaaggccatacagtctatcacaagcacttagctctgctgttgtctcatgaaaacaaccataggcaatatgtaaacaaaagcacatggctgtgttccagtaaaactttgtttacaaaaacagacagtaggtggccaggtgcagtggctcacacctgtaatcccagcactttgggagactgaggcgggcagatcacctgaggtcaggagtttgagaccagtctggccaacatggtgaaaccccgtctctgttggaaatacaaaaaatagctgggcatggtggtacacgcctataatcccagctgctcaggaggctgagggcacaagaatctcttgaacccaggaggtggaagttgcagtgagctgagatcgcaccactgcactccagcctgggctacagagtgggactctgtctccaaaataaaaaaataaaaataaaaaaagacagtagaccatgtttggcccataagccagtttgtcacctcctgatttaggtcttccataataattatgggtatgtctggccacagtcattgtgttttcagtgtaacgtgtcttttgctgtatcctaacattctccttttgcaagatgttatagaacatcacttttcaatagaactttctgtgacaatgacagtacttgatgtctgtgcagtccagtacagtggccactaaccatacgtggttattgaatccttgaaatgccactagtgagactgagaaactaaaatttgaattttatttaattttggcttatttaaatttaaccatatgcagttttccatttttttattctccttttttccttctacacaagacccaactgcattaaggcatacagtgagttatattaatcttgggtcatttcacgtcttcctcctgtggtggttcatgaagggataaaatacatctcacctgaacactgaaagtttcaccaaaccagacaattcactggctactatggtgtgatgcacacagataaatatggtttctagaatttagttctgcaaagccactgggggtgagaacaggggatatgagatatacgctaaagaatccacagcttttaggaagagactgggtttgagtaaatctgttgggagtgtagtaagctcatcagctcagccttttaaacctcttgtgccatgcgactttgcagatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggtaatgcccagcctccccgaatgtctgacatcctgcctgcatgccaataagcacagattctgaaatcaaaaatgccatcagaaagtcacaggtcacataataatttcataaaccacagaaaagtatcagtaatggaggcgttgggggttcacagtctagaatgccagctgactaatcgttggactcagtgcacacaccatgtatttaagaagcagagattattctcttaagaggtttattatatgcagaagctcagtaaggttcctgattgtgtctacgcctgccagaaatcctacgatcatctgacctcaggatgaggctctggcactttgttatcacaacagccaccttccctctctgggtacagctcacgctggaccatcagagcctctaccagcacattatgttaatctccagtgagaaactgatcctggggcctgggtctgaaacacagcactagctttatgaaagcaagcatgagtgagcccagatgtcagagacagcagggatggaaacccatggtggctctcagcctctgccatttccttacctgagcacaatgcctgaccctgagcaaaaactaggagagagataaagacttggaagaggactcaaaagagagccagacacagagatgatgaaatggtttctagatatgtcttgcagtaggaattattaaacttgaaaaagagaaagctgaaggctttacatcaaaaatgctgacaagctgttttttcatctctgagtacaaaccaagtagatatgggaggcaaagtatagtaggaaggatttgggagttgtagacatcaaggtgggttataggagaggcttgtgggtgccatgtgactcctgggtctgccatttctaggactgatctgtaccaaatctcctttaacccttagaaatagaaccagtatgctacctgctgaaatagtagaccagcttccctcaagcaggctgtgtttcatcaggaggcttacctggctatcttaggcagggcgaatccctgttcaagggccactgtatgagacttggtcccctaaccatccctaaagcaaggacagaacctatatagccagagtctgtgtgacctgggacctgacagctcagtttctgggctccaggatcctaattcgtggccagtgggttcacccatttccgtttacaacacctgatggggttcttgaacttggaactttggaaaccacaaaaggatctgttcaaggggctagggaggaaagcagcagtagggtgaacactgccgtttacttaacaattaacttggacctatatagaactaaatatatgatgtgtaccacagattgatttttgtttaactactaatccctccttactagggattggaaaaatcttctggccaggggtggctagaggcaaagtctcaatcctggtcctggtcttcgacatcctctccttgggttccacactggtcttcacctgaacgtcgttttctgctggtagtaatgtctctagcagtatgctggctgcagggctcctcagactccctctgcattacctaagtccactttcgagggctttctgccttacctgcctccgctgctgccgccgccaccgccactgctgctgctgccgctgctgctgctgctccacccatagcgtccagctctccctttctccttgcccttgcacagccatgcattgctctgcactgctgagtgggagacacttctctcagcctcctcaggacacccacagcagttacttttacccattgcacttggccccaaagcacctcctcaccccggctgggcactctcctctgctcccctgagtgctggatgagctcacctgcactcttctctcctgcttcctgggtccctgcctctcagaactgtgatctctcagatccacctagccctgagggccggccataggcatcctggctgcctgagtctctttgggccagcggccctggggatagggattgcccaggtcctgctcctcctgttggtctggttgactacactggtcccaggccctcctgcgcaggccagcctcatgccagtcctggtctcacaatgaccattgcataccacagtacagctgagaatgcccgcagtctgcaccgactgggcttcactctcgggcttctctgccctcagcccagtctctcctcagctggacaaggccttcatcctgccttcaggatacccgtgaccatgaacaacttgctttcaggcagagcctcactgctccagggaggctctctccttaggacatttttctccatccccctttcccactccagcttcttagatgacccctctactgtatcttacagacaatttaatccaacaaacttgtattaagcccttattatatgtcaagcacagggtcaggagctaagaatacaattcagaagacaagatggtgaggatgaaattccttcctcattgtacatccaaaactgtccataacagaagggccttgtggcattttttagaatcctctcacttctgccaaactacatgtggaccataggaaaaccacctaacacatgtccagctcttttagtacaggtctaatactttatgccatcttatttcagacaactgaggcccaattgagcacgtctaataatactatatgataagatgttgtggtccaactttaaagctagaggatgatggtaaagacattaaactagaaagaaattaataacctagcttctcataaaatagtaatagattatgttcttatagtgctgtatattttgccaggcgttatgactccttacctaatccttgtaaccctatgagctggagatcagtatctagttttgtagatggagaaaccaaggcttaacataattgtgactcgattaaggctttacagccaattgaaagtgaggtgtgaagttgaactgtgttgatttttaaatttttattcttttacagtaaatccccacttcctttcactgtaccaccctagaagaggtaaccctgggaatccttaagatggttcaccttatccatagtagtacaatgtaaagcctcattttttcttaacattcagaaaaatctgtaattcagtcaaacctaagaaaagctgtagaatttatttctcatgaaaataaagctatggctcagaaaataatctgtgcccctaaagctgaaactgtaatagccccagtgtgtaatcagagcttaatgtgatggttttagattttaactttattctgatgtatccatttgtagcatgaaaaagttaatagtagcagaatatttgtagttttgcttttgcccacagcggaagaggtcatcatcaagaggcagcatacagtcttgttaggaatccatactttaaaacaagagccaggttctgaaccagagactattttgtgaaatcagttatctctcttgagatgggttctggggtcactgcactcttcctaaacccttagatttttgtacaaaatgactcagatgcttgcctctgtgtgccttttaagtttgcaaaccagaatagatatctgcctcttatacacttgggtcaaatgagtttctattccttgaggataataacctgagattaattattggccatagccaagccatagaatcaatttatctccacaaatgttagattaatgttactttgactatctgaatctagcatgctttcagtgatctttctagagcgtgctctttctctccctgtccatatctgtccctgtttctctctctctctctacacacacacacactctctctctctctctgtctctctctctgcctctccccctctctctcactctctgtctctctctctgtccccgtctctctctccgaatcccagagagattcggagagaaatatttgcccatgaacattaaaaaatgtgtgcctcatcctgagtcagaaaggaagagggtttagagttcatctttaagtcacctattaactgcctgagagaggggaatccttgtgagcaattccatttcctgtccctgaagtaactctgaacctcagccaggctaccacagcaccaaaagtggcacccacttgagacccgtaagtagtgcagagtatggcccaaagaccttcaagaacaagcgaggaaatgtgtggtgagtctgctgaaaatatgaggctgactagacaggaaaatctcaatcaggatttgaggcatcttagaatttttgaaagtacaataataaagtatagaaatagaaaaagctacaaaaaggaggagaaagcaaatatgctaaccacagggctactttagttactgtgataaacattaaatttggctctgaacttcctgacaaccagggcaaaaaaaaggaaatcaaggaatataacctgattcgtagacataagaggcatttggcaatgtgaggaacatggccaccattgatggttttatgcagtgagtgcagtctatggatatagaccaagggtgtgaatgcagtgcagagatgggcaatctgcaggaagctaaactaatgttccaagcagtttgttttctgctgttgtaatgtgatagctggaatggaaaacatgataaggactgggtagctggcaggctgggccactgagtgcagaaaaaaaccatttcatgcccagggtgtcattctctacttcatctgtgggttccgttcagcatccaggctgggtggacttccatctagcacttagagtagctttggggatagaagcaaataggattctttcccatctcagttgcccagaagcaggctatgggatgggtatatgtgtgtgaccgggagtaggggtgatgagaaaaccttgtctcagctgaccctgtattcacctgatctatgagcataggaaggaaggaaaaaaggcctaagataatactgacataaaggatatttctaagtgaagatccctgttagcttgcttgagctatatatggactttgtcataatgtttgttcctggcttaagtcttcagccacaaaaggattggcaaagaaattgccagttacctctttcaaaaattaacatatgcaagcttaaagagctttcttaccagaagaatcagagcctaggactttaagagttaaaaaactttgatggataaatacaatgtaccagtctccctcaacccacaagaagatgctgtgtgactaaaattcagaaatataatcctagtgaaagccaaccttgcactaaaaaaagaaagaacctttcatgtcaaatttgtctcttacatgcctgtatacacaaagaggctaagagagtcccttcagccaagagagtagagtgctctgtagatgaacctgccttaaaagacaagataaattctgtgcaaattatatctactatttttacattttaattttttcataagggcagtttatgctgggtgccatattgggcatgagtgagatagctgaacaagacacagtccctcccttcaaggagggtacccgctagtccctggggtcttgggtttcccacgtgatgggtacttcaggagcacatgggagggtctcagagctcacaaaggacttcccaaagaaaagagcatcagtactgagttctgaaggattactcagccaagcaaaagagtgagtggggaaggggaagagaggatgggaggttcaggcagagggagtagtaaatcaaaaggccaggaagccagagagagtctggccctttctggaactgaaagtagttcaggaaggctggtccatggagccaaaggagcagagagaaaggctgaagaggttaagcataggcatgcttgtgagggagagaggtgacattcatgctgaggagtatacattttatcctgaggccaagagggaactgttgaattctgagcaggggagccatgggttttgaatttcagaaagatcattccagtagcagggtagagtatggattggaaagcagcaaaaccagaggcagggcaaccagtctaattactattacaataagctgggcaaaagatggagcaataggaatagcgtgaagcaagcaaatttaaagaccatttagagagcaaaatatgtggggagcaggatagttaaattcttgtgtaagtgacagcaagatatttaccccagcgcatatgaattaatcacatgtcagtcacttgtgaattgggtacctgtatgtgttgggttttgttccttggaagggagtttgtaacctccaagataatcatatcctcctggggaggagctgaaacagtaatcccttagcagaatcaactcccacagcgtctgactgcagcgttgcagtatatctatccaaactagtagctggcatttagaggttttcaatgccttagaagggaactgaaagggatctcagaggcccttctgtcttgagtgcagcattttctcatgggcctatacattgcccacagccacacagtgtctttagcgacaggactaagacacaaagtctagggctcctaactccagccctgggcaaggttcccccttccccaggagtcccagggggcttttctgcagagcaacacacagttacagtggacagatttgctagcaatccttggctagcaatttgaaatttgaaatgtgagggagtggcctccagattagtggtaaaaccagccggcaggtccaagtctccccttaaatgcatttcctgttgattaaaattcaggctaaaactaatagccaggtttaaatgaacattaaccaacataatcagtgttaacttttatgaagaaaaatagattgattcatgagtcataagaaaaatgtccagtttgccaacttttattttctgatggctattgtccatcctttagaaaaaaagtaatataagttatgtataaagttggtaaatttaataataccttgccaaaaatttgagccaagagcttggaattttcagttgtataaaaatttttatagactcatttgaaagttacattagttatttcttcttttaagtcgggattttttttttttttcttaacacaggcactgaaggtcctgagaactgcagagtttgctccttttgttgttttcattgctgcaccaactattactccaggtttaaatgaggtaagaatcaatctgtttttccccaaataagctgtaaggatcaagccttactccccagcacagtcagaagcgtgtcagtctacatttgcagcaaggctgctctgatgaaatgggatgtggaatagaatgctacatgggacagtcttatcagtaagctgacttctaaaatctgaggacaaacaccctcactcccaccaggaccgaggcatcccaggtgtctcacaacctccagggctgccagcctattccctctccggatagggattgtgtggcccctggagtggaacctttgtggaatttctctccaggcccctgaagactaccaaacctagaaatcagctctgtccactgtcaagccagctcaagtcagaaactgccacagacatggtgctcatgagacttggctgctgacttagaaggttttccattgctgagcagatcaaagggtacttaccatgtgtctgctaagtgtagcagtgcctatcttctgtaggttccttagttaaggggagactcttataccaagttatcctgaagaccattgctttcacagcttctagaaatcatcagaggactcttgattgactctgttcagtcaacactgacctaaactcactcaagcttaaaatctaattaaatcatggcttggaaattttccctttgtgtacctttaaggaagattcaggattttgatttacctatgttactcatattttccgtcattatgtttttgtcatttcatctgcaagaggtatattcctttgtaaaattctaccttcccatcttatttaatacataagcatgtttgaaactccacattgtggttagcttttatccttcagttgccatgtatttttcttgaatcatcatctttgctttgtttttgttttgcctgttttcctgcccttttactaattttccatagctgccaaaatggtgcagaaaattgcctgtaagtaccagctaggaggtggtgaaatacagccgtgtttcttttaatagatttagaatgtagacactttgttcccacaaatccttgcttttgctgttagaataaaggcattttgttttcactgagttaaaccctgctcacgtgtgagtcaagcacacagacaagctgttgtcgaggaagagactgacaaatatagcttcgtcttaaaagattcttaagagggagctttatttttctgtaaagagacctacattaaaaatgtgatactttcagccataaattttcttgaatattttcatcagcccagcttgctgagcaaatcataaaccctgctagtggtttttgaagctcaggactatatattcaaatagaatcccgtgtgccagagagtgatgttgtaggaattgttccttttcatcctggtaggaagcactcctgtctttgggtgaatgcacatttgctaaaatggcgttttttgcattgtgttgattatgaagtaaagccacagtgaaaatactatgctttttaagtgcaagccgaactagaaggtgatgattaactggggtcttatctacactgtagtacttaacactaacattcaaagcatgccctgtcctgctttgaaatgccagtaaaagaggacaaaacaggtaggacattcttggttcagagtgccctgagagaaaagattgagttcctgtctgctgtggtgtctgcgcatgcccactgcagtgccaggacagaatcaagcaagtctctttatctcacttctagtcccctttcttgagagctgtacccagagagctgaggcttgcctggacctcccagcagcctcccaggaaaggtctcttgccaataacagaggggctttagagaagaggagaggaggggaggggccctaagccagtactgggtactacggctcctaggtccttgaaggtaccgcatcttttattttctctggagatctgtctctgtcacccagggccccaatttcctggaagaattgctcagtctcttgattttagatttaatacttgtaaaaccctataatgactggcactagtcagacaagtgcttgttcttttgacagcatttattaagcacttactatgtgtaaggcactatgcctaatgctggggcacagcaattacagggcacacaagacaagtttatgccctagctggagacatagccactaatcaaataaagaggtatttcgttatctctatgtatatttaagactcagcccaagagctcacccacctagtgtttggcaggtagggggtggttaatttgactcacaaagttccctagtgtcaaggttgaacttgccctttgggagttcagcatgacaaatatgacttgcgaagatatagaggcagacttctttctggtggctcttaagagacccctgtcttgaaagaactgccactctgtagcagaagctatacttgcatgacaaagctgggaccctaaactccctcctcctgttggatccctcttacaagagttcttaaaatctgtggcaagctgcagcttagggaacatcctttgttgcagcaaacctccctagagttcagtactccctagagttctcttccttctgtttttttcataagagatatgaggacctacgaacagtgacatttgtctagccacttctaatgcagaccaatttggggggattcatcagatgccaggtgctgtttattggggaaacagccttattccagccattatttgtaacactcaaagatcttttgcctctggcatcagctgctattgagtgagggccattatatgtaattgaattcctagaacgtgtggcacctttaagtagaagaggaaaaaatacaacttaatttgtcatccaagggcagggacttgttggtgcaaacacagctgggccctgaggcctggctccagtgagtgtggaggaccaaggggacgggggcaaagagctccagccttgccaccgtagccctctcgccaattgggagagtggcttgaggctagggcggggggcttcctgctggcctgtttgggccaccatagccactgtaacccacacctggcatggccctaccaagcctgactctggggacaggcacagctaggcctgagtgggggtggcatgtttcctgaagagtatctgttttctctggttcgtctgctttgtcatggaccctctgttgcatgttgagcaatcactgtctcctctgtcatggagcggacttggcctcatgctggcatatggcatatcagggtctggccttgactgtttctgacactgggatgaacaaaaatgtgaaaagagaacgaatccaactgatttctctcttctgtttgcttttccctcctctcatgcccacccctacctccatctcatcaccatttaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatagatgctgctttctataatctattttaataataataaacaatgattctgttaccttgactgggggtggaacactacattctttttagagtctgattttatggattggaatattgggatatctttctttcctttatttatttgaaataattagtgtagtgattacaaaacagtcataaatttttaaaggccttttttctctctttttttttttttagaatagtatttttttttaagtcctttatgtaacatccagataatgtgatactgtctctttgaagcaccctgtaaaccttttagagatttgaagttgggtcttgactcttaatgcatgtggacagtcgcgagcgtttatgctgtcggtgtgtctgtgttggacaaaacaatctgtaatctacagcaaagtacattctacattccgttcatggggcacacccaggggaataagaataaaatgctattatgactaagttgtaaacctatgcacatcccttgcattttgggcaactttataaaaaaaaagaaactgatttttattaataataatcatgtagtgaaatgtgtttgtaattttgtctcaatttaatttgttgtaaggtggggtggggggaattgctggtttcaccatttcagatctgtgttgtctaagagtattaacgttttaattaagcaaagaaatgatttttaatctgtatgtaattgttttaaagcacccattttaagagaaaatactgtgcaatgaagaaaccagtttaggcatttgctataaactgaaatattccaaaagaatcatctataacagccctgtaaattcctttaaaatgataactaacaggacagtttgaccaattttttttaaatatacttccttttatgtgttcaataattaaatgcctttgggtccttcatttcattatagatttgttcaggcttccaagctgataatctttacaattgtataatttgttagatgctcattgaacctttgaaggcccaggagtgagtatcagttggcagggtgacaaagtagcctgccagagcacagctggaccacgtctgactcgcacagagccatgcgcccaagggccacgggtgtactggaggccacctgtggtctctccttcctcttgctgtatcccttggcacaggggaatcatctgtccttgttgctttagagacattaaccatctcataactcttccatgaagtcacattcttccaatacaggagattcgggctggggttctcagactctttgccagaggtcagtagaatgtttttcattagcatgtgagggtgtgaagtgcttatattaacctgtgatccttgaaaacataccatcattttttgcttcttgtaggttagatggccttgtcactttgtgccttggcaggatgtgcagggtgtgttctgagctgaacagctcctcttaaaggaccaaacagagaaggcattagtatacttcttttacattgtcaacaccatacccgcctccgccccccaccgcctattattaaatggtggcgatttttttttttctgatgttgttctttgccagtgaccagatgagtctgcaacttactaacaaggtattgagtgaactacttctgtatgggccccacagtggggtgaccaagccaccaaaccagagataagctcaacagtggtctcacactagatagagagagaaaccttcaaagagttgggtagggctgtgttagaactgattcgaatctgatagatgccaaggccagacagtcgttcctggtatggtactgaccacaatttcgggctcttagtgtgaaggtgcgcactctacctcttttctggtgaagcacaaagacaactacaactaacacatgggaaacagaaacttccctccctctagtggaaacccccacgcccccacttgccctttgagcccacatctccagagatgctgatgatgcctgtcttaagccatctgccatatttataaaggtggattaagcagaggaggagaaaagcaatgccaacttaaatgtctgtggccccacaattcacaagcactgtagcactcatcctcagtggctttatacgtcctctgagaagcacacaggcaggcatcattcttgccatcattccgatggtgaaatccctgcatgcagaactcattgacttctcaaagatgttacctgttccattccactaatacatgtcttctctaaagcagtgtctttatgacctagctgcatatacttacatttctgaattcagagtaatttcagtacattgctgctgctgctgctgctgctgctgctgctgctgctgctgctgctgctgctactgctacattacaattgtccactaagcaatcagagaaaattgctaaaagcttctttactgcttccattccatcagcagaacctttttttttctttctttcttttaaagaccagaatgaatgtttagagtactaaatcttattagtggtcaattgaagtattggagagccacattttgaaggttctctcccccacccaactccattccccacagcaagaaagggagtgtttttatatgttgaattctttgttaaaaagatgaaatgtcctgattttccagtcacaagacagtaattactttgcacatacagcatatcccattttaatgctaaaaagggaaatgtcactcaatttaattcatctggaagtttcccagtgtcaagataacattgtagcctttttaaatgcaattaaatgtatctcttgtcaggtgagatgatttaaaatctttgctcagagaggaaaacaaatggttgacctacttcttgctatttgcattcagaaggcatcgtcccagcccatcctattggtggcagaatatctaaagatgtcgcaaagtcccccactgcagtagaaatgcaggaggtgttcctgttccccgtccaattccttcttaggctgctagagacagccagtgggccaagccttcccctgtgctccaggcaggcctgggctgcagctactgttacctttttacagcctttgatctgatcgctgcagagttcttttgtttttaaatcacttgtatttgtctcttcattaaggcttcaagtttatttcttgaaaaagtttagtcaattgaaccaccctccaggaagattcccagcgtggaaactgcccctgaaaaacaaggcagcccaaagccagctctcttttgtcccccactgatgtcatgtcctttttttttttcatttcaggccagtttcttaacttggggcaaagagaatgtgttgctaaagctaccaagaaaactgcttgattaacaaattcttaatagaaatgcctcccacactgtctctttgaaaagagaaggcaccttggaatcggcattccaaaaccaagctccttgtcatcctcatccctcctccttcttgcttcctattatcaaactcgtgtgtgtttcttgttttctcagaactgaacacagcctcctaattccatcctcttgactagggcttacaatactgagagcgattacaggctgtaataagttaaaggtccctgagcgtggctttcttgttctgcgcctctaattaattcttctattaaaagatgctttccttctcactgcagcttacagaaaggctacaagctttaatcacagatcatttcatttgccagagcctttccttttctaactcctttagaaataagatttccctctctgtttggaatctctggatacaggactctcctccaagctcatggcttgattggctttgcctgtgcacacacacatcagtttgccttaaacttggagctatggggagtcccagattttccagcttagtgggtgaagtttagctgtcacctacatccaggaagtgggggaaaagggaaaaaaagaggatattcaccaccatgttcccatccggtctttcccctgccttgctttgtgcagcaggtgggcagacagagcccacagaaacagaagtagaaagagggccgcaccatctctggggccagcactcctaagtcttagctctttgtgggaatagaaaatcctgagctcccaccacctctcgtctgaccctccatcaactccctcgaacctgtgcaaatggactgagcaaaagaaaatggaaagagatgtttgtcaccacacaggagacctcctttctggccccaagcacaactccatctctgcgtatgctcagaaactcagaatttagctgctacttatgtgttagctccattctctctggtgtgtgactgagagaacacgccagtgttcttactgacagaggcttaggggtgaccctctctggacccagaggaagtacaacctctgtagcgagaattgtccttgggaacagaaacaggcattcctccacagtgagtggctccccctattttttttttatttggaagagaccaagaattgggggaattgatttccagtcttagctgtttcccggaatgtcatctgtgcaggcaggtaggcggctgccgggtgcagcaggcagcgtgactgatgtgaaggccgcccaatcctcacgtgctaagacccgagtatcgtgtttaattgcagtgtaggcacgtcgccattcaaactcagttctggggtggttttgcataaagttttgccaacgtgttcttttttctgtatgtattattgcctttttataaaaggtgttgaagtattgtctcagtgataaaaagagagagatgttaatggttgttgtatatttcaccgtatccaattgtaagtatttgcagggtacagcagagccttagcttgcaagagcgtttgtgcaggaggtgtccctcaacacccaggagctgaagggattggaaaggtttggattctttgtaaatgtcctgcttttctttctctctgtgtgtatctatttacatgccttagcacacgccctcccatcctgatccctttgccctgtcgccggaacaaccagaatgctggtgcgctgccggcacagtacaagttgatgaaaccctaatcagttatcttgtgtgacaggggaagaagagaaactccatagtattccttgtagaatatacatacctgtaggatgctgtgtaatgggaaaccatagaattgggcttttgtcatttcaaagttggagaaatgtatgaataaaatgtataaaacatgaaaa

SEQ ID NO: 1182 - DNA, 4823 bp, mus musculus; identical to SEQ ID NO: 192

SEQ ID NO: 1183 - DNA, 366738 bp, mus musculus
gtgtctgcgcgaggcgggtgagcggggctggcgagccggtcggctgctgaggcgtaggggcggagcagaaggcggcggccgcggctcccgcccgcacagagcgccggtcccgcgaagccccctcccactcccgggcgggcggtggcggctgcgggaggaggagaaagaggagggagcgtctctgccgccgcctcctggtccccagcgccgatccgccgccgccgccacctccctccgcggcgatcctcgctccatggtcctgccgcggccccctctgtagcccgagctgctccgcgacgcgacggagccggcctcggacagagggagcggtcgcggcctcgcggcccgcgcgggctgacgagcggagagcgcgacgccgcgcggtccccgaggatccgcacgccgggcagcgcggcccgagcagcgcgagaagcagcgggcgggcgggcggcgccgggcccgggccgccctcgctcccgcgccccggccccgccgcccgcgccggggcggtcgcctgcagaggaaggcgccgcagtctctgggcctcgcggccccactcgagcgtcctcggcaccgagggctcgcgggtcctgaggggaggaggcgatcccggggctgggcactgagctcttgggcgcccccacccccgttttcgaagccctccacgctgcggccgctatcccctccggaccatggccgacgacgacgtgctgttcgaggatgtgtacgagctgtgcgaggtgatcggaaagtgagtctccacgcgagggagcgggagtgtggaaaaatgcatttcagtgatgccccggtcttcccgcacccgctcggggcctgccccctgccctccctccttcccctcttcccctctcgtccttctcatcctggagtatttatagacgtgtacctggagctcctgccaggcgggggcctgggggttctcagcggtccattgaggccaccgagccgaggttggccaccccgtaaggcgtggggccggctgcctgcattttatctgacggttgcacagggacgtggcacagccgattttatagttgcttcagttggggttattgttaccttgcatgtaccatagaccatttttgaaacagagcagcttgcatttcctttgcttgtgtggtgagagagtccagggttttaattgtggggtgtgtgtctattgtgcgggatattagacagatgcctttgtgtacaccccatgctcggattggagggggtcatttaagacggggtgctttcagtttcagcaaattccctcctggtgtacacgaacgtggaaagagttgggggcattcgaatttttaatgccttgttatgcaatgactgttcaatcagtgctcgagactcccctcgactgttgttgggatggtggttagcgtggtagagccgtctgctttgagtcaccgggctggtctagaatatagaactgacagtccaaatgctcatcctttcatctgtgttgtataattacgctggggaaaagcagggaatcagattaatcacagtgctgattgagaattaaatctgcagttcctcatctaattgtccattccttaaatctattttgaatagtttccttttcattcttgtcaaacagtactccaagtgcacaatcctgctaatttgcttgtgaaggaaatgctggcaatctgaagttgatttcctaacacagcgtgtattctgcggctttagaagttgaggagataagatttaagagcaaatttttgcttaataaggatcgctagagctaacattgaaatatcttacctctttttttttttttttttttttttggaagcggtgctttattgtctattttaaggtccacagttgggaaatgaaaccaagaccttaaagcagttggccctatctcttttaagttgtctgcagtactcaatttcaatttgagtgctaatttgtttccttttctttccatattgaggtattacagtgttgcctcacatggtgaaattgtgggtagagcttgctacacactttactcagacccaattgatgtgaggacatgttactccttgccctattgttacatgaccagccagacttaaaaggaaagtatccaaatgtgtcctgttaaagtgcttgtggaagtgttctagaacagcactgtccaaaagatatattatgagccacatttgtaatttaaaattttctagtagccacatttaataaaaacatacaggtgcaattaattttaataaaatattttatttaaccctgtagatccaaacttaacatttcaacatgtaatcaatatgaaaaaatattaatgaaatattttacatcttttatgctaagtctttgaaatcccaatgtgtattttacactaatagcacatctcaattctgacactaagctacatttctgatgaaaatcagaaatacttaatctgtatttaggtttcataaaatttgcgtttgcaaaagtatattcacatacccaagttgttcccaatatacataaaagttttccaataaccgaatcaagtacctttttctaaatttaaattttaattaattaaaattaaatacaattcaaaattcagtttcccagtcggaccagccacgtttcaggtgcccagtagccacatgtgaatagcacagttctagagagaaaaatgcatcaaaaatctccttggtttcctcattcttaggagcacccagtgaagataaattaggtgtttcccaaaagcctccaaatgactgtatgtgtgggtgaatgatgtttgttgcatcttagttatagctgatgtaaatgaactaacaaagtcataattggaaaatgtgagattaaaatgttaattatattgtgaagatgtaaaatagccatctctgaatcagttttggtaactagttctgattccttaaagtctggaagggtgatgatgtgatctctttggatatcaaaaagaaatggtcagaatcacattaacacagtccatattctgctgatttgtaattgatagaatatttttcaggaaacacccctgggagaaaaaaattcatcttttctgactgtttcagagctgcataaagaggggcagcaagctaattttgaggtgataggtactctatggctaccttaactactatgaactgtgaaatctcattcatatcctacaaaatctgacttggtcagtgccaattataaaatgccattatgtgaaataatgaattcaagctagccttattgttaaagaatgtaataatagtgttcctcaatctgagtaaaggttgaaggtttctctagtaaattgtcttagtatatattgatctggaaattgaaattagcttgagattttcttgcagggaccttgacagcatacatttttaacttataatttgttcacctctgaatttgaacagaaagcccttgaagatattcacatgtactgaaaacctttttattgatttctatccaagttctatggaattttgattttcttttttaccaaattagtatcacaagttgtttttcaccactagatcttaataggttttaatttttactaaggtactttaaaatagatttcacttttcaagactaattgactacccactcactcctctacctacgcaaccacctactcactcacccactgtgtacttggccttacttgatggcataaatgaaagttctcgtttaatttagacccttcagtgtgtttttttcccccttggttgagaaagataacttacagagttaatgaggttttgaaatataagatcattatttggaatatgttttctttccagtggttgcagcctttacccttgttaaagctgtctttgagggaacatgtgcccaatttgttacaaatattggaaggatgccgtttccctttttaaaaattaaaactcttttccctgtgtttctcatttttgaaaatcttgcagaaactcctttgagtgactgttggttctataacattttctatgtaactatcttttaaatgactgaaacaaatctccaataataagaccttatcatagtcccaaaacttcttgtcttagcaaatgtagcgattactggaaaggaagggcgttatgcaaatgaggttaatgactaatttttatgtcatgatcatttactgtatcttttacaattataagtaagtgtacaaccggtaatactacatgaaggaaatttaagacaattcatcgaaattaaaacatagaaaaatgcctactttcttggtacagcagtgtgtatgaaagggaataacaaaatacataccatttttaccttgtgttaggtgaatacttgccctgtttagtagcctgtagcttcagactttcctgctctggtaggacatacactaaaattggaatgatgcagcatgacccttgcttaaggatgacgtgcaactttgtgaggcatgctgtatttgcttactcctcgagagcacttttatttaattacagttacttatttatggatctctctagttcactaataaggagcttcctgagggcagggaatgtttcttacacatctttctccattaacacagtgcgtgcaatgtaactgcctttcattagctgtggaatgaattgagtagttttaataaaatctcattaaaaggcaaaaaagcatgtttgtcaacctcagagcaattattgtccgaagagcctgcattagtttaaagtagtggttctccacctggctgcatattagaatcatccggggagcttttaaaaaagatcaacgccagagccctgtgtcaaagcagtgaagtccgagtttctgggactgggtcctggtcactgacatttttttaaagctctctgtgtgattctaatatgcagctataatgaggaatcattggcttaaaacttagattatgtatgtaatattttgggactggcttttcagaggcttacaattcttacaaagtagaataaattctttttggaaggtattgaagctaaatggctaaaacatggattttatcttctatgcacttgtgtttctcagccttattgtgtaaaaatttagttttagcttgtgtttggctttgatttcttgggccttttaagatccacattgatttatgacactcatctaatgctaacatggcgattgtctgacgtttggaacaacacagaacaaggattgcttcaataacagttgatgatggttttccactataatggcttgatttaatatgaagaaatttatcagtttagtatggattgtgtttgtacatacactctattaaaagagtatggttaagttgcttgtatgctttaaattacatacttgtgattccagtaatgctgttagctggagaattgagttaatgcagcctttatgtaaatactggattaataatacgtaaagtatataattcagcatacagaaaaattcagctttactaatttgtactaattactatgactttcacatgtattgattcatgcagtgatttgggtttctagtaccatagggagaatttcgcattgtgttgaaaaaatgtttcccggaaattttaactagactttgtaggtaaactagtttttaatgttaggaaaagatcaagtgtttgcctgaaggaaccgagaattttccagaaatgagtagatattccagaaataccagtgatcgtgaaagcagtgcatgatcacagtgacagccaagtaacaaggtaaaagaagtgatcagcagctaaattgttggtggcccagaaagaatgcaagccatgggagttaagctgtacttctacagaggaaaatccttttgaactcagggtgtggatgctacagatagcaggcctcaatgggagtggggaagcaatattgattcctgatgatcctaggatcatttggagggagaacagagctactccgttgcttttctgcatgtatacaaccttctctagtctcttcctgtctgctttttacagattgctttagggtgtgttgtttgaagttgtcttcataaatacttcctgtggactcccttaatttttatgtccgtaacacgcttctatgtacttgacatacgcagttcagctctctccattttttccttgtatctgcaacagtttcacctgatgaactacgtctcaagtgtccctaaattgtgtacctggatatttcctttaaactgaaaattctgtctccagctgtagttctactcaataaattgaaggagcagatataccttgcttcttgagattattcttgaattattacattttcttaaacgttttcacattttaaatgtggtaggagcactgcatttaaaggaactttgacataaggttgtttaaaaaacttctataacttaaagcttactttataaagggattgacatttatccctctaatgttaggcattttggatgtattatttaatcatacccattttacagagaacactgagattcagagggggtgatcagtaattcgcctaagatcacacagattccaacgcggttccatggttttaaagtctgttcatttcatgctgcattctgctgctaattcaagttgtgaaaatactgtgttggattttcttaaagacacgtcttcattttcagagtttctatactgcaaattttagttgtttgactttctggttaaatttcttatttcttcagtagaggttccatatactattcattctttcatctgtttcttttttatttttgtctttctctttaatgaaacatcagcatttgttaccaaactaactggtaaatctagcaatggaaatatagactcttggccatctgtccaaaatataatttgttttggaactttctctacttcttttactctccaaattttttcttccatttcccttgccccaacagacaggatagttgattaattacccctaacttgccaaaccagaagtaataaggtttcagaggtagatgtttgttggaagtggggtggagtggtttccaaaggatagttattcctttatcctgtgataaaaatacggagattgttctctctgattctgaaaaccgtgtagtgagctgcagccgctgagtctgtgagcttctagctgtttgccagcactgtacaccttaaataatcaagagactgagttaactattgcagagcaggtaccggaccccagccaacaagctgatgggatgtgctgttctcacattttttggttttattttttagttgcaactgacagtgaagattctagaagcaccaaatatggctctggatttatgctgtgggatttaagatgctacagaacttgctctccttcctttctgtcctggagccactatggtattggttgtagagcccaagtcagtatagagtctctgacttctaccctgggaaaatttcatttccgaagctagtttgttttgaagttaatgtttatttccaacattgagatttaataattttgtgttacttttctttattaattagtttttatacagtaaattataaaagtaatgatgcacgtagtaaattttattttctttttttgagatggagtctcgctctgtctcccaggctggagtgcagtggcacgatcttggctcactacaacctccgcctcctgggttcaagtgattctcttgcctcagcctcccaacaagctgggattacaagcatgcaccaccgcgcctggctaatttgtgtgtgcgtgtgtgtgtgtgtgtgtgtgtgtgttttgagacggagtctcactctgtcgcccaggctggagtgcaatggcgcgatctcggcttactgcaagctccgcctcccaggttcacgccattctcctgcctcagcctcccgagtagctgggactacagacgcccggctaatttttttttttttttttgtatttctagtagagatggggtttcaccatgtaagccaggatggtcttgatctcctgacctcgtgatccacccgccttggcctcccaaagtgctgggattacaggcgtgagccaccgcgtccagcctagttttttatttttagtagagacggggtttcaccaggctggtctcgaactcctgacgtcaggtgatccacctgccttggtctcccaaagtgctgggattacaggcgtgagccactgtgcccagccatacaatttaaaatataggtgatacaaagataagtagtgagtctgtctcaattctcctaccatccatatccccattctctagaggtaaccattgttcagtttcttctccatctttctggaagctttttgtttaaaagtgagatatttgtatactatgctgaaatattgatttttcatgaataatagtatatacttgatgatcttgtcatatccatcaatgtatctgtctgtctctatctcctctttagctgctgcccagtattctgtcatatggattgttactttggctttggattgagtgcaagccaattgtaattttacattgcttgaaatgctgagctggaatttgggtgagaggtatggaatggcagtgaagatttgggagtcatctgtgtggaagtaaaactgagtgaacaagttcttgggggttgactgctctagggctcgtggtttggagtataactcatagagttagaagaatcaggataatgggctgcacagaagtttaaaagaggggggaggatcaataatgtaaaatgccaatatactctgaggactaagaacacatgtggctataacagagaaacaatttaaagcacttatcaaaatgaatattatgtttaatagtcaattcatgatgtgtctgaaaagctaggtctggcttcttttctgtggatactagtaattttatactatctctctgtaaatctatctcagaaccaacatatttagggtaaaaacaaagtagatttctttttcactctaattgtgttttgcagatttctgatgactggcttttaggtaaaatcatttggttttcctaagattatgtccttttcattcccgagcttgtgcatgactgtcaattaaatggaagcctttcatgaagtgacaaagtaagttttagatactttacatttactttaagttcttggtatgtgtcaaaccactgttattgtcttatatctttctactataggaaactgaattctttctagcctcaaggatttttgtccacgttggatgaatgtagtactgtcctcctctttcacatttcttctcccatcacctcctaactaaatttgttcattggctatttttggttgtccacatccattcacaataagaaacgattgcttcgttgtacataagccagttttttggtatctaagtgcgtgctatttcacttcagcttcttgtattctatttattactgggctgttgtacattgttttttctcccaatctttgtgatttcttttaatatactttctttcctttttgctttgtaatcattgttttgagtatttgaatcatttgcaggtaagaatgtggattgttctgtctctcatgtagtttaataatatccaaaatatactatgttcagtctgtatttcaggcttttaacacttaagttagagtattttggtatatttaaatctaggatagaagtacactgtattaccattcaactacatgcagattttaatgttttcttaaattaaaggatgatgatattcattcagttacagaggtctctctctctagtccttccatggtgtgcagattaccattatactactgctatttcatagattctaatttgtgtttttagaaaacatcatcaattcttggccttctttcttacccttggtatgtgatttcccctaaaggtatggaatgcggttgctctgtggcttgttaggcagcccccttctgatctggtaacctttgggcacagtgtggctattttctccttatttataaaaggaatgatagctgcttcacaaaccatttgtgtggattagtgaattgtaaagtgcagcataagtattttttatttctagaatgtctctgagatactcaaattacttttggcagttatgtacgtaagtttcaacaatttccaaatgtgcacattctcagtgctaaacacaggctctattacataaataatatggtgaaatgaacattcttttctaccatgtgtgtaaaattgttagtggtgctaacttttattcattgttcatttatgtattcatttctagctatgaggtcctgggcaagttagttagcctctctgaccctcagtttctttatctgtaaaatgtggttaatggtatatactttgtaaggttgttgtgaggattgaatagcatgatctatgtgaaatgtctaaaggttgttattttaattgccattgtcattattattattttttaaattttattattattatactttaagttttagggtacatgtgcacaacgtgcaggtttgttacaaatgtatacatgtgccatgttggtgtgctgcacccattaactcgtcatttagcattaggtattgctattcaccaaacacttgagttctctggcctcagggagctcaaatgagttattcacacactcatgcacatatcctctgcgtaacttggtaaccaacagacacacatagtaaaatatttggtcagcagttgttgaatgagtgagtacattaactgagaaatccagagactgtgtgaccacctagtaggagaaggaagttggggaaatcattacagaggaggtgaggcttgaatgatttgtcggtcttctccttgggtaactcatgttatctttgtaggcctgcttcctcatttataaaaaggagtagaggaatacaggtagggaaaattgaagaaattttaataaagtcacatatattactttaaaaaagtataactttcataaattatgtatattataacattatatatatttttatatatattttatatatatatatatataaattacttgcaagagggaaggagagagggtctcactatgttgcctaggctggtctcaaactcctggcctcaagcagtcctcctgccccaacctcccaaagcgctgcgattacaggcatgaaccactgcacccagcctaagaaatatattgaagagtcctttctgtctttttaaaaactgtccaggccgggtgcagtggcttatgcccgtaatcccagcacgttggaaggctgaggtgggtggctcacttgaggtcaggagtttgagaccagcctgactaacgtggtgaagccccgtctctactaaaaatacaaatattagctgggcatggtggtgcgtgcctgtaatcccagctacttgggaggctgaggcaggagaattgcttgaacccaggaggcggaggttgcagcgagccaagattgcaccactgtagtccagctggggcaacaagagcaaaactctgtctcaaaaaaaaaaaaaaaaaaaaaaaacagaaaacaaacaaaaaaactgtccagtgagctgtaatcactgcactccaacccaggcaacagagcaagacactgtcttaaaaaaattcttttaaaaatgtcattgctctcattgttcaactcccacttatgagtaagaacatgcagtgtttggttttctgttcctgtgttagtttgctgagaatgatggtttccagcttcatccatgagaacatataggcacagggaggggaacatcacacaccggggcctgttgggggttggggggcaaggggagggataacattaggagaaatacctaatgtagatgatgggttgatgggtgcagcaaaccaccatggcacatgtatacctatgtaacaaacctgtacgttctgcacatgtatcccagaacttaaagtataataaaaaaagttaaaaaaaaactgtcattgcctcttatgtacatagaaaatacagtattgagttacagattttcataatttgtttccaagtctgttctagattataattccgtagtgttgtgaaaaactcccaagattgttaaaagaaggaattttgtatcacacttcttatgtttgcatttagacaattgacagattaattaattgttcataatgtgaaatttcaagactgaaaaaaggaaaatcccagaatatatatttcagaaacacccatatataggatttatgaatattgtagtgttcctttatgtaacttcccaaaattttattacaacagcaatttctacatcttaacagtgagcaaaatgaggtggaaagattctgaagttgtagtctctgacactactgggcactgaatctaaataacctaaaaccacagaacagtatttcatcttctagttcttattacattgtcaggtgtaagaatgatcatgttgaaattgagtggttggtctgtttagatcacttctatggaaatactgcttagattggtttcagaaatccttggacagtattatttatattgcattatttaggttagaaatttttgctgacttccatctgagttattagttcaaaagcagaatcatcagcctttatatggaatctctgctggtgctcatcttaggcttagtatcttcttaactgggtttttgttagcagtatagtgtggcattaaatttgagactatctttttaataaattttttaaaaattttgtcagttgtagaataattagatacttgtaaaacaagcaagaagctgttttcactgaggactttctttaattacatttcatataaatttaagagaactgttactagaatattaaaatcacaggttaaagtgagaatgtatttcacataatcaacatacataacatttttaacagcatgctaaagatggaaaaaacctttaccaaccatacatattataggcaaagctttaaaaaaaacaaaacattttgctcttatggatgtgaaagtaatctgtgtaaatatgtatttaaatgaaaatatctattcattatcattgcagaaggagtgtgggtatctggagagggagcattctaaacttgctgctctactttttggattatctacattaatatttctcccattgctgagtatttctgttatactgctggatcatcatacttccataatctgtgacccacttgctctaatggtagagtgggctttaaactgccatctgattaaagttcaggtttcttagttagacttgcctgggtggcttcagaattaggcccacaaatatgaatatggacttgaagatcttactagaacaatattttccccgataaagacacatccataaacatggtcctaaaaagatatgtgtaagttggatttgaaaaatgcaatttaagagttactaggaaaaagggattttaaggaaacattttaagtaatttgtgtgatatcaccagttggtttttcttcagtttcttcatcttgtaaaagaaggatagtaatggctatattatctacctcatgagattctcatgcacataaaattacataattcttaagtcttaaactaccttacgtatattattatttcaattttattgaaataaaacactttttttttttgtgatggagtctcactctgtcacccaggctggagtgcaatggtgtgatctctgctcactgcaacctccgcctcctgggttcaagcaattctcctgcctcagcctcccgagtagctgggactacacatgtgcaccaccacgcccggcttagtcttgtatttttagtagagacagggttttgccatgttggccaggctgatctcaaactcctgagctcaggtgatctgcctgcctcggcctcccaaagtgctgggattacaggcatgagccactgtgcctggcccaaactaaaacacttctaatggacttgtactttggctgggcacggtggctcacacctgtaatccctgcactttgggaggccaaggtgggtggatcatttgaggccaggagttcaagaccagcccaggcaacatggtgaaacctcgtctctactaaaaatgtcataaaattagccggccatggtggcgtgtgcctgtaataccagctacttgggaggctgaggcgggagaatagtttgaacccgggaggcatagtttgcagtgagccgagatcatgccattgcactccagcctgggcgatagagcgagactaagaaaaaaaaaaacaaaacaagaacatgggctttgttgacttttctttgattttgtaagaatcatttacctttgtctttaaaagtgattttattttcttgtttgatttatagacattaatacttctcaactccttatagggctcagaacatgttaggtgaaaatattgcataaagagatttgagaatgaatggggcaatgataaatttacactgaagtcaaagtaaagaaagacttctgagtattttgttttccccagcttctttttaaattgcttaattttgttggagctttgatgtgtggaacttactacaagtgacaaatgtttgtggccaatcagatggcacatcctgttccatctgatattgaacatcctgtttagtcagtgaggtttagatcagtggttttcaaagtgtggatcttctgaccagtagcagcatctggaaactcattagaaatgcagattcttaggccctgctctggccctacagaattagaagccctggggttggagcacagctatttctgttgtaacaaaccctccaagggaattctgaggcacgctaaagattgagaaccactgtcttggaactctagatcaggggtcagtaaactatggtccatgggccaaatcatcctactgcctgtttttgtaaatagttatttggaacacagccaccgtcatttatttaagcatcatctatggttgcttttatgctatggggcagagttgattagttatgacagagaccaaatggtccatacagccttaaccatttctccagctttttacacaaaaagcttgccaatccctactcaagataaagcattcgtgctgttttctttcctttaattctgaactgtgaacagctaaaatcattaggtaaacgcttgtgtttgcctttacacctgaccctcctatttctacagatccattcttctctctcatatcaaattattaattcaatgagtagagacttgtaaatgaaaataacatactactctaccctttccttttctgttaggtagtggtggtagcctgtttaacaattccatgaccttttctcactgattgtgtgctggtgtgtccttggtttttctgtactctagtgtaatctaacttaatcatgtattgtaatcttcatttttcccaattcttactgcctttttacttcctcaagagaaaacccaccttgtgactgccaagtttagggattcatgtgagctgtttggaatgtttgtttgtttgtttgtttgacagagtcttgttctgtcgcccaggctggagtgcagtggcacaatctcagctcactgcaacctctgcctctcaggttcaagcaattctccctgcttcagcatcctgagtagctgggattacaggccaccacgcctggctaatttttctaatttttgtattttttagcagagacggggtttcaccatgttggccaggctgatcttgaactcctgacctcaggtgatctgcctccttcagcctcccaaagtgctgggactgtttagtgtgttctaagccaggggtccccaacccttgggccgctgaccagtaccggttcatgacctgttagaaaccaggccgcacaacaggaggtgagcagcaggccagccagcattactgcctgagctctgcctcctgtaagatcagtggcagcattagattctcatagaagcacaaaccctattgtgaactgcacatgcgcgggaactaggttgcatgttccttatgagaatctaatgcctgatgatctgagatggaacagtctcatcccgaaccccctacccccaccccggtccccatcgtccatggaaaaattgtcttccacaaaaccggtccctgatgccaaaaaggttaggtaccactgttctaagccattgaaatagtgccatcccttctggaaaattgttacccttgtcctggagtgctgtagtcactggtatttcaccaggatgttagggtatttcaccaggatgttagtgagcacatagatattgaatatttcgggcaatcttagaatgtttactgggagagttttaaaagttagccttcccacatccctccaagaatagctgtttctctttgtagctggaatgtcatgttgtactcttgattctcctttgtacctgttcttagccattaaggtgattggtggtcaacttcgtataaaatacaactcaattttaccattgttcttattgatgcacatgaatgtttctctttatgcatatcactgagggaagtatagtagcctttgaaagaaaggccttcttgtagtctcccctggctctggtagcaaggtcaggcaaaagtgttgtttttgcagttgtgactccatggttgtgtttttctttacataactgatgttttaagtcaggaaatatgactttgccaaatgatactgagctatattactggtgagtttgtttggttcctgatttatttcagtaaatctgggttgaatagtttagtagtagatgctggggaagatacaggaaatagtgagtttgagactagaaatgattgagttagacatttaatttaggctttcccaatcaacttacttcataccttttgccctgcttactcatcccagaggtgaggaacaatgagaagaggggtcaggcaaaggccatccctcagaatgtggttacttaggtctgtcgccaaaggcaacctatctactggaaaatttgagctttactgtcttctgcagtatagtgttggaaatgcagtattttaaaaactaaattgttatttatagcagtgaataaaatgtgaactctttaaaaaaagagcagtgttactgtcccagctagcacaatagccacccacatgaatcatctgaacaacctcctcatttctgttttatctacctgaaataggggtcagcggtaggtgatgatgaaagcttgggaaatcatgccatgcattaggcaggagaaatgctgtggtgactctttctgtgttgtcctgccctcatgtgcataggaggctggggcagccccaagagctagaggtaagctttaataatttccctgggttccttggcagctggctgtgcttaggagccgggtgctacttccagagtagcaactgctgtagaaaagttctgccaaatgtgtagattttgaaccattttaaaggctatagtgttcagactcaaattttttagtaggcagagagtattatttaagggtacttatgctgcagtattggataaggttcgttgtgaaatagatactacaacaaggcctccatgtgacataaacttattggaacttgtgtacttttaaaaccatatgtttaatacatattttgagcttcattaggtcaggattcttggctatcatagtcattgttgtatctctacaacctagagtagtgtctggtacatagtagatgttcagtatatagttgaatcagttcaaacaaggggaagaagtgactgaacacattagaaaaggtaaaatttatggcctataatgcacaaagtcagaagttcatattttcttttagtgctaatatcttgctgcttcaaaaccatttagttctcataatgttcttttgaaataggttagtagacatagaattgtatagtatatgccgaacatagtagtggaatcctgaataatacctggtttccctagttgagatctgtaagaccaatgctctaattagatgaagaaaagaagtttctaaggttgaaatggaatggagaattttatagtgagtggaattactaatgactggcttacttgatctatctaaaacgatttcattgcttgtaaaatggagacagtagactttaactgatagtattgtttgaagattaaataagatagtgagtatgaagtccttggagacttgcaggtgtgcagtgagcatgaattgttttcaacatcaacagtaatttttgagagcttcctaatcagtcacctagctagtcccacccagccttaggcaaagcgaaggggccataggccaaatcctgccgtctgctttatattgtagccactagccagatgtggctatttcaagttaattaaaattaaaatttaaaattcactgaacagacatttctccaaaaaagatttataaatgaccaataaatacacggaaaggtgctcaacatcaagtcattatggaagtgcaaatcaagaccaaatgaaataccacttcatgtgcactaggatggttagaatcaaaaagacaataacaagggttggcagggatgtggagaaattggatctctcgtacgttggtgggaatgtagaatgttgcagccaccttgaaaaacacactggcagttcctcaaaaagttaaatatagagtttccatacagcccaacaattccattcctaggtatgtgcccaagagaattaaaaatgtatatttacacagaaacttatacatgaacattcatagcagcatttcataatagccaaaaggtgaaaacaaccccagtgtccattaatggatgaatggataaacaaaatgtggtagttgcacacaatggaatatcattcaactataaaataaattaagataaagacgcatgtgtatgttcatcacagcactattcataatagcaaaggcatgtaattgacctagatgcctgtcaacagtggactggttaaagaaaatgtggtacatatatactgtgggatactatgcagccataaaaaagaataagattatatcctttgcagtaacatagatggagctggaggccattattctgagtgaagtaacacaggaagagaaaaccaaataccacatgttcttacttataagtaagagataaacattgagcccacacagacacaaagaagggaacagtagacactggggcctacttgagggtggagcattaggatcgaaaaattgtaggatactatgctgattacctgggtgacaaaattatctgtacaccaaacccctgtgatatgcaatttacccatgtaatatgtatcccctgaacctaaaataaaagttggaaagaggaaaaaaaaagatcactttgggaagaattgatagcttaaattattgtgtcatccaatgtatgaacaaggtatatctctattatttgggtattgtttaatttctctcagcagtgttttgtagttttaaaagtacaagtcttgtacatcttttgtcacattcttaaatatttcatatattatgctgtggtaaatctgtttttcatttgaatttctgattgattgttgttagtatatagaaatgtaattgattttttgtatgttactcttatgtcctgcaactttgctagattcacttattctagtagaatgatgtatattgcattggatagtctacatagatgatcatatcatctgtgtataaagacttcctttccccaaaaaaagaaataaagtacagatacatggtgcaacatgcattaacttcaaaaacattatgctgagtaaaagatgccaaacacaaaagaccacatattgtatgatttcatttttaagaaatggcctcagtaggtaaatctgttgatatagacactagattagtatttactagggactgggaggaggagagtgtgggcagtgactactaataggtatggggtttcattctgaggttatgaaaattttaatggaatttaggtagttcttagtgatcaaggcacaactttgtgaatatactaaaaaccaccagattgtatacttaaaaagggtgaattttatggtatgaattatatctcaataaatgttatttttaaaaattcagttccttagttactttagccacatttcagttgctcagtagctacatgtggctagtgactgcatggtagacagtgcagatttagaacgtttccatcatcacagaaagttctgttagacagcactgatctaagagtctcaatctgagaccaaaaaataaaggaagaaaaaccagtctaaaaaacacagggagtggagaacagattatgttctgaagaaatgttactttggggtaattttaccctttgttgccctttgactgttctactaggagtcctcaacatgattttcattttattctcaaaacaaatgcctgtggtaggtactgttatactcatgttttataattgaattatatgagttttaagatatttgtgtagtaagggtagagcaaaatttctaacctaggtacataatctctgttacattgtttacctctgtttatggtatttgattttcttaccaaccatccttcactcccactttgttgctagcccactagagctattttcagtaccctaaatgcacagttctttttgtgccatagcagatgctagccctccttcctccttctgccgtctcccaacactagtatgtgcatgtgcacacatttactggccccacttacctgaaagtgtggtgcacatctctcttcctttgtgaagctatctgataccacagttttaggggctactctctcacctggttaaggttacataatgtcgcaagatataagcaagaatgctgacaggattcttgttgtgacactatgacacattgagcccaattcatagctgctgtgttggtgactctaacagggaagtggtcttctagtccaggcccttggctcccatttatacattatctcctttccattcacagccttctttaatccccacccacactgctacagtacctgactgaactttgcctttctttgcctcttcatatgtttttctgcttaagctttttgaacctgatgagatactgccatgtttttatatttttctgctcataaaacccttaatggtaaaaagatacctgattgaattctgaagtgctttcatggctttgcctgattctgaggtcatattttctaactttatgctaacatcagtttactctctggttttatatggagcatgtactcctgtagcttctgaagaaaggtttaatgggaagcaaattttgagactacatgtagtaggctaaatcatggcccaccaaagatgtacacatcctaattactagaacctgtgagtatgttactttacatggtaaaaggatctttgcagatcttattaaatttaggattttgagatgggggattatcccagaatatttggatggacccagtttaatcacaagggtccttataagaggaaggcaggagggtcaaagtaagtaaaaggagacacgacaatggaatcaaccagagtttggagtgatgcactttgaagatggaggaagagggccacaaaccggggaatgcaggcagcttcaagaacatggaaaagcttctcccctgaagccaacatcttgatttgagatttctgacctctgatcagaactgtaagagaataaatttgtgttgtttaaagccactaagtttgtggtagtttattacaacagtagtaggaaattatgaatacaccatgtataaaaatgtcattatgccctttaacttgattgatagtttatgtagacctaatatatatgtacacatactagtctccatggctccatgctgcagtggacccaggacccaggcccaccatccatggactcaggttccaaacccaccccagcagacttggcctccagactcaccctggcggatccgggctccaggatcatccctggttgtctcagactccaggcctgcccctgcagacccagtcttcaggcctaccttcgtgatcccaggcaccaagcctgcgtccttgaatccaggtgccaggctcattctagcaccaggctagtcccttaagactcaggctcaaggcccagtgcagcaccagattgagctttatggacccaggattcacactggcccctgtgaatacaggctttaggcctgccctgcatgcccagctgacaggcttgacaggcttacctgagtggaccctggcactaggctgttccccatgcacaccaggattgagatccaccctagcaaactcaagccgtaggcctgtcctaatggacccaagtttcaggatagcccacctgaaaactccagcagcaagcccccctgccagacagccctccggaatttctggacaggctgactggtaaaaggcttttcctgccaaagccagtctgtgaagactgcaagtgcctacttcttcttctttttttttttttttctgagacagggtctcactctgttgcccaggctggagtatagtggagtgatcacagctcactgcagccttgacctctcaggctcaagcaataccactgcctcagccaatcctactgcctcagcctcctgagtagctgggaccacaggcaagtgccaacaggcctggctaatatttgtattttttgtagagacaaggtttcttcaagttgcccaagctggtcctcaagcaacccacccgccttggcctctgaagtgctgggattacaggcgtgaaccaccatgcccagccaagtgcctgctttgtaaaatgtgcagacactaatgcaaaactgcaaggatcaccgataatcagggaaacatgacatcaccagaggaacaaaatgaagcaccggtaaccagtcataaagaaatggacatctatgaattgactgataaagaattcaaggccaggtgcagtgtctcgcatctctaatcccaccactttgggaggccaaggtgggtggatcacttgaggtcaggagtttgagaccagcctggccaacatggtgaaacctcatctctactaaaaatacaaaaattagccaggtgtcatggcatgcgcctgtaatcccagctactcgggaggctgaggcaggagaattgcttgaacctgggaggcagaggtcacagtgagccgaggtcatgccactgcactccagcctggctgacagagcaagactccatctcaaaaaaaaaaaaaaaaaaaaaaaagatttcaaaataatcaaataatcatcttaaaagaagttcagtgagttaaaagagaatatagatggacaacaaaatcaggaaaataatacacaaacaatatgagaagttcaacaaggaaacctcaaaaaaaaaaaaaaaaagaaccaaacagaaattctagagctgaagaacacagtgtctgaactgaaaaattccacagaaagcttcaatagtagacttgaagtagaagaaaaaattagtgagctcaaagatggtcatttgaaactacccagttagaggaagaaaaagacaactaaatgaaaaagagtgaagacagcctatgggagttatgaggtaccatcaaacaaagcaataaatgcatatgagatttccagatgaagcagagaaagaaaaaggggaagacagcttaaagaaataatgacagaaaatgtcccaaatctggagacatgaatgaacatccagatccatgaagtccaaagaacctccaactagattaaagagatcttcactgagacactttataatcaaattctcaaaagtcaaagataatttcaaaagcatcaagagaaaagcaaaccatcacctacaaggaaacctctataagactatcagtggatttctcagcagaaactttccaggccaggagagaatgggatgatatattcaaagcgctgaaagaaaaaaaaaaaaaacaaaacaaaaaacctgccaaccatgtattatatacctggaaaggctgtttttcagaaatgaagtagagataaagacttccctgtgggagttcatgtcccactagacctactttacaagaaatgctaaagggagttcttcaagttgaaacaaaaggactctaacaacacgaaaacatatgaaagtgtaaaactcactataaaagtaagaatatagttaaattcaaaatactctaatgctgtaatgatggtgcataaatctctcttaattctattataaaagttaaagacaaatattaaaaatgactatagttgcaataatttgttgatatgcaatatatacaagctgtaaattgtgacatcaataatagtggggcagaggagaaaaagtgtcgtacttttatatgtggttgaagttatcaatgtaagatattttataattataagatggtttatgtacacctcatggcacaaagaaaaaatctgtagtagattcacaaaagataaaggaatcaaagcattctcttacagagaaatcatcaaatcagaaaggaagggacaagagaggaagagtggaacaaaggaactacaaaacagaaaacaaggtatcagtagtgagtttttacccatcaataattactttaaatggcttaaattcttcaatcagaagacacagaatgaatgactggataaaaagaaataagactcaaccatatgctacctacaagaaactcactttagttttaaggacacacataggctggaagtgaagtggaaaaagatattctgtgcaaatggtaaccaaaagaaatagaggtggctatatttatataaaacaagatagactattaagtcaaaaactgtcacaagagacaaaaaggataattttataatgataaggggtcaattcatccagacgatacaacaattataaaatatatatgcacccaacatcagaacatttacatatataaagcaaatattaatagaagtgaagagagaagtagatagcaatacaataatactagcagattttaataccccactttcaacaatgcacagaaaatcaataaggaaatagcagatttgtactacactgtaggccaaatggatctaagagtcatctgcagaatatcttatccaacagtagcagaatacgatgttcttttcaagtgtgcatggaccagtctctaggatagatgatatgttaggctacaaaacaagtcttaacaaatttaagaagattgaaatcataccaagtgtttttttctgaccacagtggtatgaaactagaaatcaaaagaaaacggaaaattcctaaatatgtggaaagtagacaacacactcctgaacaaccagtggatcaaagaagaaattgtaaggaaaataaaatcttgaggcaaatgaaaatggaaacacaacataccaaaacttatgggatgccatgaaagcagttcgaagagagaagcttataatgataaatagcaatacatgaagaaaaaagaaagatctcaaatagacaacctaactttacaccttgaggaactagaaaaagaacaaactaagctcgaggccaaaaaaggaaggaaataataaagatcaatgcagaaataaatgaaatagagactagaaaaacaatagaagttatcaacagaactgagttggttttttgaaaagtaaaatcaacaaatctttagctagactgagaaaaagagaagactcaaaattataaataaaagagacattgcaacttaaagagatacaaaggtttataagagactactataaacaattatataccaacaaatttgatagcctagaagaaattgacaaattactaaaaatacagcctatcaagactggatcatgaagaaatagaaaatctgaacagacctataatgagaaaggagattgacttagtaatcaaaaacctcccccaaaagaaactcccagaacctatggcatcagtggcaaattctgtcaaacctgtaaagaggaattaatgccagtccattttaaactcttccaaaaaattgaagagggaatacttccaaactcattttatgaagccagcattaccctgatgctaaagctagacaaggacagtacaagaaaagaaaattacagaaaatacaagaaaaaaattcctgatggatatagatgccaaagtcctcaacaaaatactagcaagccgaattcaactgcatattaaaatcatgcatgcttggtacaacagatatatctgaagagactcttttctctatggttggtttcttcttgatcatcactacctcttagtgtacaggaagctcaaaatattactgtgtgaccttaacaaaataaatttacttctctggtctttaggtttttttcaatgggaaaatgggaaggttggctccattagtttctaaagtccctttgagctctgaaatgagtaattttataatttctaagtgtttaattcatcaactacatgactttaccttttttcttcattacctgtcaaattcacttaaaaactattatcacacttcatttgctttttaataaatttctgacagcatgaatgggagaaaaaaagggactatacagcatgatcaaagaagatttatccctggaatgcaaggatggttcaacatatacaaattgataaatcacattaacagaataaagtacaaaaaccatatgatcatctcaatagatgcagaaaatatgtttgacaaaattcaaaatcttttcatgataaaactctcaagaaattaggtgtagaaagaacataccttaacacaataaaggctgtatatgacaggcccacagctaacatcaacactcaatactgaaaagctgaaagccttttttctaagattaggaagacaaggatatccactctcaccacttatagtcgggataatatgggaagtctgtcctagccagagtacacaagaaaaatgcatccaaatcagaaaggaagaaataaaattttcggtttgcagatgacttaaaattatatatcaaaaactcttaaaactccaccaaaaaaacctgttaaaactaataagcaaattcactaaagtggcagatacagagtcaacctacaaaaattaatagtgggggaggagggagtagggatggttaatggtcaccaaaatatagttagatagaatgaataaaatctagtgtttgatagcacaacagggtgattacagtcaacaataatttattgtacatttgaaaataactagaagagtataattggaatatttgtaacacacagaaatgataagtgcttgaggtaatggatatcccatttaccctgatgtgattattgtgcctctatcaaaatatctcacataccctataaatctctacacctacgtacccataaaaattaaaaattaaaaacaatagcatttgtatgcactagcaatgaactgagaaagaaatcaagaaagtctgatctacaatagaatcaaaaatatataattcatttctaagaggtttttttgttctctcttcttgtatatagcttcaagattttgtttcttatatgctatgtctaatgtcctccaagagaaagagagggaaatggaattataattaacattgtcttttccctatattatctgttttctcttattttcttttttcctgttttttagctttggtacttgtctgtctttcatgttagaggtgtttctcaagcatcttcagctgtttgttgctattaaggaaaagtttattggaaactgtgttcatgactgtggcttgttcagtgatggacctcatgtggtgtgattgagggaaacctggctatttatggggagcctatcagttcttttttcttaagccagtcagcttttctaaataggatttctaaattgaatcttttgtgggagggagtttgggagtaataagctcatgtctagggctggatccttaatcattggctgcaaagacttatttaacccttgttttcagtaaggcatcccatttttgttctcagttatggctggtgttcctgagttcaggggctctgattcaacctctccagagagtaacttaagccctctgctatgtggagaaaaggcagttgccagatgctctggttggagtgagagtatgtgaaaatcttacttctcttttttaaacaatttttcagcatccccccaccacttgctttaaaaaaaaggattattttcttcaaatgtgcccataagctgcaattcctgagcttttaccttctgttcttccagggcactcaggagtgaactggcttacttgcctcaatttagattcccccactgcaggtacttggcacaaagaagaaagatacaatcaagtcagttacctcttttccaaatgcttttcattttaaattttgtgggcctatctcctttgctgtcatcatctccccacgctcttcatcttgttggtttatatcttttctaattcttcagtcttttgatttgtagagggagttagataaatgcttgtatctgatcagttatgtttaaacaaaagcgcctccctcccttgacaccttctctttttcttggacttctgtttcttagactgtttccaccattagaataagagcttgtcaagggcaggaaccagggtatttaatagctccagcatttgtataatgcctggagtatagtaggattattaaataaatgaacatacctttattttcaattatagatttctctgacttgagaaataatttcaaataaaacagtgaagtctctcttacagataagttcggaagctctcctctttcctcgattcttgcttatttttatccacagtgcgtctcgtgaaggaaaagaatggatcattctttcttgatttcctcgttggtaaagtatttggctttaagagctattcaaatgaatgtgcaaagtaagagtaagttgggtgtatttctagcactaagttgttgaggttctagaaaggtagttttgtgccttctagataccatgtctgcctttcctaatgagcctggtatgtatactattctgcctagcataactaggagcaataggatagagaagtgggatataccatttcaaagattcactgatgctgcttagaaacaaaaatctaaatgaaaaccaatgtacataaattagataattcacatataccattagaaattccacttaaagtcagtactgctagaaaccttgtcattaccttgctttaaatgctaagcgctttctgattaattctttttcagtttatttacctgggaggtattcgatctaagcaccagcatccctgcccccacttttatctattaatatttacaggtttttccctctttgaagctccctattgaattctgaatgactttgaacttggaattgctctgggtctgcttttcacctcctttctctacctcccaccccaaccttcactaatttgcttttttttttttttttttttttaatatttgggtggtttcttcttgcattctcttttttctatatgctccatgacagcctggactacatttctgttactcactgctgcatccagtgcttagcacatgctgggccttaagtcactgtttattgaaaagaataaatggattactcgttgaaatttttttaattatgaataacaaaaattagtaatctaactatatattatcaatcttttgctgtcttatcttacaggttttctttctggttttcatactggatagtctctattgacctagcttcaagtttgctgatttttttctactgtcaacttaaacttgctgttgagtccttctagtgaattttttgtcaattatagtacttttcaactcctcagtttctattttttttaagaattctttttctttattgatgttctctatttggtaagtcattatcctcatactttaaaaaacttctttaagtatagtttcctttaattctttgaatatatttataatagctaatttaaagtctttactaagtctaacagctgagccccctcaggaagtttctattggctgctttttttcttctgtatgggccatcttttcctgtttctttgaatgtctcataatttttctgttgttgataactgaacattttagataatatattgtagcaactctggattctgatccactcaggtagtggttattgtttttacttttgtttttccattgcttaatgacttgcctggactaattctacagaggctgtctttgctgaaatgtgtggccactgaagtttgtgctaggattttttgttttgttttaaattcttgtttttatttttaagcctggcttcctagggttttccccttggtcatccaatggttggccacaagttttccttaaacactttgagccaataagccttccatcttttgctgaaggaatctctgtgtgggttggggcatacgttgaaagttcaggcagtttaaaagtctgccttggctttcactttctgcttgtgtagggcctcacagtcagccaggagcagtagataattgggaatctttctggtctctcttgaacatgcatacatgcacagagccctccaaatggatacaaccttccagaacccccaagtatgtcagagctttaagctttctatggctgtctcattccccacatctaccttttacatgttggctagtgtcttgcttacctcaaccagtattgcagacttaagcagctgtgattgtttctaatgattgctattgtttttgacagtgcccctggccatggggctttctcttggagctccatatcaagtcagcttccttcagtggaactgtccacaaagctacaaggccagcgaattgtggtagaagcggacccaaattaaaatgtcacagaccctgctggtcttacctaggatcattagtagctgaggtcctcactccgccattccagaagtcctgccccccacctctgccttaggttttcaatgtgtttttatagctgtttatagttttgtggcttttcatttagtataaatattttctcatgttcttgataactcattataactaatttctactggctctcatcatttgaatgtctcataattgatttggtaatttcccctgttgttggacttcagataatcactggtgtaatttgcctttcccaacaggctctaacctgaatgaggcctgggactgctttgtttactacttcatcctcagtgcctgacacagtaattcttgttaaataaaggtcaccccacaattttttaaatgttataaataacactttgaggtggatcgtactgccaaaactgtattcagatttcagattttttttaagaatggagtttcagaaatggaattgcttggtcaaaggatataggcatttctaaacctcttgacataggttgccagattgatttcttaaaaagtcctatcaaaatagaaccttttggccgggtatggtggctcacacctgtaatctcagcacttcgggaggctgaggcaggtggatcacttgagatcaagagttcgagaccatcctggccaacatggcaaaaccctgtctctactaaaaatacaaaaaatttagctgggtgtggtgacgcgtgcctgtagtcccagctatgcgggaggctgaggcaggagaaccacttgaaccccagaggcagaggttgcagagagccaagaccacgccactgcactccagcctaggtgacagccagactctgtctcgaaaagaaaaaaaagagaacctgttttttcagcagcatccttatctgttgcattgtatatttggcgacatcagatgtgctagttgctcaagttttattgaccttattggccaaaaaaaaaaaaaaaaaaattctcgttgaactattttgtgtctttttttgagacagggtctcagtctgtcacccaggctggagtgcagtggtgcaatcacagctcactgcagcctcaacctcctgggctcaaatgatcctcccatctcagcttctcaagtaactgggactacaggtatgtgccagcagacccagctaattttttgtttgtttgttttagagatggggtctcaccatgttgcccagcctggtcttgaactcctgggctcaagcagtcctcccaccttggcctcccaaagtgctgggattacaggcatgagccaccatgcccagctattttgtgtctcttcgataaccaatgaaagtattagttttcctcatactttttaaaaaaaattctttctataaattggccatttgtttttcccccattttgctcttagttgcctaatgtttttcttgctaatttatgtaaactttatatatcaaagatatttatctattattgtcttttatatatttttaaaatttttcattttgttcctgatgagtttggatgtgcagaaactaaaaatcatacagaagaagcctctttgttcgatatgattggatattacaactggtctgctaaagagggaggagtataaaaaaagtctacagatatctcttcaatattttaacttgaagacaaaatatacattaagtagctaatcctttgatattgtgtgacccttttctttgaataagtctaattgattcgaaacctgctctatatttcttttatatatctcatccaaaatgcatcatcaacgatgtccagttttgatttatttaaaatggggtaatgacttaatgagctgtaatctgagtgcaaaatccttttggatattttatagatccttgctccccccgcccccccacccagtcttttgcagttttgtcacccacatttaattcagtatctcctttatctggtctttgaagccagttcttctcttttgtagtcacattcaattgctgtaacatatatgtaacatataattaagaattataggccggatgcagtgcctaacacttgtaatcccagtactttgggaggccgaggtgggcagatcgcttgaggtcaggagttcgagaccagcttgaccaacatggcaaaattccatctctactaaaaattaaaaaaaaatagctgggtgtggtggcacgcacctgtaataccagctacttgggaggctgaggcatgagagtcacttgaacctgggaggcagaggttgcagtgagccaaggttgcatcactgcactccagcctgagtgacagactgagactgtctcaaaaaaaaaaaaaaagaaattatagtaacacctacacaaccaacataaagaggtacacatttaggaacaaatacaaatagctcttggtatgtagacaacttaatttgtggggttcatgggctcatatgtactacacagtaccctgtcagcattgagcagtcagcatgcagcaggcattcattaggtttctacagagggaatggagaatggatcagtctgtgaaatttgttaagtggggtcaattaagagtgcttctaccatggtcaaaatctaatcagtctttttctttgttgtgattgtttccatgcttagaaagtccttcccttcttgagagttatgtgaaaattcacctacatttttctgtctttcttttgattcatacatttaactctttagttcatctgaaatttattttgttttttagtaagaagtaaggatgtaagcatctaaatagattttccaccttcaaataatgtgctgttttttttttccccagcatagccagtgcattcttcaaaggcaaagatcaaaaatgtaatttctagttttcaacaattagaataggggttgaatgggtctgggtcttgggagtggaaggtcagtatggtccttggggttggggaagggcaggcagagcatagagtggaatttaaaacacacacacacatacacacacacacacacacacacgcatgcacattcacatgataaggagaaaaagataactgagaaattggataataacagagctagtaggaagaggatatagtacaatgaaccctctttagaatgcaggccctttccaaaatgaaaatttgaagggtacttgggctctatttgatgaattatagtgaggtaaagtagtttattaagcatttgaataaacctaaatagttaataagctattgtttattaataaaaggtatgccaacaaggaagtaattatgcaaagttctacagagctgtcaaacttgaaagcatgtttttccccaccgattttgccagtctctactgggaaattatttatgatcattccctcagtcttttgaataagtcaacttctctcagtgcaatcattgctttttcctgggccatagcattaggtcaattagtgaaatattaggcataatactctttaaggctatgaatggccttgaagtactgtatgaaaaatatgagattaatattaagaagctgctatgaagcaaatgttaccagtggaaaattttattatacagtggtgtttatgctggttttaagttttaaaacattttatctttaaatgaccactgtataaatgttactttcaaaatattgtttggtgttgataggttctatttactcttcccaacatttatttgtattatgagtcacttcatactgactcaccagcattgcattaaaataaccagtcaccatcaaaaagtggactaaggacatgaatagacaattctccaaagaagaaatacaaatggccagcaagcatatgaaaaaatgctcaacatcactaatgatcagggaaatgcaaatcaaaaccacaatgcaataccacctcactcctgcaagaatggccataaatcaaaaaataaaaaaaaaaagatgttggcatggatttggtgaaaagggaacactcttacactgttggtgggaatgtaaattagtacaaccactatggaaaacagtatggtgattccttaacatctaaatagattttccaccctcagataacgtgcctttttttttttttccaggatagcaactgcattcttcaaagggacagatgaaaaatgtcatttctagttctcaacaattggaatagaggttgaatgggtctgggtcttgggagaggaaggtcagaactaaaagtagatctaccgtttgatccagcagtcccactactaggtatctacccaaaggaaaagaagtcattatacgaaaaagatacttgcacacacgtttatagcagcacaatttgcaattgcaaaaatatggaactagcccaaatgcccatcaatcaatgagtggataaagaaaatgtggggtgtgtttgcgtatatatacacacacacatatatatacatacatatatacatatacatgtatatatacatatatatacacatacatgtatatatacatatatacacatacatatacatatatatgtatatatatacatatattcacatacatatacatatatacgtatatatatacatatattcacatacatatacatatatacacacacatatatacacatatatatacatacatatatatataatggaatactactcagccataaaaaggaatgaaataatggcatttgcagcaaccttgatggaattggagactgctattctaagtgaagtaactcaggaatggaaaaccaaacattgtatgttctcataagtgggagctaaggtatgagaatgcaaaggcataagaatgatatattggactttggggactcaagggaaagtgtgggagggggtgaggaataaaacacattgggtacagtgtacactgcttgggtgatgggtgcatcaaaatctcagaaataaaaaaaaaataaatgaatcaccaaccaccaaccaaccaatatgggagatttgtttcagctggagggccttagtttcttaaagtagttttcttctcttgctctggaaagtactaattccaaggcctcttttctcctcccagttgtaggatattggggattcttactagaaagcgtaggcagagcacatgcagccagtgtccccaagttttttagaccatctggagctacctgtggctgctatgtagcctaaaacttcagaaggccttatgatctattggcagatggctaaactgggatccttgtgtcagggttttcttttatgttatttttaaattccagaatagaagagaaaatgaaatggagaaagaagacattgaaggttgtggtgttttctgtgaagttcaagaagtattgacatttctcagaagagtatgactatagatgatattgttactgtttggggttttttgttggtcatggtggtagtgatggatttttttttttaagagtcacgtttcttcacctagaattagctgaggaaaagtggcatctgtattgatggttttaatagatatgattttattggtggtgccttcagagtagtggcttagagtaattagaaagacatcattgctttgtataggtcttaaaaagattgttaaacttttaattcaatgttggctgagcctgctgtgcctgatacattaaaagaaaaaagtcttatgatttactgaaaagagtaaaatggtcctgatttcagttactcccttctactcatgcacactgtgttgcttactgccctttttaaatccaaggtgattcttcaacctcatacattgttttaacatttcactctatgtctaggacatgtctagaatatttaagtgcctttttcttggaaataatagagatgtatcatacccagttttatttgcttaggtagcagataaagacttcagaaatactcaatatttgagtatttgggttggaatttgacactgtgtgtgtgtgtgtgtgtgtgtgtgtgtgtgtgtgtgtgtgtgtggactcaactagcctaaaagaaagataaatgcctcttagaagctagaggggaaaaacctatgaaaacttagtttgggatgtacctatgatgaagaatttgccctctgatttctcttccatgtggctgattttgaaggttgtatagtattttgtttttatgttttgatacagctgttaattcttgaccattttcctcagaaattggcatttccagattggcaaaatctagtatcattgtaggtagctctttacagataaatttgtacgggagagtatgcaatatattttgaaacttctgtttttgtgtgtacaaatctctaaatcagcccagatggtggccattatggattagtaatagcaagaaagaaagctgttaatatcacagcttctaacatatgtctcctgattgtgggtatatatgcctggtgtcaaagataacgctacagcatacctattacggcttttaaaaagttactaaggcatttctatctgtatcagccaactagaaggatggattagacaacatgatatatgtagtgcttttatctctggcaggtagctaagtctttgaaagaagatatatcttctcatctggccagaatgttttgattttaacttgaaatttcctaacaagagttcttatgtgtttattattgcatgttcttatgtgtttatttttaaaactatcctttagcatttaggcacattaatttatagcacctgtagagcaatcagttgcaatatctgcatatatgccttttattttctgtaattgagatctgtattatatttatataatcagtgtgtaagttactctaaaagttatctagtcaagcttgactttaaagatgtctttgtaacttgttctacattgttactgtttccttcagaaagttaagtttccaagcttctttaagttacattctagacgttccgaggggttccaaagtgttgaaaaggaaattgaagtaagctttggaatatgttaataagcttcaactggaaacatgtatggtagcagctgttttaaaggccgctgatagtgagatgttaattgagtactttttaaaatatattacccaaccttctctaagctctgaagcttcaattacatttatcctaggcactaagacttgaatccaaaggggttacttcactgctcttcttgaggttgggggtcctatgttattcactattgtaacagcaacagattataatgattggtaggcaaccaaatgcttgctgatttaattaaacttgcctagttatttttaccttattgtaaattttggtctatagagctgaagagatttctccccttttctttgaattaagaaaaagccacatatgtgtggtaaactccccttcaccataatgaaactactttttcttcattctttgtaaaatattaacccagtagagtaaaaactgaattcttccatgaatggtggtatttcttctatctggcaaattaaagcaatggagaccattagggtataaccctgaactttttgtgctccctccaccctggtccgttatttctttggtataaaatcagaagaatgaaatcttagtagagttctcgtaccactacacaagacaaggtaaccatgctcttgaaatagatttaattttagatgttgagtgttcctaatgggtggcaaattatttatgctaattgtgaggaataaattacttatagatttattaataatttacacatagtaacttaaggttcaaagtttgttaacacttattttatatatgacattcacatcaactgtatgaggtaactagatttttctttttccatctcataaatgaaaaaaacaggttttttgtgaaaatgcaacttgcccaaagttgtagaattagatttttataaacagatctgagttacttaatatgtgtagaaatctttacttgacaaattttcgacattgtaaggtttgtaattttatctcagaatcctagaattctagagctgagagaaacttaagttgatacaaatggaaaataggttctttattgagtgccaggttaatatcaattgtagctgttgagacttggagttgagacatttttattgacttatttccagtttattggcagagagtgccctaattgattaaccatgcctgaagtagacatggggcaacatatagatgacaaatatgtggcagtcagactcagtaacttgatatagcattttgaaagtacctaatatagctttttacagattctgtctaacgtgagtttctattaaatttggcaaattcctcagtaagttacaggattctgtatgtatcaagaattgaatttggcaatgtggaacagaaaacccaaataatagtggcttaagtaaatttggattcatttttctgtaatgaaatgagagaattaaacattccagggttgatagggtgcctccatgatgtcattagggccctaagcaccttctcaccttcttcccagccatccttgttgtgtgctcctagttataagatggctcctgaggctccagtcatcccatttgcgttccaggcaggctggaagacagggaggagcaaaatggtgcctgtcagctgagtaagacctcttaaaagagctttgctgtaaaccacatctattgaagtttgcttttatctcattggccaagctgtatcacatgactgtctcatctactgcaaagctaggaaatgtatttttacttaagcacattggaacccagcaacaatggccttctgacagcaaaaaaagaagcagatggatgattaataatctttgctacagtacacctctttagctatccagtccttactcagttatcttcccacacaaagaacatgcttaccccttccttaatgggaacacctccaaagtcttatctagttactatatccaacttttaagtctttgatttcttggtgatgtacagtcctctcaattaggtctaggtgtggcttcttgtggtctggtgtcccacaaactgccccctccttcattgttacatagatagaaaaagaataggataactttagtaaaagttcccacccaaccaaaaaggagagagtaggaaacgtagcatttaacagatcctattgggcaggaaaagcaaagactctctgtcctgccttcttggatggcccatttggcaggccctggctctgctctaggggaatttcctttgcctgggaaagaaatttgtaagggaagccccagcatccttgaagaactctgtgatcagtgagaaattaacagcgggaactgcggccactgattgggaagcctaaatacaatgagggtaattggatcccaggatggcaaggaccagtagcacttaattgccaaaggaagggcaggtatggttactgaaatggacagcagagtcaaagcaacaattagaatgaactgactagtacagggtgatttcttttgctccaagcaggcccctggctgttctctggagattctttattgtccattcttctccatggccctatctgaaatgctctttggggagcacatttttcttggggactacacagctttcatagctaacatattactgttgagggtttggagccatgaattattttagagatttaatagctattggctgctgcagggcagttttggggtttccatgacaatatcgtttcgtcaaaaaatgtcgatatttttcttcttgtttttagtaagctccacgggggagaagccacatctagacatagtttcttagcctgaaaattcttctacttactggcctctgtgctctgcccttttctttcagcttttgagttaatagccagctgcctcgaggtaggcaacacccttaatctgatttttgctggctagttttctttcctgtcctgaagggaactcttaaaacagcttggggttgtggtttcatctcctgctaagacagccacttctctgagttactgcttataatcacctcagtttgagagtacaggagctgttgatgtttatagtcctccaaagcttcaaattatgtgactttcagtcgatttaaattgaaggctgcaggcacagaatggctggctcaagttctatttggtctctcctaggactgggctcaaaagctgcaagaggaaaccatcatacatccatatcccgaaaatgtcctacatttccataaactgtagcctcatttggcatatggtattaccaaatgttttgccactacctaacaagagtaaccagctttaagagtcactgtgaattggttagagactgatgggattagttaagactaattttccttaaagtcttttcttttccttgatataggtatattccaagtgttgatgggcagcttggggtttatttactttttagacttataaattgggagaaattaggactaagggaaatgattttttctaaggacatgaacatttataaaagacaaggaaaaagtatgacggaagaaatatgtggatgtaattgccaagaaaggagttcatcagtgatgggtaaatggtcaagaaaaaatggacagtgtgatctctgtgtgatcctgttaatatatattgtgccagccattttcctatttcagccaccaagtgatgcagtttacccagggtctgggttccagtcctcattgagaggaaccatggttaagaagaaagtgaacttacaaccaggagtttatatgttctcccacatttacccttcggatggtatctaatcattttctcctctaaatgaaatgtattacattctcttgtggctgatttctctagtacttatcttatatattcttaaacttacctttatgtaaatgtgctcaatcaattttagtaagacttaaacttcctgagctctaccttttaacagcatcctagactgagagttagtctcaaaagtcaagttctacaaaagaatcctttatgctgtttaacttaatatgttgtagtgttgtgacttctctacctttcagtgtttcttgattaggattcttcaaggtatttcttttgtttttaatcttaaaaaaattaacatgtcaaataagagaataaatagtacctggcctttattagaatcttattttccataatgttttaaatattttcatatcctatgagatatgaagggaagagttatcaaacaataaacttttgaacaccaactatcagccttttactacaccatgaggcttaataatagtaaatagtagttggtttttattgagtgcttattaaataccaggcacagtggtaaacattttatcttatatatattcattttatcctgacaacaatcccaagagataggtggtgttatcttcgctttatggatatatgtaaaccaaggctcagagagttgtaagccacttgcccagggttaccaggctattgagtggtaaagctaggagtctaaggaagttcaactccaaagtccgaactgtgtagctaccttgctataattgtagatggtccctgccatttgggaacttggtttaacagaggaagtaaacacggaaataataaattgaatgatttccctttcttagtttggccatagttgttatgatcatttcataataatcatttctataaatgtaagttggcacatatgaagcacctttggtatgatgtcagaatatcatttttgaagtagtgaactaaaatggcatatcaagtgacccaaaatgtcatgaagctttttggaaacattcactctacgaaatttattgaacaattattatggtccagggtcttctgggcccagagggtacagttgtgaataatatagaagctgtcctttctgtcatggaacttgcaagttagagagggagagacaggttaaataattctacaaacaattgtttaaaattcaatggtggtgagtgctgtgaaggaagccatggaagtgctgcaacagtataaaaagggaactgaacctacttcaagagtaagaatcaagggagtgattcaccttgagtagagctgtctttcaaactccataacatactttaatattttatcagtgagtcttgtaattcttgatcgttattctttctactagtatactgcagtcttgtgctttgtgagcaccaaggggaagagagcttaacttggtctgaggggaaatgaaaacaattcttagatacttaagctaaatcttgaagggacagtagagaggaattagaccaggggaagtatattctaggcagaggaaacagtttgtacaaagtttacacaaaggcattgggggcagatgagaacataatcctttaaagataattatggttagtatagctggatgcggtgtgtgtctagatggtattgagagatgaggctggaaagatagatagaaaatgtgaaatatttatgtaaccaaatctggtttctgtagagttggtctattaacttttccccatatttcagaggatctaagagatatgagattttcttttctcccccatattttaattgttagcattgttaaataaagtgtaaggattggcctaaatagatgtatagtgagatatcttatagttttaaaatgtatgtaatgcagtaattttaagggttgcagtcagatacccaaagcaaggcaattaattagtgaaatacatttggatctcctggctagactgaggcttgagtgttgtagaaatacatattactgcatgtgtataagattgggtctgcctgaagagaaggtttaagtgtggtgttccaggtatattccaatggtgaggcagaatattttgttaatgatcaaaggagaaataagagatcaagtgggaggaaattattaacagtgaaagcaacatgggcagtttgatgtagagcactgagaactatgtaggagacacatggcttgcatctgagctggcctctaccactgaccataggcaagtctctgggtattttggaatctgaatccaaacttcctattgaagtataacatggcatacagaagagtatataaattataagtatgtagcttgatgagcttttacaaactgaacacattcctgtaacagcacccaagtcaagaaactagaatgttaccagaagccctctttgtgctacctgtacttccatttgtttaatctttaaaataggggtaataatgtcttcttcacttttagaagtgctgagaaaatgacaacttgagaagtgccttgatctctctcagtgttgttatacaagtgaaatgagatgctaggaagtaggaccagcttccaaaattgtagaagtacatagagcttacttatagtattattagtaaacctattaaattggggatgcataaggagataactctgaaaaccacaaagcaaaggacaaaacagttgtctaaaatgaatcataaggatgcatgggcatagtatatgtgatgtcttttgttcttataaggtgtcattcttgggattcaggagagcaacttgtgtatttttacctgttcaaaaaatgtgaaactattctcattatttgaggatgctggagaaatggtagcttcctgaaataaaagtaagttctgttttaaaaatagccataagtcttgaattcaccaaatatttctgtttgggtttcaggaggtctgatgctgagtctctttttgttaatctgaatgcttacgaatacttttagaatgggaagtcctccttcatgttcttaatgccattagctaaattgatttttttcaaagtaacaaagtcatcataaatgaaattacatacattagtccccacttatccaaggttttgctttccatggtttgttacgtgtggtcaacagtagttcataaatattacagtagttcaaaaataaagtattttgagaggggggagccacatttttgtaacttattatagtatattgttgtaattattctattttattattagttgttagtctcttactgcacctaatttataaaataaactttgtcataggtatgtatgtatgtatcagaaaaatcatagtatatatgggatttggtgctatccacagtttcaggcatccactgggggtcttggcatgtatcccacgtggataagggtaggggactgctgtactcttgtagtactttttgaaaaagtttcaattttgtttagtgtaataacagattgatgcataccatttcttacacgacactagctgtagtcaccacaataatctgcatttttctatcaggcctatttgctttccaattctccatcatctccctgtacaggtatcttattagatccccttaagatctattctgtcctttacctgtatacagtgaactaagacttttaatttctataaggtaagatcattttattagcatatttttgtctttgatatataaaattatctctgctgagctcaaaagtttagtaaattttttgattgataatttaagaaagtctttaacataggcagtacagttataagggatagacaaatagagcagctttatttataataaacatttggctcttttgcaggatttccagattttaagatacactgaacccagtttatagccttttatccctcacgcccccgacctttccctcccaccagtccccaaagtccattgtatcattcttagaaacattctaagaacttcatgttacagttctgaaaactgttacatttacacttgttgtatttctgaagactttgttacatgtgagttacaggtgaatgaatttgagggaaaaactgacaaaactcagcttgaaaaggaacccacagtgatttctctacaagggtattttttgaatttgtgaataatttattggcagcttgctttgcaaaaaatacacaaaaacctatggaaataaaattttaaaaaaaaagtcaggaaagactgcaaaaaccatgaccttgcacaaaggccattgcaaccgtatacaaaaaaaagaacacttctgttgaggacatctgcccagccttggactggcatcacccttattattgatccttgaagccaaggacaatgacctaaaaacaattatgtaatcttcctcattttatctttgaaaacctttgtcttcctttacttccctaaatacacacatagtttactgtggcacacatattttcattgcaatgccctattcccaaataaataccattttctgtttttttttttttaagaatattttgtgctattatgtgattgatgttggttagtgctattagtgaagaagttggtgctttaaaattgaagcaccagagtctacttatttcgcttaaaacacgtgctaatttttaaaacatatcttcacacctcatgaaaataagaggcattgtgtttaaaatgtatttttttttgtttctttcccattaaaaatttaattgtggtaaaattatataacataaaatttgccattttcaccatttataggtgtacaatttagcggcattcattgcatttacaatgttgtgtagccatcaccactatgtctatacctttgtgctatattaccctacgtagatattatgggaagaaggaaaaattcttcccataatatctacaatggtatagaattgttaaatgatttcttaagatagttttattattttagatctggattaagaaaatcctttggtaaatgttatagttggatctgattggccagaattcaaaccagcaagtaccttattcaatagctgcttttgtaggcacaggtattccagtaccacagggtaatgagtatttcaaacaaaagagggttagagatatgtctaatgtttattgccataccctcaccctctgggctttgatctttctggtggtcttaagttactactatagatttcttccttgctcataatatctatttggcaatgggactgaaatctggtaacttctattgggaacaaaccattcctctccactgtggaaatggctgttgtctcataagtattctccctcctgctcccgactgttaatactaaatctttgggtaaataaagttactcatctgtacaaagagattggagaccagtctaattcccctatttgaaggaagccccagagagttggaactaatagttaagtgatgcatttagaattagaacacacctgttccaatctccaatcagggaagttgattgtcttgtggtggttgaagaaacagagagggacggggtcagcagaaaaacctatgaataaacctccagtgccttatggtttttcctgaagtcagaatttagagcttgacaaaatgaaagtatttatctagttctaacccactctattaaaaatgaggaaactggcgcagagtgactgtaacttaaaaatatataaccagttagttgcaaagctagaactggacacccgtatgtcttgacttttgccctagtgccaaatatatgagagtgtgactctggccctgcctctaatagtttatttgcctacaagatatttagtggaattgtcagtgccacattactgtagaattatttcaaaagaaatatttttgatattctggttttgtatccccttctaaccaattaggaacaagatatttttagtgccagttaatagtgcagtctttcagcagaaaggaatctaaatcaatatgcagtgttaaattcactttaataaatgtgaaaattgtttttaaagtaaccattgattataaagagagatgctttctatacattttggtgggtacatatacagtatttttctcatataagtgaatacttactatatactattttttaaaagcctaaagtcctacagaacataaacatataaggcaactgaaatctgtacaccttctcaatatataaaataagtgaatatttgcttctaatgaaagagataaagattagataacttcaacaggggaccttggcatatgtctgataatagatatgagacagggatagcatattgattaaaaaagtcatggactttggatctggaatttttaggacccggattctcactgaaccagttacttgatctggggctatagccaagttatttaacttctctgaaactcgatttccttatctgtaaaatggggataaatatgctaccttagagagttatgagaattaagtgagttaataccagtacctcttagaaaaatgactggcatatagtaagtactcaatagctgtaataataataataatataccaatacatactaatactaataaagtatctgttactaataattttatcattgctactgttgctcttgttggaagattatggtaaaggtgacatgtgaacagataatccttttatgcttctatggtaagtataggactttttacctgtggatgcttttgactacttggatttaaatacaaatattttaatcataattaaacaactattaatgaaattttttgttaagaaaatatttcccagtccagatggttccactaagccagctccttgatcagttttctgtaccatgcagttaaactattttttccattttcatgtttatgttcctgaaagtatattcattgggattacttttttctgtttaaatactaaaaccaggctttttaaagtatcaaattgtattaatcatggtttccactattttaagtcttcttttgtactggtattgaagtacattttttttttcttcatcattatacactaatgtactaaccaatatagcttttttaaagaagcattgttacacctccctgattatgcttcatttaaaatgcagtcccctacagtcctctccaccaatccccacccccaacctttatattgttcttaacatcactttcttcaataactctggagtgagggagcataaacagtaggttatgggtgaaagtgaaatggccccatagtgctgtttctgatgactagaagagtagcatggctgagtcttgcagtacaccaagatgttctgcatgagaggataaaggtgggaaaaggaagaaagctaaaatgatttcgcaaatgctctacagcatctgagttatgaagagaggcatttcaacaggaaaaggaggccacaatgtttagttaagtggtaaagaagactcactgaaacttaaggaaaaaccaaagagtatttccatggttattttcaaatatttgttctctcatcagttctactctgggcaaatatataatgcagaatttcactttttaaagatcacattattgaaactattctgctaagcaatgacttcttgatttacggtaggactcaccaagattttaaataaagcaataaaaacagatttgctctaatggctttagtgttatacactgtggttgatagtgtaatgttttattaagattgataaacattaagcattgtgtatttgaatcaaccactaatccaaaccagtaagcatctgttaccattcgtgattgtctgttatgtgaaaagcaacattattgcagagctaagagtatcttgagcagtaattgaaatagtagcctttgctaactggactgatcactacaactgtctttattttctgatgattataatgcattttatctactagagttgaggttttagctgagtgatcactttcaaaaagaatgattagtcttgatcaatagtgtattacctatagatgagacttttagcataatgcaatttccttagctggtgttgagatccatttcatctgttcaggaaatgaaagcaggagatatatagtactttggattgtttgtattgcagattagctaaatatttgtgggaaatcagaggtctaaaacatgcttaaaattctagtctgatatctggataaagaaaatgcagtacatatacaccatagaatactatgcagccataaaaaggaacaagatcatgtcatttgcagggtcatgggtggaagccattatcctcagcaaactaatacacgaacagaagaccaaacactgcatgttcttacatataagtgggagctaaacaatgagaacatatgcacatggaggggaacaacacacactcgggcctgtagcaggggagggagagcattaggaaaagtagctaatgcatgctggacttaatacctaggtgatgggttgataggtgcaacaaaccaccatggcacacgtttacctatgtagctaacctgcacgtcctacacatgtaccccagaacttaaaatttttaaaaaaaaatctagtctgttatatggtagtaacagactattagattggtgcaaaagcaattgtggtttttgccattaaaagtaatagcaaaaactggctgggcatggtggctcacgcctgtaatcccagcaattttggaggccaaggtgggcagattgtctgagctcaggagttcgaaaccagcctgggcaacatgctgaaaccccgtctctactaaaatacaaaaaattagctgggcgtggtggtgtgcgcctatagacccagccactcaggaggctgaggcaggaagaattgcttgaacccaggaggcggaggttgcagtgagccgagatcgtgccactgcactccagccttggcaacagagcgagactctgtctccaaaaaaaaaaaaaaaaaaaaaggaacaacaaaaactgcaattacttttgcactaacctaatacaatctcattaagcacagtaactctgcattgtgtattgtagaagcaccagaattttcttacaaatgaaatgataatggctttttgatgtgttccctagaaagaattgtggtccatcatcttttcagtagatatactttttgttatttagtgctttaggtgttatttgctaatattacagccaaaataaaataggaatgtgcagtggaactcatttcttctctgttatagctggctctttgaaagttgtttgaggaaactctaattacctacagccctgcaatgaattgcacaacagatgtactgttttaaagtcttgattcttgcatgcatttttcaccttttacttcagttttagtctttgatttggaacacttaatgttaagcagtataaatgtgtctttctaggtgacataattggattctctctctctctctcttttttttttttttttttttttttgtgaggaagaaagcaaggtcagcattagctttgcattttcttcccaggttgttgttccttgaatggagtcagagttgggtcagggtcaaaaatactgactactactgctactactacttcttcttctttagctaaaatattgtagtagaatctacatatttttgataaaaaccccttctgaaattttgcattttaggtaatattcaaatgacatcatttcagtccttttgtttgttattacttctgacaaaagcacttttctgtaagcttttcatttattttactcttcagctatgaagtatttgattatatgaggacacaggaagaaataaggagtagcccatggccccagctaatgtgttagacatcttatacaggattagtgctagattagttccatgaggtgatttgaactgtcaaggtcatcaaaaacaaggtaagtctgagaaactgtcacagccaagaggagctgaaggagaatgatgactaaatgtaatctggtatgctggatgggatcctggagcagaaaaagggcatttaggtaaaaactaaggaaatccaaataaagaatggacttgagttaatgctgatgtatcaatattggtccattaattattacaagtgtaccattctaatggaagatgttagtaataggggaactggattcagggtatatggaagtctctgtactatctttgtaatttttttgataatccaaaactattctgaaaaataaagtttattcttttaaaagaacagcatcataagaggtgatctttctgtttagatgacctcttggtagtaaggtataagataactgtttaataaaagcacaaggagcataggtaggggtatgccatgagatctagaatgtgataatcctggtagtgcagtatcaattcttggacaagggcaattctaagtcaaatagacatgctgaattcacttgaagcagaattgaagaggtaggaaacatagtcatttagcataacctgaaacctttactccaaatgcattatgtaattgagattaaaacttgttgggaacatctaagtgaggggtggacaaccttgtttctgtaaagtgccagacggtaaatattttaatctttgcaggccataccgtttttgtcacaaccactcaactctgctgtagcaaaaaagcagtcatacacaacgcgtaagcgaatgatgagtgtggctctactccaataaaactgtatttacagaaacaggtggcagtctggatttgtcctgtggtctgtagtttgctgacccctgatctaagtgatcatactgcccagctccattaggtgtactataatatctatttcaaaaaggaatgcaatctgagcaagatagaataatattgccttccctctgttttcaaggagagtagaaatggcagcaatggagggacagaagtacatggtttacttgtacatatggtcattgtgcctctggaaaccccaaggtctatgtatctgaactcagagcaatttattaaccacactctttttagatttagtctgattatggtctttttgtttatttgtttattcttaactgattttactatgacacagtatacaaaatcctttagggaaaccgtataccacttctctttgcaatgaaatttctaatcagggcttaaagtagtattttcccaagtgcatgacaggtattgtggtaggctgtgtttttaggtggtaccccaataagtcattaaataaacagtaataaacagaattatatacagtcttctttcagtctttcttattaatacatttgagaaaatttagttttaatgtagcataaacaaccaacatagactctgtttttggtttttgtttaagtgagaatagccctcaagttcacagcatttggaaaggaacaatactttcctggacttttgtagtgctattgttttagtttgttctatttctttttaaggttaccttctgtttatggcaagtgatactgtttcctgttaatgaaagtggtataataaaaaaaaattacctaagtaaagagagtcaacttaaaggagatttcctgaagaaagagattcagattatgagaagaaattggtatgagagagattctccattgctggcttgaagatggaaagggttgtggcacaaactgagtggcccctggctgatagccaacaaggaaatggaccttcagtcctacagctgccaacaacttgaatgaggttggaagtggattcttccctacaacctgtagataagagcccagcccaagtaacttcttgatttcagcattgtgagaccctacgcaaacaacctagctgagacacctggactcctgacctacagaaactgttagataataaatgtgtgttttaagccggtaaatttgtagtgatttgttgtgcaacagtaaaaaactaatacagcctataggctttgttcttactgctcttcaaacagagaccatgccctcctccaccaccaccaccagttcccctaacactgtgtctcagttcttttagtggttacccttaaaatagcaacatgtattatatacttaccaagtataatattagtcagtctcattagccttatctcagccaatgcaaggatcttaggacattttaactttattccttcctgatttacatgttaatgtctatcatatattttaattctttctgtacttgaaaactcagcaagacattattattacttacatagtcagtttacttaggttcattcacatatttatgttttattttactcttcattctttgctgtatctttgactttctatccggggtagttttccttctgcctgaagtatcctttagaaatttgtgtagtgtggatctgctatgacaaactctctgtattgtcttaagtttactttcatcattgaagattattttccctggttataaaattatttggatggcactttattttagctcatcaggtacatcatcattctgttgtcttctgatttctattgtccactgtcaaactgtcacttctttggagatactctgtccttttattacctctggttattttcaggtttttgctttgtctttatttttctgtagtgtgtctaggtataaatttcttttgtttatcctgccatgattcagtggaatcttgaatttgtagatagacacatctgatgaaaattctataaaaagatcctatgaaaaattctcagccatttcctcatagattttctctaactcattctctctttcctctcctgctgggaccccagttgacatacattaaatcttctcattattttatctaagtttcttaccctaattctgtgtttttcacctttttgtttttctccatggtgtattctggatcatttattttgacctatatttctcttcattaattttattcagctttcagttcctctgaaacccatccattgagttttaaattttggcttttttttttttttttttttttttgagacagagtcttacttcatcacccaggctggaatgcagtggcgtgatctcggctcactgcaacctctgcctcccgggttcaagcaattcctgtacctcagcctcctgagtaactgggagtacaggcgcgcgccactgcacccagctaatttttatattttcagtagaggcatggattcaccatgttggccaggctggtctcgaactcctgacttcaagttatcaacctaccttggcctcccagatcgctgggattgcaggcgtgagtcactgctcccagcctgtattttttgtttgtttcaatacctcatgtattttgtcttttatttttgctaattctaagatacggtatcttttcttgagagcatctgcctaccaggtttaggggataggacagctcatggccaggactgctttaatccaactttaagatttaaaattccatggaccaccagataaaagagagccaggctccaagtccatgcgaggccaggtttgttttgggttcacctccaccctaggcgtagcctttcagaacaaaacagaataaggtggaggttggtttatcaaatggactgtaggtattcactcactcattcattcctatgaggccctatgagtcctatggggcagttgcttcccaggggtggagaattaccctccaggcaaaagtagttttatgtgattgaactcactactgtgagttccctttttctcctagatcatcaactggcaaaatttaagtaccttataagatatttgatactttcaaaaaatgatggagaggggaaggttttattttgtttttcagtaggaaggctagtgtaggttatctatttcatgatcattggaagcagaactttctctggcttcttccttgtttctttgttttggtagtgaaagggtacccttttggtatggcagacatgatactttttaggggagaagtaatgaagaagtacttgtacaatagcagatgagccccagaagaagtctcctgttgttcgtatgcgccagacacaaccctttatgccttgttatttcctgtactgctgagaaccctctaaagtagctattatctccatttcacagtataaataaagtagccccagagagattgaataactggcctctcattatagttagtaatgagtaatgggcacatccaggatgcagccccaggtcttttgagctatcaagcccttgctctgtttatgttgtggtggctttgattcaaagaggaaaaagttaaagtctatcaggggctaaagtgcattctctcaaggggactttcccataattatggggtgtttgcagctggagtgtctgtacgtccaggttgcctgggcttgccaaaaggaagttgtaagttcattgtaaaatattaatgtgcagggattcttggttaatagaataaattattttttctttaaaaagttcaatggtctctcagtggagctgcctaaaaaaattcatgttaaaacatcttgttcttttacatgatctcaagccatctgtttgcatctatgatagatattcttcatgcttcattccctatttcttccctactggttgatataaagtaaaggattccattaaaggacagggcatagtaattgcatatgtcttgatttttaatgaattgataaacagtcattggccaaaatgtttctaattttatgatctcatcctgtgtctatttactggtttaaatttgtgctcaaaattgtcagtcttcagtccagcattaattaggaaccatgaagttttctttgtcatctgagtcttaattgagtttatatacctctaacttcacaaaaaggtgatcatgtggataatataagtagtttatttccatttaatgatattttctggtggtaagctattatagtgattgagtgtcatatttcatcttgccagatcatacaaactgaaatttttaagcaaactattaaaacatccaaaccaacaaaaagcttgaatgaattctgagctaatcattgtcacagctgattttgtaaacctttaggttgaaaagctttctgaattttaggagctatgtttggttcagttctctgctattacaaaatactattttgtaaaatgcctcaagtttataaggcctattttaaatcattaaagtatttaagaacagatgttattacatggtaaaagttaaaaagtctgctttctgagtcttagttatggtatcactggaaggattttgaattagcaatcaatgtctctagtaaaacaattatttttgaagatgtgtttaaaaaatagttaacatgttatatgattttacagcttttgtttacctttcagtaattggcattgacaaattaacatttttatttgtattagataagtgaaaatctcccccaaggtatcagagagctatagcttcaaattaacttaaatgtaactatgctaatgtaagtgtctggaagatggcacccatgtttgtgcatcctaaaatggatttatctatttgtccatccagtagcatttactgggtcttcattagcacagtgtcaggcacagttctatatgttagagactcaggatggataagagaaaattcctgccttcagagaactagtttagtcaactggtaggtcctttattaagagctgaccttcagttatgcataaccgtgtttgtgtagaatactgtaacccctaactttcctatttgtgtaatatggaaggccaagtgatgaaattgttattaaaaacaccaattcccaaacagtgtgccatgattttaatatgctaaatagactgtggcaatgttagatttcctttttgactcaggaagactgtgagggtgagtgagtgagtgagtgaggatgtatatgtgtgtgcatgaggagacaacagagcagaacccctagtctagtatgctttggttagttggtattcatcaaaccccaaaagattgagaaacatcgttgtttgagaccctaaaattctaaggtagagtgaggaatcatggaagactacattatggacctgatgagtttaatgcctgccatttttaactgagtatgttgatcataaaagaactgtagcttgtactctcattttaaatagactggactccttctgtaatagggattgtcaacaacaacaataaaaagaatggactcctaatgctagccagaataaaataggttgaaaatgcacagatttccatttccagaacaaaaaggcgtagacttacttttcactgccccttccttcctctataaatataactaaatgtcctggaaattattcaactgacagcaataaagggattctgaaagttgggaagaaagcagagtagcttggaacctcaggactagaagtttgaggacaatgagtataagttcactgggttttcttttaatctcccattttctcctagactgggtgctggagagacctacaacccagaatcaccagtgggcaaagaaagcagaacaaaaagcctgctttctctggctagaagaccaggaaagggaaagcccaacaaagacctaagtgggagtgctcatccccactgtttcacagtgggtcccggtgggcactctgatctgtccccattatggccccagttgctgcgggagcagcaaagcccctggccctcccacccactgctctacaactggggccatgacgggtggtttgttctgccaactacggtgaagaccagaccatttcagcccctgtggtctgctctgtagacagcagcagcaacagcaaagcccaggctatactgcctctgctcccaactggccccagcaggtggtctcttctgtagggagcagtaagcagctgcagccgcagcgaagccatgtgtcttcctgccctccacctcatggcttaaggagacccaggccccagtaggtgaccccctccccctcaaggtttcccagcaatagcaagtggccctgggaagtaccttttatccctgcagatggcatcagcagggattgagtgggagtcccaacatcaccagaagaatgaagcacaccaaaatagcattgtgagggctcagaaaactaaactgtcattggaactgaagcccacaaaagtagtctagaacctacacactaaacctaagcagggtgaccaccctgctaaaatagaagatcctgtcatcaagtcttctaacaataagcaaaacatccagggtacaattgaaaaccacttgtcatagcaagcaccacaaaatatctaggatacaatatgaatgaaaaaagacatcaactgatgccaatacccagttgaatcagatatgggaatttgataaggtttttaattcagctgtcatgcaatttatccaacagtcagttgcaaattttcttgaaacaaatgaaaagatagaagatctcaggaaagtagagccaagagcatttcctaatgaactggaatgtcagagaaaaaaaaagggtcaagaatggtgccataatttttggctaagctatcagaaggaaatacggagttgccttcaactgagatagcaagaggagagattagaaagctcagttcactcagatgttttgggggatctgattgccctttctcttgtcttccatgctctcttgtgtgccttattgattagcaggagtcattacggagactgagaggttggtccatccatgggaaactcgttaaaagtgagcattactaacttgcatactcacatgcagggagtttggtttcttacctaacttgaaaaattccccaagtgtttagatgtttgattttactatgtcgcctaaacagttacatccactatactcttattttcaaattttttcccctaaagcaattattttccagatcatctactttatgtctttagacctagaaactgattactacaattatgattcaaaacctattttctgctgccctgcactgagctgagtaattgggtgtaaatggttatttcgtttgcatgctttgcctttgtgttaagtgttttttggttaaaagaccagaggttgcattattgcctgctgaatatgcttatattaacaattgtaaaaaagtaaattacttttgggagtattaatgaataggcacttaaattgcatagttaaatcttttccatcctttactaagcaaacaattggattaccccccataagaatttaattgacaatttccatgccacatttgggtagggaatatttcttacagacaaaagttgtttgaaatcagaaggttcttagccatttcaatttcataatttgtatttgtgttgttattataaatactaaaatttagattatcatgtccaaagtccactgataataaatgctacatgggcaacggggtggagtgtgacagaagagagaggtttcttaaccacaagactggactgctaatgtgtaatatgagtacgggggcaggaggtaggtattttatatggtgtttcccaaacttacttgaatgcgaaactttcattctttaaggactccacaagatgccaatttgggaaaccctgacttagagtgttaggtaattacatttttgtttctgttttacagtataattttgtataatcctgatgcaactgaaatgaatagagagaggcgtattggtgactgagatatctttcactagcttatttaaattagataatttaattttatttaatttagaagtaggtttacctggttatggagatctttaaaacatggttttaaatgagaagagattaacggtattccacagaagtatcactgaaataaaaatctcttaaggaggataacaacttcagagtgcagatattaacctccgccccctagctgcagagttgtgattaatggcttgcaacaatactattataggataatgtagcatttggaaaacaacctatgttagtggcatattaacagaacacaccccttagaaatatgatttacaatgtaatttcagacttccagacttccataattattagtttccatttacaaagagtggattatgcacagagaatttgacaattgtgataatgctaggtactagttaaaagtaattaggtttatgaacactagtagagaaggaggagtgaagaggaggagaaaaaggtcaatagtgaatttcaaaaaagttgtttctctactaaatattttcattgggccaatttctgatgtataggcccacatttagaaaataacaaaatgtgaatatatagctcttaacataaaaatgaaagttatggttttcttgcaccagccttaagaggagtgttcctgtttagggcagaccctgctaggccttcctgtttgttatctccacaagatattgtaccttaagagcttgcctttagcactttttctttttcctttctgggcttcttacagtctttctatggggatgtttccagcagccccttggggaggggtttggggatatattcatgttttctggggctctgtcctctgtatcctgaagtgctgtcattagcagcaatggcttcaattacctctcattcactcatgctacctagggagtatagaggttaagaatttagatttcaaagttccatatgtttaggctccagtcctagctctaacatccactaactgtttgaccacagacaacctcttagcctcagtttcctaatctataaaatgaggctgatattatattagctatgatgacaaataaattatgataaataacaagaatctatgtaaacttcttagcagcatgcttgctgctgacatgttatattataaatgacagttgttgatgtcttcattatcatgacccgttccttgaactttatactcctatctatatgccctctataaatctctgcctggatattccatggaaaccaatattttccaaacatagccatgtgcttcgtttctttctcagccttctatcagttctttctcttgtaattcctttctcatttggtggtatcattcacccagtaactgttgccagaaatttgtaagttttcttacaactcaaccccaaccaccatctagctaatcattcactgtgttatcttgtgaatttattttcttaagtatctctctgtcgcctttactttatcacctcttgcttgggctaatgcaataacttcctgagtggctcccacccactccacaacgtctctcactctctgtcatagtgatctttggtccccttttccttttccagccacttctcaccctccagtttttcatgctagcagtaccaaatagcttgaagtgcccagcacacacttttttttttttttttttttttttctgagacagagccttgctctgttgcccaggctggagtgcagtggcatgatctctgctcactgcaacctccgccttctgggttcaagcagttcccctgccttagcctcccaagtagccgggattacaggcatgcaccaccatgcctggctaatttttgtatttttagtagagacagggtttcaccatgttggccaggctggtctcgaactcctggcctcaagtaatctgcccgccttggcctctcaaagtgctggagttacaggcatgagccactgcaccctgccagggcccaaaacaccatgccctgtgttttgacttggctgtaggccattgcacaggctattacttacctctggaatcctctcctttccctgcttagcccaacaaactcctattcattgtttcaagccctccaggatgtccgtgtgtcatagaggccttctctcagtaccatgctatccacagatttttaaaactcatagtgttatactatttctatactttataactttacactaacattatatataacgtatgtatacatacataatgtatatatgtatgtgtataatgtatatatacatatgtatacatacatatatagtatatatagtatatatacatataatgtatatatactatatattatatattatactatatatactgtatgtatattatactatatattatatgtatatattgtatgtatatatacatatatacaatatatacattatatatacatatatacatgtaatatatatacattatatatgtgtatatatacatgtaatatatatacattatatatgtgtatatatacacgcacacacatatgtcaacagcagcctactagattggaagttccctgaggacaagaattgctttattaatctttttcttgtttattctttatattctttgtcttattttcattggggaaatgaggtaaataagataaaatgtgcaaatgtcaatagaatttttaaaatcttagtgctttaatatttatttttgatttagctaagattgcctaaagtgtgtaaccaagtcagaattctcacttttgtaaggtttatcttcatatgttttcttgcttgtttctttccatgcatgtctaatctccttcttcacatttcttatgttataaaaatcttttttcttctctattaatagttcttgatatatcctccatcaagtgtgagctaacaaagacctagaatcgatgtccctctacattggctctaaccccagcccttctcacacacgcatgcacacgcacacacgcacacaaacacacacacacaccaatcaaattttccagaacctttgctttgagcagaaattgccttatgtgactggcagtcctctcataaaagtagtaaatgatgagtgtattatagttagactcagaccagaagatggtgtgctacatgaaatctaaagtgaagtctactaaacttcactgaagtatcaaggtgtgacagaggtactaattatgtcaatataagtactgagttagtaaatgctagtcttaactctgaattgttcagctttgacaggtgagctagatttgttccattagcttattggagattcattgctagctgtttcaaataaacctcccccttctattttcaaggaatgatctgaatcatactcctttgtcaagtctttaattgttaacatttaggcaacagttcctgagacttttattttaataattttccactccgtgtgtgttttttgcggtagcaatgagtaggaaaacttttttttctttggtttaatcactgtacctaaagcaactcagcttggtgaatgtatgtaagcatatgtgttggagctggggatgggtaccagaagtgttaaaaagtgtcaggacagcatctctgttcccttactgctatcacattgattaccgcgataatcattgtcacagctgattttgtaaacctttaggttgaaaagctttcacaaagctatcacaaagcacaggaagacaaggaaaggatttattgatgaaattatatgcataagctcttctttagtggcaatgactacactaaatagtgttgaaatagggaacagaccatcgttatctttaatcggtagagtttttatataaatttatatatgtctataattttcaagattttattcttactgctaatgttgtcatttatagttattttattttagctttgtttcctttttgcctacccaccatctatgtccctcaattcttaacgtcagaactgtataaaaagtagtaggaagacacagatttagaaaatgggtagagaaatatctagaagcaccatgatttctcaaaattttatgtacttacataaaattgcgttacttaataaatgtatcaatggcttattcatttctagtttgtcatttttcttatatcattcaccagatattttttgagggcctaatgtgtactgggtactcattaagtttatattttaatatgaatacacacacataaatataacattacatattataagtatatatgaaataatataaatacatgtatgtgtgtatatatgtgaatacacacagtttattctcattattcatggtagttgtgttctataaagttaccatgaatgctgaatgaaccaatactgaaccattgctcctaggggaagtacaaggttgggttccttcaaacctctggtcacaacattttcatcaaccgatcaatacataaccttgttttatgtgtgcttctgtttaaagatactgcatgtaatatatactgttgattcattaacattgaactcacagccaacattgttataactcatgcctgaaggaagcttccctaactcacgtattttccccataaggcacatcacagccttcttgtgcttaggaacactagacagtcccttcagcactatgcttggtgaccatattaaacagcaaaatcaccaagaaaaagcgcaaaatgcaaaaaaatgctctaaatagactttgaaaagatgacttgttgatggcatgagagctgaaacaagaaggcagagcatcatcttgtttgccctcagctggcatcatgcacattgggtgattcaaatttttcaccattacatgcgtgcctgtaaacgactgaaagtgccatgactgttgatttgggggttataagtgaattttaccaagtaggcgaatttacagacatgcactctgcaatgtaatgaggatcagctgtatatcaactttgtgtgtgtgtgttgtgtatatatgtgtgtaaaaatttgttcttggccttcactttccccatctttgtcttttcttttttaaatcattcacggttttcctacgtatcttgtggtacattgcacaattcattataaatgtaatggggcttctaggcctgttgttatggacagaaatttcattgcgtttattaaaggtttcctgagacatgatgtgtttttgtttatagacctctcatagggtgaaaatttaacatgtaactccaaagtttatatgtagcaactcaaagtattattttaaatttattacaattagatataaaattacaactgacaattcatattgactttattatgtttgagatgcagtgtttttttgaagtgccttcaaaagccctttgtgctcctccccaatcacaaccccctccccctcaaaccactatcctgccttttatattaatctttttaaattctctttatagctttaccccctatgtttgtatctctaaggagtatattgtttaatcttttagaactgagtagcaaacacaaacttagctgggtaaagaaaggacaatattactactattgtatgaagacttaggagaagagaagctgaacaagctcttgttcatagtctggcttcagatgttctgagagtggttaggagcccattctgggaagtcggttggcaaggtcatgcacaaataaatcccgagacaaggggctcttcacaggcaggacatttccgctgtagtgcaggatagggggaggtactgagcacccagcaggaatttggtggggggcactggctgccctgcatttcctgctcttcagctccctgatgcctgcctcccattctcaggaataggtcaaagcaggcactgctgtagggtgaaattaagagtcctctgctagtctaggcagcagagaaggacagaaatctcctcagccaattgtcaggaaaagaaaaacagaagaatctggatgcagctcacctacctattctgttttcaggttaaaaaggtggcccgtggcagtggaaaactgatggctctcagtctggattggttgtcctctgtgcctgaggcacagctgtcagcctgagatttcccttccttgcattcctggggattcccttcatctctcttctgtgttggatctcctatttgctgtctccaggcatgctttttattggtctattcttgttttagcaaacacgtcctacaataatttcttcagaaagtgtgcatggcaagtaatttattgaccttttttgtctgaaaatgtccttatggttaatgatggtctggctggatgttgaattcaagattagaaatcattttccttcatgattatgatggtgttgctctattgtcttctagcgttggcattgagagatccaaagctattctgggtgaattgtgtcatccttcctcgctgcacatctttacccccacttctggaaacctgacaatctccttgtccacagtgattttaaatttcacagcagtgtgtgtatggacatgggtcatttattttgctgagtacttggtgggtccttttaatttgagctccttatgatttaaattctgggaagttttcttggattattcccttaatttcttccccttcattttctttgttatttatgctctgcttttcccaaattatcggccaacgcttctattgataaatttctctgtgtgtttttcaagggctcttttgttttctgaaagttctggtttttgtttcacaattgtgatatctttctgaggatattaatggtaatttgaagtcttattgtgtagtgtgtttcctctaagttgctctttttgtttgtttttggttctatcttccaaattagagactcttcagatgtcttaggagccttggttgttgtatacttatgattagaaatagagcaatgattctcaactgggggcaatttgaaccttccgtaccccaggaggatatttggcaatatctggaggactttttggtggttaaagctgcagggggtgctatgctactagtatctagtaagtagaggctagggatgttgctgaacatcctacaatgcataggacatccctgcacaacaaaaaattatctagctcaaaatgttaatagtgctgatattggaaaccctataatagagggcctcaaagctgattaagagagctccgaaggtgcaggtggaacgtgttgactttgggttttgctggaggatgatctagttgagtagtttggagaacctcttcattatctttaggtcttttcttctgagctagtcagatattcaatagaaaagtctttcatctcctgccttaagggtaaagatctggcttccaatattccccctgttagtcaaaaagggactcgggctgtctgcgttcagtgtatatgtgaccacataatacccttgcttttcatataatacccacttcctcaacagccttgtgtttccagttgtgagaccctacagtttggttttttttttttttttttgagacggagtcttgctctgtcacccaggctggagtgcagtggtgcgatcttggctcactgcaagttccgcctcccgggttcataccattctcctgcctcagcctcctgagtagctgggactacaggcgcccgccaccaagcccagctactttttttcagagaccctatgttttatttactctttccagataattaacctgttgggatgagggagcggcagttatccatggtatggagtacaggagaccacctagggctctaactgcttctctaacacatttcattcaaaccttgttactttaactctaccctctcttcacttccagttccagagttatctggaacccattcatgagtttcttggggattctacagtatagatgggtttggttctgaactttccttattatctctttgcagttcagcttttccaggtctgccaagtcaattaccactctccatctgctttcttggattccaaatttaattattactattatctcctctcttgtactcccaatcctttttaaaaacccctttggtatcattgtagtggagtttggatagggaaataaattagatacattgtgctcaatctatcccatgatcctggaaaccaacatgctgtattctagcataatttcatttaattctagtcttattttggtatatttacctttgttatcagaattatttcctagacttaggttttcttcacataaatgaaaactagaggatattagtctgtgtctgcatagggacataattgaattcttttcaaaaccttaggggatattgtagtgatatattcacttctaacatattctggtttaatttacctttttgcttaaaaacatagactgctgtaagcagccatctgcctcaagtagaaccttgttttaccatcccaatcaatattcagaatttgtaaagagttgaataaagaatatatatttcattaaatctgaaatgctgtcaattatctttttccatttttaatacggtcataattagtggaaatatgagaaagatagttgtttatgatgacggcttataactatctctaccagtattttcccccacataaatattcaagaattgactgtaccttagatttaaaattttaagggtgatttcaaacatcaataaaatgtacaggccagactgaaacctatacctcctgaatttttgctgttccctaaactgtcatccaagcataagtaataagtgtaatatagtaggtgtgttacactactttatcactcctccctttttaagatgggaaaccaagccaaattttaaattttttatcagtttctgctgagtttccagttaatgggttaaatcgcaaaaacctcaaaacgtattttagtatctttttagggtgttaaatttggtttaccattgttaaccccctggatgtcattgacggacagacccttaaaatgctttacttgtaacctgtcttcaggtcttcagtagttcatagatataattattttctttgcctcgtactataaaattaaagaattggggatttgatttgatttttattcacagatttttaaaagtttgtgttttgttgtctaagtattctcttttctccctagctctattaattttattgttactaaaagaaaaggggggagaagatatgctttcttcctcacctttgttcaagcaggaaaaagtaaagaattgactcgattgaccatgaacaatcaaccccacatacagatgttgggaagtttccaaaaagatacagtgaattgaagcagactattcaaatgtatcataaatagagtcccaagggtttatgtgtggacaaaaaccaattacatgaagcatttcctgaaattgcttgctattgtcaggataagtaatcagaagtaagacatccaggttgagaatgaaaacgtttgtccctcagtttgtaatattgtcttctcacagaggaaaatctttgaacagttttgagggattatcaaaaggatcctctttctgtagagttttgaaagatatattattaccatttcttttcctcccaggttagcttttttaggttgcttgaaaagagagatttgaagctgtggtatagttgatgtcctcatgatgtcatcttggataaatgtttaagtctaagattaaatttagtagttcgtcctgtagttgaaagaagaaaaactttaaggccagcagtatcacaagtgtagtactgtaaatgaagaacttttctctatctgctaattgagcacatgcatctaggtgtactgtttgtacctgtaataagcgaatgaaggtggtttttttgtttgtttgccttctccccaggagggggaaaatacacgcatgtatacatgtacacatgtatttaatgaccaccatattaaccttcaaataaaccaatcacattgctattgcattctgtattttatagtcaattcacacacacacaaatctatatttggattatcttaactgagttcagatatttcttttataactggtaaccacagggaaccgtgtgtgtgtgtgtgtgtgtgtgtgtgtgtgtgtgtgtgtgtgtgtgtgcgcgcgcccgcgcgcgcgcgcatgttccctggaccagggtatgggcatctttaaatcatctcagctgattcaactgtgaggtctgggtcagcaaatagctagaccagtggctgtgctcatagaaattacttcctttcctctagtaatttcaaacaattctaatttgaagtttgaggaaaattaaggatttctctgtgatttcaggtgaaactggagagggttggagaccaaaccacgcaggcctttctctttgtaaagtgtttgttcaagtcttttgcccagattttattggagtgtgttttttttcttattgtatttacaagttacttatatattttggttcttgacttggactgtatattgcaaatactttctctctctctggtgttttaaacagggatatcatatcagattttcattttttaaatatcattacaagaatgaatgggagaaacaagtttttcagtggttctagtagaagatggtaggatgtgggacatggagagaagaggacaggttcaagagatatttgagataaactcagtaggatttgttagtgatgattaggtaaatggtgggtaagatgagagggaagtgtcaagaatggcttgggtttctggttcataagaataccaccattactatggacttcacttattttgtttaagatgttgataatctatatagaattgtacagtcattatttgccttgagcataagactactatttagaatttttaaaaaattactgcaaattgcaaatttattggtcatttttatggttttggtaatcttttaaaattatctcatgaattatagaaaaatatgttggaagttatattacttaaattttattttgaaaactgtgttcaatttggagtctaaagtagaatggcaaacattatctatattatatagataatgaaacagtaagacattaatgggaaataggaacttaagagaatcaatgaattaaaattgactttttgttttataggggtcccttcagtgttgtacgacgatgtatcaacagagaaactgggcaacaatttgctgtaaaaattgttgatgtagccaagttcacatcaagtccagggttaagtacagaaggtaagagatggatttcaagtaagttatttgatgtctggctttattccatctccaaaatccatttaccaacctaaccttcatctgggggtggggaagcagagggtatgatgtagagggaagtgggtggagacagtttaaactctattctagtttgtcagaattctaggacatagtatttgaaagacagggtaatttacagagttataaaatcatctaggatttctatgggcctatgttttttgactaggaagaaagcaaaaatctgggctttttttttagggtctaattttgaattatattgtgtgggtcatgggatgggaaaggaaggaggtgaaataatggcaagaatgataattgaagattcagaagaaacttagttacctcaaaatgcatcacttactacctttaggattatgatttagtggaatcaaaagattcatatctcacatttggcttaagtcacatatgatatatgtgtaaaaatttgaaaggtcagtactgttaggactttcaggacttaaaattttgtttcaatacattattatagataatcatatttatatgtatatttataaacagtacgtaaacattttaaagttttattttgtttgttttttaagccatagtttcatgtaactgtgacatacatgctcatacttcagatggcacaattgatcatgatactaacttttctaattagcccattactaacttttcacttttccacagttcagtaaaatatgaatccttctttagtccttccctttttaatcccaagagcaatacagttgataatttagattggaaaatctagggcagtgtagcctatttatattttatccagttattttactttgggaagtagaagcccacatattgtgagcttcaagtttgtctgttcctggagatctttttttcttttaaatacttttgtgaccctttgaattattattattcatataatgattatggaagattcttagaagttgctactcacaaagaataactgatttgtttttagtgctttaatatttaaaatattatggtaagatttagagattttatattttatggttttatgctctagaattggctattattgcttttgaatataaattattttataaatctagcaacatttaaaattgacttttaagtggggtttagaacaaaattatatttccttacacctttaactgcctttaagcttaatattctatatttgatttttctctacctctgttgtctgaccaaatactgaggtaattttgtataaacctaattcattaaacatatgttctgatcctgtttataaacttagtaagattccaattttaaatcacaagtctaagtcagttactcagttaccaatattaaattggaataatataagccaaattctcttaagcattgttataaataattaaaataaatattaatagcttctttttcaacccaaaattatcaataccagagttttgacttatctcattgttgtaccaaattctaaatctccccaggctaaagacattctttcgggaaacaattacttaccttctcattggctgaggttgtttattgacagatttcttcagccagatctcttgagctacagactcagaatgccaagctgaacctgtctcttgtcacttggtcagggagtcaaattccaaatttacaaaaggggaaagtacttagtatatagttcatatacctggtattaagtcctgtcttcatttaatataatatatgggagtctgttgctgaagttatagctcactccttcattactttgccattgctttggctatataaatgtcttcaagtcctattctgaagacaaagccacccattctattgatccctcatactcttaagcctccttgaacttaatagaatcatgtactcttttcatatccttcctatatggtaggaccacagcgtatagatattaaatgacatccagttggatttgggatattactcatgactttatctgattttggtcggagtttagtggtattcaagtgaaaatatgcaattggccctttatgtttatggcaccagaattaagtttttccatcttctttagcacagcgactcagtataaagttaggaaacaatcaaaattccatctccaccacctctacctttttttcttgcgatgggattcccatgccctctgttgctcatgttcacacaagctttcttgattctgacttggacacattttattataagatgtataatatatgtaataaatagtaaattatttcattatataaagtctctgtgaacagtgcttcccctccctcaacttctttcaacccttttccagtcactatgggcaacacatcttaactcctctgctcttctggtccatttacaaattgttagggtccaaaaatgacctcattcatggcttagcatagaaggagatgctacataagaagacacatattttgaagtaaaatttaacacagtaaaaaggaatccataagttcaaataatatctagaaatatctatatttaccgttacattctttcccaaataaacttatctcttaagcaacagataatttaaaatctattttattctttattctttcctttttgtttcattttattattttatttttggcttagtggtttgtttgctctttgttaattacctcaatattttttcttgttttcctagtgtacttgtattcaaatacattattgagtgaaataggtctttaaagggttatctaagaacctaccatatgctatttatttggataggtcattataatacaaatgataaataaaaagagcccctagccttatgggacctatgttttaatagtctccaaccattgtttataacatggtttttattaggaaaacaatgtgtaataaattcgaagtaaatcatttacaaattaattttttttgagatggggtctctctcttgcccaggccagagtgcagtggtgcaatcatggctcattgcagcctcgacctccttgggctcaggttatcctcccacctcagccgcctgaatagctgggactacaggcatgcgccaccacacacagctaattttttgtattttttgtagagatgaggttttgccatattgttcaggctgatctcaaactcctgagctcaagtgatctacccacctcggcctcccaaagtgttgggattacaggcatgagcctccactcccagcccacaaatttacttttgaaatgaaatgtgttgatttgttgcagaccacctgtacgttttaatattttaaattctcattgctctaatgaagatgagatattataattggtgaggctaaagatgagacatttcataacagatgagatatttttgaatatctgttctctacttttgccatcaaaatcataatttttattttatagggcttcttaacttgcaggttgccgactattcaataatcccttgaaatagtaagcagaattatgtttatttttttagagagtccatagctcttattagattcctaaaaaggcatattattcctaaatgatttagaatttctcctttcacatgtatgaaaaaatgaaattcatgcttatgaacatgagatgaataagaagtttctactaaatcaaaactggatgaatttatattaggatatgacttctgattgggggattttttatacttacatatacagcttccattaatgaatttcctagattattatcttgaacttttaattaatatactttttgtctcttactctactgagccactaatttagagtttttgtcttaaaaatagatatcaaaattaattcagacaaattataataaggaaactaaaggaaagtaagatgtatagaattggaaactaaattatcaaagttctgagttcttgataggactcaattctttatggtttattataaaagtccaaaattaactgtttttatttgggagtattataaattgtgttctagaaagagtatattttgggctccagtttgcttagtcttcaagaatgtctcattctaaagtcccagatagtaggtgatatcagtgaaattgaagaagtaaggaccttgacagttctcacttttcatttaaaaaaaagagaaaactgacagaaatgtcagaatcaactttttcagggctctggaaattgaccaaaggcttacagctatccaggaataatttattcaagaaaactgactgattcttagtaacaacagtgaacttcatagcattgtataataatttgtcccattcacatccccctttcttccagttctgtagtaaccttgaaaacaaacagttcacaatcacgatgaaaaccagcaacttgacagccatcaaaggaggctgaatggggatggagctcctctaaggccgcattcccataatattgtcatttttttacttgtctggtagttccctggaagacttgtcttagtacatttgtgtttctataaaggaatacctgagagtgggtaatttatgaagaaaagaggtttatttggctcatggttctacaggctgtacaagaagcatgacaccagcatctgcttctggtgagggcttcaggaaacttccagtcctggtggaaggggaaggggaaccagtgtgtacagagatcacctggcaagagaggaagcaagagagagatgggaggtactaggttgtttttaacaaccagttctcatgataactaacagagtgagaactcacttgttactgccaggatggcaccaaggcattcatgagggatccacccccctgactcagacagctccattgggcccctaccttcaacattggggatcaatcttcaacatgaggtttcaggggacaaacatcccaactatagcaacccctcttgcaataccatctttaattggcctgactcagagatcacccagtgcaaaaaaagtttcctctgggggcatttgccaaaaacctttagaggtagttgtttaatttcattgctgcctgaggcatagataacagctgggcaaacaaaaagctaacctaaaagcttaaaacaaaaagctagctaatgagatgcccatagaggctttgaaaaagctacaacgtattctctagaaaatactatgttaagaaggccatgcacatatataaggctatgaacaagctcaggaaaaatctaagaaggccttaatttctcacctctagctgactttcaggctacataaacaggaattgaatgataaggtagaaatgtgaactccctgactgagtgttgaaggtatgccctacacatccacaaaacccttgagcaaagactaaactaaataagcagagacttaagtggccacacataaaaaagaatacagactgcagaatgtgttcccccaaaaaatcactaagcaaagagcaggagtaacaataaacagcaacaataaatcctgcagaaaaggagattctgatttttagagttgacacataatattatttaagacactcagttttcaacaaaaaattatgaggcatgcaaagaaacaagaaaatatagctcacactttggggggaaaagcaatccatagaaactgttcctgagcaaacccagatgttggacttactagaaaaagagttaccaaatggaaagtatcaataatgagatagaaactataaaaaacaaaaagagaaaatcaaatcaaaattctggaattgaaaaatacagtaactaaagaggctcagcagcagatatgagcaggcagaataaagaatcggaaccagaagacatgaagataggttcattataattatctggtcttcagaactgaaagataaaagaatgagcaaaatgagcagagcctcagagacctctggggataccatcaagcataccaacatatgcataatgagaatttcaaaaggaatggagagaaaggagtagaaagaatatttgaagaaataatagtccaaaacttcttaaatttgatgaaaacataaatctacacaaccaataagttcagcaaactccaagtaggataaatgcaaaaacaaaccataatcaagttgtcaaaagctacagacaaggggagtatcttgaaaatagcaagggagaactgaatcatcacatacaagggatctataaaaatattaacagcagatttctttcaaaaaccaaggatactgaaaggcaacaggataacattcaaagtgctgaaagaaaaataatatctaccaagaattctttatccagcaaaaccatacttcaaacatgtaggataaatgaagatattgtcagataaagaaaaacggatagaatttgtcactagcttccttgtcctacaaggaatactaaacgtagttatttatgctaaaaggaaaacttatttttttaatttttaatgtttatgggtacatagtaggtatatatatttataggtcacatgaaatattttgatacaggcatgcaatcacatcaggataaatgaggtattcatcacttcaaacatttaacctttgtgttacaaacaatccagttatattctttcagttattttaaaatgtacaattaaattattaaattatttttgactgtagtcatcctgttgtgctagcaaatactaggtcttattcattctttctattttttgtacccattaaccatccctactttccccaacccctactagccccccgcccccccaactaccctttccagcctctggtaaccactcttctacctgtatcctcctgacttcaattattttaatatttagctcctacaaataagttaaaacatgcaatgtttgtcttcttgtgcctggctcatctcatttaacataatgacctccagtcctatccatgttgttgcaaatgacaggatctcattcttccttatgactgaatagtaccccattgtgtatatgtaccacattttctttatctattcatctgttgatggacacttaggttgattccaagtcttggctattgtgaatagtgctgcagtaaacatgggagtgcagatacctcttcaatattctgatttcctttcttttgggtatatacctaggagtgggattgctggattgtatgatggctctatttttagttttttgaggaacctccaaactgttctccatagtagttgtactaatttacattctcaccaacagcgtacgagggttaccttttctctacatccttgccagcatttgtcactgcctaacttttagataaaagccattctaagcatagtaaaaggaagtgtagtaaaaggaatgacaagaaatcaaagtagaacaccataaaatatctatttaacacaaaaggaggcagtattggaggaatacaggaaaaaaaagacagatagaaaaccagtagtaaaattagaaacataaattgtaccttgtcagtaataatattaaatataaatgaattaaacactccaattacaaggcagagattggcaacatggatgaaaaacaggtgagatggtatctcatgtcgttttttgctgtctggaagagacatacttcagatttaaaaaatacatataagttgaaagtaaatgagtagaaaatgatatactatgcaaatagtaaccaaaagagctctgaagtggctattactaatatcagatgaaatagactttaataattaaatcagaaatttaatagtcaaacaaattgttactaaagaaggacattttataacaatagcagcattaatccatcaagaagatttagcaattataaacacatatgcacctaagaacaaagctccaaaatacatgaaacagaaaaaggcagaattggagggagaaatagagaattcagcaataataattggagacttcaatacctgacttaataatggattcaacaactaaacagaagatcattaaagaaagagaaggtagatttgggcaacactagaaaccaactagacctaacagacatctgtagaacactccactcaacaacaggagactatacattcttttcaagtacacatagaacattatctaggatagactgtgcattagcccatcaaatatgtctccatcaattttaaaatatctgaaatcatacaaagtatcttctctggccacaatggaatggaatcagaaatcaataacggaagcaaatttgggaaattcacaaagatgtggaaattaacatagtagccagtgggtcaaagaagaaattacaagaatactttaaaaatactctgagatgaatgaaaacaaaaatataacttaccaatatttatgagatgcagcaaaagcagtgattagggggaagtttattattgtaaatgcctatattgaaaagtaagaaagagctcaaatcaataatttaacctttcactttaagaaactggaaaagaaaactaaacttgacaggcagaaataaggaagtaataaggattataggagacatagagactagaaaaacaatggaagaagtcaataaaaccaaaagttgtttctttgaaaaggtaaaaataaaattgagtaggctttaaactgaccaataaaaagagacaactcaaagtaataaaatccataataaaggaagggacattactactgaccttataaaaatgaaaaggattataagagaatatgctgaaaaattgtatgccacttaattagatagcctagattaaatgagctaattcctagaaagaggcaaactaccaaaactgactcaagaagaaatagaagatctaagtaaacctgtaataagaaatagactgatatgtactcaaaattttcccataaagaaaagcccaggcccagatagcttaatggtgaattctactacatgtttatagaattcatataattccttcacacatatttctgaaaaataagagagggaacacttctcaactttttgtataaggcctgcaataccctgataccaaaaccagacaaagatattgtaagaaaggaccaatatcccttatgaatgtaaacacacacattctcaagaaaatactatcaaactgagtttagcaatttaaaaaatgttctgtagttcttcagaaagttaaatctaaggttatatgacccagccattttactcctagacatatgcctaagagaaatgaaacatatatccagataaaatcttgtatatgaatgttcatagcagcattattcataatagctggaagatagaacccaaatgtctaccaactgatgaatttataaactaaatatggtatatccatacaatggaatgattttttcaaccataaaaaggaatgacatactgatataagctacaacatgaatgaatcttgaatatattgtgctaagtgaaagaagcaagtcacacgagattacatatgttctattcatgtgaaatttccagaataggcaaatctatcagaaggaagtaaattagtggttgcccagggtatggagaaagatgagatggggagtgtctggtaatgggtatgggatttcttttcgaagtgattaaatgttcaaaatttgaacacagtaatggttgcatgactgtgaatatactaaaatccattaaattgtatactttgtggacaaattgtatgataagttaattgtacctgaataaggattttttaagtaccacgagtaagtagaattataacagaaattcaagcttgtttaaacatttaaaaatcaacgtcatacaccttattaatagaaaaatgaacaacagtccacatgatcatctcagcagacaaaaagcatttaacaaaattcaaccccctttcatgataaaaacactcaacaacctacaaatagaagggaatttctttaaccttttaaaagacatctaggaaaaaccaaagtctaactttatatttaatgttgtaagataatgctttcctccgaagatcaggaataagataagagtatctgttctcaacatgtttattcaacattgtactggaaattttagccaaggcagttatgcaagaaatagaaataaaagcatccagattgaaaaggaagacttaaaatgccctctattggcatataacattatcatgtatatatgaaaatccaaagaaattcacaaaaagacttagatgtaataagtgagcttagcaaggttgcaggatacaagataaatatacaaaaaccaattgtatttgtatacacaagcagtgaaaaatctaaaaatgaagttaagaaagcaattccatttaccacagcatcaaaaagaataaaatacttaggaagatatttaaccaaggaagtgcaaggctaataaatggaaaactatattgttgagaaaaattaaggaagtcctaagtaaatggtaagatctctcgtgtttgcctactagaagacttaatattaaagtgaaaatatttcccaaattgatctatagattcagtgctatctctatcaaaatccctactggcgctttttgcaaaaattgacaaactaatctaaaaatttacatggaaaagcaaggtaccccgagtagccttaacaatcctgaaaaacaatggacaaagttggagtactcacatttttcaacttcagaattttttttttttttttcctggagacagagtttcactcttgtcacccaggctggagtgcaatctcggctcactgcaaccttcgcctcctgggttcaagtgattcttgtgcctcagcctcccaagtatctgggattacaggtgtgtgccaccacacctggctattttttttgtattattagtagagatggggtttcaccatgttggccaggctggtcttaaactcctgacctcagatgatctgcccacctcgcctcccagggtgctgagattatagccatgagccactgcgcctggcccagaattttctataaagctacattaatacacatagtgtaaccctggcataaggatagacatatagattgatgaaattgaattaacaatccagtagtaaatccatatatttacagtcaaataattttcaactgtggtgccaagacagttcaatggagaaagaatagtttcttcaaaacagtggtattgggacaactggaggctgacatgcaaaagtttgaaggtggacctctaccctacaccatatacaaaaattaactcaaagtagatcaaagatctaaatgtatgagttaacaccatgcaattttaaaagaaaacataggcataaatctttgtgaccttggattaagtagtggtttcttcattattacacctaaagcacaagcaaccaaagaaaaaaatagataatgggattcatcataatttaaaatttttatgcttcagtagacactatcaagaaagtaaaaagaggctaggcgtggtggctcatgcccataagctcagtactttggaaggccaaggcatgcagatcacttgaggtcgagttcaagaccagcctggccaacatggcaaaaccctgtctctactaaaaatacaaaaattagccaggggtggtggtgcatgcctgtaatccaagcttcccagctactcaggaggctgagacatgagaatttcctgaactcaagaggcagaggttgcagtgagccaagatcatgccactgcagtccagcctgggtgacagagcgagactgtcccccccacccaaaaaaaaaaaaaaaacaaaaaggaaaaagataatacacagcattgggggaactatttgcaaatcatatatttgataatctagtatctcagatatacaaagaactcttgaaaatcaacaataaacaaaaacagataacctgattaaaatgataatggatttgaatagacatttcttcaaataatatttacaaatggtcaataaacacatgaaaagatattcagtgtcattggcttttaggaaaatggaaatccaaaccataatgagataccacttcacacctactaaaatggctgtagtaaaaaaacaaaacaaaaaacaacagcatgtgttggcaaggatttggagaatttggaaccatcataaattgctattgggaatacaaaatgatgtaaccgctgttgaaaagcttggcagttcctcaaaagttgaacttagagcaccctatgacctagcaattctcatcctaggtatatacccaaaagcattgaaaacatatgtacacacgaaaactggtacatgaatagtcattgcagcattatttgtagcaggcaaatgtggaaacaaaccaaatggtcatcaactgatgaatgggtaaacaaaacgaatattacatacaatagaagatttattgttcaaccttaaaaaggaattaaaggtatgcaaaactggttcaacatttgaaaatcaattaatgtaatccatcacgtcaacaagctaaagaagaaaaattatttgatcatattagtagatggagaaaaggcagttgacaaaatctaacaccctcaacttgataaagaagtctacaaaaaaaaccctacagctaacatcttacttaatggtgagaaactgatgtttttcccctaaaattgggaatgaggccaggatgttcctgttccctactcctgttcaacatcctaccagaaacccttgctaatgcaataagacatgataaggaaatgaaagctatacagattggggggaaagaagtaaacctgtctttgttctgagatgacatgattgtctatgtagaaagtcccaaagaatcaacaacaacaacaaactcctggaacaaataagggattatagcaggttgcaggttacaaggttaacatataaaagtctatcgctttcttacatgccagcaatgtgcaagtggaatttgaaatttaaaatataacacattatattaacaccaaaaaattgaactgcttatgtataagcataacaaaatatatacaagatacatacaaaggaaatttctaaactttgatgaaagaaatcaaaaaagatctaaataaatagatactccacgtttgtggataagaagactcaatgttgttaagaatcagttcttaccaacttgatctgtagattcagtgcaatcccaagcataatttcaggaagttactttgtggatattgacaaattgatctaaagtttatatggaaaggcaaaagattcagaatagacaccatattattgaagaataagaataaagttggagaactgacactacctgacttcagtacttgacttcaatactttaaggctacagtaatcatgacagtgtagtattggtgaaggaataagtaaatagatccatagaatagaatagagaccctagaagtagatccacacaaatattgtcaatagatctttgacaaagtagcaaaggcaaaccaatggaaaaagtcttctcaacaagtggtgccagaacaactggacatccacttgaataaaaatgaatttagacatagaccttacatttttccaataagttttttcataatacttttcccctaagaccaggaataaggcaaagttgatcactttcaccattcttcttcagtatatttctggaagctaccacagtaagggaagaaaggtaaatataagcatatagattggaaagaaagaaatgaaactgtccctgtttgctgatgacatgacagtctacgcagaaaaattaaaaggaatctacaaaaaaaaaaaaaagactcctagaactagtgagtgcgtttgtcaaggatatgagataaacatacgaaaaatcagttatttctctatactcgcaaagaacacctggaaaccacagttaaaaacatagtaccatttgcagttgcttaaaataaaatgaaatgcttaggtataaatcccacaaaacatatacaaaccttgtatggtgaaaactacagaactctgatgaaagaagttaaagatctaaataaatgaagagatgtactctgttcagggattggaagactcaacatagtaaatatataatttctccccaaatctatctctagatttgacccaatttcaattaaaatcctaggaagattttttatggatatagaaggcttatcctaaaatatttctggaaaggaaaaagaataagaatagctaaaacaattttgaaaaactatgataaagtgggaggaatcattctacccactatatagatttatatagctataggaattaatatagagtagtactggcagagagatagacacgtagcttgatggaacagattagattacccataagtacccccacacaagtacagccaaatagtttttgagaaagattcaaactcaattcaatgaagaaagagtaatttttttctacaaatggtggtggagcaattggacatccataggccaaaaatgaacctcaatttaaacctcatgccctataaaaaattaactcaaaatagatcatagatttaaatataaaacataaagctacatagcttttttttttgagacagagtctcgctctgtcgcccaggctggagttcagtggcgcgatcttggctcactggaacctcccatcccgggttcaagtgattcttgtgcctcagcctcctgagtagctagctgggactacaggcacacaccaccatgcccggctaattatttgcatttttagtagagacggggtttcaccatgttggccaggctggtctcaaactcctgacctcaggtgatccacctgccttggcctcccaaagtgctgggattactggcatgagccaccatgcccagccaagatacatacttttgaaagaaaatgtaccctaatatcattaggacatggagggagatgaagaattcttagacatgacactaaatgcacaattcgtagatgaaaaaagaaaaacaaaaaacctcaacagtaaaaaataaaacaaatagtccaattggatagtggttaaaagacatgaacatttttcccaaaaagggttatacaggttctaaacaattacatgaaaatatgttcaacatcattatccattagggaaatgcaaattaaagccacaataagatatcgctccacacttaatagaacagctacaataaaaaggtgaggccaggggcagtggttcaaacctgtaattccaccactttcacaggctgaagcgggaggattgcttgagcccaggagttcaagaccagtctgtgcaacatagggagaccctgtctcttaaaaaaaataagtaacaatatgacaataccatattctggcaaggatgcagagaactggatctttcatatatctggtgtgaatataaagtggtacagtcactccagaaaagagttaggcagcttctttaaaatactaaaacatacatttgccatacaacccagcaagtgtactcctgggaaatgtacatcctaaggaaatgaaaacttatgttcacagtaagacctgtaatcaagtttttatagcagctatactcgtcatagctaaaatttggaaagtaccaaaatatcctacaatgggttaatggttaaacgaattgtgatacatctataccatggaatcctactgagcaataaaaatgaaaaatctactgatgcatgcaactacttggatagatctcaagaaattctacttcgttaaaaaaatctcttaattgtcgtgtactgtatgatttcctttatataagtttcaaagtgataaaattatagaactggagaacagattagtgattgtcaggtgtgggacactgcaaagtttaggtgaggattgtgagatgggtgagtgggtgtgactagaaagggttagcacttggggtttttgtgggggattattatgtagcagttctgtatctctgttttggtggtgactacttgaatttacacatggcgataaaattgaatagctgtgcacatagacacatgagtgcatgtaaaactattgaaatcgaaataaagtctgttggttgtatcaatagtcagtttcctggttttgatattgtactactgttatatgctactatgggggaaaatgggttaaaggtacacaaaatctctgtactacttttgcaactttctgttaatgtacaattattttaaaattttaaaaaattgtaaggtttcccttatgaactgtatgctcttccatgaaagagataattagcccacaaatatttaggagtataggtaaaagcattttaactacaggttttggtttccaaacattccaaattgttctgtacaggcaaaccctgactgatataactgatagcatcatcaaaaactgtcactcgttttcctcaagaaacatgaatatttaatagatttaatttacataggaaatttgtattcattttgtggaataattactggtttagttaatgaatctctataccttccttttgcatgcagaaatcatttgccaaaaccttttatttgcagttgcattttcttagtgtcatcatttgcttgactatggcttgcaattgatattgttagaagtaatccagcaaatttcaagatattaaggcttatacttttgtttaattttgtcatgcaaaatactatagaatatgcttccagaacagtttgatcatgtatttttaaattcccatcccatatttatcaaattatagtttataaatttaatatttaaaatgaaaactcattctttgaaacattaatgaattatgttcattatgtgacataatacgtcacataatataaatgtgcaatattttttgagttgtcagataatcattttgagcattggtattattaattatagattcttaaggatgatgaaatccttaaacttggctagtatttaaaaaacgtatttgttaattgtggttctatggggaaaaggttttgtgtttcttggaatagtttgagcaaaactgctagagaccagcttctagctgctgtaataattttcaatgaaacacctccttttcacagttcctgatcataatagtcatttaattattgttttgctcattggctagtattttcctaaatgggatttcccttagatttttttttgtttttcttcacttttaaagcaaatattctttgtatagaatttcatatatttctgtagaccttatatctttttttccccacagggcaagttctatctgtagaccttagacaataaattatgagtactgttttagcaaactgtacatctttggctgtttttcctaatggttttgtgtatgtgtgtctgttttgaattttttcaggctaatgagagtcaattttaaatacgtctgtttcttaatgattaattttgctgtattatgacaagcatttctggataactatttacaatgagatacaaatattacaaatgtaaagtttatacttgtcttgctaatcagatcctgctattctgtgaaaaactgctgatgaatctctaaacctaagacaatttatagtgattatgcttgagatcaactgcatgggaaaagaaaacttacttctttcatcttgttttttgccttttaaaaaatagtgtagattacctacttctgaaagtatgtggctatttgttaactaaaatgactcatacttgttcaatataattctaggtgtaaacatggcttgatattacatgtaacatgttggccataatccccaatatcaacgttttatttgtaaatgtctcttaacctgaatttctcatcttatatgacttcagtatgtagatgaggaggctcatgtttatataatagagctctcaaagttcattggctcatatattcaatttttcttagtatcatcttaatgttacattcgggaaatatagcaatatgaaaaaaatgtgagatgagtttctctactcattttttattctgaaataaagcagcttttaaaaaatgtttttccaggccaggtacagtggccaggcatggtggctcatgcctgtaatcccagcactttgggaggccaaggtgagtggatcacctgaggtcaggtgttcaagaccagcctggccaacatggtgaaaccctgtctttactaaaaatatttatttttaatgtttttcctctactataagtggaatttgtgtttcacaagttaaaaatgatttttatcattgttttctctttttctatacaaatagctacctattttctttcaaatctgcattttgctagcttttacattatgtgacgtagagaattccttaggaagctgtgggaatagaaaatagataaagacaggaatttggtgggttgacataacccttgatatatgggctacagtagctggaaaattcagtctgtacactaggtacaagatgaattttggagtatacttgctaattaaaatttgagtctgaagaattagatgggggtgttcttagatgtattgaataagttactgttatcccatctatatgaataacctttggaaataacctaagaagtgtcttttgttaagtttgctctgtaagaaatttgtattacacaattaaataatacatgtcagatagaaaatataataaattctaacttagcagacagtttattcaaaagaattatcgcaagggggagaaactattgcaatagggagtggggtctattttaatagaacactctcaccataagatctatgagtatctcaagggttaggcaaaaaatatttttcttttatgggaggaataaacaagactagaaagaacttggtgggaggaagtgggaaggcctgggggaaggagagaagcgtaaccagtttgattaacaggcaacttcaaattgggtacaagagctcctaattgttcacaaaaacttctatacaatatcaatcacgaatagttttaagggaaccacttttcaaattcttacttctatatatactcttcgtaaagttgatatgcttaagaaaatgtctgtaatggacatagaagttctcctttcttatatcccctttcacaaatttttcttctctcattttactattgtccttcctcctacccatccagaatcttaattgtggtgcgttacaagatctgttgtaatatgtatcaaaatctccagggcgccaaacaaaaggacagtttgaaaattggcatcagtgttgagaaagtgaatgactctgaaagaccaataacatactttttcaagttagatctattcttgctttgctttcaacaaaattgatggatgaccttatcaatttgtaagttgatggattattaagagtaatttttgtggctcactcctgtaatcccaacacttggggaggcagaggtgggcagatcacctgagcctaagagttcaagaccaccctgggcacaacatggcaaaaccccatctctacaaaaaatacaaaaaattagctgggcatggtggcatgtgcctgtagtcccaactacctgggaggctgaggtgggaggatcgcctgagcccaggaagtcgaggctgcagtgagctgtgattgtgccactgcactccagcctgggcgacagagtaagatcctgcctcaaaaaaaagcataatttttattaagtcattataattcatggtgtataactcaaaaagagattgctttaacagaactccatctattcccgtatacttggtttttttcaaataggtttattgagatataattcacacaccataaaacactcctttaagttgtataattcagtggattttagtatattcagagttgtgcaactgtcattgctacctattttcagaacattttcatctcccccaaaagaaaccctataccttttcatagacacccactattttcccccctcccagcctctggcaattaccagtctactttctatttctatggatttgccttttttggacattttgtataaatggaaccatagaatatgtgttgcatctggcttctttcgccttacatattttcaaggttcatccatgtagtagcaggtatcagtactttattccttcttatgactgaatagtattccattgtgtagatatatatcgattcattagttgatgtacatttgggttgtatcagttttttagctgttatatataatcttgatatgaatattcatgtgtagttaagcctcgttattcaaggattctttatttaaaaattcacctacttgataatatttataacccccaaactcatactcttggcgtcacgcacagacaggtgcaaagtgacaacaagtttgaatcattcaacatgcacattcccagctaaggtcggacaacgcaacactcttctatcttgttgtttgggctctcataccataaatgagttcccttttctatgtctacttaattccatattttttcacatttttgtgttttttgctggtgattttgcttcttaaagtggccccaaagcatagtgttgagtgctgtctagtattcctaagtgtgagaaggctgtgatgtgccttacagagaaaataaatgtattagacaagtgtcattcaggcatgagttatagggctgttggccatgggttcagtgttaataaatcaacaatatatatgaaataacatgtctttaaactgaaatacacatgtgataaggttatatattgatctgtggacaaatatggtgcaaccagagattcacagtaacctgtattttccctaaggaacagtgtttctgtgtttcctcagtcagtgtttgtgttgactttatagaatataagtactgcaaataatgaagatcgactgtatatggtttcatgtaaacatacgttttcagttctcttgggtgtatacccaggaatagaattgctaggtcatatgataacattgcttgttttgtgaacaaggtttctcagcgttcacatctataaaagtgaaaataggaatagaatttgtgttgagccctgtcttattctaccacatgcaagaaaatgagatccttgttggactggtgtggaactggccccatgacacacaggaatgtcaccttttgtgacacttccatagacataacttccaaggacccctgaagagacatgcccaagtggaagaaatcaccacattcaggaaagtccaaagctgttcaattgtaattttcctagagtagattgttttctttgttattataccagctttccaccatctgtctcactttcctctttcccagttcctagatggccgctttatgggattgaatctagagagtttaagccttacatagaaagttgatgagcctacaagtgggttaaagcttagtgtttttttttttaggtttcgtgttttttaaaaaagcattttcatatgaactgttgcttttttatttatttatttatttatttattttgagacggagtcttactctgtcacccaagctggagtgcagtggcacgatctcagctcgctgcaacctatgtctcctgggttcaagcgattctcctgcctcagcctcccaagtagctgggattacaggcgtgcaccacaatgcccagctaatttttttgtatttttagtagagacagggtttcaccatcttggccaagctggtcttgaactcctgacctcaggtgatcagcccgcctcggcctcccaaagtgctgggattacaggcatgagccaccacgcccagctgaactgttgctttataatatctcaattgtttacttcttcaatagcatgaataatttactatataattaaaagattttagtgatagtacatcaaaaagagtagtatctgcaaacagaagcagttttgtgcttgtttgtagtaaagactctatctataactgagtcagtaagcatattctcctttttaattactgccatgtactaatcaaacactatttaaaatgccaggcatgttgctaggtgctgttcatatctgttgtcttatcttcagagaaaccctgcaaaaaaatactttatctacattttgcaactgaagattaaagaagttaaataacttttggattgatgcacaggaagtggtagagccaggtgaatccaagttggtctgtcttttggactgcaaaagctgtatttttcccacatctgaagctgttagccctcaccctttatatcctagtgcccagctactttatgtgtcctgcacccctaaacccaaaagcggtatgtgtgtgaagtgaaggtagagagttttgtttttctggatttgttttttcacagctttactctgaccacctagaaccatgcctggcacaatataggtaatacttattgagtgaatgaaggaatgccacgtaagttttgtgaatttactgaggagtctcgggatggtgcaataagagaacagtgtgacagttgataaacaaaggaaggtttctgctttttggcaaagattacatctgtaaaaggtaaataggctgagtaacactttcatggtcaggactacaaagctgggctataaaaacacattattctaatccatgtttatctatcacttcttttgtttttttttttttttttttggcagagtctcgctctgtcgcccaggctggagtgcagtggcgcgatctcggctcactgcaagctccgcctcctgggttcacgccatactcctgcctcagcctcctgagtagctgggactacaggcacccgccaccacgcccggctaattttttgtatttttagtagagacggggtttcaccgagttagccaggatggtctcgatctactgacttcatgatccgcccaccttggcctcccaaagtgctgggattacaggcgtgagccaccgcacccggccatctatcacttcttacctggctggcacgctagtttatccaaactactttattgtacacgcttgttgtacagcttgctattaatataatgaggtcatataattagttatggtagtagatggtgacccttctcaaactatgaggaagatgtttaggtatcctcaaagtaaattctgcagtgatcccagagacagattaggaagtctcagagatggacaaaagacttgaaaggtatttcagaggctgggcacagtggctcatatctttaattccaacactttgggaggccgaggcaggaggatcatttgcgtccaggagttcaagaccagcctgggcaacatagtgagacccgatctctacaaaaaataaaaaaattagccaggcatggtgatgtgtgcctgtagtcctagctgcttgggagggtaaggtgggaggattgcttgagcctgggaggctgaggctgcagtgagccgtgattgcaccactgcactcagcctgggcaacagagtgagaccctgtctcaaaacaaaacaaaaaaaaagatatttcagaaaaaaaatgtatccacatgagcagtaaacaaggcacaactccattagtcatcagagaaatgcaaattaaaaccagataccactgcattcctaacaggatggctaaaaaatgaaaatgacagttgtaaagtggcagtgagaatgaagagccaccagaactcttactgctaatagggatgcaaattagtttaaccactttgataaactgtttgggaatatctaccaaagctgacatatatatatatatatatatatatatatatatatatatatatatatatatatatatatatcttgtgacctagcatttgcatccctgggtatatacccaacagcaatgtcttaacatatgttcacccccacccccccaaaaaaaaaaaaaacaaaaacatgtacaagaattcttttagcagaattcttcataatagccctaaattagaaacaacccaaatgtccaacagtggcggaatgacataaataaataccactgtattcatacagtggagcacaacaaagcaatgagaatggatggaactttgttacacaaaaaacacagatgaatctcacaagcataatgataagtgaaagaagccgggcttaaaaaactaccaactctatgattccatttatataaagtacaaaaacagtgtaactaatatatgaagtttgaggtcaaagtagtggttaccggtgggggaaggtagtgaatgggaggggacatgatgggagctacggaggtgctggtcatgttctgtttcttgatctggatgctggttgagttcactgaaaattcatcaagctgtacatttatgatatttgtaggaaggataggtatacattgtccgaagggaaagagtggagcagttttattttgtcagctcatgtggtctggcataaagatctgtctgggctatttaaatatttatattttgcataatggggatctgacttgttcacaaaagtattcattcagtcttggggagaaaagggtgatgacatacctgttctgtgccaaatgctaagtactgggatatgtaaaaatagaaagaaaacatagatatctttaaatctaataatccagacataagattctcttcctcagtagtaaatgctaaagagacagagtgactccatgtacaggtgaatctgctttgttatccttattggttactttaaaaataatgacagaaggcattggtgcaaaatgtatctaaagttacaacgtaagtgccatttctaaagcgtttgggagaaaattccactagtctatttgaactggccttgtgttgtctgtggtgtttggctttctcttgggtagcttaaatttcctccccatcagtatagtagattttatctattttgtttactcttcagaaataactgccaggggatttttaagactactgattgaggaatgattgccaaattacccatttttaagtgtaaagtcagtaagcaatgccaggtttctgaggagcttcaccaatttgtctctataatgtgtagtatttttttaacagttttaatatatgaatgaaaatactaccaagtttctcctggatccccacttttgttcattcagtgattttttttactgagctttggaaatgaaccttttgtctttttagtatgatcctctcccctcatgtcgtttgaaaatacccatctcttgcacgagactaagaacaatgctgtcctgttgagttcttataaaatccaaagaaaatttaagtactaagtggatgatagttaaagggtttacagcttttcttacagatccatcaaagtgggaaaatcatgagaagagttggagtcagacatgccagacattccaaatctgtcctgtacaatgtgaccttaagtagttccataaacctcagctttcctagttgtcaaatgaggagaatgatactgtcctcatggggctggtgcagggattaagggtgatgatatctgtgaagcatctcagcttagtgcttagcacactgtaggtggtcagtaattttcctgttctctgttgtgatatatcctctactaattctggagttatctttatcttgcctacctcaatccattctctacaatttccatttgtttatcttaattattttgtcttcctcttacttttttcctaaataaagctacaggagagtagattttctgtactctgacaagacatacatttttcttcttttaatagtgttaaaacaaatgtccaaaaaaacctttaaataaaaaaccaaacatgttcaaggaagttaccatcttttctaaactctgtcagcagggtggctgataaaataaattttctactcattagtctgagatgcttattgaagactgctaatttaggaagtatgggcctgctatggtctgaatgtttatgtcccccaccccaaatttatatgttgaatcctaattgtcgaggtgatggtattagaagatggcgcctttggaagggctctgccctcgtgaatgggattagtgctcttataaaagatgccttagagagatcacttgcccccactaccatgtaaggacacagtgagaagatgccgcttatgaaccagagagcagcctgcattagataccagatctgctggtaccttgatcttggacttcccagtttctagacccatgagaaataaattcctgttgtttatagaccacctagtctatggtattttgttatagccagcccaaacagactaagacagggcccttttatgttctggcttaccgtatttaactatggctattttactagtcagaacccctcttttctctagtgtatgtttctgtgacttagatttagtttgagggcattttcatgtttacttttttcttaaaaattttcccaagattattaacagatactaaatgaacttccctcttccatttcaattttatatggtatctcttttagatctttctcttaaagtaaatgcattacattgtatttttaaaacattttttgccttaataaactgctagcatttcagttaagaggagttaataacagtttcaccaatgcacattgaaaacgatgggttccattaaatagtcaataattattaaaattaagccaagaataatgaaagggatacaattacactaaagtgatatttatgtcttataaagatttctcttaaatgaaaattgacaattattagactagccatacacaaaatctggtattttaaaactaatcttggctgggcgtggtggctcacacctgtaatcccagcactttgggaagtcgaggtgggcagatcacttgaggtcaggagttcgagaccagcccggccaaccaacatggtgaagccctgtctttaccaacaaatacaaaacttagccaggcatggtggcatggacctgtagtcccagctactcaggaggctaaggtgtgagaattgcttgaacccaggaggcagaattgcagtgagccaagatggcaccactgcactccagcctgggcagcagagtgagaccctgtctcaaaaacaaaacaaaacaaaacaaaaaactaaaccaagggccaaagcagtatggtgacagggaaatattttatattttcccttagagacttcagagtgctgactcaccccttccacctaccatgtgaggacgcagtgataacacaccattgattaatgtctaagaatatattgaggaaaatactctatcaggctaacagggaaactggcacagttttgtttccactatattttattggttagagaagtcacagagccacctggttggaaggagaaaggatgtagatcccacctctggatgggagagatgacaaaaaaatttctggccatctttaatctgccacatcaattaattttaaacttaaactttgttgccttaatgtttgagtgagattgtagtagttgatgctactccattccgaggcagtactaaaatcctaccagaggatccaatgtcctcattaagtcccaattcaggatacatatgacagcagtgaataatttgtcactgtgaataggagactaaaataaggacataccatgttgcacaattacagactatttgaaatccagtctggcactgtttgttaaaacagaattttaatatttttgtaatcaaaagatagggaaattatttcaggcaggctgtttttataatttcgttttggcattcttctcttaagaatgaataataatataaggaaacaggtagtgattgccttttgaactataaagtgcttttcatttttagtaagaggttttatgtctataaaattatctgaaaagacaggtcatctgctaaccagtggtagagtatccactgcaaggctcaggactcctgaaacacatcataaaattgtcatgtaaggaaattcttggagctgagtgcagagctagtttgatttcatcataataggcagatattgatggattaactttgagtatttcatgaaataaaacatactttgctgtttttggtttataatacattttaaaacgtttgagtctgaaacaaaaattgtgaagctgatatttgtctttcctttcattctatatgtgaccagtttaatttttgtgattcggggcaatcaaagtatttgctgggtatctagagtgaatattttatcactttagataatctaatctaaaagcccagtaataacagttttggttatttttttcacaggtggggtagtatatcaaacagggtccagttaggagacagaaaccaaacagtaatttaatgtgtttcttttgactttttaaaaatttttgttggtacagagtaggagtatatatttatggggtacgtgagatgttttgatataggcatgcaatgtgtattaatcacatcctgtaaaatggggtatctgttccctcaagcatttatcctttatgttacaaaaaacccaaaaatactcttgcagttatttttaagtgtaccattaaattattatctgctgtagtcaccctgttgtaatatcgaatactaggtctttttcaatagtaatttaatttgaacatgcaaagtttagtataaggaattattgccaaggggttggggtaattggctagtaaaagttagagaactgtgaaaaatacaggcataaggaacagctgctattccaacggctgagatagaatgctcaaggaagaggtttggccttcctcctggcagcactaagatctgaaccttgttgaagaaaatatggccatgactcaccggatcacagtgaggttcactgagacaccatgctagtgggactcattggaaatctgccctctggagtccaggggaagccatccttagggacagaactctgaacatgcagcaagctcactgaggggctgctggaggaagccagtaacaaggagagtaccttgccagcagcgctctgctgtaaaggcacctgaagggggttccaagagaagctgcacatggaaagatgcatgctgctggccactgtgcactgcagataaactgcacacactgcaggagcctgatgagaaaaacactggaactgggacaacagaaccctttctcctccagtgcccctccagtgcccttagtggacaaagcttaatgttgtgccagttggaaaaatattcacagtcaatctccagtagtgcagagcaggcaatgaagtgtggatttggagctgacagacaatagattgataagtggcatgaggagtggagagattgtgtatatgacagtgagtatagttttgatgacatgtatcaagcaacctcattcattatacttggcaatgattttatttcattttgcttttttttccccctcctttaaggagattcattcaatacaacttagtggtatagggcttaaggaaggaaatgcccacgtttttgcttcatatgactagttggatagtggtgctacttattttattcaaatggatactatcaaagggtcagggagaataaatgagtttttgacatcttgcatctcagtaacttttgaaatataaatgttgatcagttaaatattttagtctaaaatttaggaccacaatctgaacaaaagagaaaagatttgaaaatcttcatcgttttggtaatagacgaaacttcggaaatacctgtgattgcttaaagaaagtatattaagaggccacaatgaaaaaaaatgatcatgaggaaccatttttggtcatgaaaaatggtcatgaggaatgatcctgacgaacacctaaatttaaagaaaggatggaaagagacagaggaaaccaggagggggaaagagaagtacaagaattattatcagagaatgctgtcatagacgctgagatcaaaaagattttctgtgttgtcaaatgctataaagaagccaaatgagggaacaactgtaatgtctatggaatttggcaacatggaaaccagtgtgaactttggccagagcaatttcggtattgcactggggacaaaaacaagattgtagtaggcagaggaaggaatggggagtgaggaagcagggaaaataaatataggataattttcaaatggctagactgagaagaggagagagaaacagtcatagatgcaggggcatgtggaggcaggggtagcgattaaaatgggaaggattccagtatctttttttttttttccttttttgccagaagagagagctaagaggaaagaaaagggtgcactgatggactgagatcttcgataggcagcaggtggagggtgggcccctcttccatcaagaccaaaagaaagtcaaggtactgatagagctaggcctgcaggcaggagaaggaaccagaggatgtccctcagctgatggcctgattttcagcaggtgggaggcagagccacctgctgagagtaggcatggtggtagagagtagagagataagagagttagtaatagcaggttaagagagataagagacattgctaggctgcctcaaggcccctccccccacccccgctgaggctaaatgcaaggaatttgtagcagcgcttatcaacatgcagatatgatttctctcagcaacactaagtagcctacaattgaggaaaggaaaattgtatgggtagattgtgctagagtgagaagtattacacacagcagacatgatggacaaaggaatcaagagagatgaaagtaatagtaatagcaagagaaaagaccatggagctggatggggaggaagattttagaggtgcatcaaacatattctagttggtcagtctcctcaccagtcacaatagttttcacgacatcaccgtaagagggacaatagtatggtaagtaagaaaaggaagttaatttcaggagacttgggttcaaataatgatcctgccatttatttattttgaccttgtgaaagttacctaacttctaagcaagcctgcatttttctttctttcttttttctttttttttttttttttttttttttgagacggagtctcactctgtcgcccaggctggagtgcagtggcgccatctccactcactgcaacctccgcctcccaggttcaagcgattctcctgcctcagcctcccaagtagctgggactacaggtgcacaccaccacgcccagctaatcttttgtgttttagtagagacggggtttcaccatgttgcccagtctggtcttgaactcttgagctcaggcagtccgcccgcctcggcctcccaaagtgctaggattatagatgtgagccaccacgcctggccacctgaatttttacacatagtaaatgctcaacaaatatttaatatgaagtgatatttcaagaaataagaaggtgcaatacaacacattagagatgccattctggcacaaagaaacaagtcagtgcctgctctaattttaatttaatgttacaatagccagttttgattagaatattttgcttcaccacatggtgctcaaggtactgtggctgcataacaaattaccccaaaacttagtgtcataaagcaactatttaatatactcacagcttctggggctctgcagtttagacagggcaaatctggggtgtgagtcagaagactcgagggctagggcaggaatcttctaaaggctcactaactcacatctggccattgatgctggctgttgactgagagactttacctgggaactttggcttacacttcatgtgacttctctctgtgaaaaggcttcctcatagcatggcagctgagttccaagggcaaatattgagagagacatccttttgctcagaataatggtattgagattcatccccatgtctgttgtattagtactttttaaattggttagtaatgttccatttcatgcatatagcaaagtttttaaatccattttcttgttcttagaaatatatgttgtttccactttggggctgagtaaagccgctttgaatgtttgaatgtaaatcttttgagttggacatattgtcacttctctcacataaatgcaagagtgcagttgctaggtcattaagaaactgccaaactattttccatagtggttgcactattttatgttattaccagtaatgtatgagagttacagcttttccacatccttgccaatacttggtattgccatcctttttaattttagccattctggtgggtatgtcatgatatttcttgtggttttcatttgcatttaccttatgactaaaaatgttgcacttattggccattcatatatctttgttgaagtatatcttcagatcttacaccgatgtctatttttcattgaggtgtgtgtcttttgtattaagttgtaggagttctttgtatattctggatacacttccttggtcaaatatacatattgcaaatatgttttcccagtttgtaactttcccttttatattcttaatggaatctttaaaagagtagaagtttttcattttgatgaagtccagtttacagtttttttccttcatggttcctgatttttgtgacctaagaaaatttcacctacgtcaaatttgtgaaaattttctttatattttcttgtataattgtagttttggctacgtttatgatgcactttagcataagagttgtatatcgtatgaagtgtaagggttgagattcatgggtagccattcgctccagcactatttgttgaaataaccctattgagttattttagcacctttatcaaaaataatgtgttggtctattttctgcactttctattctgatctgtatgtctatccttatatcagattcacactgtctagattattctatattaagtcttaaaatccagtagccaaaatcctacaattaggattttgtgtttaggctattctagctacttaaattttcataaacaatttagagtaaatttgtgaatttctgcaatgaagcatgagattttgattggtgttacttttaatctatatattaatttggggagaatggaaatcttaaccatattgagtcctccaatccatgaacactactccatttatgtagatttttttacattctcccagaaaatatctttgtagttttaagagtagatattttattcatatttcattacatttattgttagggcctcatgtttttgatgctatggtgaatagtattatgttaaaatttttaatttaatgattattgatagtatatagaaatacagttgattcttgtatattgatctcatatttggcaaccttgctaaatttacttattctagtggcttaaaaaaatccttaagattttctatttgaacaattgtgttattttatttctgtccattctgtatcccttttatttctttttcttacctttatgccctagctaggacattcaattcagtgatcttatattgatctcatatttggcaaccttgctaatttcacttattctagtggctttaaaaaaaatccttaagattttctatttgaacaattgtgttattttatttctttccattctgtatgacttttgtttcttcttaccttgatgccctagctaggacatacaattcaataatcttagggagcaaaccagtctcttaccattaggtattgtctgcaggtttttcttaaatgccctttattagattcaagaatttgttttatcgtcctaatttgttgaatttttattatggataagtgttgaatttcttagaatgctttttttctgagttgagtttttgtatagttctcctttattctgttacttacattgattgaattttgaatgctaaagtaaccttgcattcctgggataaaccctacttggtcatggtttattaaattttttatatacccatgtggtaaaaatactaatattttacaagatttttgcatcagtggttatgatggttattgctttctagttttctttttaaagtttctactggcttaggtatcagtagagtcaggtttactggtctcatataattagctcattattttctcaaaatgtttgtattggattgctattactttttcttagtgtattgtggaattcaccagtgtcactatctcctgggcttgggattttctttgtggggttattttaaattatacatgtaatttctgtaataaatttagggctattcagattttctattttttcttgtgatagtacttgtaatttgagtatttcaaggaatttgtcagtttcattttatttgttggatatattggtatatctttattatatttcttataattttcttgtctgacatatctgtactgatgtctcccctttcattgctgatattgataacttttgtcttctctcattttccttgatcattaaaatctttccaatggaatctttcaaagagcagaagttcttaatattgacaaactccagtttatcatttttagctagaggtttattattttcattgatcatacattgaacaagcttttggtatcattaactttattgtttgttcattttctgggtaatttctatcactgttttaataaagtccaatttgtcgacgtattgttttatgaattgtacttttggtgctccttctaagaaatctttgcctaatccaaggttggaaagcttttctccttttttttaatagaaatttaatagttttaggttttacatttaggtctttggtccattttgagttaatttttagatattttctgaagtctggatacaagttgtctttttttttggtcttgtcttttttttccatatatatagttgttccagcatcatttgttgaaaagattatcttttctccattgaatttccccttgcaattttgttaaaatttgattgtacatacctgtgtgggtatgtttcaaaactctatattgtttcatagacttattgatctgtctttagggtaataccacactatcttgattactgtaattttatgtgtctttggattttttaaaaaatagagacagggtatctctctgttgcccaggctggagtgcagtggggtgatctcagctcactgtaaccttgacccctcgggttcaatcaatcctcccacctcagcctcccgagtagctggaactacaggcgtgcaccatcacacctggccaatttttgtatgttttgtagagatgggatttcaccatgttgcccaggctggtcttgaactcctgggctcaaacaatccacccacctcagcctcccaaagtgctgggattacaagtgtgagccactgcacccagccctgtagttttatacgtcttgaaatcaggtgtcagtgtcccaactttgttctactttatcaaaattgtttgcacttttctaggtccttttcgtatgaattttagaattagtttgtccatttcagcaaacacacacacacacacacacacacacacacacacacacacacacacacagaaggcctcctgggatttttattgggattatgttgaatacaggtagtcctcaccttgcatggcactatgttaaatgaaacgtgcatattgaaaccaaggcctcaccatgcacagttccaatattcatgtttcagttaacacagtactagcactgtgcaaagtaagtatggcctatatgtagaataatttgggggagaactgacatattaatgatactgagtcttccaacccatcaacccaatatcattcttttatttgtatctctcatatatctctcagcagcattttatagtttttagtataaatgttttttcaacgttttgtaagaatttttctctgtatttcatatatttgatgctattacaaaatttttctagtttcaatatcctttttttaacttctggaatatataaatacaactgatatacaattgtatatcagtcttgtattctacagtcttacaaaactcagaacacattgagctctctagtccaaaaattcagaatgctccaaaacctgaaactttttgagtgcctatatgacatcacaactggaatattccatagctaatacctaaatccaaaacacttctggtcccaaggactttggataagagatattcaacctgtagttctaatagcttttttgtagactctctctgattttctccatggatgattatatgtcagttatgtcatcttgaatacaatcagcattaattacatcttcctttccaatctggattcctcttgtttggttttctggccttattgcactgactggctagatgtctcctccagtataatgttgaatagaagtcatgacagcaaatgttttcttattccttagagaaaaaacattagattgtttaccattaagtattaatattagctgtaggtttttgtggatgacctttttgaggttgaagaagtttctttctattccaagtttgctgagaattttcagtaggaatggatgttggattttgtcaaatgctttttctgcatttattgagatgacctttttagtttattgacatcatgaattatattgattaattttgtagtgatcaaccaacctgtattctaaaaactgcatattggcctctagttttcttttgttataatagtctttaactggttttgatatcaaggtaatgctgagctcatagagtgaattagaaagtgttccttttcaattttgggggaaaggtttgtgtagatgtggtattatttcttcatgtttggtagagttcatcttggcctgaagttttctttgaaggacgatttttaactaaaaattctattttttatagttataggaatattcagtttatttcgtcttaagtgaggtttggttgtttctttcatgaaatttgtctgttttacctaagtgggtaaatttattggcatggagttgtttgtaacattcattattcttagtatatctgtaaaacctttagtgatgttacctttctttatccttaacattattagttcatgtgttttctctctttttttttttctgagcagcctggctagaggtttatcaattcattgatctatttcaagaacccattttttgtttcatttatgttttctgttgatttactttttcctattctatttatttcaactttggtctttatgttttcctttcatgggcttattttgctttaattttctcatcttctagtttattaagttggagactaagatcaagttagttaatagtattgttcaacttttctatatcctcattcattttctgcctacttgttttatcaattataattttggatttgtctgttcatatacttttatcacttttgtcttttatgtattttgaagttctgttattagatacttatacatttaggattattatgtcctcttgatgagttgactgtgttattatcatgaactgatcttttttctttgttcttcctttatgcagtgtatccttttttctgaattaaaaaattttgtttttttagctgggcacagtggctcatgcctttaatcccagcagtttgggaggacgaggtgggtggatcacttgagctcaagactagcctgggcaacatggcaaaaccctgtctctacaaaaatacaaaaataagccaggcatggtggtgtgtacctgtaatcccagctacctgggaagttgaggtgggaggatcatttgagtgtgggaggcggaggttgcagtgagccgagattacaccactgcactccatactgggcaacagtgccagatcctgtctcaaaaaaaaactttgtttttatcactggttttatgcaatttgttgataatctgccttagtgcctttttttatttgtattttaatttgcttgagattctttgagcttcttatatctatgggcttatagtttacataacatttgaaaattttttgggctttatttctttagggtatttttcttctccatttgtctcttctctcctttgaagggctccagttacatgtatgttagacccctttatattgtcccacatgtcattaagcttctgtattttaattttatacttttcatgcattgtctaatctgtttagttcatccagtgactttttcatttgagataatatatttttttaattctagaagctccattttgttcctatttatttttttgtatttcttttctcattatgtccatgctttcttttaaatctttgagcatattcataagctattttgaaattcctgccttgtaatgcctacatagctatcatttataggtctatttgtattgactagtttttcttttggttatattttacaatttgctgctttcttcattagactatatctagaatagccattattttagtgccaaatttagctccactacttaggtgtgaattatccttagcatttcagtgaggtctctctactgtgtctggttagaactgcagtatctccctgctctttttgaccagcctcatggagtttcaagttatgcaaggacaaattattattaaagtattgttgggactttttttatacctcagtcccttcttttcagtaccctctcctgaacattccatctccctcatcctccccaaaccataatctctgttttctctactcagtgacactgcatgcactgctttgcttcccctccctgtgctgcatactggaaattgcttccaggaagaagccaggctctcatttggtactcattccattcatttccctttccataggaatcacaatcttttactgcctattgtctcagtgcctgataatatttgtttcatacatcttattcaattttctagttcagtgggtaaagaaagtcctattccaattaaatttgcatgattagaagctctttttttcccttcaaaatctttatttgcatttctttttttttattattatactttaagttctagggtacatgtgcacaacgtgcaggtttgtaacatatgtatacatgtgccatgttggtgtgctgcacccattaactcgtcatttacattaggtatatctcctaatgctatccctcccccctccctccacccaacgacaggccccggtgtgtgatgttccccaccctgtgtccaagtgttttcattgttgaattcccacctatgagagaacatgcagtgtttggttttttgtccttgcgatagtttgctgagaatgatggtttccagcttcatccatgtccctacaaaggacatgaactcatcattttttatggctgcatagtattccatggtgtatatgtgtcacattttcttaatccagtctatcatggatggacatttgggttggttccaagtctttgctattgtgaatagtgccgcaataaacatacttgtgcatgtgtctttatagcagcatgatgtttaatcctttaggtatatacccagtaatgggatggttgggtcaaatggtatttctagttctagatccttgaggaatcgccacactgacttccacaatggttgaactagtttacactcccaccaacagtgtaaaagtgttcctatttctccacatcctctccagcacctgttgtttgctgacattttaatgattgccattctaactggtgtgagatggtatctcattgtggttttgatttgcatttctctgatggccagtgatgatgagcattttttcatgtgtcttttggctgcataaatgtcttcttttgaggagtgtctgttcatatccttcacccactttttgatggggttgtttgtttttttcttgtaaatttgtttgagttatttgtagattctggatattagccctttgtcagatgagtagattgcaaaaattttctcccattctgtaggttgcctgttcactctgatggtagtttcttttgctgtgcagaagctctttagtttaattagatcccatttgtcaattttggcatttgttgccatggcttttggtgttttggacatgaagtccttgcccatgcctatgtcctgaatggtattgcctaggttttcttctagggtttttatggttttaggtctaatatttaagtctttaatccaccttgaattaatttttatataaggtgtaaggaagggatccagtttcagctttctacatatggctagccagttttcccagcaccatttattaaatagggaatactttccctatttcttgtttttgtcaggtttgtcaaagatcagatggttgtagatgtgtggtattatttctgagggctctgttctgttccattggtctatatctctgttttggtgccagtaccttgctgttttggttactgtagccttgtattatagcttgaagtcaggtagtgtgatgcctccagctttgttctttttgcttaggtttgacttggcaatacgggctcttttttggttccatatgaactttaaagtagttttttccaatttcgtgaagaaagtcattggtagcttgatggggatgccattgaatctataaattaccttgggcagtatggccattttcacgatattgattcttcctatccatgagcatggaatgttcttccatttgtttgtgtcctcttttatttccttgagcagtggtttgtagttctccttgaagaggtccttcacatcctttgtaagttggattcctaggtattttattctctttgaagtaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacagtggggttttctaaacatacaatcatgtcatctgcaaacagggacaatttgacttcctcttttcctaattggttaccctttatttctttctcctgcctgattaccctggccagaacttccaacactatgttgaataggtgtggtgagagagggcatccctgtcttgtgccagttttcacagggaatgcttccagtttttgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggttctgtttatatgatggattacatttattgatttggatatgttgaaccagccttgcatcccagggatgaagcccacttgatcatggtggataagctttttgatgtgctgctggattcggtttgccagcattttattgaggatttttgcatcgatgttcatcagggatattggtctagaattcccttttttttgttgtgcctctgccagcctttggtatcaggatgatgctggcctcataaaatgagttaggaaggatttcctctttttctattgattggaatagtttcagaagaaatggtaccagttcctccttgtacctctggtagaattcggctgtgaatctgtcgggtcctggactttttttggttggtaggctattaattattgcctcaatttcagagcctgttattggtctattcagggattcaacttcttcctggtttagtcttgggagggtgtatgtgtccaggaatttatccatttcttctagattctctagtttatttgcatagaggtgtttatagtattctctgatggtagtttgtatttctgtgggattggtggtgatatcccctttatcattttttattgcgtctatttgattcttctctcttttcttctttattagtcttgctagcagtgtatcaattttgttgatcttttcaaaaaaccagctcctggattcattgattttttgaagggttttttatgtctctatttcctttagttctgctctgatcttagttattttttgccttctgctagcttttgaatgtgtttgctcttacttctctagttcttttaattgtgatattagggtgtcaattttagatctctcctgctttctcttgtgggcatttagtgctataaatttccctctacacactactttaaatgtgtcccagagattctggtatgttgtgtctttgttctcattggtttcaaagaacatctttatttctgccttcatttcgttatgtacccagtagtcattcaggagcaggttgttcagtttccgtgtagttgagcggttttgagtgagtttcttaatcctgaattctagtttgattgcactgtggtctgagagacagtttgttataatttctgttcttttacatttgctgagaagtggtttacttccccttccaactatgtggtcagttttggaataaatgcaatgtggtgctgagaagaatgtatattctgttgatttggggtggagagttctgtagatgtctactaggtccgcttggtgcagagctgagttcaattcctggatatccttgttaactttctgtctcgtttatctgtctaatgttgacagtggggtgttaaagtctcccattattattgtgtgggagtctaagtctctttgtaggtctctaaggacttgctttatgaatctgggtgctcctgtattgggtgcatatatatttagggtagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatcctttattttgagcctatgtgtgtctctgcacgtgagatgtgtctcctgaatacagcacactgatgggtcttgactctttatccaatttgccagtctgtgtcttttaattggagcgtttagcccatttacatttaaggttaatattgttatgaatgaatgatcctgtcattatgatgttagctggttattttgcttgttagttgctgcaatttcttcctagcatcgatggtctttacaatttggcatgtttttgcagtggctggtatcagtttttcctttctatatttagtgcttccttcaggagctcttgtagggcaggcctggtggtgacaaaatctctcagcatttgcttgtctgcaaaggattttatttctctttcacttatgaagcttagtttggctggatatgaaattccgggttgaaaattcttttctttaagaatgttgaatattggcccccactctcttctggcttgtagagtttctgctgagagatctgctgctagtctgatgggcttccctttgtgggtaacctgacctttctctctggctgcccttagcattttttccttcaactttggtgaatctgacagttatgtatcttggagttgctcttcgcgaggagtatctttgtggtggtctctgtatttcctgaatttgaatgttggcctgccttgctaggttggggaagttctcctggataatatcctgcagagtgttttccaacttggttccactctccccatcactttcaggtacaccaatcagacgtagatttggtcttttcacatagtcccatatttcttgaaggctttgttcgtttctttttactcttttttctctaaacttctcttctcgcttcatttcattcatttgatcttcagtcactgataccctttcttccagttgatcaaatcggctactgaagcttgtgcatttgtcacgtagttctcgtgccatgattttcagctccatcaggtcatttaaggacttttctacattagttattctagttagccattcgtctcatcttttttcaaggtttttagcttctttgcgatgggttcaaacttcctcctttagctcagagaagtttaatcatccgaagccttcttctctcaactcgtcaaagtcattctctgtccagctttgttccgttgctggcaaggagctgcgttcctttggagggggagaggcactctgatttttagaattttcagcttttctgctctgttttttccctatctttgtggttttatctacctttggtctttgatcatggtgacgtacagatggggttttggtgtggatgtcctttctgtttgttagttttccttctaacagtcaggaccctcagctgcaggtctgttggagtttgctggaggtccactccagatcctgtttgcctgagtatcagctgcggaggctgcagaacagcgaatattgctgaacagcaaatgttgctgcctgatcgttcctctggaagcttcgtctcagaggggtacccagccatgtgagatgtcagtctgcccttgccggggggtgcctcccagttaggctacttgggggtcagggacccacttgaggaggcagtctgtccgttctcagatctaaaactccatgctgggagaaccactactgtcttccaggctgtcagtcagggacatttaagtctgcagaggtttctgctgcctttcgtttgtctataccctgcccccagaggtggagtctacagaggcaggaaggcctccttgagctgcggtgggctccacccagtttgagcttcctggccgctttgtttacctacttaagcctcagcaatggcgggcacccctcccccagccttgctgccgccttgcagttcgatctcagactgctgtgctagcaaggagtgaggctccgtgggtgtgggaccctctgagccaggcacaggatataatctcctggtgtgctgtttgctaagaccattggaaaagcacagtatcagggtggagcgcagtatcagggtgagagtgacgcgattttccagatgccatctgtcacagcttcccttggctaggaaagggaattccctgaacccttgcacttcccgggtgaggcgatgtctcgccctgctttggctcacactcggtgggctgcacccactgtcctgcacccactgtccgacaagccccagtgagatgaacccggtacctcagttggaaatgcagaaatcacccgtcttctgcgtcgctcacgctgggagctgtggactggagctgttcctattcagccatcttggaactgcccccctagaagctcttatcgtgagttttaatgtgattttaaagaatcttaattctaatgatattactttcaaatagagacagactattacagagttttatctaacaaagctaacatttatttagcatttcagtgatgtgagacgccttgctaagaggtgtctcagttcccattataatcctattataaaggtgccatgttatgcctattttacagaaaggaggactgcagcttgaaaacagttaagtgacttgttcaagctcacatatcagtcgagtaaatggcaaaacctagattcaaactcaatcttgtcaaactgccaaggccttgcttatcatcaccatgtgctatggtttggatgtccctgccaaaactcatgttgaaatttaattgccgttgtaacagtattgggtgctggatcctttaagaggtgattggcctggcacgatggctcacacctgtaatcctggcactttgggaagccgaggcagatggatcacctgaggtcaggagttcgagaccagcctggacaacatggtgaaacccatctctaccaaaaatacaaaaattaactgggcatggtggcagacacctgtaatcccagctacttgggaggctgaggcaggagaatcgcttgaacctgggagatggaggttgcagtgagctgagatcatgccactgcactccagcctgggtgataagagtgaaactccgtctcaaataaataaataaatacatacatacataaagaagtgattaggtcatgaggaatcctccgtcatgaatggatttatgttgttatcgcgagagtgggctagttattgctggagtgggctcctgataaaagaatgagcttgggcccattttctctctatgtcttgtgcttggttgcccttctgcaatgggacgaaccttaccagatgctcatgccatgctcttgaactcctcagcctccacaacagtgagccagataaacctgttgtttataaatttcccagtctgtgggtttctgttataacagcagaaaacagactatgataccatagtatgctgctttgaagtgggtgagcagctgggacaattaaggaatcagcttcagtactaagtgtctgggatgcaatgctttgggggccattttcaggttttgtacagcagtctttcttgggtcacattttcactgctctttacttcaaatggtcaagtcagacatcttttaagcaacatttatgggtaggttctgatggcatcttccttatatctgcatatgattggaaatctaagagcatttgggaaccttgtcactgaccatctttttttattgtaactctacattaaagtggggtgttttttgttgttgttgttgttgttgtttgagaatgataaggtaccatgggagcagaattacattactggaaaagtggtggctaggtttataaaagcaaaacagtcaatgatgttctcagtctcaaattatttcaaaataaaaagatttttaagaaaaatttacctaaaataattagtctcttttcagtttagccaccagcttcctatattcttagattgttttattttgatttttgggggttttttattgtgatttaattttttataatcatgtaaaacatttacgtggttccaaaggcaaactataaaagaaaatattttcaaagaagtatgttttctatccctgttcccaccctccttcataagtaatcattttcattagctttcagtttatactcattgtctttgctttaaaattgtaaatattgtagctgtgtgtgtttttacatacacatacatacacacacatttccctcttccttggataaaaggtggcatattctacacactattctacatcttcttgttttattaagtcgtagatactctggagttcactcaatagcatggtattaagattgtccttttttctttttaaagctccaggatattccactggatttaaatttttcaaaatctcatttgataaacatttattgtctactgtgtgtgtcatctgtcacgggtagtgcatagcattgtagggcaaacagaaatgaacaacatatagtcttcaccctcaagaaacttacagaattttaaaatacttttacaaatgtgtacctctcacagtagctgatccagtaacaattatttttatttttacccatctcctttttagagaacagagtaaaaatttttttgccatctattgtttctgttatatttaatgtcatttcagtagtatttataagcagtctaggaacacgtcccaacatttaaaatacttagatatatgattgtaaagtgtgaggcagagaagtacatcatatgaatgtatgctatttctaaatacttgctattaattttagtcactctaaagtcagaatataccagacagtccaaattactgtaattataccatccttttaaaaacttggcacctctttattcccaatattactccaaccattatcattataacaggttcctgttctgtacctcactcacatctgtactcttctccaatatttcttatttctttaatgtctgtacctcataagatgctgaacttttctttgaagacttaggcattggggctgtgggggtactagcctagacttattgaaagcagctcacctatggtactttgtcacgggagtgggtatatctgtgctaggtattgtccttcctatctctttgttggctcttaggggcactccgtctctcagggtcctgagtctgactttgcatctttgaatatggtgtctctccttaaagtcatcttggttacaccttgggtttaccttttctttgcctgtcctccagtagtggccctgaagcctatccatgttatcatttggctactcctggctcttccatcctggagctgttaacctagttgctcttgaactctgcatataaggcccccttccctttctctttcccctttccccagttgctctctaggttttctaatttctttcctgacactatgtatggctttagtcaagcgtaacccttgtccctaaatccacaaatataaagctaagacatgttacttgtctagttttcttagagaaggaaacttctcaggtctttgtatgcttcctcatacaattgtaggttgcagtaaggttaaatggctgaaaagcggtgaaggaacatgttcaagaagtttcatatgatttcactacatgaatgtagatgtggtaatctagcacctactgtactacttaaagcatttcctacagtgaaggcttctgagaaaataaatactattcctgaagtagtctcacaaaaaaaccttttttaattcagaaaattgattccaggttcactaagtcagcattttctctcatcaggcattgcaactaatgacattaatgagagccatgccatattttttaaaacaaaggataaaaagggcaaaactgagaattttaaaagggagttgtttccagtagtctgtttgaacattgtaattaaccaagaaataaaacaagaaaaggccattttaattgtgttttttagtactccattaacagtgcatcaagctccttatgaattgagacagtataaaatgagtgcttacgttaaagtaggaaagccatcagtctgcggtacagagcattgtatttattagagtatcccagacctgaatgagtattaccaccattaggtaatgcttaagtgtctattttaacaaaaggcatttttttttgttattatagagaacaaacactaaattgactaaataaatgaagtttaaacaagaaataaaacagctagaatttgcttgcttttgttggtggtgatatgctcttgtagccccagcaaattacatcagcattgttaccctcgacagggagctttataatttgtagcatgtaaaataacccttcccaaaaaagaagagagccaggacctgtgttgaactacttacaaagcaagcatgtccctggtgtcaccttagtagttttagtgagaaagatgggatttctaaggacagtagttcacagttgtgctctctctgttttctgtctttcatgctttaaggtttttttgctctcttattttaatgtgtgtgtctctatgtatgggcatgtaaataaatatgcagatggtggcacctatgtaagaaaatgtttgaacacagccccaatttcagagctcaatatggcatggggaattcttgggagaatgtgacctattgagggttggttggttgtttgtttttaagatggaatctccctctgtcacccaggctggagtgcagtggtgtgatcttggctcactgcagcctccgcctcccgggttcaagcagttatcatgcctcagcttcccgagcagctgggaccacaggcgcccgccaccacacctggctaatttttgtatctttagtagagacagggtttcaccatgttggccaggctggtctcgtactcctgacctcaaatgatccacccacctcagcctcccaaagtgctaggattgtgggcatgagtcaccgcgcctggccaattatcataaatatatgctttttagtggaccatatagaaagttctattctggttctttatatggttgggttttacttttatctaagtaatgtaagcacatggttttaaaagtcaaatcatgctacttctaacaacaaaaaagcagtgtctctcctaatttgttccaactccaccactttaagcatttttgctgtttcttctgtaaccagcaacatatattactatttcttgatttcatagtttcagatatcatcagttattgcctttttgctatgaaagatgtagctgttttatgttgctaccctcccaccccacttcctggtccctacttactttcccttccccatttttataatattcatatttcagttattcatataatatgattgtatttcttgtgtaatttattgttatatctggggtgaatcattgactcatttctttgattgcttagttttttgttgttgttgtttttgagacagtctcgctctgtcacccaggctggagtgcaatggcgtgatcttggctcactgcagcctccacctcctgggttcaagcaattctcctgcctcggcttcccaagtagctgggattgcaagagcgtgccaccacacctggctaattttttttaatatttttagtagagatggcgtttcactatgttggccacgctggtctcaaactcctgacctcatgatgtgcccacctcggcctcccaaggtgctgggattacaagcgtgagccaccgtgcccagcccgattgcttgttattttatgtattattgctaatttatccctaggctgtcccactaaactgtgtaactttcctcggtacattcaaccccattggataatttatcacattcattgtttttcttggtgacagagggccccctgcctgtgagcctttcatctgtttcattgtaagttggttgctgtcctggcctgctgggctcgtcatgagaattccttttgcctttcatctgtgctagagtctttgttccctaggtttcttgtttttttgcttttttggtttttttggcttccttcttcattttgataaagtatgccctctagtaactttctgagaagaggtgcttttttgagatacctgaaaatgtctttatattactctacaatttgatagtttggctgggtgtagaattctaggtgacaattttgaaaatatatagcatatgggtgaaagtttatatgatgcaacgagactacttaggttcatatcacacttaaccagctgtgtgtgacatgggcacatcacataacccttctgtgcttaagttttctcatctaaaaatcaggcataatatcttacctgcccttacagttattgagaggattgattgaataatgtatgtaaagcacttagggcagtgcctggccgtttttctcccaaagctttaatgatattctctttaccccagtgccctaaaattttacaatgatgtgctttactgtgggcctttttaaaagtcgttatactgattgcttagaaatatttttaaatctggaaactcattgttctttagtttagaaattctttaaaatatttcttagataacatccttttctccagtttctttgttcttcttttcaggagttgctgtgattcaaataacataagggcttataaggtagggcttcatctctaaccttttctttcctgttcctctttctttatctttttgctctactttgagagatttcttcaacttgatcttctaacccttctgtttgagtctcgtggtttagctctcattttttattttcaaggacttttttctgaatgtttttcttttaaactattatatagtttcatactcttgtcttcataggtttcatattcttatctatctcaaagtagtatatttttgaaattttctttgccttatacagggaacagtttcctcagaaaaatattaagagggaagtgttaaataggtgcctgggaacactctgtatatgggtaaattcattatcagtgatcagacaaagactaggccattttttgagcgccttatggatatccgttatctgtagatcttttgttcttaagcaggtcagtttgacagaagaatcttctgatcttctgccttgggctaagggtatgtgtattagggggagaaagggtacgtaggggcatttaagtctgactgcagtggttctgagagataaaggctgagggtctttattttaacatgtttaatacatggaactttccagttaatcctcttgtttgagtacagcacttcagtttgacgtgagctaggggtctggtgtccaaagtctccaaaaagtggggtaaggataatttgcttggccaaagatatccaaggtcatactgcatacctataaaggttcagccagtcctcctgttatctgctccaccatgcaaccctgccctcaaagatacctggtgcttcctattgctaaacctttcttagggacattttgacaggcatatcagcgtgcttcttactggctcgccttattgaaagcttgtgttcaggttctacagaaagcttgtgttcaggttctacaaaaagatgtcaagaagggatttgatgtgcaagaaatttattgagagtgaaaatgaatggtagggagctggaggaggctgggacagccatcacaggtcatgcaggtctgaccccgttggaggaaaaagggaagaaaaagaggaggattgggtggggaaattatttgaccaaggtgcagtttcaaggatgttttggcaaggcgtattgggagtccttgagccaaagttgaccatcagagacccatatctcacaggaattagcctgcttaagtattcctgctgctcttagtcaccagctgagagtatttataatagctgctttgaagtcttttctgctaattccaacatctgggctccctcaaaggcagtttctattttctgcttttttttcccctcctttgtaaaggtcacacttttctgcattttgcatgtctcctaacactttgttatagcaactgtggatactgacaccttcctccactccagggttattcttttttagttacttgctggactagttcagtgcaacctctgatgtccctcttcaggacaggtgtggtccttatccatgcatttctctgctacctctattggtgttaaacttaaccaatcgatagctgattgctcccttctttttgacaatgccttgtggtataaattgctccatagtctgatccaattaaaattgggtcccttcatggatgaaattggaaatcatcattctcagtaaactatcgcaaggacaaaaaaccaaacaccgcatgttctcactcataggtgggaattgaacagtgagaacacatggacacaggaaggggaacatcacactctggggactgttgtggggtgggggaaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaagaaaagaaaagaaaaaataaaaataaataaaaataaaataacattgagtcccttgtcagggacaagtttttctagtctttgagacttgctatacccttccctgagcagaatctctgcactatagagtaggagctggggaaaatggggaactcactcctcattggctgttccacccagatcctccctctgaagcagggtttttgtgttgccgggaaggaggaggtatgaactgtgcctccttttgcctctgctgctactcagtgtggatcttccacagctcaaaaccagggagtatgatatctgtcagtgttcaccaggtgctgaaagtactcagaatagttctttcaccctaggaagttgaaggagatgggagctgccactcagctgccaaacacatctctgtagctctcttgacaacacagagctgtgtgggcaggggggactacactgtttaccagcttcctcacctgattcctctgtttttagctggagttcaggggagagaaatggctgctgccatcagcttctgccgcttgctctatataggccttccacagcatggagccgtggaaaatgggatctgccaatgtttactagctgccaaatccaccccgagtagctcttccatctcaaggggcggatctgcccttagctgctgaactccttaaaacagttctttggcaaaacagagctgtggggggacaggtgcagtccctgtgtggtccctatctcgaatgctacagcctcttattgttcttatcgaatttctgtagattctattgaataaatgcttctctatttgttgtaagccctttgatcagtctccagggactttgaatgattgtgatttttgaccagctaaatatatgtctctccaggggagagatatccctgagctcctttatacagccattccagaagtcccacctagtcattgtgggggttttctgggttttttctgagacagagtcttgctctgtctcccaggctggagtgcagtggtgtgatctcagctcactgcaaccggctcactgcctcccgggttcaagcgagtcccctgcctcagcctcctgagtagctgggattacaggcgcacgccaccacacccagctaatttttatacttttagtagagacagggttttaccatgttggccagggtggttttgaactcctggcctcaagtgatctgcccacctcagcctcccaaagtgctgggattacaggcgtgagccactgcacctggctgtcattgtgtttttaatgattctgtcttaatagaaaactagttttacacaaatataatcaagtgacttaaattgaaaggactaagattgaaaactgaattgaaattgaaaattgaattgaaattgaaacctaagatttttttgaaaggtatgattttattacggaaatttgcttgattgagctttattttaatcaagactttgtatttccatttttagaattaattcagagaaatagctaacctataaagttcatcttcagaattgagtcattgtagacctaagaagcaatatagcagagttattaagagcataggttctggggccagactacctaggttccagtctttgctttgcagcttattggttctacctgggttccaatctttgctttgcagcttgttagttctttttatttttatttttgagacagtcttgctctgtcacctaggctggagtgcagtggcatgatctcagctcactgcaccctctgcctcccaggttcaagcaattcttctgcctcagcctcccaagtagctgggattacaggcatgtgctaccacacccagctgatttttatattattagtggagacggggtttcaccatgttgtccaggctagtctcagattcctgacctcaggtgatccacctgccttggcctcccaaagtgctgggattacaggcgtgagccaccgcccctggccgcagcttattagttctgtgaatgagttacttaactgctctctgtctattcatatataacatgagcatcatctgccccttagaattattgcgaggttaaatgggtcaacacatctaaaatagagcctgactcatagtaagtactcagtaaatgttagctgatggttattgttgttagacacattaaaggcaaataatcatctcatctttgtattttattattgagaccaataatattgtctaaagccagagaccttggtgaaacgctgggtgcccagctagctataatatgatctttagttccctctagtggaagaaaattagataggctctttgcataaacatgctgcttttggaattgtgatcatttaacctaataaaattacccctgaataattaaccaaagacaatatccacatacataaatggatttaagaaattgttaaaacttacaatcttaaatattctttccaagtgaaacttttttggggacgtgtaatttataatattaaataatatagtatataaaccatccagtgacataaaaagttaggcatatattacttttgtttaaaacaagtgcattcagtagtagtagtaccttgaagttttccattttaacattcatacccagttatctgcaagtagatggcatttcttggtcattctctgagaagtctttaatcattgtgatatgccacctggagtagatttccttgaagttttggcatttttagtatcctcttccacacagcctatggggtaacagaaagattgctagattgggaatctgagacctgggttcatcttccagttctgctatgaaatatctgtgtgacttcgggcatgtcttactagggcctcattttccttctgagtaaaatttgaggatagagaggagcatgtgatgatgactgtcttgctgtcacttctgtttctaacattctctgattcagtgatacatacactttgatgtgagacaggagatgtataatagatgttgagtctaagttgggtaaatgggtcctgtatgcttgatgttgccttctagcaggattggcaggaatggaaatcaccagcagtggaatgatttggtaaatgccaagatcttgaggcatctatggaggcggttgctagattgcagcagggtatgcctccctcagcttgggagattgttaaagagaactttgaggcaacgtctaagtgggatcttgatgaacaagtaggggtttaccaggcagagaaggaagcacgtggagtatcatacagagggaacaacatttgtcaggggacagagagcagggggccggtgcacaagctgcgggtggttcaggattggggtcagggaggctgaaggaagaagctactggaaaggaatgtataaatgtgtgacttcaaaaaaaaaaaacaagagctaaattgtttgactaagaagccggagagctagcttctatttccagttatactgttaaataggtctgtgaaccctagttaagttgttggacttaaaagattttttggaaggctttcaaagccatgcttagggattataatgtcttgctgtatggaatggagctcagtgaaggttttggaataatataatatctgttttagagtaaaactatgatgacactttaatgagtctaaagagaagaaactagaggcaaagaaacccatttaaagatctttgctgtgatccagtcaagaattgttgagggctgaaactagggtaaccgcagtaagggaaagatagttttgacaggtgttgcagaaatagaatggacaggttttggcagctgcatataggaagtagaggagaagtggtagatggtgtgaagatgactccaagggctgtctggaagattaataattttggtaatcagtaggccacacacatacagctacatgggttctgttttacttttcttaactagtgtccttattattaaacattttgagtgtgtctagtttttttcccaaataaccctatggtcatcttgaggttttttacgaaatatgtgatttcccaaaaaactgtagatgaaaaactgcaaagttaaagtaggcatagaactacactatatatagcagtgtggtttactaatagatgttcacattgctgccttcttggtgtcaaactcggtttgattgacatttgttaaacatagaatgatttccaccaaaaatgatgaaaggaaaagaaaacaaaacttattgtgcatgtgcactctcacatactttattaatcatccaggcctaactacaaccctgtataggagttgttatcttactctttctattttacaaatgaggaaacagatgttctaaggttatgcagctactaagtgatgaagacaggaaagacaggtcttttgactacaagtctattgccctatctattatatcataactgcctgccagcagaatgtgttagtgcttaaaaggatagatgccagatctgtggaagtagggtgaccagtcatcttggtttgcctgggaatgagggtgggttctcagaacccaggactttcaacctggaaagatcctcggtgccacaactgagaaagttccaggcaaaccaggacaggttggtaccctgtccagaaaagtcacttatatgaaataaaccattatctagaatgacttaaataaggtatttactgtatttctttcccataatattgtgtcatcaatgctaaatgacaaatgattcctaagtgaagaggagttaaggccccgccttccttccatctgtttgttttcactggctctgagcatcctgccttgctgcagttacactcaactgtgtgtgaatcagatactagatgcctttgcttctaagtcagttttattttattttttatttttatttatttatttgtttatttttagacaggatctcactctgtctcccaggctggagtgcagtggcatgatcttggctgactgcaacctccacctctcgggctcaggtgatcctcccaccccagcctcctgagtagctgggactacaggcacacgtcaccgcacccagctaatttttgtattttttgtaggaacagggtttcaccatgttgcccaatctggtcccaaactcctgggctgaagcgatccacctgcctcagcctcccaaagtgctagtagaattacaggcacgagctaccgtgcctcgtctctaagtcagtttttaaggaaacttatgctttgcccattccaaatttgatgaaatggcaaaagagctattcagggaaaaatcaaggagggctgtcagtatctgtgatttcaaagtatttatcaaaacaattaactcatttttcttggtcctttttcaaataagtatcacatattggtagttatttctttacgataaatttgttttatactatttttatgagactttgttgacaaaaggattctgtagctggatggggaaacccatattattaaaagaaaaaaaaacctcagataatcatttcactatgccgtacagaatttttacctcattcattttttacatattgaaacagaccacaaattgctttctgggaaaagttttggccctgctgtcagtatttcctgggctggccccatcctggaagaagatttgggggagaaatgggtggtaaggaaatctatcctgtcaacgtgtccttgttgagctcctcagctatcagttaataaatatagaaagtaaattatagataacacaattatgaaagtataaagcacaggtatgtgaagaacattttttttctttgacatattagttgaattcccattttatttcagtaacttctcgtttgctttttaaattttattgaagaacgtgtatgcacaataaaatgtacccatctaattgtacacttcagtgagttttgacaaatgtatgcattctgtcatcccacaaagttccttcgggctctaacatgtatgatttttaagactttaatattgaaaagtaattgagttataaactgatatttctctaattttcttgtataaagtaaggaataccatgttgaaataggtgtctggtttttctaatagtcaaatgccctgatcttcccccctttggtttacatttcccaaaatgaaaagcaacagagcaattgcaccttttagacaaacttagagcattgtatttctatttttgtcatatacaaatttgttacacttatcagaactgaaaactctttgggaaatatattaacaaaaccccattaatttgtaaatgcttaatgcagctaagattgatttctaattaatacacatttgcctatttaagaaaattttcacatcagtcaaacactgaattaatggtatgctgcttcctttctttattcacctgatgatgatatttggggccataggaattttttttcaatgggcaagaattcaaagaaattagaaggtgcttggatttctgtttgtgtgtgtgaaaaaagacaacaaaatgtatagagctagtagtgaaacatgtaaaaaagaatcaaagaaattatgagtttgcagttgacccagatttctatggtggcctgtctaggcctctactcttcactagctgaggtcaactttcctgaaggtcaatgaggaagatagcctcattaaagccaacctgacctgtgttgttgccaaaggcagctgggatctttattcttcaacttgattatgagataaaggtagaacccagcagcagaaattgactttgctactataatccttccaaggttctgcttggattcctttcttaaagtatcatttggtcattcatttcagtacactaaggaaaaatatgttgagtcaataatgactttcatttacttattttgttattaatatttattgaaatgaacacattagtacttgtcctagttctttctatgactagattagaatattctttattttgattttgagtccaggtcagctcttagcgaattttgtttaactgttgaatttctaacacaacctagacattgtttggaaatgaatgagaatacttgtatatttgttaggaaaagcgcagtatctagtttctgactatcactagttacaatgcagctgaaataagccggttctgtaacagtcttgatagcctgtcattcaagtcagtattaccatattagcactattgtgtgattggatcttaggatatataaaaactatgcagacccaggaggcactgtggtgtgatgtaaagagcaaagggctttggttattagtcctgcttcctccacttactagctgtgtgatttatatcattgagccctggacctcagtttctacctctgtaaaatggggagatatatgtgcatatatatgtatgtgtatatgtacatgtatgtcatgcagggttattacagtaacaaatgaggacttatagaggggcactttaaagtctcagagtttgcattagattaacaatagtgaagaaattccagatttagttattaaatgatggatttgggttattaaaagaagctataggatttccttctgtgaaagtattttttaaaaacacatctgtttgaatttagattctttttggaatgactgacattataaatatctgtaagaattacagaactcacaatcaggagaggataagaattaaagcaagtcaacttatctagagtggcaccattccaatttggtagacactagccacatgcagttattgagcacttaaaatgtggccagaccaaattgagatttgctataagtgtaaaaatacatgctagatctcagagataatagtacaaaaaaagtaacttattttattaattttagtatgattatatgttgaaataatactttgtatacattgaattggataaaatatgttatcaaaatgaattttacctgtttctttttacttttttaatgtggctactggaaaatttaaaattatatgcatggcttacattatacttaaattggatggtgttgatcaaaatctttattgagctaggtgcagtggctcacacctgtaatcctaacactttggaagtccaaggcaggaagattgattgaggccaggaattcgagatcaacccgggcaacatagcgagactctgtctctataaactatttaaaaattagctgggcatggtggcacgtgcctgtagcccagctgctcaggaggctgaggtgggagcatcccttgagcccaggagttcaaggttacagtgagctatgatcacaccactgcactccagcctgagcaacagaatgagaccctagctcaaaaaaaaaaaaaaaaaaatccttattgaatgctctcgagcaaacgaaatcttaaatttagatcttttaagttcagatacagatagaatgaaaagttctcctagttcttcaagaaaaatagtagtaaaataatactttacaggaaaatcatttttaaaacagaccacttgaaccagcttccctaactttcccttacttgaccagtctgataggcagaccctggtgggatacttgctttactattgttggagagcccaaactttttaggaaaataatagtcattctaatgccatatggcaggttgatttcatttaagtttctaatttgggttagaaaattaaatattgctacctgtattactagttccccttttaaagggaaataaattgataaaataaatataggcatatagttaaatgtaaggacactaaacacagaaatagattagtttaaaatatttttaaaatttcctgagaaattacaaaaaagaaagtacaacttagccataaaaaggaacaaaataatgccattcacagcaagctggatggagttggagaccattattctttttttttttttttaatctgagatggagtctccctttgttgccctggctggaatgcagtggcgtgatctcggctcactgcaacctccgcctcccaggttcaagcaattctcctgtctcagcctcccgagtagctgggactacaggtgcacgtcactacacccggctaatttttgtatttttagtagagacggggtttcaccatattggtcaggctggtcttgaactcctaacctcaggtgatccacctgcctcagcctcccaaagtgctgggattacaggtgtgagccactgcacccagctggagaccattattctaagtgaagtaactcaggaatggaaaaccaaacattgtatattctcactagtatgtcagagctgagctatggggacgcaaaggcataagaatgacacgatggactttgggggaagggtgggaggggaggtgagggataaagactacacattgggtacagtgtacactgcttgggtgacgggtgcaccagaatctcagaaatcaccactaaagaacttttccatgtaactaaacaccacccgttccacaaaagctattgaaattaaaataaaaaatgtactcattaaaaaaaaagaaagtacaaaggagagtgaagagaggtaccagttactagtctgtaaacaaaacaatacttcaaaatagagatggtaaccctgggtcatgtcattcccaggtacattttgtgctaacatctgtaagcagtcagataatcaccactttaaatcatattttcatcacctgctttcaaattccttcctactttgcctctagagttgatttgtaggcaaatagtgtttttagtttgctatatcagcgtggacttaatagcacttaatacatatatctttaattcacattcatatttagaaacaaacattttgagtttaatattcgtggaatctatagttggaatggatatatttgtgtttttaattgtgctatttgagctatttaatttatacttgaattcaggaaaacatgaccacaatttttctagatcattgcccttatcatttgaaatatatttttatgttgctagtttcatactagcaaatcaagtcaaatcagtgttctgactttagttctgaaatgtcagatccggtgacatttaaattgctttgaaggctggccccccagcaattctgcctttattttgagagtgggtaggtgataagagactagaccaaggacttgttcagccatttaccaaatcaaaatgtgaggctcaaatggagccaaatgtgtggcagaaatggagcatccatttctgcttacaaactttcagtataaccaatgtatcacatagcaaatggtgaatgtggagataaaaatacaatttagactgggcacagtggctcatgcctataatcccagcactttgagaggccgaggagggtggatcacttgaggtcaggagttcaagaccagcctggccaacacggtaaaaccccatctccaggtgctaaagttgaacgagctgatggatatgaaccaccagtccaagaatctgtttaaagttcagacttaaaatagtggcaaataaaaagtcctcatttgtgatggtttgcttctgaaagaaaaaaaaaagtctctactaaaaatgcaaaaaattagccaggcatagtggtgcacacctgtaatcccagctattcaggaggctgacgcaggagaatctcttgaacctgggaggtggaggctacagtgagccatgatcacgccactgcactccaacctgggcaacagagcaagactctgtctcaaaaaaggaaaaatacaatttagttacatgaaagaggcaaaatagaaaataagctgaaaataaagagaaaatatcagttttaattgtggcaaacaccaaatctgtttacttcatgactcctgtgtcacaggatagagttaaaatcaggcttttgattagaatagagaggaatggaaagagaaaaacttaagtcgaaaacagaagatatgaaagggtgagttctaataaaaatgggaagctagagataaacataaaaatgagtaataaaaattttaagcttttcctagaattagaaggcagaacactcctggagaggaaaaatctgtgcaggcatgtgattgatgttgtctggctcagcctggccctccagcacacttgttaaaagctttcctcatggttatgacttcccagcacaaaccccacagctgcttcacatcctcccctcctgcggggccttcctaactacttttggagatggaggcatctttcctgtgcctctgatctcttcctttgcagtaaacactgagcccccagccctgccatgctgggctccaaacatccagcttctcattagaatcttaacactgccctctccaactgatttggtagactctgcaggtaccacatcacttgtcactgccccatttcattgactctaagaaagtcatttgtagaagttagcagtcagcttgcagatggtaggacaaaggcaggaccagcaccatattttctgactccagatcctgtaggcttttcctcactgccacttacaaacacacagagtgcttcctttaaaaaaacaaacaagtaaaaccttctcttgaccccgctatttctttcctactgccagattcttctaatatgatcgtgttcaaacccagcatggcattattggaaggactgctgactttggaattgggcaggccagggttcaaaacctaccctcatgatagctgtgtgatcttgaacacgtttctaagcctcagtttctccatctgtaaaatacctacctcacagtgtggttgggacatcaagtgacagtgactatattaagtacttagcccaatgagaggtgtgataattttaactgattattacataattgtctctggcatactgacctcaaccctgactcctccccaaaagttgatcttgctcaggattctcattaccttttctggctgaatcttgtggtcttttctcagctttcagccttctccagctatttacaacttaatttcctctactctcttgattttcttaatattattgattcttcctttccttgtggcttctcttttgtcaaattttctgacttctttttctcattctacccttatgtaagtcaatcttctaaggttccatctacgatcattgctctgttgacaagactaagttgaattaataaatcagaaaggagataatattatctattttactttctgcagtacatccttagccttggttcttccttacctgtctcccttcgactttctaatataaaaatgtcacattggattttaagtcatcagcaaacgggtaaagccccagtgctattagcactggatggctttcattattctattccatgtagacatggcaagcgatttccatgcccaaactgttttgtatgatgatgatgatgatattaacaactttgttttccaaatagtattatagagtttacacagtagtcctacatacattatttggatttgttcttcaaagtaacattgtgaggtaggtagagtttggaattatccaacactttttttttttttttttttttgagacagagtttcactctttgttgcccaggctggagtgcaatgacgcgatcccggctcactgcaacttctgcctcccgagttcaagtgattctcctgcctcagcctcccgagtagcagggattacaggtgcccgccaccatgcccggctaattttttacatttttagtagagatgtgatttcgccatgttggccaggcttgtctcaaactcctgacctgaagtgatccacctgtctcggcctcccaaagtgctgagattacaggtgcgagccaccacgcctggccccagcacattttataaatgatattttaaaaattctgactttgactctaggaatagtgccttttctgtttaaaccatactattttttgttccctattccgtataacttccctgataggtctataaatgctagattttaggctaaagaatagacaacatatttttattttatttagggaaaactaagaaaaagaggtaaaaatcaaaacagtaaattgagttattagtttattagcagatcaaggaagagttacaaatttggaggctaagattttattagaagagttggggaaagtatttgtggtttgtttttttttttttttttgcttttggggaaagtattaagaaatgtgtactttttttattaaaagctcactctatactgtatatagatttaagcttgcaaaaaatatgaaaagctatagtcaaagattttaaagggtaaaaagttaagctaagtttaaatgggggatttcatctctctagttagagaagtatccatgttaccatagatcacatccattcattcatcattcactctaattgtcttttgttcctacctaatgaagtatgctgtatgtttgttttacagatctaaagcgggaagccagtatctgtcatatgctgaaacatccacacattgtagagttattggagacatatagctcagatggaatgctttacatggttttcgaattgtgagtgtgtattttaattcttaaagggtaaaacttgaagcaatgttggtgttggataatgctaacacttttctcttgaaatttagcagtagttgtgaacttatctgttcagaaagacctaaagtcacaagaaaaaaggattatgtcatcataaggtttacagtggcaaaggaagcaaaagctgggcatattcagttactcttcatgctttcagcatgcttcagagaagagactccaaaaggaaattgagttcagaggaataggaggaccccaaactataaacttctgaccagtagaagtcttagtgaagaagagtaggatgaaagtggaggcatccatgtagcaagactcttggcaactaaaaacaagtaacgacagacttagttcctcttttgatataatcaccatatggcatataagggcaattttatagatcacagtgtatcttgatttcaataagtcacttgatatgtctgtcgcagactttttgttggtaagatggagaattgtgagctaaggatagtacaactgggtcatccagctctggtcggatgattgtgtccaaagagattatataaagctttataggacagcatcctacagggttttatctttgatcctattctgttcaaaattgtaatcaggccgggagtggtgactcatgcctgtaatctcagtgctttgagagtctgaagcagggaggattgattgaggccaggagttcgagaccagcctgggaaacataccaaaacctatctctatttttttctaaaaaaaaaaaaaaaaggttgtaatcagtgactttgattaggaaaaaaaacagaagatatacttgctaaatattcaaaagataccaaggtcagaggttatattcattacctattgcttcataacaaaatgccccaaaatgtaatggcttaaaacaacatacatttattatcttagtctctgtgcatcaggaatgtgtgttccaacttagcagggtcctctggctctgggtctctcacaaggtgataataaagctgttggccagagctgaagtcattttgaggctccactacaatgtggatctgcttccaagctcactcacatgattgttggcagtcttaccttcctcacaggctactggactgagagccacaattccttaagagctgttggcccaagcctcccttggttccttgtccgttgggcctctccatagagcagcttccagcatggcagctggcttcatcagagcaagcaagaggacaagtgagagtatgagcaagacagaagtcacagtctcgtaacctaatctccaaaattacacaccatcacttctgcagttagaaatgagtcactagatccagcctatacacaagggggatgggattataccagggcctgaatatcaggaggtgaggatcactgggaggcatttcacaagttgccccctacaaagggctagctaacatattggctgtctacatcaaaattcaaaaatatttttacaagtttgtagcaaaggagctgaaacaaagaaggtgaaatttaagaccagttaatgttaactccttcattcaaatatgagtaagtgcaagatcagtgtgaatttagttgtgattatgtgaaaaaagatgtaaacattttagttgttgtttgcaacagcttaaaaagcgctgaatggaaggttatgctacattaattaggagtatatagtattcagaacaaagtcatactcctcccgttcaccctggaccattcatagtaagcaggacactggaatgtctgcagaataggataaccagaatggaaaggagcctgaaaattgtgtcatagagacacagccttcaaaatcttttctggcaaacctgctaaaagaattttgaggccaggcgtggtggctcatgccaataatcccagcaccttgggaggccaaggcaggcggattgcttgagctcaggagttcaagaccagcgtgggcaacatggcgaaaccctgtctctacaaaaaatacaaaaactaggtgggcatggtggcacacgcctgtagtcccagttacttgggaggctgaggttggagaatcacctgagcctgggaagtcaaggctttagtgagccatgattgcaccactgtactctagcctgggcaacagaacaagaccctgcctcaaaaaaaaaaaaaaaaaaaaaagaattttgaaaaacgtatgtaccccttcacatattttttaggttgatatataaaaacttttattgtgagaatataattctcagtatcttgaatattcttttaaatatgttttgtttgtttgtttttttgaacagagtctcactctgtcacccaggctggagtgcagtggcgcaatctcggctcactgcaacctccgccccctgggttcaagcaattctcctgcctcagcctcccgaatagctgggactacaggcacgtgccaccatgcccggctaatttttgtattatttagtagagataggtttcaccaagttggccaggctggtctcgaactcctgaccttgtgatctgcccgcctcggcctcccaaagtgctgggattacaggcatgagccaccacgcccagccttaaatatattttctacacaactgtagaattgcctgtttatctcattcactgtatggaaaatgtctgctatgtgacctacatggcaatgctagtccttattgtcaaatcactcagccaaatcagactcattttctgtcagggaaaaaaaaaatctgacttcatttttcaaacaaaattaaagtgttaaatggacatccctgtgacactcatcttagtattgattttgaattcttaaacagcttaccatgaatatattgcctggataaagtaaggtggaacctccctttttttctcaaactctctttgttttgctttcaaaggtctctccctccctcaggggctgtgcatttcccagccatctctttgaagttaggctttttgggttggaggagtagtttgccttttggatgggtaactggagatgtggagatgggtgattgtagttgtggagatgtaaaagaaaaaccgcagaccacagacttgtttacaaacagacaaaattatggaaaatgaagatatggaaattgattgccttaaaaatatcctagttcatgtgtctcctggaaggactttgggtattcccagagatacccaaatcctaggttgaagaccactggcctagaagagctgttgaaaagactgggaggctttggttatccacgaatgtattcgtttcattattctgctggaagagtccccaaagcagaagcccatagatagaacataatcaatgtccacagttatttgaaagattgtcatatataagactatatgcttattcagtgtggcatcagaggctgtaactagaatcaacaagtggcagacgtcacctctaactaaagaagacctttttgatgattaaacttactccatgaatgaagcagcctgtctcacagactatgtagtttctcactagaagcactcaagttgaagctggatccttccaaggggcctgaagataaggttttaattttggactagagatggcctctaacatcccttctaattttaagatattgtaattcttttgttttttttttttttttgagacagagtcttgctctgttgtccaggctggcgtgcagcggcgcgatcttggctcactgcaacctccgtctcccaggttcaagcgattctcctccctcagcctcccaggcacaggtcaccacgcctggctaatttttgtatttttagtagagacagggtttcaccatgttggccaggctggtctcgaactcctgacctcaggtgatctgcttgcctcggcctcccaaagtgctgggattacaggcatgagccactgtgcccggccaagatattataattcttttaaaattacttatctggtttaattttattctttattcaagaaatatatttctgtctgtatgtttattttctgagaaaactaagaacaagttgggtttgttttttgttgttgttgtttttgtttttaacagtctcactctgtcgcccaggctggagtgcagtggcgccatcttggctcacttcagcctccacctcctgggttcaagcgattctttgcctcagcttcccatgtagctgggactacaggcgcatgccaccacgcctggctaatttttgtattttttgaagagacggtgtttcatcatgttggccaggctggtctcacacccctggcctcaagtgatcaaccctcctcagcctcccaaagttctggaattacaggtgtgagccaccacgcccagcctcctaaaaagcaagttttacatactatataaagtaatgatcacagaaagcaaattttaaaaattcacctaaatttcaccatgtatgctaattgtatcaaaggggacttagtgacagtgtagtagagaaaaaaggatctttggtttcataaaacctgggttaacatcccagctctgtcacttttactaattatgtgaggttggccaagttttataagttccctgagcctcagtttgcttaccttcagaatcttcctaagattatgagaactagatgagaaactgtatgtgacttccctttgtaagtggtgaagtgctttttaactataaagtattatttccagtggctttaacaggatagttttagtccctcattgttgaagtagtctgtgtgggattttatgtaactaattttgtatgttgtgatggaaataattcatggttggctgtatatcgagatgagacctggttaaattggatattttccagtgacctgatcccagtgttaacccaaatcactagaacatggccttatgttttcttttgttttgttttcttttttaacagtgtaattgtggaaaatttcaaatgaaaagagagaatagtataataaaccccagcatactggtcaccaagcttcaatagttatcaaaacattttgccattcctattctgttcctcctgatgtctttttctcccctggagatttctaaagcactataatttcacctataaatactcttgtttgtatttctaacagataaggattttttaaatgatcatattattattatacctaacaaaatcaacaataattccttaatatcatgtcatgatcagttgatactcagttttccctgattgaacatgaattttaactgacagatttctgaatttagaattgttttattagctctagggacctgaaagtagattataaattcagttaaaataacttagttatttctcaaaagggccagaagcaaactagaaatagaaaattgttcttttgtatcattgttttgtaaattcacctcaacaattggccttgcacagttttttgcatcctccttatctcctgggtttcaaacaaaccaaaaatatcgattactctaagatttaaagtcatgtggagcaaaaaacaaagccaatgcacttgtgtatagttccacctactggctaggtgagagattgcttctatagctgctacgtagactaagctactccagaattgccctcatgtttctggcaacagatgtaattacccctggtatttaggggctcattgctcaggttatgggttatctggatcctttttacagtttttgtaacatgacacccatacagtgtagacaatgaaaggcaaaaaaataaaataaaattaggtcagttagttttgttgtttgttggctacttagaagcagcatttatcattttggtggagaaaaggctagacaaaacagcatatttggatcatgagtgagtttcttaatatggtgtccatatctgtctttgccacagactatgtataaccaacactcctttttttcttcctaaactgaagtcatgaaattatatggcccgagaatgttgtttatcatgttagaaaatccttagaactagttgatggctgggctcagtggcttacgcctataatcccagcagtttgggaggccaaggcaggaggatcacctaggggtttgagaccagcctgggcaatagagtgagacctcatctctacgaaaaaattttaaaaattagccaagcatggtggcacacacctgtagtcccagctacttgggaggctgaggtgggagaattacttgagccacagaggcagaaattgcagtgaaccaagatcatgccactgtactccagtgtgggcaacaaagtgagaccctgtctcaaaaataataagccggacttggtggcttacacctgtaatcccagcagtttgggaggctaaggtaggtggatcacttgaggtcaggagtttgagaccagcctggccaacatggcaaaaccccgtctctactaaaaatacaaaaattagccgggtgtggtggcacacacctgtaatcccagctactcgggaggctgaggcaggagaatcacttgaacccagaaagcagaggttgcagtgagccaagatagcaccactgcactccagcctgggttacagagcaagactctgtctctaaaaataaaataataataataataatagttgatatctacttaatcacaaatggtttataagtttaaagcatgcttaaaaacagagactcacaaaaccagaattttagatatggaaaagattagattagtaaatttcaaattttaggttagaaaatccggtataaaacttgttaaacaagcaggtacccaggtcccacctctagacattcacttttgcagatgtgagttctgaccgggcaggtcaagagatgattgacctttaaaatgggggtaatacaacataaaggctatatcatcattgtcccaacacacacagtagttttgtagacatctgcatatatttgcacatccattactttgggattacacttaaatttgaacctgtctgtagcaatttgctgaaacatattttaaatacaggttcagttttgaagacaggctgagttgggttatccccacaagttaaatatttatttctaagtgacacatttgggcttgtctttagtagtatctggtacttgagttaagctgtaaatcctaaattggctggccaaggaattttaattaccttattacagagcgattacatataccacggggagacttttacaataattaaatattgatttaaaacacatccgacatgatgtgtatcttttaaaataatttttttgtatcttttaaattttttatctttaatatttttaccttttatatctttaatttttttgtatattttaaaataatattagcagtttgtgtttttgtagctcacaaaggcgataaactgaaagctctttttttattattatttttttttggtctagtatttatgcctggggaagggagtgtttgtgaaatttatttatactgatagagtggaactgattactacttaccagcaaacttgctgcttaagggaaaatatgtttgtctcataccaagcaataaatatctgtactgtagcattttaatctatttgaagatttgctcatattttcatagctagtcttatataatctattttgattttttctttttatgtgtgatgatataaattgctatttgttctttcagcaaagtaaacatctcttttgactcacagtatcaaaatgtttagttgattttagttttgcaaactgtgtgtcagggatccccaagaccacccccaggcttgatgattcactaagaaaactcaaaggactcagcatatagtcatattcacagctatgatttattatagctaaaggatataaagagaaatcagcaaaaggaaaagatacattagctgaagtccaggggaaaccaggcacaagctttcaagggtctccccagcaatgagttgtgacaacacatgtgaaatggtgccaaccagggaagcttattagagactctgccctgggtttttattgggggctggtcacataggcatcttccacttggcacttaaccaaattccagactcccagaaagaaagcaggtgttcagcctaaatcacattgttagcacaaacagtttagacacagtgagtcagtcttttcagtcaggaatgtagaggaccgtcctgaaatccaagttcccagataaacctctcaagggccaaccttagtaggcctttcaagccttttatgagatagtagtttaggcctgctatattaactcttctgcacaaactaaaatagagataaatagaagaagggttttaaaagagttgatataaactcctggatctgcaaacaaaatataattgactgtaaagataatgacagggtttggagtttggggtttttttttttttctttttaactgtaaatacagtatcatttttatatctgttaaaaaacatttaggtggtcagatttttgtataaaacaaatcctggattgggatgttacagtatagaacagattttaaactttgaatgctatatgagaaaataaactattcagatgctactgtcttagaaatacatttgaaattgtcactccgataacttttcgtctatgacaactaatcttcaagccactaaaataattttgaataaatttgtgtacatataaaatctgaagaaaattcagttaattttctgttatttaaaagaagtatagtttgttcatttaaaaataaaagttattggccaggcacggtggctcacacctgtaatcccagcactttgggaggccaaggcgggcggatcacttgaggtcagaagtttgagactaacctggccaacatggtgaaaccctatcactactaaaaatacaaaaattagccaggcgtggtggcgggcgcctgtaatcctagctactcgggaggctgaggcaggagaatcacttgaacctgggaggcagaggttgcagtgagccgagatcacaccactgcactccagcctgggcaacaagagcgagactcagtcttgaaaaaaaaaaaaattcttagtgtacaacctttgccatatacataacttgtaaaaatttagaaattacagaaaattttgacaaaaaataatgtcttaattttgttataaaaattgtaacagaaataaatgtcattcacaaacattttggaccatttccttctattggaagcattttgctataccattaaatattttttggatacaatattttaatgacttcattaagacatctaaatgtgtgcatgtgccatgtttaataaattccctatagttcaacattaacattgtttttccctattagaaataatttataattaatatcttgtacataattacttgttcacgccccttgattgctttgtttcctcagaatacatttctgaaagtagaataactgggtaaaagagtatatgaatacatacaaatacatacatcatacttagatttaacctttttctcagtacaatgcctcacattttgaaaaatacattcacataaatatacaacttaaagaattattgtagaagtgaacaaccatgtaactataacccaagtcaagaaattttaaaactgccagtacctcaacagcccctgaattcccctttctcatgataatccccttcttctctcagaaataactaatctggacttcacttctgtgctttttatatccctagcatcaaaataggaattctcagaattctcaaataataaagttcactgtcgtctgctaaaatctattttttttttttttttttgagacgatgtctcgctctgtcgcccaggctggagtgcaatgctgtatcagctcactgcaacctccgccccctggattcaagcaattctcgtgcctcagcctcccgagtagctgggactacaggcatgcaccaccacgcccggctgatttttgtatttttagtagagacagggtttcaccatgttggctaggctggtctcaaactcctgacctcaagtgatccgcctgcctctgcctcctaaagtgctgggattacgggcatgagccaccacgcctggcctaaaatctttatttgaatggaatcctacagtatatactctatttttggtctctgagattcatctggttgctttgtgcagctgttcctttattttattgctatgtagtattgcagtgaacaaactcgcactatttattcattttaatgctaatgagtatttgggtgattcccagatttcactattttgtagagcagatccttccacgttgttcttcagccatgttttaagggatgtacttgtctgcatttctcatatacattttagaatgaggttgtcaatttccaccaaaacaaaaaaactattgagatttttgtcttgaattactatatcaaatcttgatagcaatttgagaataattgacatgtttacagtgttgaatcatccaattcgtgaacatagtgtctatcttcccatttatttagctctttgatttcttgcaataaagttttatatgttcctctgtagaggttgtgtacatctgtattagatttatgtattgtcagatttattcttaggtattttgtttttagggtaagtcagtttctctcattctcccttctctttccctttccttgtactaactttgtgttcctattcatcaggcttcattaattccaacaattaatctgtagaatcatttggattttctccatacataatcatatcatctgtgtataaggaggatttgatttgccctttccaacttttttacatcttttcttgcctttattacaatggataaaacattcagggcagtggtgatggcagttatctctgcttatttctgatcttagagtttgctaagcatgaatggatcatgaattttatcaaatgtcttttttctgcatatgcagtcatgcatcctataatgatatttcagtcaacaacagactgcatatacatgggtgctctcataagagtataatggagctgaaaaattcctatcgactagtggtatcatagctgtcataacataatagctcaacacatcactcacgtttgtggtgatgctgctataaacaagcctgtgctagcagtcatataaaagtataacacatacaattatatacagcacacaatacttgataatgataataaataactctgttactggtttatgtatatactatacttttttgttgttttgtttttattttaattttatttattattattataccttaagttttagggtacatgtgcacaatgtgcaggttagttacatatgtatacgtgtgccatgctggtgcgctgcacccactaacttgtcatctagcattaggtgtatctcccagtgctatccctcccccctccccccaccccacaacagtccccagagtgtgatgttccccttcctgtgtccatgtgttctcattgctcaattcccacctgtgagtgagaacatgcggtgtttggttttttatccttgcgatagtttactgagaatgatgatttccagtttcatccatatccctacaaaggacatgaactcatcattttttatggctgcatagtattccatggtgtatatgtgccacattttcttaatccagtctatcattgttggacatttgggttggttccgagtctttgctattgggaatagtgccgcagtaaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcctaccaacagtgtaaaagtgttcctatttctccacatcctctccagcacctgttgtttcctgactttttaatgattgccattctaactggtgtgggatggtatctcattgtggttttgatttgcatttctcggatggccagtgatggtgagcagtttttaatgtgtcttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggctttggttgccattgcttttggtgttttagacatgaagtccttgcccatgccttgtcctgaatggtaatgcctaggttttcttctagggtttttatggttttaagtctaatgtttaagtctttaacccatcttgaattaatttttgtgtaaggtgtaaggaagggatccagtttcagctttctatatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagttgggtagcgtgatgcctccagctttgttcttttggcttaggattgacttggcaatgcgggctcttttttggttccatatgaactttaaagtagttttttctaattctgtgaagaaagtcattggtagcttgatggggatggcattgaatctataaattaccttgggcagtatggccattttcacgatattggattcttcctacccatgagcatggaatgttcttccatttgtccttcacgtcccttgtaagttggattcctaagtattttattctctttgaagcaattgtgaatgggagttcactcatgatttggctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcttcttttcctaattgaataccctttatttccttctcctgcctaattgccctggcctacagtatgttttaagctaagtgttattacaggagtcaaaaaggttttaaaattttttaagtttattatataaaaaattatagtaagctaagatttattattgaagaaagaaaaatacttttatataaatttagtgtagcctaagtgtacagtgtctagaaagtctacaatagtagaaagtaatgtcctaggtcttctcattcactcatcacttactgactcacccagagcaagttccatgaatgcaagttcccttcatggtaagtgccctataccagtgtaccattttttatcttttatgctatattttgattgtaccctttctatgtttagatacccaaatatgtattacagttgcctgcagcattcagtagtcacatgctatgtaggtttgtagcctaggtgtgtagtaggatatcccatctaggtttgtgtaagtacactctatgatggttgtacaggaacgaaatcccctaactatgcatttatcagactatatccccatcgttagcaacacatgactatattgaaataattatataataccatccttcaatctattgctgtagtgaattgcattgattcttgggttaaccaaacctggtcatgatttatgatcttcataatcctttttacatattgttgggtttggtttaggctttctgtgtctctcttttttaatttatttttacttttttttttttttttttgagacagggtctcattctgtcatccaggccatagggcagtggcaccatcacagctcactgcagcctcgacctcctgggttcagttattcctcctacctcagcccctttctgagtagctggaaccacaggcgtgccaccatgcctggctaattttgtagagatgaggttttgccatgttgcccaggctggtctcagactcctgggctcaggtgatctgtccgcccagcctcccagagtgttgggattataggtatgaaccactgtggcttcctggttttcatacctagattacacttgcctcataaaatgaattggggaatgttctctcggtttttttgttgttactattgttctattgattgattgattgactgagatggagctttgctcctgtcgcccaggctggagcgcagtggcgcaatatcagctcactgcaacttccgcctcctgggttcaagcaattctcctgcctcagcctcccacatagctggaactacaggtgtgcaccaccacgcctggctaattttttgtatttttagtagagacagggtttcaccatgttaaccaggctggtctcaaactcgttacctcaggtgatccgcccgcctcggcctcctaaagtgctgggactacaggtgtgagccaccacacctggcctctattgttctctttatgtgatttgtagaactcacctctaaatccatccaggccagagttttcaatcttagttcaattccttaaatatttataggaatattcagggtttttattcattactgtgtcacttttagtaaactgtattttgctaagaatgagtgcattttatctaaattttaaacagttttggcataaagttcataataccactgcaggttctgtagtcatgtcttctttttcattcttgatactggtaatttgtgccttctctttttctttctcagccttgccagacatttaccagttttattattcttttcagtgacaacttgtagctttgtaattcttttttttttttttttttttttttttgagacagagtctcactctgttgcccaggctggagtggcgtgatctcggctcactgcaacctccacctcccaggttcaagtgattctcccaccttagcctcccaggtagctgggattacaggtgcctgccaccatgccaggctaatttttgcatttttagtagagacggggtttcaccatgttggccagactggtctcaaactcctgacttcaagtgatccgcctgcctcggcctctcaaagtgctgggattacaggcatgagctaccgcgcctggcctgtaatttctttttattgtgtgttgttttctattttagtaatttctacttgctgttatttccatccttttattttgggtttaattttctgggagctttttcccttttagtttcaacctttttgtatccttgggttttatttgtacctcttgttaaaggcatatagttgtgttttattccagtctctcaatctttgtcttttacttggatcatttagtccatttacatttaattatattttagtatattttgagttttatctatggtcttatgtgttctctatttgcaccacctattccatgtttttttctctcttgatttatttgaatcaaatgaatatttttatcattctattttccctctgttaattttgaagtttaagcactcttttctgttatcttagtgtatatcccagaaattacagtatgcttcgtaacacatcaaattctgatattgataccattattgtcctcctgaacagtgcaagtactgtagaacatgttaattttatataattccttccttgacttttaggctatgtttttcatgtatttaaattatattcgtgtgtataaaaacataaatcccatgtatttatatcatctcctatttcttatattatttgtatcgatttggatttacccacacacttatcctttgtttgttctttattctttcagcatctctaaggttttatctgggttcattttccttgtgtcagtctgctggatgcaaactttccatttttcttagtttcagagttatttcttatatccccttcagtcatgaaggatattcactgggtagagaattctagattggcattttctttccattagatatcattccactatgttctggcatccattgatgtggagaattcagctagcaggggctgtaacttctctgaaggtaatgtcattatttctcaggttattaaaaattatttcatcttttgttttctgtagtttgtgatgtgtcttaagagtgtgcgtatgtgtgtttgaaccttgccttaggttctttgttttttcaatcagtgtattgatattattcatggttttagaaaattctcagccattatttcttcaaatgttgcttctgcccctttatctctttcgtcagctttgtgaccaaattaaatattggtagaggtataccttgtggtattttctatgtcttctaccttcttttctgtattttgcatgtttttttttctccatgctttggtctttttgtttcttctgtcctctcttactggtctctttctcttcagtactgtttaatctgatgttaatctattcactaatttttaaatgttaattatatttttcagttttatgtttctatttcctttttaaaatctactgtattattttttggccgggcatggtggctcacacctgtaatcccagcactttgggaggctgaggcaggcagatcacctgaggtcaggagttcaagaccagcctggccaacatggtgaaatctcgtctctactaaaaatacaaaaaaattagctggacgtggtggcgagcacctgtaatcccagctacttgggaggctgagggcaggagaatcgcttgaacccgggaggtggagtgagccaatcagcctgggcaacaagagcaaaactccatctcaaaaaatagatagatagccagccagccagcctgggtaacaagagcaaaactctgtctcaaaaaacggatggatggatggatggatggatggatggatggatggatggatggataggtaggtaggtaggtagatagatagatagatagatagatagatagatagatagatgatagatagatagattgtattatttttggcttttattctcttgcaaaaaaaaaaaacaagctcagcttttatgttctagggcatagtaagcttcattgtttgataatctgtgctggataatctcagtatatgaagtccctgtgggtttgcttttattgtctgttatttttgctggttattggtcgagatctcttatcccttcatgtaccttattcatttttgtcttgtgctagaaattatgttgaaaattattggcctaagatgatgctttctttctccaaagaggaattttgttgttgttgttgttgttgttgagacagggtcttactctgttgcccagactgaaatgctgtggctcaatcacagctcactgcagcttctacctcctgggctcaagtgatcttcctgcctcagcctcctgagtagctgggatgacaggcacacaccaccacagccacttaattttttttatttttagtacagacatagtctcactgtgtttcccaggctggtcttgaactcctgggctcaaggaatcatcctgcctcctcagagtgctgagattacaggcatgagccactgtgcctggcccaaagaggatttttatttgctgcttctactgcgaaccttcaggcacctagctgtttaagactttcttactcaagatttaaggcttagattttcagtgccacctagatgtaaagccgggttgcaagtctgtgaaggggctgattgcttccagttcacccctagctctttagggcatcagctcagtgctggagagtagagtttatcagattctcttgaattctcactcattttcccttttgagcccaggaattagagaccagcctgggaaatatagtgagacctcatctctaaaaaagtttaaaaattagccaagcatgggggtatgcacctatagtcccagctactcaggagactgaggcgggaggatcacttgggcacaggagatggaggctacaatgagccaagatcatactactgtactccagcctaggcgacagagtgagactctgtctcaaaaaaaaaaaaaaagaaaaagaaaaagaaaagaaaaaagtactttttttttttacttatttagttgtcttcaatgggagacatcatctagtctaccattacaagaagcagaactctagcaatgtatttaaaactcttttaacgtagttttcatattactctccataaagatttaccaatttatattcacacatggtaaataaatgtatctatgtttacattttgataggtcaaaaggatgttttggtttaatttgcatttattttgtcattagtgtggtcaaatattttaaaagtaaatttacccatttcttttgcatctagtcactttcattagttgtttagttttccttagttgttttagttgtaagaattcttttttgtttgtttgtttttgttttttgtttttaatagagatgggctctcccttgcttgcctaggctggttctgaactcctgggctcaagcagtcctcccaccttggcctcccaaagtgcagggattacaggcatgagccaccacacctggcgaagaattctttatttgctaaagatatttacctttttcatgtatttgtaaatattttccccaaatctgcctgttttattttgcttgttgatttttttttaacatgcagaacattaaaattctgtcagaaaattacagataagcaatagggaaggctagaatgaactcttagctactagattagagttgaagacagcagtataatctcatattgaatttattatatgtacacacacgcacacatacacatatacatgtacagatatatacagaaatcataaattatatgtgcatacatgagttagtacacatacattcctagctctgtccacttagagagcctaaagcatacccacacctagatttttgtttctgaatgtcctcctctaatttaagcagccagggatcctcggaaaaatgattataaattctagggctggaaaagagaaaatataagataaacatgaagcatcttagagtgcctgaaggtaaggaagtattcaaaaagatgggggcatatcagagagacataggaaccaacctgaaagcatgtccagtggccaaaactggaacaatttgagcaaaaaataacacagtatagattacaatccaaagtataaaataaatacttatgagtgcatagtgatataaagaaataattagataaacaattgagagagaaaaaaagaagaattccaagtgttaggtatagataatttccctccacccttgagtgtaggttggacttagtaactcactttcaaagaacaaagtatggagagggaaatagtaattttacagtagagagaactaacagattatcttcaccaagtgatcacattagcattaccagtgatcattcctgcgtatatcatccgctccttgatatgatgtgatgagaagggcatttcacctctgatattcttcccaagaaacccataaccctgacctaggcaagagggagacatcagacaaacccaaattgaggaacattctataaaatacttggccagcatgctttaaaactatcaaggtcatgaaaaacaagtaaagactaagaaactgtcaccaaccagaggagactaaggaatcttgacgactaaatgcaacgtggaatcctaaatggcaagggaaaaagtatatagttgacaaactgatgaagtccaggtaaagtctggagtttagttaatagtaatgtaccagagttactcttagcttttacaagtgtactatagttacctaagatgataacactagaagaagttcatttagtggtatacaggaactctctgtacaatcattcctcagtatatatgcaggggattggttcctggaacctcacgtgtactaaaatccacgcatctcaagctctgcagtcagccctgtggaacccatatataggaagttagccttccatataggcaggtttcgcatttagcaaatactgtattttttatctgcatttggttgaaaacattctgcatataagtggacccatacagttcagaactgtgttgttaaaggatcaactgtactatctttgcaacttttacgtcaatctaaaattattctaaaataaaaagttttctttactctaaacaaacaaaaaagaaaccatgagtttacaccatttccagtttaaagtagcaattacagatttttatttacaagacagttattaaattataaggaattattataagtaattttggtattatagttatataacaaaaaagagttcttaccttttggagataagtactgaaatatttatgcataatgctcttgtttttgtttttttgaaacagggtctcactctgttgccccagctggaatgcagtagcccaatctcggctcactgcaacctccacctcccaggttcaagccatcctcctgcctcagccccccaggtagctgggactacaggtgcgcgtcaccatgcccggctaatttctgtattttttatagagacagcgtttcaccattttggccaggctggtctcaaactcctgagctcaagtgatccacctgcctctgcctcccaaagtgctaggattacaggcgtgagccagtgcgcctagccatttatgcataatgttttattgatgtccgggatttgcctcaaaatcaagcagtgggtaggcagtgggtactatgttggaatacaggtgaaacaagattggccaatgtgttgttaattgttagagcagtgtaatgaatgtatgaaactctgtattttctacttttgaaattttccataatataaagtttttttaagtgagaaagaaattacatagtttttaactttttaagttttatatttgtatatcttatctctgaaaatctgggttccttgccacattaatatacttatttgcttcatcctactagtttaaatatgcaataaaaataagactattgaatgcagattaggatttctttgcacttcttttcatccgaagggtatatcccacaggaatgcacaatcaaaaccctgggttttaaagaaattttaaataactcttctcattgtggttttgccacaagcttgatatagatagatttaagtttgtttgtttgtttcagtttgtttttttatttacatagtttttattacaattttagattcacatacagctataagaaatatagatccttgtagactttgcccaattcttcccaaaattaacattctgcaaaactactgtgtcacagccaggatattgacattgatacaatccactgatcttattcagatatctgcatcagtttgtttttaatttttaaaattgtcttttttttctccttgctttaattttggttttagattatgaaaaacatgtatatgattacacaaagtcaaacctgtgaatagggttcattcagaaaggtctagtttgcatccctgtccccattcactttcttgccctaaagaaaacaatttttaaaaattagttattttatttttccattatttttatttgaaaatatgagaagatatgtatatgattttgtgccaccccccttcttacacacttccatatattctcatctaaaccttgatttttaaaaaattttaatatgaaaacactggggatcactccatggcagtaagtagacatcttcttcattcctgtttatgcctgctgaatactccattatggcaaagaattgtttattaaaccattcccctaatgatggactttgggattattttcagccttcttttactacatgaataaccttgtgcatacgttatttcatactgttgctaatgtcaaattccttcctcaaatgttgtgtcattttgcatcgccaccagcactgtctgagggttgtaggcttcaattttaaattgtgatttaaaggactaatctctgtcatataaattagtatatgtcttacttcattaaaaaactgtactcatatgtataaggctagacaaagagagtcatagataaattctgatttattttatggccctcatttatatctgtggacttgaccagaatgcttttaactagagtgggtttcttatcattgtaaggtcactaggtctaagaaaatttgtaatactcagaaatagagagaaggtcatttgtccctctgccatttgtttactttagatagtaggcagagtcattgaatcttattaggaaatataaaaaacatacttgctctttttgccagactcgaaaaagtactaaagctattcatatttcttatacacaccattgagagctcaagaggttcacaggaaataaaggcaagattttgatgggacttttaagacaaggcaaggatttggggtttatcttgaagatgtggatgccatcctaaggcatgtgatcagatcaccatttttaaaggttgtttttttttggctacagtatggctatagtataggaaggaacacatttggatatggggagaattgggaggccattgccattgttcagtatggatattgatggctaggatagatcagtgtcagcagagagcaacagaagtgaattaggaattagaaaggatagggtttgatgattagataaaggaagtaaaggaggaagaggagtcaaagctgacttgccgtctctggcttgggcacctgatatatgatggtgccactgactaacttgggcaaccctggaagcagatgatgcagtatactttggacatgctgagtttgaagtctctgtaagatatctgaatgaaaggactaaataggaagttagatatgtggattaggagcacagagagagatcttgggtagatacagagatttgggaatggttgctacttagatgatttagaagagtatatagagggagaagaaaaaaggacttgaggactgaggttcttccaaattttggaggttgtagaaaaggaggaatagctagcaaatgagatagagaaggaatagctgaagagatagaaaatcacgacagcaaggagttgcagaagccagaaaaaaaaaagtgtatcaggaacaatattataggaaaatgaagggtttgggtaattcttagttccatcctttactagattcctgtattcttcaactattgtcgagtgttcatgctctgcacagctcccattcggcctcatttctgagatgtgctgccttttggtatctattggtatctctttgctgccatttggtattcctatctgatatctcatttccttagtgagggacatagtgagtgaaagaacattagaggacaaatggaaaggcctatactgttgtcctagctctgtcaccaactttatttagtaattttgtttctttatgcctattatctgtgagatatagctagaatttcaggacagagatggctacacatggaaacaattacaatgagaagtaaggagagagaggaagagaaagagccgtcatagaggaggtgatactgagaattgaaggatgaccaggagtttgccaagtggtaatggcaaggatgaaactagaaagaagtagtaaatatattataaagatacagaaatatcataaagctttctttttgagacagggtcccactctgtctcccaggctggagtgcagtagcacaatcatggctcactgcagcctcgaccacctgggcccaagctgtcctcacacctcagcctccaagtagctgggactacaggtgcacgctaccacacgcggataatttttgtatttttttgtagagacagggtttcaccatgttgcctgggttggtctcaatttcctgggctcaagcgatccacccacctccgcctcccaaagtgctgggattacagacatgagtcactgcacctggcaaaataataaaatttaaagaaagaaaatagaatgaagccaggcctcataggaactaggaaaaaagatctcaggaatccaagttactgttctcttcattccttagggttttgtgtctactttgctctggaagaaccagctttctccagttactcaagcgcttgcacatgaccccaaaacgggcaccccagtttccaaaatttgtatgaccttgaagcccaagtaatttctttctgcttttcttacttcacattccagatagaaaaaaaataaacatgaatgagtgaatgtatctatctgattatctcagtttcccccccttttttctagaactgagtatcctaagttgttgacctgacccccctatagataaccttcttttgaatcagggatctgtttcatccagtggcaaacagaagcccactgctgtttccatgattgggctggggctttagatgggagagtttaatagaatatagatggcaaatcgactatatgagtgggaaaagagagaggcattacaggcaggcaaagagcatgtggaatgaatggccagaaatatgagccagcttgtgtggttgggacactgctaatagtggtgggctatgactttggaacaaggtgcaagatgagagaatggagattagcttggatgtgtacaaataaaaccatcggtaagtatgaaagagaagctgagagtcatagaggccagttgagaatatccaacacacataaacaggaattctagaagtagaacatagagggaatgatgaagaaaagagaccttattcaaaaagataatagcccagaactttcccaaattgaagaaacattgtaacctcagatagatgtaaggtttggagaagaaaattgctaattttcttggattatttgagtttatggtggttgtaggatacccacctgtaggtgtctactccaaactgcctgagtctggcccccaggagaagaacctaggctagcaataagagtttaggaggcattaccattagcacagggtccatttcacttcttggcacctcagtttctaccctagcaacttttgagaatgaaatgaagtgtaaaagtactctgataatcacaacactacatagttttaccattgtcttcattgtcattgtcataaattctattgagtatagagcctcagtattagaggagaagagctaaggaacctggagccagatttcctatattcaaatcctggctctgctactttgtaaccatgtgaccttggacaagttatataacatttgtcttaagcctcaatttcctcatctgtgaaatagtacctgtctcctagtgtttttatgaggattaaataagttactacttgtaaagcactttaaatggcacttggcatgtagataaatgcccagtaaatctttgctattagctattaaagtacctgcatttcacaggaaccttcagtatcttatttcagaggagtgactaatgtaaaaatcatagtctatgaggataataaatttaggtatctgtgtcttcctgtaatactcaaaggatcagtttagttaactgctggcttttgtctatgtaaagagttttgtggttgtttgcaaattgctcatgatgttatttgaacattcaaggacttctatttttttcttggtaatgtctgaaacttggaaataattcatgggcatatgggatattctcctgaggacacaataatggttccatttttcttgctaagttggaacaatttaatcttgagcaaatacctatgcttgtgcttctgtttttgtttatatctgtatacatctatagttttacaaataccaatattgacattttcattttagccagaaacttgcctaaaagtaagattacacgagctagtttgatttcagagtgcaaatggcagtaaaatgaaagcagaaaataaaaaattaaccatatgattattttgtaatccccagtgtgtttgttcaaggtgagatcattttccagattcatccttcacctgtaccaccttcctgatctgcaaggccatatcagggctggcatggttatttacagttatttagatgttctgtgaggcagataaacagaagacaggacacaagtagaactgtcaaaaaaaaaccccaaaatccatgaattccacaagcgactagaaggaacttgttgtggttttcatatctacatcgtttgaaagggcactccctctcctagagatcaggagctgtactgttagtgatggcaggggctgcactgatacacctgcctctgaatgaagagaaggttttgaggagcaagaaggagaacttatttctagagagaagaatggaaataagggctagagagacttagaaacaatcgcagatacacatccataccagagttacaagaacttacacaggatagcaagcaaactgatgcaatggttatgactgatttggtttggggtggcagaggatccatcccagcttctacctgcaaaagtaagtaggactaggtcaaaggtctaagaaacttaaaaaaaagtgtgtttaaactagctgaactaatacatccagtagataaagaattgcacataaggtatttgtataataattttttttgaattaatgaagttaaaaaatttggggagagagggctgggtagaagagagagaaactcgagaacttgggcctttaaaccctgcaagcataactggggccatttaactaaccaacgtcctagttgaacagagctcattttgagtacagaaacaatagtagcttggaaacttagttctacctaaccccatgaaaccctgtctgtctcctggtcagttgggaaagaacttgtgaggatttcagtaattaaaaaaataatccccttgaagaattagaatgtcactgttctctcgataacccccgtaagtccaagttaaggcaatagcagcctcctccttcaaaaaggtgaacaggaagcatggagttatacagcgggctgagaatcaagagactgaggttctagtcctatctgctattaattagttactaacctaaagcaagtctcttaaacttccagttctaagattctgtgatgtaactcatcgtgatttatatctggaggtccctccccctcactttagtgttagagattagggaggtgggtgtttagctgtgaggattagtgagtacactgaggactaacagtgaagttcctacatggtagaagctagaacagaataggggctattgctcttatctgccttgctttttttctggaaattattagaaagccatacagatatgtatgttaacgtaaacaacaaatccagaggtcgtcttagaattatttgctatcccttgtagctggagcttccttatccactaggaggcaccattgtcaaacaacattgattaggggtcaagagctcttgatcatttaagcaattggagaggaaaaatgtctagaaagaagaaaaaagaggtaaatataggaccctggaaattgtgaaaaatcaatctttgttatctagatggacattagaacagttctcagtttctaaaattcgataaacagtatttcagactacatatcaattttagaagtggcaaaatctttcaaggcagtctttttttcgaagaaacaaataagatatgaaaaaagaccttagaaattactgagccaaatcccatctttattgaggagtcatgatcaacccagaaaggttaagtgtcatgaccaagatctgccaggcttgagcctaaaaccgatgtgtagggggggcatttctcattgattttggccatcccaacacctgaactctcttcaagtatttggagaatccctcattttaagagccttgataggggaaaaaatcccatattctactataaaagctaaaaatggcagatatttgcactactaaacatttagacccacagaactaccacaggacacacttggcatcagattcacttagaaggatacaggacagggggaaagaaaaaacagctttttagtcaggcagcaccaggcattcctctgcagtacgagtcctttcagtagtatatacaataaagttcagtaaatataacagggaaaagaaagatttttaaatagtgttgagaaaacaagttaacagttcagaaatcaatttagattcacccttccccacacacatgcacatacaacaaaaatactacaaacaaaatagagttgatagaagctaatcaaatcataggaaagctagcaaaagataaaattatttaacagatctttagagagcttttaaaacttcaaagaactgggatccacaaagaaaaaaggtatcaatagatttaacaaaaattgaaaaaactagaaaattaatttgcttcaatcttgacataaaaggtttacattctatcgaacataaagagttcaccccaacgaaagggaagatattaagcttcatacacaaacaggcaaggacaggaatagacagcttccaccaaaagaactacaattggtaaagaggcatttgaggatatgctcagtcattttaatgtctttgacagtatatcagaattgctttattaaacagtgaatattccctttctccattgaaaaggtgaaggtttctatctacttgcatatcttaattaacaatcctgaataagcaccattcatattgaaaaaatatgattatatcctatttacagtatcagtgcaagaggaggccttagctccatttatagcacctcagacattcccaaccccaaacccacctactatgttgacacatttcctggtgctccaggccttattgttctttgtcggaacaaatgccttgaaatgctgctgtcctcttaactaccatgtagtcaccaccactcccccatgctctcacccttgcttcttgaggacctgtctcagaggctgactactccatgaagactttctttttttttcctttttttttttttttttgagatgaagtctcgctcttgtcacccaggctggagtgcaatggcatgatcttggctcattgcaacctctgcctcccaggttcaagcaattctactgcctcagcctcccgaatagctgggattacagatgcctgccaccacacctggctaacttttgtatttttagtagagacggggtttcaccacgttggccaggctggtctcgaactcctgacctcaggctatccgcccgcctgggcctcccaaagtgctgggattacaggtgtgagccactgcgcccagcccatgaagactttcttaatctctccttctgtaatgtaggctcttagaagatgggatcttcatgtaactggtccttctatcctctacaaatagtagatgtttaatgattgaatactgaatgaaacataatccccccacaaatacggagtagtttagatggggaaagggtgaaaaagattatgcgtacatgactcctttctttcagaaatgaattcgccaccaacaaatatttgtatatattcatcaatatgtgggatagtatgctgaagacaaaatacctgtttatgctctctatttgtctatagacaattgtacagaccagaaggcacctacccatgaaataaataatagtaactgccaggtgcagtggctcacgcctgtaatcccaacacttcgggaggttgaggtgggaggatcacttgagaccagcctgggcaatataacaagattccatctctacaaaaaaatttaaaacttagccagacatggtagcactacttgtgaggctgaggcaggagaatcacttgagcctgggacttcaaggttacagtgagctatgattgtaccactgcacttcagcctgggtgacagagcaagactgccattcattgacttataaataaatacatacgtacacacaaacaaacaacttgtagtgtaggtctaaatgaccgtagagaggtacagattgttagggcctcataagttcattggaagaaacagttaggagctagaataggcagacaggcttataggaagttgataaagggcatcagcaccagtgtaggagtcagatgggtggaaaggtgaagaaaggacatcccaggcaggagcataaagaatgcaaaagtgttgggaaaagatggtagttatgggacatttgtgaagacatcaaaacagtaccacaaacaaagccctgaattagaaaaaaaacagaattaaagatttttttaaaaaagactgatttgtgtatgcaaggattacagcatttatcaacaaacttactaaatatagacaattcatttaaattatatcaataatatagtattcatatgtatcatctggaaagatggggacataggctctgtattttaaaaatccccctatatggttctggaacatggggcccccataataggcatgaaaatggatttcacatatggagcctttctttacattatgattttacctacttagttgtaatctcttgtcttccattaagtaactgaaagcctggagcagaagtgaggaagtttccctctttgtaacctgagcattttgtggaggataatgcatggactgtaagtcagcttgcctgagttagaatccaggctctaccccttacaagctgtgtgatctcttggtcaagttacttaacttttgctgtttctcagttttctcgtaagtaaaataggggaggtagtcataatacctatgtcgtagacttctcgtgtaaacattgaatgagttaatgcatataagggacttagaaaatacctttcacgtagtaagcactcaataaatgctagctttaattatttattacagcaaaataaggttacttctgtctttgaactgtatataaaataaaccaagcagtttaggtttggctacatctgcttcactcagtattttgtcttcaggattcagccatattcctttgtgtagctgtaattaatttcctttcattgctatatagtattctatacccattttatctattctactattgatggacattgggttgttcacagtttgtgaccattgtgaacaatgctgctataaacattcaggtacacatatcctggtccacataagcacacatttctttgaagagactgtgtttgcccagtatcctcctttgtcataaatcaagcctctatgtatgtatggttatgtttctaggctctctgttatgttctactgtgctgttgtctgtcctagtgtcaatatcatacacttaattactgagctttgtaggacattccatacatagtacctgtggacatggaggtgggggctaaattttgaaatcaagtacagcaaaaactccaagaggtgttattcttccagaatatcttgagtcttcttggccttctgcaattccatatacattttagattctgctttagagtttccacaaaacctgttgggattttcattcaaattctgttgaatctatgcttcaacttggaagacatcggctgtttacaatattgagtcttcttgtcagtgaacaggataattttctctccatttatttcatttgtttaatttctcttaaaaaaatcatacttttctccacagagatcttatatacctttcttttagatttatttctacattcttaaagaaacactcttttaaaatttcatataacttacaatgattttgctgaactctgcttagttctaattttaacttagattattttggatattctatatataccatctgtaattagtgactgtttcttccttttctattctcatacattttatttctttatcttgccttactgccctggctaggacctccagaataatattgagtttaaattgttagagtggactttcttggcttgttcctgatctaagagttttttaagttttttaatcacaaatacatagttttaagtgttttgacatttattgacctgaccacataatctttcatctttaatctatcagtgtacacaattatattaattccaaatgttaaaagttttgcattcctcgggtaaactcaatttggacctggtgtaattcttatatattgcctgtttggggttgttaaacttttgtttaggttacttgcatctatgttctttagtgaggttgtcttttaattgtctcatactgtccacagtaggttttagtatatggattaaactattttcataaagtgagttggaaactattcctgctttttattcttttatttctccttagaatgttcaatagaacttgtcagaaatgggctgggtgcagtggctaacacctgtaatcccagcactttgggaggccgaggcaggcagatcacgaggtcaagaaatcaagaccatcctggccaacatggtgaaaccccatctctactaaaaatacaaaaattagctgggtgtggtggtgcactcctgtagtcccagctattcaggaggctgaggcaggagaatctcttgaacgcgggaggtggaggttgcagtgagccgagatggcaccactgcactcctgcctggtgacagagcgagactccatctcaaaaaaaaaaaaaaaaaaacttgtcagaaatggcatctaggcctagagttttctgtctcagaagattaaattactgattcagtttcttgaatcagtaaaggattattcaagttttctaattctttttgttaattttggtgagttttatttttctgagaatttgtcggtttcatatacatttttaaatttgtgacataaagtttcagtatcatcttttatttctgcagcatatgaaatgatatctccttcattgttaatactgggtgctatatgtgtcttttctcttttctttttgttatcagtcttgccagagattcatcatttcacagggaacaacttttagctttgttaatttcttgaatatgtttgtcttccatttcattaatttctgcttctatttcctttcatctaatttctttgaatttaatttgatgatctttatgtaacttatacaggtagatgtttagttcttaaatgtttagcccttctctttttttgagtcagggtctcactgtgttgtccaggctggagtgtagtggtgcagtcatggctcactgcagccttgaccttccaggctcaagcaatttggccgtctcagcctcctgagtagctgagacaacaggcccctccatgcccagctaatatttttattattattatttgaagagatgggggtctcactatattgcccaggctggtctcgaactcctgggctcaagtgatcctcccacctcagcctcccagagtgctgggattacaggtgtgaggcactgcacttggccagcctttcttttctaatatgtacatttatagcagtaaatttccctctaagtactgctttacctacattttacaagttttgatgtgtttactgttattattattcagtttaaaatattttctaatgatttattctgagatacatgtaataaaagtatattgtctagtttccaaatgttaggaattttctagatttattaattgctttaaaatttatttatttacttttttagagatgaggtcttgctccatagcccaggttggagtgcagtggtgccattatagctcactgcagcctcaaactcctggattcaatcaagccttccacctctgcctctggagtatctgggactacaggcatgtgctgccatgcccagctaatttttaaatttttagtagagaaggagtctcactgtgttgcccaggctgatatcgaactcctggcctcaaatgatcctctcaccttggcctcccaaagtgctgggattataggcatgagccattgcacctggcctttattaatcatttcagagaatctatttgttgctttgctttttctctattttgtctctttacttcattaatttctgcttattatttccttctaccttcattgggtttaatttgctgttttttaaaacatgtctcatgatgagatgtcactgacttggtaacttttcatattttctaatattttaagtcagcattcacaatatttctattaaatttctaattaaagttttaaaacaagtttatggatacaaactactttgtaagtaccatttcatctgcattctgctttttttttttaacagaactgatttcctatgacaaaagtatagtgcctattcatttttttaaaagtaaaggtaaaaagaagaaaacaaaaaatttcaaatagaattctacccagtctttaacaccccattttaatagcaaaggcttcacactgcatctacttatacataaatatgcatatatatgtttatacatgttaatgtattatgaacatctatgtcaataaatatatgtctataacatcatttaatggcaatataatattctactctagttaccacaatttatgtaaccattctgttgggaatttaggttgcttctaatttctccctattataaatagctgtgataaacccttgtcattaaaacttgaccagtattcctaattatttcccttggaaggaaataattgagccgaaggacatatacatgtttaaggtttttgtcacacattataaaattgcccttcagaaagttgtattggtgtattgttctatcaatagtagattacctactttaagcaaggtttctccagtgccaagttgtgtatgtaacatggatcaccagcttcttaacctgtaagattggacctatgcccctcctcctttcagccatttttctatatttgtgggtctattaatggcaaaaccctgatcttgaaatgtaacgtaccaatcctgtacaagttttgatagtactcttttcattatcattgttaggaatatgttctgctgggcatggtggctcatgcctgtaatcccagcattttgggaggccgaggcagaggggatcacttgaggccaggaactcaagaccagtctggccaacacagaaaaaccctatctctactaaaaatacagaaattagctggacgtgaggtgtgcgcctgtaatcccagctactcgggaggctgacgcagaagaataacttgaccctgggaggtggatgctgcagtgagccaagatcatgccattgcactccagcctgggcaacagagcaagaccctgtcttggaaaaaaaaaaaaagttctaattttcattatgatgatttcttatttgattaattggctatttagcatgatttctcaatttccaagcatttagggttttctagttattttgttaatttatttctaacataactactttgtggttaggaaacatactctgagtactcgtttcttgcagaagtttttagactgagcttttatctccatagtaagcattgaggtttttggggtgttttttttttgtgtttttttttttggtgggtggggatggggtcttgctctgttgcccaggctggagtgcactgacagagtcatggctcactgcaacctcaatctcctgggctcaagcgatcctcccacctcagcctcttgagtagctgggaccacaggtgtgtaccaccacacccagctaatttttttttattttttgtagagacagcatctcactcttttgcccaggctggtcttgaacttttgtgctcaagcaatctgcctgcctcagcctcccaaagtgctgggattacaggcctgagccaccaccatgcccaaccagcattgaggtttttctgtgctaccaacatgacataccagaatttattctgtaccccatttttcatagtgcagctctatggtcccagccaggagcaaagggtgtttcatcagagccttaacctcttagatcaccctggtgcaaaagcaactggaccctgtcattctccatctgaccaccccaccccctcctacctctctagagttcctaaaagtacccctcctttccaaaacccacattcttcccctagggcagaagcagctcttgttcacctctttgagttgtaatcctttctctgttctcaggactagtttttcactcactatactgttaattctcacaagctttaacaaaaactttttgtttgactgggcacaatggctcatacctgtaatcccagcactttaagatgagaggcccaagcaaaaggatcgtttgagcccgggaattccagaccagcctgggcaacatagccagatcctgtccctacaaaaattaaaaataaaaaaattagccaggtgtggtggtgcatgcctgtagtcacagctacttcagaggctgaggcgggaggatcacctgagcccaggcattccaggctgcagtgagccatgattgtgcccctgcagtccagctctaggtgacaaaacgagaccctgtctccatttaaaaaataaataaataattttaaacatttcatacagtttttgtagttggcgtttttgtcatcctcagaaaaaatgctggttggaaaaatccagatttgctctgtacaacagtgttcttcaaggatatttgcagataagtaccaatctgtcaccagtctgccatgagatacatacagaaattgacagtaaacatttagaaactgttacagcaatttgacattgctgtgaaatcatagcacgtgattttgtgccttcaactccagataatcctgttgccaaagcagcatattttggagtggcatattctgatctccctcaatgtgcagccagtaataccttgtgcctcaagacctgtgatctgttttgtttatttgatgagtttggttttggataatttcttaattatataaataatgcatgtttattataaattttaaaaattcagatggatgaaaaggagagacagctaagctcattcataatcccattacttttcacaattcagactaaactgcccttaatttctctctgcatacagtatagaagtccacctcccccatactcttccataggagggtttcttctccctctcctttcattccctcagaatggagccaactaggaaaattcacaatgtgttctttgggggttcttgacagccccagaagcaccccaagatgggaagccaaagagaagagcaataaaagatgccttgtcagtttgtagaatcattatattatcaaataaagtttatcaaagaattgagtcatcaactttgttcaaaaggttcaaggttaggatatcaggatggtatgtattatgaatatgtgtattttaaatttcgttgaataaaatttgcataaataacagtatttttagtttttatttctatatctcatgaaatttaaaattagtagattgcttcttttactttaatatcaattaatattataaataatcaaatagctttaataatagaaaaatattttcacagtgatgcctctctttcagagtaacccttcaaagaatgtgcctgtatatttactaagttgcacaggtggttttgtttgatatctgtggttatgaagcattgaattaaaaaaaaacatataatggctgaaagatcccatttacaatagcaactaaaatataacatgtacagggaaaaagcctaataataaatactttaaaccaatataaagaaaatcgtaaaactataacttagagacatgaaaggaagtggagagacatatcatgttcattgatgagaatattagaaaatgttaatttctagaagttaacctatacatttaccatctgaatcaaaatacaaagattttttatagtttgacaaaatgattttaaaagtcaactgggaagaaaaaaatcataagaaaatgttggtgaaggccagttgtggtggcttgtgcctgtaatcccagcactttgggaggccgaggtgagcagatcacttgaggtcaggagttcgagaccagcctggccaagacggtgaaatcctgtctctacaaaaaaatacaaaaattagctgggcatggtggcaagcacgtgtagtcccagctacttgagaggctgaggcaggagactcacttgaacctgggaagcagaggttgcagtgagctgagatggcgccactgcactccagcctgggtgacagagcaagactctgtctaaaaaaaaaaaaaaaaaaaaaaaaaaaattggtgaagaataatgagatttttttttgccaaatattaaaagctgctactacagtattttattttgtctgtccatgtttttgtttttgttttgagatggagtctcgctctgtcaactggagtgcagtggtgcaatctcagctcactgcaacctctgcttcccgggttcaggtgattctcctgcctcagccttcagagtagctaggactacaggcgcaggccaccatgcctggctaatttttttgtatttttttagtagagacagggtttcaccatgttggccaggctggtcgcgaactcctggcctcaagctatccgcccgcctcggcctcccaaagcgctgagattacaggtgtgagccactgtgtccggccctacagtattttaaatggtaacttgatgcaagaataggcaagtcagtggaagaaagtagaaacctaaaaatacccccatgtgtgtatgcacatgtgtagagattgtcatttcaagtaccagtatttcagatatgaccagacaaaatggattgatccttgctgataattatagcacagggcagtaaataatttccaagtatttctcacggactggttccctccttagtctttatacttctcaccactttgctgcctcctccccaggctccgtcttttccctcatcccttctgggtccctccagaaagtcctctagctctcagaacatctcccaaattctttttggaaacaccagagtccattgaggcattttatttgtaagtatatattacatccctagaaaaagaattccaggattttccctcctatatgttttcatcttgcttcttcatggtccataatgccagctgaggtcgttagtacagtgaatccaaactggtgggataggaacaggttattctgccattttactagatctttgggttgcacatcaaatctgggatctggggctgatcactccacacttgtttaacctacctcaggttcacaacaattttcccagctctatgatcatcagtgatttcaaattcaccaatgtaaccatgcttcatcatcacagttagaaactggacagtaactttggagcacaacctaataagaacctggtgtttgcctctttttggtattgttgatgctctggatagcatcagccaggacattcatgcacaccattatggcagcatggagagatggcagaaagagcctaaattcttattgcttcattatgcaatcagtttagctctctccttttcctaacccctctctcatctaagttgaatcgtgcttaccctcatatatcacaattacaaaggaaaacgcctaagcaaaactgattccttcgctatgagatgttttttagtcctcatagatcaactaaccagcttaaactacagccagtttttaaaatagcgtttcttttctccccacaggacaaagaaatgaaaaatatttactctctgtagtaatcaaggaaatgcaaattaaagcaatcatgaatgacttttttcctcttatctaattggcaaagatggaaaaaaaataatcattatcctagtagagcaagggacacattcacacatggtagtgggagtataaattgttaaactgtttctggtcttgtgtatgtatcaaaagtgttattgtaggccgggcgcagtggctcatgcctgtaatcccagcactttgggaggccaaggcgggcggatcacgaggtcaggagatcgagactatcctggctaacacggtgaaaccccgtctctactaaaacaaatacaaaaaattagccgggcgtggtggcgggcgcctgtagtgccagctacttgggaggctggggcaggagaatggcatgaacccaggaggcggagctcgcagtgagccgagatgcaccactgcactccagcctgggcgacagagcaagactccgtctcaaaaaaaaaatgctattgtatataccccttgtcctagcaactcagcttgtaggaattttaccatacagataatcagagttgctcaccaagatgcatgatcacgttcatccaggctttatttctgatggtggaaaatgagtgctgccatactagggagtagactagaccattataataatgtttatagtagactaggcaactataaacattattttggagaagaatcctatttgacattggaaaatgttccttaggtgtgaaatggaaacttggtaaagtttttagagcctgtataaatgtgaaagtattttcattcatttatataaaaccacaccgagaatcaaataatagaatcaactgttcattaggtgtctacagtgtgtcttctgctgagtattaggtaggggtacattgaaagtataaatatattttttcttgttctttaggactttacactatcatggaactgttgtagggcttaaagatgtgcatttgttccttgcacacccagtaggtatagctataatcaatgggaagagcacaggacatagctagacagagatttcgatcttgtccctatcacatacttgtccactcacttagacaaattatttgaaaatgatgctgacctcatggggtggttataagtatgaagggaggcataacaaggactgcttcctatgatgcctcatgaataggaagtatgttagttcctttactttcccttccagaagtttctatttcctcagtataatatctgcagcaggtatattgggaaactgaactactgaatgaatgaatgaatgaatgagatactggatttaaaaatatgttataagccttaaagcattatgaaaatgttagctgttaatatttgcatagtttcattaatatgtataatatggcaaaattcatgtatacatatataggtgtatgtggggggagggggaggtgtttgtatgtgctaaatgttatggaccatatagagttgttatagaatgaaaagcaaaggaaggcattaatatggctggtaatcattgagggggcttccagggaaggtaggattggaatgaaaccttgaattaaggtaggttttgaaaatgaaaagcaatatatacaaaagtaaaaaagaaaatggtgtactcagggagtgataataagaccattctgcctagagaggaagattttcttgaaacatcagtggacaaggtaggtagaagaggcaaggtgtggccaagacaacaagaggccttacttatctagtaagaaatagaaaactactgtaagttctaagacaatatcgtgacattgcgttaccaacacatctatgtgttacaatatgtttgtagcgatgaactttgggaatggcagtgtaaacaaaaataaattttattttatatatgtcattgttttttccttccacagtatatagcctgaattttccatttagtggtaataacaatagcaagattgttttttaaatccttgtattctacataactgaatatttttggaatttgacttaaaaatatgcacacaaccctagcattgctgttttctgatgcttctttttgtgaaaacctaaagaaaaattatagtcaattttatatactcaatgttatttgatattactgttagcctactcttcctgtttctttccctgcagattttcaatgtgaagatgactgtcatgccctttataatttatgtctatatttcattgaaagaaaggagatttaaataacataacccttagcagtaaatcaactaataacttagttacaatgtattcactttcagtgttgtcttcctggaatttcctcttttcttatgttctttttcacatttttttacagtatggatggagcagatctgtgttttgaaatcgtaaagcgagctgacgctggttttgtgtacagtgaagctgtagccaggtatgtattgtatatctaatcaccagaggtcaagttgaaaataaaaaaagaaaatgacaaagacatcacatgacaaactgataaagagcatgctgctgctctttgctacagggaacatctctgttttagtatgtgttagtagaaccgatagtcactggaaatgcaaaataccgaacaatgagtttatctattaacatgggtttataggggccaggcacggtggctcacgcctgtaatcccagcactgtgggaggccaaggtagacagatcacaaggtcaggagatcgagatcatcctggccaacatggtgaaactccttctctactaaaaatacaaaaattagctgggcgtggtggcatgcacctgtagtcccagctactcggaaggctgacgcaggagaatcgtttgaacccaggaggtggaggttgcagtgagccgagattgcgctattgcactccagcttgggcaacaagagcgaaactcagtctcaaaataaataaataaataaaatgaaaacgtgggtttataatacaggcttacattttcagtactgctgtctttcccatttctgatgatttttgtacaggaagcggggatctaatagctcaggaaccatgtagaattctacttgggtttttttatttttgttttggcaaatctgcctcattagttcttcattttgccttttagtgatatcaaattatctcacaataattaaggaaaagtaaagaacagtaaaaggaagagaaataaaagcaccatttttaaaaatatatttgcttcaggccagtgtgagacctaccaatcaaatggcagctgttgttctaagtggagaagttgtttgtaaagacctaatgactcaaaataagaaggaaatatgggccgggcgcggtggctcatgcctgtaatcccagcactttgggaggccgaggcgggtagatcacgaggtcaggagatggagaccatcctggctaacacagtgaaaccccgtctctactaaaaatacaaaaattagccgggcgtggtggcgggagcctgtagtcccagctactcgggaggctgaggcaggagaatggcatgaacccgggaggcggagcttgcattgagcagagatcgtgccattgcactccagcctgggcgacagagcgagactccgtctcaaaaaaaaaaaaaaaagaagtaaatatgaaaaatcacaggagccatgcacgtgctgggccacttgcttatacatttagagcaacacagctttctgttttggttacattcaatcataattacccactcctgtaggttgcctttttaatacatggaatacagcatccctccttagtcaccagccatagtatgttgaagggttcaaactcacaaacatattaagtttttttttttttgcggggggtgcgggcggcgggggacggagtctcactgtgtcatccaggctggagtgcagtggcactatctcagctttctgcaacctctgcctcccaggttcaagtgattctcctgcctcagcctcccaagtagctgggattacaggatgcgccaccatgcccggctaatttttgtatttcttttaatagagatggggtttcaccatgttggccaggctgatcttgaactcctgacctcaagtgatccgcacgcctcaacctcccaaagtgcttggattgtaggcatgaactacctactgttcctagcctaggatttatgaaaactttttatcatttgaaaaacagttatattaaatgatttcctctgtcttaccatttcttttacaattatagcatcttagacaaacatagctggaaacaacttggagaccaccttaatacagctttgagctcagcatgacttgaatgtcttcaaattcattgccctgactccttctggctgaagagcaagggacctagtctcagggatggagcagccatggctatggcacaaaataaagaatatgctcaatgtgtggtcgctgtgtttttgtactgctggggctagggcgaaggagcaaatgaaagtttatgtgtgttctttaggcttctgatctatacgcggtagaactaaagctaaatattctcttttcttttgtgcaatgttctctaaagcacattccagggtttttttaaatcccatcttctattattttgagtttttattacaattttaaatttttattctttcttgtccctcaaaattttaaagcattctttcataccaaaaatagtcaatactagtgaaactcaatggaagaaggggatttttcccttcttgaaccacaataacacggggatacctggcaggtatgctgacaggattgatgtgaaaccagtaccacttttactctggtccccagtcatctttattgcttttccttaacttcaagcctatctctgccactgggctacatgtcaggataagcaggatggtagtgtgaagagatgatgtcatacaatgacatgacttgtggtctctcctaatcttgagatttatagaaaaggtagatgtttatacacatcaaaatgaaagcctattgatttttaaagccacctgtataagctgttaaaatggtgaaaggaactttccagagtggaccagaaaagagtagcattgggaccagtagatgacattgcaaagagagaggtttggaggcagtttattaaaggttcttcctctgaacaataaaaaaaagtaggcggggactcagaaagtattattatgtgtgtttgctattgcagaggatcaatgaccatgcaacaagggcgcgtagattcttccattggtttaatgacagatgacttctaatctttcttcgtcctctctgattctgtgatttattgttaggaaattcagcttgtatcagtattctagtgagaccgactgcaagaagactctgagacaccaagtaatcaaattgataatgttgtttttctccaactggctgagcttcaagaggagcagcaaagcatggcataaaataaaactgtgttcagtccttagtgcaacccaattagttattacctccatcctttcaggggtgatgagttgtggagtgagctaacacacaagatcagattatcaaatcaaactctcagagatcttcttaactagtaccaagctttactaaataatctcaaggatacaggcagtcagaaggctcaagtgaagcagagaagggaagggcagccccccacgtcacttcttactgcctcagaaatgcacctctggcccagaatagatgaggtttatactggggtttgtgggtttccacacacaaaggggagcattgcaaatatcttcattttacaccccagagatttggatagctccattgacattctccaggaagccatctgtgcctcagagatcccgtgttctacttaccatagtaatccttagccagagatatcctattaagggcatttcagagataaggtctcttctgcctagcaaatagcattaggcttttcacctgcattgacaagaatagcagactgaatcacctctcttctaccatgctgcacccctgaaatgcctccttccaaaggcagtaaatgcattgctggccagctttttccttccatggagttattatcttgctgatccttaggaaagataaagataaacaaatatattgctgagtttctctgaaagcacaggtctctatgatgcttcatgaagtgaagttttttgattaaaagtttagtcagcaacttcctagaacatgtgggcagattttagttcttgttttattctgcttgcacactttgacatgcattgcctcgcaggatcatgactgggagggtggagaaagatagttcagttctgttataacttgggaagaaaaacagttccactgtctccacacacgccgcaaagattctgctgtgtacatacgtttgggtcaagtaattgagtgttctcatatgcaaatgaaaaaagcctcattcattgagtttggttttgtgttatgagactttgagataggaattttctttaggttaaagataatttaggtggctgtctcagtgctttgtatccaaaatagttcattctgtgggtacaagctatgtccactttaactaatttaaatttacccagtatttccatgttgacatctagatggacaaataagctgttcctaaatctttgattgaacttaacaataataatattgtactaataatgtcttaacctttgtagcatggtttagagtttacaaagcactttgacaggtgtagtctcttagccatttcaaggggttacagatcttccaaagcctgatttgaaccagtaatgggccacaacaccaagttaacccctcatttgaacaaaacttatggccaggcgtggtggctcatgcctgtaatcccagcactttgggaggctgaggcaggctgatcacttgaggtcaggagtttgagaccatcctggccaacatggtgaaaccctgtctctactcaaaatacaaaaactagccaggcgtggtggcgcatatctgtaatcccagctacttgggaggctgaggcgggaaaatcgcttgaacccaggaggcagaggttgcagtgagccgagatcccaccattgcactccagcctgggagacaagagggaaactccatctcaaaaaataaaaataaaaaataaacaaaacttaattacaggctacaatggcccaagcaaagagtatatgagcacaaccccttatatgtgcatttgcaaagtaagataaattaaaacatcagagctaatgattacatgagcctagctctctggcttaaagccccgttgtaaggagcctgtgattagtacaggaacaaggcttgtgattagtacaggaacaaggcttgggtttgtttttgtttttgttttttctcctacctttcatttttaaaatggaacctttccaattaattgtaatacatgaaataatgcatatgctaactagagaaatattcctgtgagcttgattaaatggtatcatgccaaagagggaacttgatggaaatgtcttttaattgtaaagccaggatagggattttttttttttttttagtcctgagtcacatacacatgttcaaggtcacttgtatcagaaatataagatctggaaacaaaacaaaattctataaatattatacagtgaacagtgttaagtctattgcatttctgtcatgctggttgggaaggaaaagggaaaaaatgagaaaagaaggggaataggaagaaaagagacaaatatggagggaataaaatacagaaaatgaaacagatactcagagaaagagtaatagggcaattatagaagaactttagaaataggagaaggaggttctaaagtggtactgaatcaactgctcttgtcacacatggttgctagttaaccccattaccattttttaattcctgttctttaaaatgctgatttcttctttgttcttcacctgtgctccatgagggctcctcagctggccatgtaaggagtcaggctttctaggacatgtgcctagaattaactccactttgttcaagggagccccaactaaaacttgattatgttacaaaaagaaattgtccgataagggtggctcttccctcatttgtcctcacagctaaatagaagtaagatgaagagcatcttattatttgctggcagatcaaaggctcccactgcttgagtctgaatccttggggcagccctgagcactgtttacataacgcagtccagtttaagtagaattacctgagtattggggaaaaaaattgtcatgttttaagcttgaatttttagtttgcaaagcaaatttacttatgaactatgtgtaattcttttgacttagatagcttagaaaatatagagcatactatttcttcatgaagcccataaacttttgagtctgccaacattttcattattaagcctcactttacaccaatcctgtctgctcaaatcaaatgtgtccatggacagctaatatgagagtgggagttataaactaggagcactgtatattaagttttaaaataaaaattgtttacagtttttagatttcttttgttttttacagccattatatgagacagatactggaagctctacgctactgccatgataataacataattcacagggatgtgaaggtaagtcatttgttatcactaactttaatgtttgtgaagaaatactgatataacaatgataatcaagaattcttctttaatattgtcataaagaacatcttaattttacttctaagtaaaaatgtatttaactgctttgtatttgggaagtcattgtactaattcttactaggaacactataatttcaatttatttatttttactgaagtgttcatgcaatctaaaattgtattatttctcttttgccattgtgtgtgagagagaaatgaaaaatccaataaataggaaaaaccaaacaatatcctatactgagttaattgggggggaaattagaatttggtttatatagtaaaagttaatcataacatattttcataatattgcaatgcagaatagtcagcattgtatttttttgcagatagtttttaaatatagtatgaaatcataattatacatgtaatacgattttatgcttggaataccggtattatcattattcagtctttctgcctatttcatcccagtatcgggttaatgagaactctcagttcctggttctttaacggtgtcaagccaaacatagagggaggcaagaaatgagaccagtaggccttcctcctgatccctagcttctcccaaggcccagaatcactagggagcccctgaggtccctttgaccctgggctacacttttaagctctgatattttgtcactggcctttctctaacctccagcatgcacatacatagtgttccttccctcaagatatattattaaaggcctggcttcttcgatgtatttaatactttaaatgattaagaaaattaagtagagtttaattaaagtgtctataatgtttgggaaattttcacagaaatccttgtagttaaaagctgagggaaaacatgagcaattccaaaaccatctagtaaaatattttaatagcaaatgaaaatcactggagaaatatacaaaatacacattagtgtaaattagttgtaaaatatctcactcatccttttcagatgtgttaagaaaatgatattgttattatcagaactcaacaccgagcatctcaatgggtccccctttatgaaaaagtattctggccaagcccggtggctcatgcctataatcccagcactttgggaggccaaggcgggtggatcacctgaggtcaggagttcaagaccagcctggccaacatggtgaaaccccatctctactaaaaatacaaaaattagctgggcatggtggcacatgcctgtagtcccagctacttgggaggctgaggcaggagaatcgcttgaacccaggaggcacaggttgcagtgagccgagattgtgccactgcactccagcctgggcgacagagcgagactccgtctcaaaaaagtattcttcagttatccaaaaagaaataaaagtgtggaaaggtaaaaggcgggaaattgtcaactgtagtagtttgctgtgcagttattttgcattaattaatgtaagaaagttcatatgtagagagtaaaatatatctctttgtatatattctaaactatatacaagaaaaaaatgataatttaaaaacctaaaatgtgttcatgtaatagcattatgttaagaactgttttgctcaagaggcaattttattttgaatgaattattctcgaaagataattatatcaacatcatataataaacaatgattgacaatatattctactgtaatactttcaataatgtagtcagcttttgattaactggtatttgatatgacaacctaaacctaattaatatccaaaagtagataatttgacctcaccttttaatttaccttctgatttatttatttaacaaatatttgagtgcctactttatacagattactgtgcttggagccctaaaagtattatggtctcagtagggagataaggctcggtatctcttatctactgtagcagatcaacacatgccaaaacatagtgacttcaatcaataactgctgcttacttgctcacaattctgcagtttgggcagagcttgataggactgctcaattctgtttcacaggatgttggtgacgtagcgtggctagtttccacataggcttcactcatttttctgacatctcaactgaagtgactagaacagctgggagctggctgggcgctctttgcggtctctcattcaaaacgtctctctctctccacgtggccctatctccagcaagacagtgtcttagggctccaaaagagcaaaaatggaaggtgctaggcctcctgaagcaaactgacactgtgtcacatcttatgcatttcattagttgaaacatacttcacaaaaaggtcacaaggctagtctgagttcaaggggaagaaacatagattcatattttgattgatggagtgccagatatatacaaggatgggagaacttgttcgtggccacctttagaaagacaaataattattgtgcaaggtagaaggtgataagtatcattaaaagatgaggtcagagaagtttcctgggggaggtcacattggagcttgttcttgaatcatggggtagttatatggagacaaaaagacatttcaggcagaaggaacagtttgtgcaaaggcccaaaagtagtcttacgttggagtatgttagattagtttattatttctaaagtacatgctaaatagtttagaggaagcacgtagaaacatgccaaggaatgaaaaagaagtaattctcaaactgcaaataagtaagaagaaaccaccccaaaaattgccattgttcagttgggagacacactcaacacagagcacacgttaatgttgatattctttttttgtttgttttttgtttgtttgtttgttttgttttgtttgttttttgatacagggtctcgccctgtcacccaggctggagtgcagtggcgcaatctcggctcactgcaacctctgcctcctgggctcaagcaatcctcatgcctcagcctccagagtagctgggactataggcgtgcgccaccacacctggctaaattttttttgtagttttttgtagagacgaggtttcaccctgttgcccaggctgctcttgaactcctgggcttaagcaatcttcttacctcagcctcccaaagtgctgggattacaggcgtgagccaccgcgcccggtgttgatattctttatatttcagaagccgaaatccacacatttttacatgggtgaatagaatactcacatttagttaattgaaaatttttaatgttggtgtatttttcttaagacattcatccaaaagatatttattgagtgcctactgtgtggcaggcactgtcctaggaaccggagctacgtcagtgaagaaaacagacaaaaatcactgccctcatggagctgacattctagttcagggaggcaatactcagtaaacaaatgaactacatagtaggctagaatgtgaaaagtatcacagaaaaaactagagtggtcagaaggttagggagtgtccagagaagggcttgcttttgtaaatatggtggtcaaagtaggccacattgagatgatgatatctgagcaaggacttggaagagaggaagcgggctaatctgacagctgagggaagagcacttcagttaaaaggaacagccagtgcaaagaccgaaagacaggaacacaagtagcctgctcgaggaacagcaaggaggccggtgtggctgaggcaaaatgtgcaaagaggagagtaaaaaggagacaggagatgatcctgcctggctcagaccagagtagtagcagtggaggtagtaaaaaaaaaaaaaaaattagttagattcctgatatattttggagattatgccaataggatttcctaatatatctttggtaacgtaggcaaaacttagttttattcaagaccctgttacaggggtattccaacatagtggtcattgtaaaacttcaagaacaatacatttcacatgctaataatgtaaattttcacttggtttgatttgttaatatttttgccaataaagcaacctatgagcttttctttccattcagatatatattcagtgacttatctgtatgtagatttggtttgtatgtagatttttgtttctgcagttaaagtttttgtctaagttttctttccttatatttaataacgaaaacagaagagcattgcaatattttatttctctaagaaaaatttattttatcatctgtttcatctagccaagaatattctcattctctctctctctctcataattcttggcatatgatccaaaagcattacatttcccaaggatcctgttattatatttattaatacttttttctttacttttttacaaaaggtatttccttttgtaatcattgtaactgagtcttaaaaggattatttggttagatttgaatatatggtaccatgtaatctatttttgggaactgcttgctctgaagaagcagtttcacataaaactgcataaaaagcaatcatataatcctttgaaattcgagagatgtgtgaacatagtgctgggcctccccacagccacacttagtgacatatcaggctatattctttgctgtgggaggctgtcctgggaattgtaggatgctgctaagcatccttcacccactagatgccagtagcatctccccctagttgtgacaaccaaaaatgtctccaaacattgctaaatgtcccctggggcacaaaaattgtccctggttaaggcccactgtcataatagactgttataattctcaagatttgcctccctacaggtattaattaaggcatgcatataaatttctatttttttctgtcatcttcttccctttaattctactttttcttgtgaaagaatgtgaaaactttcattatgtttctggtatttttttttcttcctctcacccctaaattaaaagtactttagaaagaaatagcacagttgtcaaggtaaatgcaactcctggctctttgccttctttcatgggctctactaagcactgagagtttgtggaattttctcctctctcctaactcttgcaggcagccttagatcatgaggttgtggggagacttagttttagacctttctgtcactctgacctactcatgtataattctaataactgaagttgaagtgaaacagtttctctgagaatgcaaattgctacccacaatcactttctattctgaatggtgcctgtgcccagaaggtctgggtgctgtttttagttcttagaactgtgcaaaccccagtcacacacacactcagccagaggccagagtgtttctgagtgtgcttcctttaaatggttttccttgctaacctgtgtgaacacgcctggctgctttttggttcccttctggtctcagttctccttttacctatttaaggccagactttatgataaatttgtgtttatcatataacactggttggcatgacattgtggatttcttaaagcattccgtagtctcttgttctccgttactgatgtttcttttacacctgataccacaactccccaaagtttatcatgttgtatagagaaatttaaattctcataaaacaaaaacgtatttattctttatttattttatttatttatttattttttttgagacagagtctcactctgtcgcccaggctggagtgcagtggcgccatctcagctcactgcaagctcaacctcccaggtccacgccattctcctgcctcagcctcccgagtagctgggactacaggtgcccgccaccatgcccggctaatttttttgtatttttagtagagacggggtttcactgtgttagccaggatggtttcgatctcctgacctcatgatctgcccgcctcagcctcccaaagtgctgggattacaggcgtgagccaccgtgcccagccactattctttattattatattaacattggttaatcttctgcatttcttttataagattttttaacataatgtgcacgttcagttttaatgtggcattttaataattgtacttaggaagatctcatggattacatgattattataaatttatcttgtgtttctaactgctatacttctctttgcccagcctactcctacaaaaaaagaaatcaactccttggttttaagtttctcagcctgagcaacatagtaagaccctatctctctctctccttttttttttttttttttgagatggaatctcgctctgttgcccaggttggagtgcagtggcacggtctcagctcactgcaacctccacctcccacgttcaagcaattctcctgcctcagcctcctgagtagctgagattacaggcgcctgccactacgctcagctaattttttttatatatatattttttagtagagacagggtttcaccatgttggccaggctgatctcgaactcctgaccttgtgagccaccacgcctggccagtaagaccctatctctatcaaaaaataaaaattagccaggtgtgttggcacacacctgtggtcctagctactggagaggctgaggcaggaggattgcttgagcccaggaggttgaagctgtaatgagctgtgattgtatcactgcactccagcgtgggcaacagagtgagactccatctcaaaaaaaaaaaaaattcttttgcttattagaagtgaatccttttactgttcctctccttctgagccaggagtagcgtgtgtgatatagccagaggtttttctgtcaggtgcaactatagctgtagtaactcttcccagtgttatcaattccatttgagtgtaggggccatcagaggaaggtttgtggcattaggctgctggattgaaatgcttatgcttagcagattaccagtgttccctctgttctccctttgtggtttgccggcaggatttcctttcaccttgtcttcccagatttgcccgtaactcccaccctgacagagcacaaggccagtgataggcctagagtcctcagcaaattgaacagaatgggccatcttcctcttctatccagggagtagaaacttacttccctgttaagttgtttatcctaaattttgtctagtcttaatggtttgtgttcctgattatagtttgaaagctgccttaatgagagtatgtgtatgcctgttttctacagtttaagataaaatcttgttggcctttgagtcaaaatttgagattcctgaaaccccaaatttgtgtttgactgtaactcacacagacacattaaaaacactgtttttttgaaatccaaactttaaaatagggtaagttttgaaggtgattttaaaaccaggcacagtggcttgcacctataatctcaaaactttgggaggctgaagcgggaggatcgcttgagcccaggagttcaagaccagcctgggcaacatagcaagagcacatctctacaaaaaaaaaaaaaaaaatacaaaaattagccaggcatgatggcacacacctgtagtcctagctactcaggaggctgaggtggtgagatcacctgagcccaagagtttgaagctgcagtgagctatgatcaccactgtactccagcctggacgacagagacagaccctgtctccaaaaacagaagtgatattttaagtaaaatatttactatgccattaaatagccagttcttcaattacataaaaaaattcaacatgatttaaaatcaactgtttaggaaagcatctatggtgtaaagatatccatgatgataatgagctgagtatatagttcattcttcagtataggaaattaaaatgtgagtttatcagaatgagtaacttaaagagaaattgcatatctcttttcctgcctttttaaatgtaagaatctctagaaatattttttgtttaaagtagtggtagagctgtaaagtgattgttttttaaataattatttttagaagttgtattttttgggttttttgtttttgtttttgagacagggtctcgctttgtcacccaggcaggaatgcagtggtgcaatcatggctcacttcagcctcaacctcctgggctcaacagatcctcccacctcagcctcccaagtagctaggactagagacatgtgccaccatgtccagctaatttttctattttttgtagagacgtggtctcactatgttgatcaggctggtctcaaactcctgggctcaagtgatccccccacttcagccccctgaagtgctgggattacaggcatgagccactgtacctgactggaagttgtatttttttaaaactcctaagtccagtgagattattacatgcagtatagcttatgttaaacaaacattactgtcttagtcggatgagttttggtctcaaaactcatgtaagaataaaactacttagtctgggcacaatggcttgcccctgtaatcccaacactttgggaggccaagatgggcagattatttgagctcaggaattcgagaccaacctgggtaacatggcgaaaccccgtctctacaaaaaaataacaaaaattagccgggcatgatggtgggcacctgtggtcccagctattcagaaggctgaggtaggagaatcacttgaccccgggggggtggaggttgcagtgagccagatcacgccactgcactccagcttgggtgacagagtgagaccccatctcataaaaagaataaaactacttttgtaactgtggagaaatctgtgcatctcaggaactctccctgatggactttgagttactctatgatttacatgtctagaaatcactagattggacacttccatttacagctagcattcagggcggtcacctcaagttcccaaatctcctttgtctctgcacattaatgagccaaaaatccaattactactataaacgaattgatactcactgtaaatatttgaagccagaatgtgttcagacttttctcagaacattttcatgtctcagttaagcatcaaagtagaaaaggaaaaaaaaatttactgggtttttgtgtgtgtgtgtgtgtggttttttgtttgtttgttttgcccccggaataacctctggtgatttttgaacacatggctcttgggcaatgtactgtgaattgcttttacagctctaactcaggaacaaaacatgctatgagattaaagccttggaaggattacgtgaacttactttaaacttcattttggacactgaagtaattactatgtgaagaaaaaaaggagtctttaagcagtctctaacaaagtggcaagttactattaatggttgattttattcagctgtttttgtttggttatctgagaagagaatatcagtaccatggaagtagaaatagacaagaagtttatagctccaaagtgcttatgatctctttgggcagatagtacacgcttttttttttaatcataatatatgtacttattacagaatatagtcaccatcatttgtctactgacaagattacatgaaagaaaagaaattaacattaagaaatgcttatctttaaatgttcacttaaatattagaaaaaattggggtgatttacttaactatgcacatatacatacatacatacatatatatatatatatatatatatatttttttttttttttttttttttttttttttttgagacagagtctcactctgtcgcccaggctggagtgcaatggcatgatcttggctcactgcaacctccgcctcctgagttcaagtgattctcctgcctcagcctcccgagttcaagtgattcttctgcctcagcctcccaagtagctgggactacaggcacacaccaccacgcccagctaatttttgtatttttagtagaggtgggtttcgccatgttggccaggctagtctcgaactcctgacctcaggtgatctgcccacctcggcctcccagagtgctgggattacaggcatgagccaccgcacccagcccacttcaatattttcatcagtaaattagtatactttagagttgtggtgattaaaataatatatgtaaagcatataagtagaatgcttggcaaacagcaagtgcttactaagcgttagctactcataatagtaacagctgatttaataataggatctgtaaataagatagtattttctgctctacaaatgaagaaattaacacgtacagaggataagttaatttgcctaagattgtccagctaaataaaaagtagagccagattgaacccaagaagtataacttcagagatcaatctcttaactgcaatactattacactcccttattattcattcatttatttcacaaaaaattaactgccaggtactgtttgtcactaataacattatttatattgaatacagaagaaaatatgcacaatgtgatgaagatgggcatataatgacatagctttttactttgacaaagcctaatccaaatatttaagcatttttataagtatcatctgctttaaaaatatagtcaatgaatattgcttctccccaataacatgagccagataatttcaaataaataatatgtttataaaaccttggatttttttcactgtattattcatgcatttaggtaagatgtgaatgaggatatttcttatttatttttttacttatttttatttttttgttttgttttatgagacagagtctcgctctgcctcccaggctgtagtgcagtggcacgatctccgctcactgcaacctccgtcccgggctcaagcgattctcctgcctcagcctcccgagtagctgggattacaggcgcccaccaccatgtccagctgatttttgtatttttagtagagacagggtttcaccatgttgcccaggctggtcttgaactcctgacctcaaaatgatccacccacctcagcctcccaaagtgctgggattacaggcgtaagccactgtgcccagctacttatttttaaagattttaaaattaccaataaacactagccatagattgacccttgtattctaactaccagaaagcagacaagtcataaaccatttgcttctttatcctagtcatgaaataacgtgttctgaacagaagcactgacagttgagtttaaacagaaaacagcctgttagtttcatatgagtgggatcctttcaatatgcttaatttttgcttctgaaagtttctgccatctcaacgttcagtataactgttttttgagttttatgaatatatgtttatttatttttaaaaaccaaagagattttcttggtgattattgtcaaccaagctgtgacatgttaatgatgtagtttagtgtccctaataaagtcacatgaatgcttttcttaatattgtggggttttccattcaaaagtcaaccatatgattgcatatgtgctgaattagactttgtaaagagattatatagtgtcttcttgaatgttttatctaataaaagaaatataatggggtctgtgctacttctggccgaagcaagacaggtgagaatgttttttgtttctattaaataattcaattgctgacagttatctctttggtgtagaacataaaaaatgggtttaaaaatactataaggaaggaagcaaactattagtagaatctggatgaccaaaagatgtcttttcacagaactgtaagtcaaatctttctccataatggacgtacaggttcttatttttctcagatggcttacaaaagagtagtatgatgttagtactactaaaaaggaaaatccaataaatgtggttccaatgagacctgcaatctgagagatcatggctcctagttccatctgccgattgtagcataggctctcttctccttctgtagcctctatgactgagtagtatacggtaactggaatgattatgcccagtacaactccccatatgtaaatgcatagttttctagcaaagttgggctggcgaaattttttcagtaaatggccataaaatattttctcatagcatgaagtagtctcttgcgaggaatccttttgcattaaggtagcatagcggcttatggcaatccaacttaaaattaagagactgacaaacatacttgcatgcatggatagagttcccagaaaattgaccactctgcattgagcagattgatattcccattggaaacctttcaggaaatagatactcatgaaaggcatggcactgcacacaagtaagtttgcagtcacaaggtgtgacaggtagatgtgcgttgatgtttttttacctatttttgttaaaaatatccattgagagagagtgtttccaaaaacaccaacaatacaaaggaggatgtaaatgattggtaaagccatggaagagatcatagatggttgaatacatgttgtattgttgttcatttatgtcaggttttcttgaattttgtcacaggagctagaatagaattgcagatatttaatattaaaattatttttggtacagtatttaagctgaatagtttttaaaaaagaaaaacattgaattaaataaaatagtaacaaaaatgtattggatggaacgggaaagtatagatggcttcttaccttttctaatcacgattgtccggttgaaataaagacaaaaagttacttattgtgatggataatgcctttgtctgaaaaacaaaatttgatgtgaatagttacatgcctgggatttataattttacttagagaaatgtatagttcttagattgtaaaacaatttgtaagtgatgattgatttttcctagaaatataatttaaaaaattttaaggcacatgtaaccaattcatgttggccaaagtattacagaagtattttgcggccacaataatagagagttgactggtttttaattaccacattacttatatatagttttcaaaatggtgtctttttgtggctaggctaaaacactcctttataacctaatactattagaagagtctcttttcatatttcagaagttaactcagttctacatgaacaaaaattcaggcaagatcctgaattgaacagaagtatagcaaccaaggacagactccaaaatcccagggtcattaccaaagaatatttaaaatgtcctttcaaatatttaatgttaaactgtcatacttcaataaaagtttacacatgtatgtcaaaactgtagttacagccagatgtggtggctctgcacctgtagtctcagcactttgggaggctaaggtgggaggaatgcttgagaccaggatttcaagaacaccctggacaacatagcgagaccctgtctctataaaaaatacaaaaactagaccgggtatgttggctcatgcctgttatcccagcactttgggaggccaaggccagcctgggcaacatggtgaaaccatgtctctacagaaaaattagccaggcatcctggcatgtgcctggagtcccagctacttgggaggctgaggtttgaggatcagttgagcctaggagttcaaggctgcagtgagctatgatcattctactgcactccaggctgggtaacagaaagagaccctgtctcaaaaacaaacaaaaaaaaactgtagctgctatgcttgttggttagagtgtccttgtgtgtaatttgctatctgagtttttcagaggattttttttaaaggatatgatgttttaatcacaacataaatgctggtttttacttttttctgtcttatatttaaatctttctcgcttcaaagggtacacatgaagtgctgaagaatcatatacaaactgcttttattcttatttttctccttatttcctcacttctttcaggtgagaataacaaaagttactggattctggtcaaataagaaccatgatctctattcagaatgtgccatattctctgtgttcttcaccatagccttctgagcaccacattctccactctttcatgatctagagcaaggtttctcaatcttctttttaatcatgttctcttttgataaacataaaaactgtaccatacacaaccctttgaaattcttatatccccccagcccctcagggcaattttactctctacccccttcagaattatggtttgatttattttctgcatcttggattacagaaattggggttttttttcaaatatgatattataattttataataactttttaaaccaatccacacccaaagtcttgaaaacttgaggactgtgcagtgtctgtgggtttaaataacaagattcttaattaatgtttaccactgtctttataattttatttctttgctatttttatttagaaaacagtccatatgcttcattgtaagtttgtatctgaatctagtgcaacctgatgaattataatctggtttcagttagtgtagaccctggtataaatatataaaacctaatctgtaacttcaccagttcaaaaatcagtcagacagtgaaatgagccagtttatttaagaaaaaattatctgctcacagtaggttttgattttacataaggattggagcttccttttatgatgctgttaaagaaaagcagtagctcctaccttgtgcagataatgcatagtatactaaaaactgcaaaggtaatggtgcttctgtatgaatattaaatgcttccaaacaaaagggacatagacttctgcagaggctagctttatcagacagaagttgagtctctgtaggactctcagtgtagcagtcaacaactaggtcaccatctttaccttcccaaacttgtatctactatgtacatctccttcaaaaataaacttggatcataaaactactagataactattttccagaatttggaaagtactattaagaaatcaaataaaaattacatgttacagatgcaaaactggtctccagaaaatgtctctaagtctatattcccctcaggagaatgtctatctcaagtcactcatgcatacattttgtctctgctaatttgacaaatgaaaaaagttctacaactcttaacttcagttactaatgactgtctacatagttaatatgctgactgcctttcttaatgatcagctttcaaaatttaaaccattaggtcctgtttatttttatagagtttaatttttaagctaaaaatgaataataatcactcttacctgtatgagtagtttatgccaactaaggttatattgttcagggcagtgatgccaaatttcagacttaaaattctctgatcttcactcttccaatatctttagtcagtgtgaatagattcttgcatgacaccaactacagtgggaggaaaaggggaaattaaacagaatattgaagaaattcaatagttatggtcaatgtggcaactgcctcctcaaaaaaccctcatttctctatttctgtagtgggaggaagtggtgaacaatatacatattatacttccttatgattatttcatgaactagttacactccagtaacctttgtttgcacgattgactgaagttaagttcacaggtttaatcccccatggccagttttatatgacacagtgatagaaggagccactctgtagtaacccaatacaaatattggtgcaaactcgtttgtaaaattgtttgtggatggcttatttgcaatccatctttatcaaaaatagaaacaaaactcaaagttttcttataacttactagaatcaaatattatagagctaaaatagaacttcatgatcatctgtggactgagaccctttgttttaaagttgaagaagctgaggcccagaggaactcactgtaagcacagactgcacccagggttgggtcccagtttggttactaatgagttaacccactctgtttctaattgccctgcactatctccatttgtcaacataatacactgtttggggcatttcataatggatttggcaaatcctgggaagtgccaagtatgcctcagatcaaatgaatagttataaagaattgtgaaaccatgactagtctaaaacaataaaaattttaaaaataaaaaatagaattgtgaaaccaatttttttgttcaggattgtcgaatcagtctgtgacctactaactaaatgaaagctaagtgtgtacatctggggaggaagacttgcatcaagcactccctctcatccttgagtagttaaaccagtgggagtctgaaaaagagaacagaaatctaatttcatcaaacctgagcattttagttatcagtaaatcttcacttaaaatttacagaagtaccttgccatttctcataaacccgcaatgcttaccttatttcatgtttatttcataaattctctatgatgtttgctaatatttctctccaaaacaaaagtgagaactgcctaaagtgtccagattgtgttctgctgctgttcatctttgccttgccaccatttacttaagaacagtgactcatccagggttacatggccgttcattacagagtagtttggcttttagaattcccatcacttttacttcagtaatgtatcatgttccaggaaggaattacatagaacaaaaaacagttttaattaatttagagaagaacagaaatggaatgctatttctaagtgattgaaagatagttgtaatattatctgttcaggcataagcgtctttggtccgaaaaaagaacgctcttgttttcctccattgtctccaaactcagtaaatgataccatcactccttcagttattcaagccaaaaacttacgaatcatccttaattcctctttctttcacatctcacatctaatcaattgctggtactacagcttctactatcactaccatcattcattagccacatttcatgagagcttactatgtgccagatatctcgctatgtgccttacatccaagtcttatttggttttcacaacaccctgtgaaatgtctcattttaaaggtgaggaaaactgaaactcagaaagatctcataagttgcccaaggtcacacagccatctgtcctcacaggatggtgattggctcacctcaaagcaactaattcaagaacaagtccatagctgcaatgcctttttgtgatctagcctctgaagtcaacagtgtcacttctgcagtattctattggtcacacagagccagccctgcatcagtgtgggacgggtaaatatcaggaggtgatgatcactgggagccatcttggaaactggctatcacagatgtcaatcaaccgttgaaacaaaggaagagtcagaagtactgcttaaaaaccgttgtcagtccactggttgtttattggacaagcatacctggataggtgtaagttttgccagttcttacactattttggtttttaggtctatttttgttaaacagtgtaattcattcaacaaatacttattggagtttctactatgttcctagcagcatgtggaggtcacagaagtaggatgtttagtcacaagctaattgagggtctctggaaattgagcagattccacaagcaagccaagaatttagattaatatgtgatacagatttcaaatgctctgtgaattagagaagggcagaaacagtgactcaaagtggttctgaaaggctttgtgaaagcaaatggaaggaaagagaggagaacataacctagtaagtgacagttttgtgccaggtatgggacagagcattttatgactaagaaccctagagatgtgtggtgggagtcccattttacacgggaggaaattgaggctcaaagaggttaaatagcttgcctagaggaatacaattagtaaattagctttaaaatgacctcattctctgccttagaaagaaattattggttgttctagcaggtcaataagggtaccttatggtactcacaatagggtcatgttttaagtatttttaactttgttcagatagggtttcctgttctgatttatgtatttgtgtatcctgttctagacttgaggtagcagaaactgaccatggaagaaatcaagtccagtttttttctgtctttgaaaactctggactttgttaagcaaactattattccaacaatggcagtataaattctttaggattcagtgattttgagttccccaattgaaatatatgtaaattttattttcattcttctaagaaattaggaaatattgttacaattggtaaaaagagtaaatgtcagggaatactagattaataaagtatgttacaagtattctgtaaaagtggcccctttggacttttctcattcaaatcaccaatagttttctttggttctcattcatcttgcccatccgtctcttcaaggttccccttctattgtccaagtccaaatgctcttggcctaacagttctagttgattcctgtatcatctgccaaatattgatctcctaagtgttctgctgtcacccttaggatttacttccttgaggtgttagagttatgtcctacaattgaagttctgtcttgtattaattttcctgcttttgagatggatttgtgtatcaagtgtgttttttaatctggccccaaaattcatctggagtggttcagtgagagtgtttcaaagggcaggcatatacttacctggcagaggagataccatcatcaaagggcaggcatgtggacatttattttggcaatccatggtgggctatacatagcaaggggacatgagagctttcctgactcacatggattgttggggttagaattagggtcccttatcaatttccctcagagccagaacccagaggacacaggacagcttagtcattcctgaagccatgtgcttcatctagaaattattttaggctatccaaactagtgtttaaactggctgcaactggcctcttaagtactctcactaaccaatcaggagctcagggcattgggaggctggtatgcagaaagagaagacatgactaatttagtacacattagaatatcatattcaaaagataattatttctttaaatcaggggcagtggtaagtaagccttgtccagttcaacatacacccaagccagtggttatctttaggaggagtgagacacagtgcagttactcaaagctatggtttgttcaaggctcactgagccccctgccctctccaggaagtggtgtctggccacagccttgtttccagtcacactgttctcaggccctcaccgcctgccacaagcagctctgatcgtgggtgtcccacccttaatcagagtgtgaagaaaaacctctccttgttctgaagagctggtttctcagcaagcaatgggagcgtttctctcaagaattacttttaaaaacagcagaaaatacagtctgaagtttgtaaatttataataacacagaaaagttatcagcttttgtaaaaagtaaagcagaggttcctcttcgaagactttcctccccatttaattaggaataaatagtaacttctcttagaagtgaaatttattcaaagacctgtgctaacattcttaaatatctgctagccgtgataaagaaatcaatgtactttatgttcttagctcccacaatttagcctaaatatttgccctggcatgcttatactggtgcaagcaagcattgggtcatagcctgttcctcttccttatttgcaggtttttacttttctcagcattccacaagttacttcctccttcttttgttctcctctgcctttgccttttttaagaagttctaagttgctagccaatcgggacagatacagaatgcgaggtcccgttccagccaatggaaaccggacacagcagtagggtggacacgtcagcttataaatgaccctgtctcctttgttcagtgtactcttgtggcaaaactgctggcgagtgtaccctttctgcaggaagtaaaaatggccttgctgagtaaattaaatttatgttcaagtggtatttctttatggtaccggggaacaagcatttcaaacgcttttaagaaaagactaatgacaaaacagaaatggacttggtgagttgaaaaacacatacacaaactcaaagggcattttcttattagtttgcatttccttgtgcatccagtgaaccaactccccaggagttggatccatctctaaattccgctagtaacttcaccttcagtaaccgattgcagcacagctgctgctccaaactgtgggtgaccacccaggaattaaaggttcctcatctcccaaccctttcatcctttgtcttaccaaaccacatgtttccatgaacctgaaccagggccattccagcaaaccccacttcattgacactgagaaagagtagagacaggcttggcttcagctcacctccactagagcactcccactgatcacaaaacccacaccactacctcaaatgctaatagttcttaaagaattccaggaattggccttatgagataactaagattgcctcaggaaggaatgctgaacaattgatttacagccttgttgccacaggccacgccaccaggtggcccattactcaagataaccatagcaaccagatctgctgacctgctttgctcagcccagcctgcatacccttcccctgttaccagttcctgcactttgcctaataagaaagccctatgactcttttcagaaggaagcccgggaattctctctctcttgtgctgcctcccttttgtttgggcataagctccagtgaagctttgtctatgaaagcgcttttggcctcatatcaatttctattgcattgagagtccaagaacccatgatcggtaacaatgccaattgagggtagaaaaaagaaaaaaaatcacacacaaacccaaagtgctttttctattctctcattcaacaagagtctaaacagatgacctctgtgaccaaatgtgtggggatttctcccaatgaacaagcaagcaagcaattcagtggacaccagctgtgtgtcctctaattcagttctattctgacactatctacctggagatagcgtcagatcccacaggttgaaggctgagtccccaagacttcttcctaccttcagatgccagtggcaagccccaggttgtttcacctgtgcttctgaccgacaggctataaatcaaagatcccacagcccctctttgggtccaattaatttgctagagcagctcacagaattcagggaaatacgtttaccgatttattataaagtatattacaaaggatacagttgaagagatgcatacagtgaggtgtgggagaagagagggacgtggagcttccatgccctcctgggcgtgtcaccctccaggaacctccacatgtacagctatccagaagctccttgaaccctgtcattttggggttttatggggacttccttacacagccatgattgattaaagcactggctactgttgattaccttaaccttcagcccctctcccctctctggagggttgggagtagggctaaatgttccaaccttgtcatcctgccttggtctttcctatgaccagccccatcctgaagctacctaggagctgccagaccgcagtcacctcattagcatacaaaaagacatcactttggagtttttgaggattttaggggttgtatgccagacaacagacgaaagaccaaatatatatttcatagtatccagtccaccctctgtcttggatccctcacatcaaaaggatgtacaactcaaaagataccgccaaattactagaatctcattcaatcagtaataatcagtccagcccatcatattgtatgaatgtctcccaaggcgaggccactcaggtttgcaggcttccattcagtcttgtcagagtgctctcggcaaacatatagcttcaccctttacagcagctggtataattaagctaggagacagatatcatttcttgctctaagcctctttcaaggtattaatataatactgggtttctttcatttcataacccatttattctttactctcactactatttttccttatctctataaactcccaaacttttccacctttggatgggacaatagaatcagccactgtgcttatctagattgcaggcaacaatgctagtctagcaagtgctgccccctcagtccactcccattcatgttagaaataaattttcggtgccacaaagaagaatcaaatcagcactcccgcaaaaagttttctcagcaaggcaaattaacttccatagaagcgtgcgtctcgcgggtggagcaatggcgagagcacacagaacaaaggaaagcaggggtttttattcctaatgcaatgagtttctactactgtgtcctgtctccattggatggagctggaccacacaatcgaaactggtcttggttggctaatttgaagtgtgcagggagggggttacactggcgggaagggcagttttgggggtaagagctgttatggcaggaggggtaatttgcagagtgagtgactaagggcaacgagcaagaaacagctgtggactatagactggcgggaaggttgtttacttcagtcaggggcaaggagacatgaagaacaaggaagttgagattgagaacaaagaacaagggagttaacatgccaaacttttgaagagaaactgattgtatctgacattcagatagagtaaggttccataggcacagcagaacgagtgggctgtttttaccaccagggagtatagctgcatttattgttagccccaattttgccagatgggataaggcacaagccaccccttaggagtccaccccacaatcagacccttaggaattctgactcaaagtttaaaaacatagttacagtttcttacttaggaattgcccctgcttccagcacttgtagttgcagccctggtcctaggaccaatgcatcaggtaggggaaatgtaaaaaaaaagttgaggtgatgtgggaaagaaaaataaagagtgatcattataccagtgtactcctcccttagcaagaaatgcatagtcataccagcatccttccacacctcctcttcccggatacctcagaaaagcggagaaatctattgagtggggaaattcccttagccccactcatgttgaatgtgagcacacacttgcgaaggcaaataaggcagctcttcgtgctttcatctccctctgttttagacaaccagtgttttcattgcctgttccactctctatcaaaccgttactctgaggaagatatctctctgcccattgctgaacattataggctatataatgtgttcctgggtctgaagaagtgacagccatccaaatctgtgcaatatcttctgctctagcttttatggcactctgagcaaactattattctgagaagaatatctctgcccactgctggaacattatgggctgtaccgtgtgttctttggcctgaagaaatggtgttcagctctccaaatatgtgcaatatcttctgttctggcttttttatggtattctcatcattcacatcttccaccgggcaagcaaagcccagtccagaatcagtgtctactcctgtcaaaacccatttgtggcctcccagggctaccagcatcagcctcacttgccagcttgttcagggctttcccaccagggaaatctgccccacagccatgggcaatgtctgtctcttttgctggcagacagaacagtttttattggcattttgtgcctaagatggtgcaaaagaaacatgtctaaatgcagcctatctctgcactgttgcagtacccgtttatccactcatttcacagacccaggtggccacttcaagggagcacccagggttgtctgcttgtgatatcaatcactttctgaaccaggatcttttttttttttttttcaagtcagagttttgctcttgtctcctgggctggagtgcaatggcgcaatctcggctcgctgcaacctccgcctcctgagttcaagtgattctcttgcctcagcctcccaagtagctgggattacaggtgcgcaccaccatgcccagctaattattttgtatttttagtagagacggggtttcgccatgtcggccagggtggtctcaaactcctgacctcaggtgatccacccaccttggcctcccaaagcgctgggattacaggcatgagccaccacgtccagccaagaaaggagctcttctgatgggcattgacatgttctactttaatgcactcctcaaatttccatagggccattctccatatgggcatccctttaataaataggccaggtttccactgcccttctgcctgaccatgtggccaggccactgagtcagtaaaaaaatcaaacacaggggtttttgctattgttcatttctgcagaatgcaattcagccaccaagctaatttggtcttaccttctttgatcaagagtggcatccttccaaacaagattgttcaccttggaactgtcatttacacaccaagcaactctttgttggtcagttgagagctgtttacggggccctgtccaagtctcagtagaatcccgcagttcctcacacagttccagagtcagtcctaggggaaaagaggctccctgcatgagagtatttcctctttgcacttcccagggaggatgctcctgtataaaccatttccattttattatggaagtgttctgggcactgccatccccatttgaatgtttctctgacatcatgtgagaaagcatgggtatttcaggtgtcaagatcattttatgtccttcagtcataggggttaacttcagttaatgtcccatagcaaggtagtaaatacccccaagtggaaattctctactgcaaagtcccagtagttgtcactgggagatgctcacagacttctgagtaagccccagtaaacgctgacaaaggggtagcaaatggagaatttgtccctatgatattccagcttctattctacagattgtgggcttgggtaatcttactggtttgccatttagcatgttcaattaatattgctacaagggtgttttacaatacaaggtaagagaaacattccccagtcagacacaatatccccataatacagtcaagtgaaagagatacaaccacttcatgtaaagtgtgttcaaatgtaccaacttaccttaattttctcaatgcttactttcctaactgtagcctctattacgactttaccaacaggttttgagtttacagtactaggtaggggaagtgttccccacccagacataatatccagttccatcaaacattcaggtaaaggagacataacttctttacataaagcctgtttataaacattctaaatctcgtattcctaccaacccttactttctgtcccagtcccagaatttctcttcttcactcccagaccattttaccattttctccttagaaaaaagctttgaatccccagcagagggttgagccaagggaccttagcccttttgtcaatctttgtcttgattaacctgcctcaacactgctccaagtaattgttggtcagctttctcattgtaatctcttcctctcattttttcaatttctcctaactgggataaatacaccaaacctgtttggatcctcttaccgttaggagaacagcagaatctccctaccaaccttctatagtgatgacctttgttttaaccccatcgatttccactttattcatcccattttttaatagccctctaaagactctaccctgcttagatgagtcccatgactctcctttctttttcctcttagtttcaccccatcaatgttttcttcattcaccttatttctcaataaccatttagactttccaccttcctgggatgagtcctgtgactctcccctctgcctttccccagtctcttgttaattacgctcatgttttcattggtgcccatacaaaagaggctcccttagccatagcatttactacagccagagtaatggatgtattcagtgagtgaatatctcagtcatcataaagccagtcccacatggtctacataggaagcaaatgagctgctgcttcagggtacaccacttggcatttataggtgaaattggacagtccccttctcagggtaaacaggtccagtccaccacgctggccattcccttggaaataacctcctgtgtgtctggaaatctacctttccatctgtgattgttcaataatgaactgcaggtcctacctcaaccaaacatgctcttccactcttgagcatttaaaaccaaagaaactgctctgacagttccttcacagtataccctccagtttcaatagtttatcagttttaccctttccccacattgactacccttcttgataaccacaggttgtgtaactgtccagtgggttcatcttgcccgctgtctagacagagctgatttatcaatacagggaaattgcaatagaaaaaaagtaattcacgcagaaccagccgtgcaggagagcggagttttattattactcacatcagtctcccagaagactcggggatcagagattttaaggataatttggtgggtagtgggctgtgaatcaggagtgctgattggttggctctggaatgaaatcatagggagtcaaagctgtcctctcatgctgattcagttcctgggtagggggccacagaactggttggcaggtccaggtggggccatccagttgttagaaatgcaaatacctgaaaagatatctcaaaaggccaatcttaggttcacgatagtgatgtaagttgcaaatcttatgacctccagaataatggctggtaacatttagaattccagcccctctcatccgtacttggtggctggtggcctttcattcgttttacaagaacagtttagcttttgggaagggctattatttaaactataaattaaattccttcccaaggctagtttggcctatgcccagtaatggacaaggacagtttagaggttagaagcaagatggagttggttaggtctgatatttttcactgtcataatttccttagttacagttttgcaaaggcagtttcaatcgtaaaggtacttcagtgtccttgcataatttttccttgggggtcagctttgaggctagtggcctgggctcagacagacaaagtctaacctagcattctcctttaatttcatttagctattagagataaacaccaaagaatttagtatttcactttttcatattagtctgcataccctcatgcaaccagtgaaccaactccccgggagttgcatccatctctgaattccaccagtaacttttacctttagtagctgattgcagcacagctgcagctcaaaacagtgggaaaccacatggccacccaggaatcaaagattcctcatctcccacctttttgacgcaggatttttcttggccactttgccaatcagggacctccatggccagcaacgcccccctacctggcctttgcttggccatgggcctgctgaggcgtcaggcccactcaccccacctgtgctatggcttgtacctgcgttcagcagttcccaagctcctgtccttatccacgaagaatgaggatacgctgacaatttgaagggtgaggatgggtagggaagaattttattgagcagcagaacagctttcagcagagaggggacacgggtggcccccccacccctgcagtcgggtggtttgtctctctcagtgtggctgggtccatggtattttatggattcagaatggggcatgtgtgctgattggtttgtgagtatgcagaaaaggttaaagcgaagacaccactcaaaggtgggcacaacagtgtagaaaaccaattagggaagggtaggtatatgtaaaataggtgaggggcggggatcaatcagaggaaagcacaccaaacaggaagacaggttctcaatccagtccatggatttacccgggacatgtaggtaggctttaaactgtcttcagcttgaaggtcaatttcactgaggactcgcccctatctgtctaggcattttgtctgcctcctgctgctgtcactttcattctttctcttcccaaaccacatgtttctgtgagccaagtccattctagcaaaccctacctcactgaaaccaattcatagtttggaaggaaaacaaaactcacaaagtacttttctactctttcaacaacaattaacacagatgatttctgtgaccaaatgtgtggggatttctccccaaccaacaagcaagcaagcaattctgcagttgacaccagctaggtgtcctctaattcagttatgttctgacactatgtacctagagatagcatcagattccacaggttgagggcttagtccccaagactggcccccacctttagatgccaatggctagccccaggctgtgtcacctatgcttctgactgactagctataaatcagggatcccacggctccctctttgggcccaattaatttgctagagcgcctcacagaactcagggaaccagttacatatacccgtttattataaaggatacagatgaaaagatgcataatcctggggcacggagctttcctgtcctctctggacagaggcaccaccatctgggaaactccacaagttcagctatccagaaactctccgaacactgtccttttgcggttttatggaggcttcattatgtaggcatgattggttaaacgattggccattggagattaatttaaccttcagcccctctcccctccttggaggttggggatggggcttaatgtcccaaccctctaatcctgcctagtctttcaaggctaccagcctcatcctgaaactacctaagggttccagccatcagtcaaccattagcatacaaaaagacatcattctggagtttctaaggattttagcagttgtatgcctggaaagagggttgaagaccaaatatatattttatagtatcacagacctgatcatcaaagtttcactatccttcagctttggcttttggcttttcatataagcttgagtgtgctggctaaacattgtcttttaggaatgcacagcatagaaactctagcgacttcagtggcagtcataagaactggaatcatttcaggggtggtagttgaaaagcagacaggaaattagcaggtttagaataggggagaaactttagcattgaattacgtgaggcaaaaatatatttgagggacaaattttgaattttgacatcttcaaatcagtcaaacttggttcatattatgcttcagaactaaccattcttttctgtagattctttaaaaagccaaaagtagataaagatttctatgaataaagcagttgaggatagaattccaaaaataatgctgttccattgtatcaccccaggtacaaaacacacacacacacacacacacacacacacacacacacacacacacacacaaaatctataccctgggaaacagtgacttggattgcagtgagatttagcgaatttaaaaggcatcatatatcagtgcccagaattctccacttcactgtctctttctagggccaaggtttcctggccattttattaccaatcacttcttttgaatttctagatacaattgtcttaaggtgaagtcccctgctccatgtaacttcctgtccttaatcaaggggaaaaaaagagatagatgtcaagggaagagaaagaagaattgaatatctcatgtcttccctcctatacccattagtgtctgtattcattttctcttaagcgccccaagcatgaaagtcacaggtttctctgagaaccacatttagaaaattaataataataagtgacagccactgatctgcttttatatatatattcatataattttagaaatatctctgagatagattctattattactgtcactttctagatgatggatgtgggtccacagaggataacttgcctacagtgataaaactgctctattataaggtctagatttgaacccagatagtctgactttagagcccacattctttactgttttatatggactctcataatatatgataatactcaatagaatctagtttattgctttaaataaggagaccagctatccccaatgaccaaaaatatatctcatttatgtacttgtttccaattttcaatctcgagatttattaactcctgccaactctccactgtaaaggtaccctgttttcattgtaattgataagtaatctgaaggtgatattttaagactctatgagtatactgtgtttccctttcacccactggattttgacattcttcgatgattctcttcttgcctaaatcagctgtttccttggtggtggcatcttggtaatcttttggtgaatggatatattagatttgaagtagtccttttaagacatcttttggtgagtggatgtattacatttgaagtagtccttttaagacatcactctaaacaagtcttgttgttttatattatttctcaaacagcactgtatgtggcatagtttctaatattttcatgttgcctcttcttccctttcctctatcaaaagccagcctaaaaatgtatggttttaataaacctacaaataaagtattgaacttggaagtataagttctctagagttccagaaatatctggagaaaaaaaaaactggaaagaagaaacctgcgttaaattttataataacactgaaaaaagtctttaagagggtcacttttttaatagtgccttggccagcagagggtaatatattaccagccctagttaaaccacttttgctgacgcataaactgcccacattgcactattttccagctagaaacataaagcaatagaaaagtttggggattttttgaagctctaatacaacaataaatttcttttagtagctgaaaaccactttacacatgatagaaaaaaagtaattgtatagacaatggatttctgtccttaagatgaaagcccggtgccactcatctgcccttaatagggtatgtcctttagggatagtttttgttttgttttgtactagtgattatcacaagagttacttttgtaaagtattcacaactacagttatcctagtggtagaaagaaagtcttacatttcagtatgtgaaagtttttattactgtatcttttagtttttctttaactttttttaatcatagaaattgatggacatagttttaaaagtcaaataacactgaaaagcttgtaataaaaacatgttatgtctattaataaatgtaatttaaagtattttcacctaatgaagacagtataggagaaatcacctctatcctcgactatagtcacttcctcctgtcagtgtaacaacttacgctacatatcccttccacttaagtggtaattttttttttttttttttttttgagatggagtctcgctctgtcgccaggctggactgcagtggcgcgatctcggctcactgcaacctccaactccctggttcaagagattatcctgccttagcctcccgagtagctgggattacaggcacgcgccaccacgcccagctaatttttgtatttttagtagagacaggatttcaccatattggccaggatggtctcgatctcctgacttcgtgatccaccaacctcagcctcccaaagtgaagagatagcttataataaccattccctctttattcagctctcttcatcagggggagcatgtacttgtttttatctcctagaacaagtggtttgttactaaatcttcagcagctccactactccctgcccttcattggtttggaaggtacattctgtctctctctctttctctctctcgctctctcatgcacacacacaaagctttcaagtaaaataactcaaggcattgtcttttttgttaaattactatatttattgtcatctttttagaaatcagtgctacacatattcttcatttatattttttatgcatcatttatctattgctgcatacttaactacccctagacttggtggcttaacacaagaaccatttattcactctcaattctgcaatttgttctagactcagctgggtagttctgtttgtctcacctggtggtcattcatgcagcttagtcatctgtcagctcagctgaggctagctggttcaacatggcctcactcacgtgtctggagcatcacctggaagagttgagcaggctgtgcccctctctccatgtgatctttcatcctgggcttctttacaatgtgatggtctcaggttccaagagggcaaaactggaagctgcaaggtctcttaaggccttattcaaatgtcatacaatgtctaccacattttattggtcaaagcaagtcttaatacctgcccagattcaactgggaaagtagactccacctctggatgagaagagtggccaggaattgggggcaatttttaatctaacacatttccttggatgtgctttcaactttaatgttctaactagacttgttatattttctccttgaaatgcagtgaattggctctttctttagggattactatagtatgtgtatctcagagttcgtagtttcctgggtaatattcctaaaagaaaaggaaattttgctttgtgagagatacccaccctgtcccactttggtcttggagctgtcatgttgttttggttgtttcttgtattaaaaggtatattcagtgtgccatgaatccagctgggtacagtggcacttgcctgtggtccctactacgtgggagactgaggcaggaaaatcgcttgagcccaggagtttgaggctacagtgaactatgatcgtgccactgcactccagcctaggtgacagagtgggactgtgtctctaaaaaaaagtatatgtgtatatgtatatataatatgccatgaatccatgatgtttcctttgtgctttttatcttctataaatcctctccctttaccttctctttccagaatattaatctaacttttcaataaaaccagaagaaaagtctgttgctcttgcttcccaatagctagtttgatcctgagagctggataagttcattgacatcttcaataccagagcttaaaaggatgtagaaagatgattagtctagcatggtggggtagctttccctcctaccatgcttattccctcctaccattattcaaggtttcattattttcaggatcataaatgtcaaactactgggccatgagacttgcattcacttacttagctgcatcctctccctacttgccacatctttttggaaccctgtaatcagtccccacaagagctgaccctgtgtgttcctgtgtttttcaagtttcactagccacaaaggggaactgaatatgaacatgcatgcaaacctcaccagttccctttgcagccagctgaaagttatttttcatgtagaggaaacagtgtttttcttttgagaacaaactgaatttccacacaaatatgaagtgtttcatcttctgacagttcagaggacccaagagaagagggcaccaaattgtgagaaaggccattaaaagagaaactaggaaaacaaagagacaaactgaattggggaagagagaggtgctgctgagtacaggaaaggaaaaaagcagaccacggggaggggtgccggggtgctagaaagtctcaataagtaatggcacacaggacaaggcaggaaatgtaggaaggaactgtctgcaaagggcctataatagctatgccagcagtattaatggaaggcattaagaacttttggtttagaaatttgctgttggacaaaatttcaaaatataccacatttacgtgattactgggcctgcctgagttcatgctatggagccaggtttagatgaaggtgccttgtcctcacttcagaatgcaatatggtgacctgtttggtgtctctgattagacggagaaaaaccaagaatcagatatgtattaacatctcttctaattttttttttttagaagatctctgtcacccaggcttgagtgcagtaacatgatcgtagttcactgtagcctcaaactcctgggctcaagtgatcctcccacctcagtctcctgagtagctgggactacaggcacatgccaccatgcccagttaattttttaatattttgtagagactgcttcgctatgttgcccaggctggtctggaactcctgagctcaagcaatcctcccacctcagcctcccagaatgctgggattacaggcatgagccactgtgcctggcccaacatttcttctaatggcatcctgccaggtgccctcacactctcctccttacttgctcaagtttcagagtatggttctgattagcataaaatacaatggatctgttacctctcctgtcctggacattgctattattagtgaaagctgaggctgaataaaataactctttctgagttacttcccccacctcccttgatccagatcaacttccactatgtatcttcctagttctgatgtttaccctcagcttctagccattccattttatgtattttctctgcctttcccttggcatttgggtatttagataccatatattgcatgtttctacttggccaggtacatttatttactcattgagtcctcctaacaaccctatgagttaggtactactataattcctgttttcttagtagaggaaatagagcttacccaatgttacattgtaagtgatggcagcagaaataactcaggcagtctgactgcatcattcacccttttaaccagtcttttatgctgcctctcagtttgttatttaataatgcttaatattattgggataagaaaacctattggattcagccttaccataattcttgccatggccttaatgatgggaccataataatccgtatacattggccaagatcaatcccctggactgtgttggatgggcaataccaacatttttctagcactttttttcttctaattttccctcatctcctagtgaacagccaattctttctgtagatatgctaatgcatttaatcaggtcatctcctggtctaagagactttctgtctctgaagttgttttacatatttgtactcaggtatttggattttgtagttgaactcttagaaaacatttctattttcatgttctcaaggaacacctgatttcgactcctctatactatttataactgaaataccaagctatctaattataagataatttcatctgcaagttctttagcttggtccttgaggaatgcataagtgccagtgtttatttcaatttattgattagaaaaatttttagctttgcttctagtgtctgacaaaagaaaccataagcaaagtaaaagacaagtgcatagtgttagaagttatttgcaaactatataaataacaaaggatttagaacccagaatatataaagaactacttcaacaattttttaaaaagaaaaaggaaaaaaaaagataagcaactcattaggggaaaagggagggggaggggtatagatatgaataggccattcacccaagaagaaaactgaatgagcaaaaagtatatgaaatgatgcttcatttcactagtaatcagggaagtgcaaattaaaaccacaatgagataccatttcatacctaccagattggcaaaaattagtaaatctgataaaaccaagtgttggtaaggttgtgggtaaacaggaactcatttctgccttgtagtgagatgggcatataaattggtaaaatcactttggaaagcaatttgtcaaaactgagataagctgaaaatgtacatacccttacaaccaagcatttctgcttttaggtgttagccataaacttcacacatgggcattgggtatacaaaagaattcacttgagcatggtttcaattagtggaaaaagtggaaaccaccaaattgcccattgttaggggaaatggagaaatgaaccattgtttattcatgcagtaaaacactacatcagtgaaaatgaatgaacaagacctacatgagtctacatagataaacaaaatttgagtgaaaagagttacaaagaatgtaatagtaagataccatttgtgtaaatttttaaaagaaaaagtgcatattgttatgcatatgtatgttgtaaaagcacaaaaatatacgtcagagtgatatacaccaacttcaggaaagaggtttcctcagggaaggatgtgaagtgagctttaatatatctaacattttggatgatgtatacgggtatgaaaaaacttttaagtaaaacgaaaatgttaacatcttttcaattggggtgatgggtacttagctgcctgttatgttgtgtttttccatttttgtatgtttgaaacgttttataactaaaaactatttatatgtgaaattaccaaaaaagaatataagtgtaacagttaactgttgctcccaaaaaacttgcatgacttattaaagcaaaaagagattccatgtatcatcaacacctgtatccaaaccataattagaaggcctttccatcttctgatggttctttatgcatttcatgggccagaagcaaaactaataagggtaggatgctctaatttgattccattttttttcttctattcaacctgtatgagtttgttctggattatcgtacatgtttcagagagagcttccagagtatataaatgtgtgatggttagaagactagttttaaagattgttttttgtttttgtttttgtttttgttttgagacagagtctcactctttcatcaggctggagtgcagtggtgcaatctcagctcactgcaacctccacctgccaggttcaagcgattctcctgcctcagcctcccgagtagctgggactacaggtgcgtgccaccacacccagctaatttttgtatttttagtagagacggggtttcaccatgttggccaggatggtgtcgatctcttgacctcgtgatctgcccgccttggcctcccaaagtgctggaattacaggcgtgagccaccacgcctggcaaagattttgtttctttggcatcacacaattatgatgagtggtaagcagaaatttttgcccccaatacatattaatggcaatttatgtttttttattttattgtaatttatttatttatttatgtttttgagacgaagttttgctcttgttgcccaggctggagtacaatgacacaatctcagctcaccacaacctccgcctcccgggttcaagcgattctcctgcctcagcctcccgagtagctgggattacaggcatgcgccaccacgcctggctaattttgtatttttagtagagacggggtttctccatgttggtcaggctcgtcttgaactcctgacctcaggtgatccacccaccttggcctcccaaagtgctgggattacaggcgtgagccaccgtgcccggcaaagattttgttttttttgacatcatacaattttgatgagtggtaagcagaaatttttacccccaatacatattaatggcaatttatgttttttaaaataaaagacatctcagcaatcaccattgtgcttggacagaactaaacaaaagtgaaaagcattagcagagacaatgtcagtagaatggaagtctaccaacttgcatccctacatatgtaaaatacagttgctgcttacatcacaatgccatgaagattaactgatgataatgcatgggaagcacctagaacagtgaagggcacataaataaacaaatgttactttgcttcccattcccttgcatgtgaacttgaagtggggaaataaaaggaaaaatagaagtttcgaacaaacttactacctcctttccagttctgtgctcactgttaccatccccaaccagctctccaagtcttcatctgaaaacatggactgactgaggcactatggcagccactcagctgggccatgtagctatgacagaggacactacatcatccaacatgggaatgccgcatagtttatctctcgtctgagttgacataattcagattatattccgagtttcaaatcttttcttccgattaaaaatacccctacaagcctctttacaagtgaagtttgtttgttggtggctgaaataaaaggctctccagtaaatgtcatatctgttgtgaatatttttcctgctttgtacttttgcttcagtttttatggtttgggacaaagaatctaaatttttaagtcaaatctatgaatttttccctatagttatttctattattttgtttgaaagttctttcccatctacagatgaactagtcattttttaatcttttatggtctcattatttacacttaattcttgagtgtccttataaattttggggtatgataaaaggtaaggctgtaaattggccttttattttaaataggcacagcactattatttattaatccatcccttccttcctgatgctttttgtgatgtttcctatatatgcagtgattttctctgagggaggagaatgtatgggggtcacctgagctttgcaaaaacacacttaaccccacctttgcaagattccagcacatcttgactaacaggaaccttttttttttttttttttttttttgagacggagtctcactctgtcgcccaggttggagtgcagtggtgcaatctcagtggggcatggtggctcaatgcctgtaatcccagcactttggaaggcaaaggcgggcggatcacctgaggtcaggagttccagaccagcctggccaacatggcaaaaccctgtctccactaaaaatacaaaaattagccaggcatggtggcacgcacctgtaatcccagctactccaaaggctgaggcagaagaattgcttgaacccaggaggcagaggttgcagtgagccaagattgcaccactgcactccagcctgggtgacagagtgagaccctgtctcaaaaaaaaaaaaaaaaaagtcatatacgtattttgtacttttctcatatatcatctaggatctgcttagacatgtgtattcagttccacagataagtttatccttgtgtctgctccccagtgttatccttactgaaggataagaatatattttaatatctgataaagtattatattttgaaaacctaaaaaataattagcccattaacatgttgctgcagcatccaggttgcttgttgggagaactctcttcatattgcttttcttttgtgggataactttcagtaagtctttcgttcaaatagttatattacctctacttttatgtcagcaggaataaagaatccattttttaaagttgaaaataaaactgtactggaagaggattgtctttttctactgacctaatcttagaaattcaaccaccatcaaacctggctctatacagcatacttttctaaaactaacagcaatattcaacactgaggtctcactctgacagccagacaattcattttgcccatatttggttttgcatgtatgagatgttatttagaaagctgttctgaaggtctttgcaaggtaaagatacgtatatacttctgaatttccttttcctgtatgcttctagaactaaaccttgggttaggagaggtaggaactgtttcctgcttgcaaatactaatgcttagtaagaaatgaaagattatatgtcataagtagccttaactttggtaagacagtagcatattttttctaaaaatttagaaaccttctcaggattcaagttactctaaggcatgttatcagatttctctcagtaagcaatctgttataaatagacagattgatttatatcaaaatgtattttattccaaataatatagcaataattaattgagtatactttaaaattttcttaagaatgccattgtgcagagctttatagtaatcatctagtataatgagacagcttctagaactatgagtgtatttatattcattttaatgtcccttaaaagtgataataattgataatataatttcaccaaactgtatacaatgagatatgtaagatgtttaccagtaatgtaaaataaatttttaagtttgaggacatgaaggaaaatagaagttttcataacttaaaaccatacaaacagaaatgctaaatttcatttagatggtatgtgttaacattgtcagggcaaagtaattaatataattttgtcacctttttctgaccctctaatttttctgcaaatttcagtatttatcctcaaatattacttatttttaaaatatacttttgctttgacttattctttattcagttaattatatttgcgggcacttattgaaatatagttaactggccgggcgcggtggctcatgcctgtaatcccagcactttgggaggccaaggtgggtggatcacttgaggtcaggagttcgagaccagcctggccaacatggtgaaatcccgtctctactaaaaatacaaaacagccggtcatggtggcgggcgcctgtaatcctagctacccgggaggctgaagcaggagaatcacttgaacccgggagacagaggttgcagtgagctaagatcacgccactgtactccaacctgggcaacagagtgagactccatctcaaaaaatatatctatatatagttaactgagcactgtatacaagccaaatctcattaaaataaactcagttctgatcaaaatcttcatggtcattcacattgatttctcagccaatggcctaccttaagttttaagaagtattctgactctaaaaaaattttatacaccatgatagaaactttcagatgagtccttggagtttgtcctaagatgcttttacataaattcagtcaataacattcaggttctgtgtatgaccaaagaactggacaaatgctggccaaactttcaagaatgtttgcctaatgacaccccctagattgcaactgtatggtgttctatacagctatattcaaatggactaggaaaaaagctaattactcccaactttttttcttgtaagcaccccttccttccctttctccctatcttattcatccgtccattcttcttaattattcaataaatgtgtattgatctcctatagccaagaaacatactaagctccagggaggcaatgacgaacaagactaagaccgctttcttttagagcttgctgtcctgttattttttaatgtacatgaaaattgcagagtttgctccttttaattctaatttgcaggtttttattgttgtaaagtatttcaaatacccaggagtttaccaaaaataatataatcacgtgcctactacctagatttaagacattaacattttgccatatttgcttcaaatttctccagatataaccattaagttggtatgtatcttgtatatattatcatacatgttttgtatctttattttatatgtattgatccataagaatgtggtattgttttctaccaggcgcggtggctcatgcctgtaatcccagcactttgggaggctgaggcaggtggatcaccctgaggtcaggagttcgagaccagcctggccaacatatgaaaccccgtctctactaaaaatccaaaaagtagccgggcgtggtggcatgcgcctgtaatcccagctactcgggaggctgagacaggagaatcacttgaacgtgggaggtggaggttgcagtgagccaagatcaggccactgcactccagcctgggcaataagagtgaaactctgtctcaaaaaaaaaaaagaatgtggtattgttttatgtttttatattttacataaatgatttcatgcagtacatacccttttgcaattttgtggggttttttttactcaacattatatttgagatatacccatgttgatgcatgtgagtgtagttcatttcattgcatcgctacatgatattccatttcgtgagtaaaccagttcacttctccatgcctttgctgttatgtccttatttccagttgtttcgtattatgaatgttagttcactgagcatcattacatgtttcttgtgtacgtatttgaatgattctgtaagatgtataccttgtagatgacttgctggatcacagaatatgcatgttcaatgttactttatcaaactgtggctgaaatgaccctattgtttataaacctgttttaagtaaggtgtggttttaagacctattgctaggctattgaatcgttagcttatctgttaatttttactatacagtatttaaattctttccctttttatctaagcagtgatagatagtgggtgatctcattttttaattaggattttattaattatcttttcatctgttatagagatttaggcataaatgaatacagtggcaaattatacaagattttaaaatgataaatgaacatatattttctgacacattgtcagttcccaaatcatttacttttaaacacacttcaaattagtatcaagtgcttgattttaataactactttagtcacttgagaaactatggcactttaattattttgctgttagagccataaatttcacttaacttcataatctatgttaagagtattagcttaaaaatgtattttgaaaagattttacatacagatttaaaagttagtaccttgaaatggtttacagttaagcaaatgaaatatcacaaatacaagcagagctttgagatctgagttttgtaaatgctagaactttgtttcctaattttttagttcttcaaagaattaagaggctgcattatataattcattttagtatgtttacctcaagtacttttagaactagactgtattttcactgccacagatgtatcatgcagggagtatcctggtttaaattctgaagtgctttcactcctacttggttcaccttgaaatcgtctaaaaagaagttggcacattattttgcgaatgttactggacatcaggaaatacatgactggatctaagcaactattgaaagatgagagaaccagcatgatctcattggttttgtgaacaatttctttccagtagcaagatgatacatttagctgtgaagaaatgtagatgaatcgaaaggcatgatagggaacaaaacatatagtaaaaatgataagtacaataaaggagttacgagctgtagtggcatatttaccagaattaggaaattttgacctccttttagaaatcctcaatagattcttcccaatcttaatatatgaaaggattattagtaagaaaattagccagaacattaccacaagaatgaagttaaaaatggcttctccttttgcgttatgcttatctctgtaatggaaacacattgtggaattatgccctcctttcttaagtgttaaaataatcatagttaggaatccaccaagagcaagcatccatactatacaacagacataaatactttgtttggttgttattgccttccgttgctgtatagaccgattaatttttatatagcgatccaaactgatgaatccaagcaaaataatgctaatgtacatgttcatataaaacagtgttcccacaaccttgcacagaatcacacctagtgtccacttgttttggttaatatgatacattattcggaaagggaggcagaagatgagtaggaggtctgcaatggctacgttaagtagataaatttgaatggaatttcttttacggtgaatacccagaaatacatagagggcgattatgttcccaaccagtcccacgatgaaaataacagagtaggatgtggttaacacagtagatagcaatttttcatccatgggacaggtagtaacatttggtgttgctgagaagttttgtggcggttggtcgctatgattggttataaagcgcattctgtgggaggagtaaggccagctgctgactgaagttgtcgtcattgttatggtatgacttctcattgtcttctgtggagatcaaaaagtgaaagtgctaaatgacatattcctcatgtgtagttcttatgtcttcagatttttcctacaacggaatgccaaacattgagtcatttgctattttaataacagttactttaactaaaagtgtaaataataggctgggcttcccagcacacgcctatggtcctagctactcgggaggctacagcagaaggattgcttgaacccaggagttcaaggctgtagtgagctataattgagccactgcactccagcctgggcaacagaacaagaccccatctctttaaaaaaaaaaaaaaaaaaaagacagtgtaaataataaatgatttattttcagacattgcgagaaactttacttttatcctactgtatgtagtaacattattgtatcattaaacaagcagcacatagtgtggtatctcatggagtttcatgctctaacctttcctgtggccatggcctacattgaagttctgtttcatgtattatattaaaataactcaatttatgagatcatcttctcttagggaagttcttatgggaatacagatggtggtgaagagaaatgacagctcatatttctcaaagatgagcatcagtttctctaaaggtatgtacagccataagagagctgggcccactgctggccctgcccagcttcagaaccacttcctgccttgactttttccctcatatgtggcattcattcattttgacatgtattgctacatggcgtgtgacttgtggtggtctcattctataagtgggaataaagaagaggatcctaaatttcttttcagcctaagaccaaggtaggggtcttagggcatgcaattaacataatagactaagagaatacagcacctgcaaggttacacagactcttgtatcactggacaggagaaaaaagtaaccaaacaaaaccaagttagctggcagctgccagttagccactcctaacctagaagcatagagtaataacgtagatgggaaacagcatgtgcaatccaagattttgaaagtaacctgaccaaagcttaaatgtgccctgggttcaataatttgagacttgctagaaccttcgaagagatagtgtttgaattctacttgtttgtggcagcagagaatatttgcaaagctacttattattggcccattgactgctgtaaagagcttagtctgagagctggtcataacaagtaaagaaagcatttctggaggtctcatcacattcctctcatagagtgactgccctatttctctacagcagccacttagcagggttaacataaagatgcccagagcaaggttctcaaaatcagacccaactaacttgtgaccaagggcaaataacttaatcttttctatgccttagttttctcatttgtgaaaatgaaaaatgcataagaagaacttaatcctggcacatagtgactgcttaataaaagttagctttaataaacaccttttgattaatctcattttagtaaatatctcacacttggctaagtactgtgtgggaaaggaaggtgaataagacagagaccctattagtaaacattttggaggagtggacattcaaaccctgactgctaccatgcaaagtggatttgaattacataaattaagtccctgatttgatcttatacacagagaaaaatagcctttcttaaagctctacacataatttgattaaaaacaaagcattttggtagagggtaacattaagatttaaaatgttgtaaagttggggagcattgattccacagaagaggaactggctggtgaagaggaagttatgtaatccctggtaagagcctgtttccagaattcaggaaagtggagggagaaaggaagggagcggggaaggactgagtctagtctgtcatgtgtctcaactgcaggaagacaaatttcagaaagtttatagaaaggtataggcatgtttcttgtgatctaagattctggtttttgtttgtttgtttgttttgttttgtttttgagacagagttttgctcttgtcacccaggctagagtgcaatggcgtgatctcggctcactgcaacctccgccccctggcttcaagcgattctcctgcctcagcctcccgagtagctgggattacaggcgcccgccaccatgcccggctaatttttgtatttttagtagagatggggtttcaccacgttggccaggctggtctcgaactcctgacctcaggtgatctgcccacttcggcctcccaaagtgctggaattacaggtgtgagccactatgcccaacctgtgatctaagattctaaaaggaaagggcaatctagaaagaatgtcaggctaccaaaaatgaaactgataatgcaacctgcattaccaggaaaaggaaaagggtgtctgtagaggaaccacctatattgtgtggttatgtagggagctctcataggttcagggaattgaggcacaagaagtaatgtgattttgagagctcaagtagctgaaatgacgtgaaaaactcacctgtgagtagttattttggattttttttcttctctcatgttagaatttaagttccattaggattaagaaccaagtcaattttgttcggctctctgtacctaatgcttagcataataaatattattaaatcaaagagggaatttagtagaaatgtatatgaagttctacatgtggatattaaaagcagctgtacaagtacaggaagagctttagctgcattaacaaacacaattgcaattgctctatcactagcgtagtgtggtggcaacgaaaaacccatctttagttgaattcctagatacgtgatgtctgaaatgaaaattgttactactatgctgcttctgtcccaggctggtagggtctcacctggaatgcagtgtttgatccacagcagcacacttagaaaaggccatggaccaaatggagagaagaactcaaatcatgtcaaagaagcaagttgaaggaaataggcacgttaccctggagatgagaatgctttacaaagccatagagaaaagggtttcactttgttatatgtgtcttcacaaagcaaaacaagaaccaatgatagaaattgcagagacagatgttgcctccttttaaggaaatcatttttttctaatgaaatgatctctcttgggaggcaatataaggatcttaccactggagatttttgagactaccaccaattgggttctttgtagaagggattatcagtggttctcaatcctggctgcatattagaatcctcttgagggttttttaaagataccagtgcttggctccttccccagatattctgatttaattggtctggaatgggtttcaggcactggtttcctttaaaagctccttaggggattttaatgtgcagtcagaattgaactcttaagctagatggccaaaccattaactaatatttatttagtactttctgtgtaccagacactgtgttaaacacatttatattacttcctttacataattcttgcaatactctgtgaggtaggtatcacaaaagaggtaatgaaagatcaaaaggttggccaggtacagtggctcacgcctgtaatcccaacactttgggagactgaggctggagaatcacttgagaccaggagttcaagaccagcctgccagccaaggcaacatagcatgaacctgtctctaaaataaaaaaaggaagaaagaaagaaagttcaagaggttatgatctttactcttggccacacaactctttttttttttttttttttttttttgagacagagtctcactctgtcacccaggctggagtgcaatggcatggtctcagctcactgcaacctccgcctcccgagttcaagcagttctcctgcctcagcctcccaagtagctgggaccacatccagctaatttttgtatttttagtagagacggagtttcactatgttggccaggctggtcttgaactcctgacctcattttccgcccgcctctgcctcctaaagtgctggggttacaggcgtgagccaccgcacccggcaggccacacaactcttaaatgacagtgcccaagttaggactcagatctgacttttagagcccatgatgcttttcaccaaatctcactccttatcacatagggtcagcattttctttattaatattgagttctatcagcagtattttgacatgattcctttaacatacactttaacaattttaagaacaggttatgccatctagctttacttctttggaaagggtattaatcttatttgctatgtccattattataaggaagtaaatccagagtttacagaatcacaaatcattcatcagaatgattgccactacccacagagcatatctttttaaacttctagacccgatagccataatcaagatgtctccagaaagctgttagcacaaagcacatatcctgaaaccatttgcctcagctctaatctgcaaataaaataagtaatagttggacaaatctgtcagtaagcatttctggttttgctttagtcttcagtttaaagagcataaagcaaagccagtgcatttgtttatgttataatagtggccatcatttagaactatgtattagacagctagcatacaattattgattcacaaattgacagctgagcgccatggttcatgcctgtgatcccagcactttgggaggctgaagtgggaggatcacttgagttcaggagttctagaccagcctgggcaagatggtgaaaccctgtctctacaaaaagtataaaaattagcgggtatggtgacgtgcgcctatagtcccagctactcgagaggctaaggtgggaggatcgcttgagcctgggaagcagaggttgcagtgatcctagatcactccactgtactccagcctgggtgacggagtaagaccttgtctcaaaaaaaaagaacataaaaaaaaaaaaaattggccgggagcagtggttcatgcctgtaatcccagcactttgggaggccgaggcaggcaaatcactggagtccaggaattcgagaccagcctggccaacatagcgaaaccctgcctctactaaaaaataccaaaaaaaaaaaaaaaaattagcagggcgtggtggcacgcacctgtagtcccagctactccggaggctgaggctggagaattgcttgaacccgggagacagaggctgcagtgagctgtgttcatgccactgtactctagcctgggcaacagagcgagagtctgtctcaaaaaaaaattttttttttaattaaaaatcacaattacattctgttttaaacttggtgactgtttttttttctcctttgaagttggttagtacattacaatgtcattcactatataaggctatttactgatattttttaaactacctgtttgatatgttaagaattgcttgtgaagacaagaaacaaaccactgtgtttacataggggattaatttcccagtgggcattacttgtgacccatgtgctatattgaagtggtcacaatagttttgtaatagtagatagtgttttttaaatgttgttacttggcaaatcctattcacaagttcaaaaacctagtattagtgcattgtacccccgcaccaccacctactcctgcagttttttttcaactggctcatgtaggagtactggacccagagggcaggacccaacagattccactgtgactccagatgagcagaagcttttaaaatgcagtttgggtatgtttgtgaaaatatcacattgctatgttgaaatacatacctatttggtaatagtcgcaacctttcaccgtttttagtttgacttgataatgactgaatctattcagggcatgcttcaaaattgcattaactgctgtataaaaaatgaaaattgaaaacatattactttggaaataatactattaatagtgtgttaggttttgttacaaatttaactgtgtccctagaaacacattttaaaaaattattatttgaactaaagcatattttgctttctctcttatctaatattcaccttatttacttctgaaacaccaaacttaaatgttatatggtctggtaatactataaaatagtaataatataataaagaaaagacagtaatttaaaatagggagacagcataacttaaagtcaataagttataatttataatacattagaaataaaatgtattgcatatgaaaataacttttaattcatgcaagtagatctgcaaaatcttgatggcagtatccaaatgcagtatcaacaatgtgactatattgacagtaggagcttaaataccttgaatgtcttaaagtacttaaagtaactaaaaagacagtctcatttgaaatcaaggcagaggtgtcattcaagcaatttactcagtagttctaaaagcgaataactgctgacattagagtagccttatcaccatgaatcacgtttcactttgaatgttcagataatcaaattttagctgaaataaaggttcatttatgtagccgaaatcaagaaatactcacagttcaggttcgcctgaagtaaaaggagcagaaccccaagcttccctagacactgagactcgtcttggttgtgtcagctgggctcttccatccggtcgtggtgcaattggttggggttctcttcttttttatgttcatatgtggtggtagggttttttttttccccctctttttttttttcttttttcggtatgacaactctcagattccttttgaaaatattaaaaagccctactaccatggaacaactttaagctcaaccaacactgaactttaggaaattatttatatcttctttatgaataccttccaacttgacaattgtggaatgttttcctccccccgctcaaaatttaaaagttttataaattctaagcagaaatatgtattttctgtgttttgtaagaaatgatacataatatgctatatggactttcaaagcacaagcactgaatttctgtttcttaagttttcatctgtacattattttagcatattttcatgtattcctttaagacctttgctaaaacaaacttgtattattaggactagatgagatttctgatggtgttctccccttttgatcactatgataaactctcccgagcaaattaaaacatcacctgtattttaagcgaaataatgatgggattctgcagtcttggttttgatcctagtccaaaatttaaccactatctgtccatctatgtaactgctggccctgcagtttagtgttatttccctttttttgttgtcatttgaaatgaagaagttagtttttattctccccataattgttatcctgcagcttgtttgcactaaatatttgactcattgggctgtatctaacattctaattatttctgggtacactcttctgaacattatattctccagagctttttgtttgttataaatatgatttatgggacaggatatttttaaattaatagaataaaaatgttttgtagctcttacttccccttagaacctctgagaaggaaggtggttgctgtattagtcctgcaatattgttgtattggcaggattttattttattgtggtacaatatgtaacattaaatttaccatcttaacttttttttttttttttttttttgagacggagtttcgctcttgttgcccaggcgacaagagattgtacaatggcacaatctcggctcactgcagcctccacctcccaggttcaagcgattctcctgcctcagcctcccaagtagctgggattacagacatgcaccaccatgcccggctaattttgtatttttaatagagacagggttttgccatgttggccaggctagtttcaaactcctgacctcaggtggtccacccacctcagcctcccaaagtgctgggattacaggtgtgagccattgcgcccagccccatcttaaccatttttaagtatacaattcaatagtgttaagtatattcacattgttgtgcaacagtttctagaagtttttcatcgtgcaaaactaaaactcttcaccactaaacgatttctctcctctccccctgcccttgacaatcatgattctttatgtttcattgatttggactactttggacacttcatatgagtggaatcacacagtatttgtccttttgtgacatgtttatttcacttggtgtcatatcctcgaggttcatctgcgttgcagcatgttacaggatttccttcttttatcaaactgcattatattccactgtatatgcaccacattttccctatgcattcatctgttgatggatttttgggttgcttccacctcttgactaatgtgaataatgctgcagtgaacatgagtatgcatatatctcttcaagatcctagcaggaattttttaatgactaaataggcatttaactacgtgcattctatttcatataatctagcatgaatatatttttttctatattattttcctacacctaagacaacccttttcaaaacactaattgttttaatcttcagtttcctcatattgtgaccacattttctcctcaatgtgagtcagcacagctaccaccagatttgagtataatctttttctagttctttctttatataagctttttcctgttcattctgaacattctggtttgtctctgcgttcttagctcattttcgatatgtcctcttcccttcacgcttcctctttctcttgttgggattataaggtatttatattaagatagaagtagaaaagaacaaatgtatacgcttgtttggtgccatctattactgatatcactgttctctttaaatcccaaccctggttaaattcagctcaccacctactccaggcctgaaccttgccatgtaaaatgaggactgctggatacaaacactcaatgatgctgattggtctcacttcaaattcatgactacaaacctcaagtgggcccctgggctgccaacagtcctagtatatttccttagtccagtggttctcaaaacaggggtcccaaacgagttgcgtcaacaccactcagaagcttgttagaaatgtatgttcttagctgggcatggtggcgtacgcctgtagttccagctacttgggaggctgagatgggaggagcacttgagcctgagagtttgagtctagcctgggcaacatagcaaaaccttgtccctaaaaaaaaaaaaaaaaagaaagaaagaaaaggccaggtgtggtggctcacgcctgtaatcccagcatgttgggagaccgaggcgggcagatcacctgagggtcaggagttcgagaccagcctgaccaacatggtgaaaccccatctctactaaaaacacaaaaattagctgggtatggtggcacgcacctgtaatcccagctactcaggaggctgaggcaggagaatcgcttgaacccgggaggcagaggttgcagtgagccaagattgcaccattgcactccagcctgggtgacagagcgagactccgtttcaaataaaaaaagaaaaaaaatgcatgttcctgacttcatcccagacctgtgagccagaaattctggggatggggctcagcagcctgtgtgattctgatgctaaggtttgaggaccactgcttaatcagttcattcttctattccttgaaaatactttttcacacctgtactcttctcagactgccaggaacccctctccttcctcactcccacctggtgatcactttttatttcactgagaaaatagaatcactcagaagagaattttattgtcttccagtgtccacctctgctagtatatacaaatgtctctctaagaaacaaaagccgggcgcagttcttcatgcttgtaatcccagcactttggccagctgaggtgggcagatcccttgagctcaggaattcgagagtagcctgggcaacatggcgaaaacctgtctttaccaaaaactacaaaaattagccgggtgtggtggcacatacctgtagtcccagctactcaggaagctgaggcaagagggtggcttaagccccaggaggtggaggctgcagtaagccatgattgtgccactgcactctagcctgggtgacagtgagaccctgtctcaaaataaataaaataaaaaatttaaaaacctccacaaaaaagctctaggtactactatggaattacctgtagaatatattgttatgtggaaattttgaatatttgtacatattttcttatttttaaaaaactgaaggataaactgaaaactgataaaaatagttaccaatggggaagaaaagattgggagtgggggaagagtgcaaaagctagacctctctgaatagtatctgttttacagtttgtactttagaacctatgtacatgttttatacaattaaaacaccaaattaaggcaaaatctagttgaaacaaatgaacctcactctattgcaaagtgaaagcataaccacaaggagaattatttttggtaacttttaaaatagggtaggggtttttgttttgtttttacgtaattttagacttatagaaaagttatgagaacaagtacgaggattctagataccttttactcagattctctatgttaacattttttccttcatttgtttaatccttctcaatctctcactcttatccatttatgtatttcctaaaaatagggaattcctttacatagctgcagtacagttatcaaaatcagttaatttatgttgacctaatatcattatgtattctacagaccttgttaaaatttcatcagttgtcctagtaaatatcctttataacaaaaataaaaacaaaccgggcacagtggctcacacctgtaatcccagcactttgggaggatgaggcgggcggatcacttgaggccaggagttcgagaccagcctggccaacatgccaaaacactgtctctaccaaaaatgcaaaaaattagtcaggcatggtggcacgctcctgtaatcctagctacttgggaggctgaggcacgagaatcgcttgaactcgggaggtggaggttgcagtgagcagagatcatgccactgcactccagcctgggtgacaaagtgagaccctgtctcgaaaatatatatatattaaaaacaagatctatctttttagtctcctttaatcactttaacctggaactgtatttgaagaatataggccagttactttctagaatgtccctctttgggtttgcccagggttccttcatgattagatctcgttatgtactttggcaggaataccacagcagtgttgccaagttctcaatgcatcatatcaggaagcacatgctatcaatcagtcccattagaagcagtgttaacttcgctagtttctgctgggtttctcccttgtaaaattactagtttcctgtttgtaattaataagtatgctgtagggagatatttagagatcacataaatatcttaccactcttcaaacttccactcacaagttagcatccttgatgattcttacctgaatcagttacgataatgaaaactgacagattccagcatttcttctacatttaattgattttctacttaaagcttttcctccttccccattcatgtatttgtttatttatttacatcagcatagactcatggattctttacccagtagtaaaatgctattttgaccgggcatacctagtgggatatatcttaaggacaaaaagaaccacaaaatcttaaacagcattcagtggtgttgttattgataatgtaggtattactattattttaaaactttcacacacacatacacacacattctgaagcacaaagcaaatgagtaattatgttagtatcattaggtaccaagattacagttgacccttgaacaacatggggattggggtactaatccccgcacagttgaaaatccatgcataacttttgactcccccaaaacttaactactcctggaagccttaccaataacatagttgattaacacatattttgtgttatatgcatcaagggagcctcaagtgatcctcaagtgatcctcccacctcgaccttccaaagcactgggatcataggcatgagccaccactcccagccggtttgataattatagaaagaggtttggctttaaaaatgtcaaaatagcaggatgcagtggcacatgcctatagtcccagctactcaggaatctgaggcaggaggtttgcttgaacccaggagttctgggatgtggtgcattatgccaatcaggtgtccacatgaagtttggcatcaatatgatctcccgggaggggggtaccaccaacttgcttaaggaggggtgtgaactggcccaggttgtcagcggagcaggtcaaaactcccgtgctgatcagtagtgggattgtgcctgtgaatagccactgcgctccagcctgggcaacagggcgagactcccacctctgaaaataaattaaaattaaataatgtcaacataacaggaggatcagtttttgtcagcaaagaggcagcagatgagttctcagatgccattcagaaaagtattgaagaggagcaatatctgcctgaacaggctgttaatatggatgaaaagtgccctattctggaaagaaaatgccacagagaacatctattaataaggaacagaagcaagcaccaagatttagggcaggaagggatacactaactctaataagcatagtcctgatataattccaactgcatttgcacaaaacagtagagtcagcctatctgcctcacttgaggtcaggagtttgagatgagcctgggcaacataacgagacactctaaccccccaaaaaatgtttttaattagccaggcatggtggcacacacttgtagtgccagcttctctggagactgaggcaggaggatcgcttgagcccaggagttcaaggctacagtaagctatgattgcaccaactgcactccagcctgggtgacagagtgagaccctgtctcttaaaaaaaaaaaaaaaatttatcaaactgtcttttgccaccattgcattctccagcttttagatccttcattttttttttttttttttttttttttttcctgagacagtctcattctgtcacccaggctggagtgcagtgtcagcctcctgggtttaagcaattttaccgcctcagcctcctgagtagctggaactacaggcacgcgctaccatgctgggctaatttttgtatttttagtagagataaggtttcgccatgctgcccatgctggtctcaaagtcctccactcaagtaatctgcccaccgcagcctcccagagtactgggattataggcatgagccaccacacctgaccccttcaccttctttttgctttaagttgctatttcgctttttctcaaattatgttagaatctataggtatgtcttttttatacccacataaaagctgcattttcaatactacttaaaaaggtatttcacaaaaagtgcaagattttagcacctactggtgttagctgcaggagtagcttcatgaatttcctttcctttttttttttttttttttttacaatggtccttatgttggattcatttatcttgagatggcagccaattgcagttgcagacctcaatctacaatacatatcaagcaattcagctttttctttttttttttaagatggagtctcgctcttatcacccaggctggagtgcagtggtgcaatctcggctcactacaacctccgcctcccaggttcaagcagttctcccacctcagcctactcagtagctgggatttacaggcgcctgccaccatgcccggctaatttttgtgtttttagtaaagatggggtttcaccatgttggccaggctggtctcgaactcctgacctcaggtgatccacctgcctcagcctacctttttcttgtaatgtcatgactttcctctgtttcttaggagcacttctagcatcaccaatggcactttttatggatcctatggtttaaggtattgcactaaacacagtgaaaataatatgagaactgtgagattacttttactgtgatatgcaatttattggagagatgaactgctcaagcaaagataagtagcatcacacaacatattaggtgaatactcgcaagacttgagctcactgcaacagcaacaggagggagctgtgaaattattacagtagtataatatgtactacagttaattttatggttatgatttaatattgcattctttgtatttgttcacatttctcttgactgaatggcaccgtttacagtctgtgtaggtgtaagttttgataaattttaactctttataatagatttgtgtacatttttatagtactaaataataaaatagtatctaaatatgttttatgcatttatgatatagctttttcttaattttttattccagaagtcatccttcacctttttcttaatttttaaaatagttctaggcaacatggttggtccacgagttttttcaaattgttacgaatctccaaaaaaaactttcaatatattttgttgaaaacaatccatgtataagtggacccacacagttcaaacccatgttcaaaagtgaactatacttgccaaatcaaagaattaaagtaaaaatgctataattgaataggaagaaatattagcttgaacttgtggtttatttatttattttttttttttgagaccgagtttcgctcttgttgcccaggctggagtgcaatggcatgatctcggcttaccgcaacctccacctcccaggttcaagcgattctcctgcctcagcctcccaagtagctgggattacaggcttctgccaccacacccagctaattttgtatttttagtagagacggggtttctccatgttggtcaggctggtcttgaactcccgacaggtgatcctcccgcctcggccttccaaattgctgagattacagacgtgagccaccacgcccagcatggtttatttttctcctaaaaatgcattcttttttcagcactgtccactgaaaagccaaagtaataataacccagtaaaaataatatgcctagtacccacatcatggatttatttatatattttattttatttttatttttattattattatttttgagacagagtctcgctttgtcgccaggctggagtgcaatggcgcgatcttggctcactgcaacctccgcctcctgggttcaagcgattctcctgcctcagcctcctgagtagctgggactataggcgcatgccaccacgcccagcaaatttttgtatttttagtagagttagggcttcaccatgttggccaggatggtctcaatctcttgacctcttgatccgcccacctcggcttcccaaagtgctgagattacaggcatgagtcgctgcgtccagccaattttttttttttttttgagacaaggtcttactctgtcacccaggctggagtgcagtggtgcaatctcagctcactgggttcaagtgaagctactgcctcagcctctcgagtagctggaattacaggcatgtgccgccacgcccagctaatttttgtatttttagtagggacaaggttggccgggctggtcttgaactcctgacctcaagttatccacccaccttggcctcccaaagtgctgggattacaggcatgagccaccgcacctggcccacatcatggatttaaatcgttttttgcactaaaaagaaacagggctacttagagaaatggctgattccagatctggggcaagaaatggacatgacaagcctggaacatcatcttgtgactgaaagcaaggaagttatcagacttctggagtcttacaaaaatacagaagaactgacttaaaggggctcccactggcccaaaatgggacaatttgagcacaaaaatttgtaaaggcagcaactgattaaaacacattaaatatataaaaatctgtaagttcataataattaaaaaaaaaacacctcatcagtcacctttggaggttgcctagaaactaacttggtattctggaaataaattataacagctttattcataatatccaaaaactagaaatagcctaaatgtctgtcaacaggagaatggacaaactgatatattcatacaatgcaatacttacggcagtagtaaaaagaaatgaactactgatcacaacaaaatgaatgaatctcagaacatgctgaatgacagaagccttacataaaagaatacatacttacggttttgtgtctatcaagttctaatataggcaaaacaaacctatggtgaaaaaaatatcagagtagtggtttgcactgggggagatggcagcagagattgaatgggaaggggatgagggagggaggtttgtgggataatgaatttttttagggatttgggttacacaaatgtatgcagttcatcaaaactctaatggtacgcttttgtgcatttcacagtatatacattttttaccttaagcataactttattttttttttactttttatagaagttttaagagacagggtcttgctgtcacccacgcaggggtgcagtggcacaactgcagttcactgcaatcttaagctcccaggctccagtgatcctcctacctcaagttactggtcccaagttactgggaccacaggtgcacgccaccaaaactggcttttttttttttttaagtagaggcataattttaaacaaatattaaatttcaatgatatgtgtgctaaggtgtattaaaaagtaagatggatagaaggataaagagatagatatttgataaagcaaatgtaacaatatttaattgtagaatctaggtggctctttacaatataattctttcaattttctatatgtttgatagttttcataacaaaatgttgaagaaaacctccattttggcacctctaattatgggtctaggcatcaacatctgctaacatcattgagtgaaaagttgatggtgaatcttataatgatgggtcaggcagacaacacctgaacccactgctcaatcctgtcactaaaagtaggatagccaggtgctatgttcttcctgttgcaatacaatagatatatcacctatgaagtattagtgcataaaactaaaattgaatctgaatctaatcaagattctagatctaactacaaatttacaggaaatacaggagagtaaaaaacattaaataataccatgtaggtaccattagtcaagtacagattgtgggggatttcacaggaaaaattacctagtatcttaacaaatcaatggcatgaacattggaaaaaaaaaagcataaggaaggggatctgttacagagtaagagacactcacaagacatagtcatcaaatgcaatgtacagaccttggatcctgtctagaaccaaccaaccgtaataagacctttcttctttttttagtctgttctactccttcaagttattggtagagaaaagacatttttgagacaatcaaggaaaactgaatgtggactgagtattagatgatactaaagaagtattgctcattttgttggacttaataatgatattatggttatttttaagtcctgtgttagaaatactgaactattaacaggttaaattacatttatgttaaaatacttctggggaaaaaaagtaaacagttggggatagatgaagcaaaaatgaaagaatgtccttgtttttgggtttttcgtttgtttgtttttgttttatttttgcctggagacgggcaagttgcccatacatcccagcaggccaggggaggagctgaaagaatgtcagtaattgccaaagctgggtgatagatacatggaagtttattaatctattttctccacttgtaaatgttaaaaagaggcatcctcagcttcacactttcttctacatcccatttctccatttttactacagtaagactgtgaaagatatctgtatttactgtcactacatcatctcctcccattctctcctgaacctggtccaatggggatttttgcctccatcgtgccaccaaaaccactcttatcaaggtcaccagtaacttccaaattgccaaatctaatggtcagttctcagttctcattttaaatgacctttgtaacattgatgactactaatcattcctacttgaaaaagtttcttcacttgacttccggataccaaactgattttcctcctgcttcactgtctagaccttgttttctttgctagattttttcttctgacttcagatattggcgtgcaccaggactcaatcctctgactcttctctatgatttcctaagcaatttcattccttaccatggctgtaaatatcatctgtgtactgttgattcccaaatttacacctctaatcccagcttccccttaatgtcatcttataaaatctcaaactcaatacgtatgagaccaaattcttttttttttttttttcatttttctataaaatagagatggggttttgccatgttgcccaggctggtctgaaactcctgggctcaagcaatcttcccgccttggctccccaaagtgctaggattacaggtgtgagccaccgcacccagcctgaaaccaaattcttgatccaccttacaaactcctccctcagtgttccctgtttcagtaaatggcatcttcattttcactcagttgctcagaccagaaaactaattgttataattgacttgtgtctttctctcacgctcatatccagtagcaattcctgtcagctttacctttagaacataaactgaatttgactacttctcatcatctctgcttctgtcactctagtctagtccaagtcaccatcttctcttgcctgtgcaactgcagtagcctcttaattggtctcctttttccctgtttcttcacaatctcctcacacagcagccagagtgatccttttaaaacctaaaactgatgatagtactcccctgttcaaaaccttatggtgatttcccatctcgctcaacataaaacccagagttcggagagcaggccagagcccaggcccggcccagcggcgcccgccaggtagacccaggcgaggccgcgtgccggcgcgaggggagcccactgcgggaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttttaggagcccgtaggtcatcttggagggtcgtctcaagtattgaacaaaagacggaaggtgctgagaaaaaacagcagatggctcgagaatacagagagaaagttgatacggagctaagagatatctgcaatgatgtactgtttcttttggaaaagttcttgatccccagtgcttcacaagcagagagcaaagtcttctctttgaaaatgaaaggagattactaccattacttggcagaggttgccactggtgatgacaagaaagggattgtggatcagtcacaacaagcataccaagaagcttttgaaatcagcaaaaaggaaatgcaaccaacacatcctatcagaccaggtctggcccttaacttctctgtgttctattatgagattctgaactccccagagaaagcctgctctcttgcaaagacagcttttgatgaagccattgctgaacttgatacattaattgaagagtcatacaaagacagcatgctaataatgcaattactgagagacaacttgacattgtggacatcagatacccaaggagacgaagctgaagcaggagaaggaggggaaaattaaccggccttccaacttttgtgtgcctcattctaaaatttacacagtagaccatttgtcatccatgctgtcccacaaagttttttatttacgatttatgacaggtttatgttacttctatttgaatttctatgtttcccatgtggttttcatgtttaatattaggggagtagagccagttaacatttagggagttacctgttttcatcttgaggtggccaatatggggatgtggaatttttatacaagttataaatgtttggcatagtacttttggtacattgtggcttcacaagggccagggtaaaactgcttccctgtccaagcaaagaaaactgcctacatattggtttgtcctggtggggaataaaagggatcattggttccagtcacaggtgtagtaattgtgggtactttaaggtttggagcacttacaaggctgtggtagaaacataccccatggataccacatattaaaccatgtatatctgtggaatactcaatctcaatgtgcacacctttgactacaactgcagaagtgttcctttagacaaagttgtgacccattttactctggataagggcagaaacggttcacattccattatttgtaaagttacctgctgttagctttcattatttttgctacactcattttatttgtatctaaatgttttaggcaacctaagaacaaatgtaaaagtaaagatgcaggaaaaatgaattgcttggtattcattacttcatctgtatcaagcacagcagtaaaacaaaaacccatgtatttaactttttttttttaggttttttgcttttgtgattttttttttgatacttgcctaacatgcatgtgctgtataacaatccaagcataattgttaagaacacatgtattaaattcatgtaagtggaataaaagttttatgaatggacttttcaactactttctctacagcttttcatgtaaattagtcttttggttctgaaacttctctaaaggaaattgtacattttttgaaatttattccttattccctcttggcagctaatgggcttttaccaagtttaaacacaaaatttatcataacaacaaaaatactactaatataactactgtttccatgtcccgtgatcccctctcttcctccccaccctgaaaaaaatgagttccaatttttttgggagaggggagattgattagaaaaaaatgtaatatgttccatttaaaattttggcgtatggcattttctaacttaggaagccacaatgttcttggcccgtcatgacattgggtagcattaactataagttttgtgcttccaaatcactttttggtttttaagaatttcttgatactcttatagtctgccttcaattttgatcctttattctatttgtcaggtgcacaagattaccttccttttttagccttctgtcttgtcaccaaccattcctacttggtggccatgtacttggaaaaaggccgcatgacctttctggctccactcagtgtctaaggcaccctgcttcctttgcttgcatcccacagactatttccctcatcctatttactgcagcaaatctctccttagttgatgagattgtgtttatctccctttaaaaccctgcctatcctgaatggtttgtcattgtctgcctttaaaatccttcctctttcttcctcctctgttctctaaataatgatggggctaagttatacccaaagctcactttacaaaatatttcctcagtactttgcagaaaacaccaaacaaaaatgccattttaaaagaggtatattttttcttttagaatgtaagctcctcaagagcagggacaatgttttctgtatgttctgttgtgcctagtacactgtaaatgctcaataaatattgatgatgggaggcaaaaaaaaaaaaaaaaaaaaaaacacccagagttctcaccacagtttcaaggccctacacctttgatcatccctcagatcacatttcccaccgctctgccccttgctctcatgcctttccagacacactgggcttccttcttcttctccaaacaaccctccttattcctgtgggcctttgtattggctgttcttctcatctggaacttgcttccatgtggcttgctttttcacttcgttctggtctctgttcagatattacccattagagaggccttctctgaccccaactaaaatagcaattccctagtccccatccctataacacctccttaccagcttaattttacttcctaacaagtaatactacctggctttacattctgttaatttgcatttatggctctatttgctttcttaaattcaactctttaggccaggcacagtggctcatgcctgtaatctgggcactttgggaggccaaggtgagaggatcacttgagaccaggagttcaagaccagcctgggcaacatatcaagacccctcatctctttttaaacataaattaatttaacttaattaagttcacattttataacttgtcttaaggattcaagaatgactgaatctacacagaggagaattatataaattcccttgtaacattaacttaagcctaaacatcatcaacatactattaagggcatacagaactttggagttctgatttcagcttctactccttcctaaggtgataacagttacacagccatggccagaagaccctgttggagtctagtttgcacttttttcttctgtatcatgttcattcttttctaggcttgctcacttgctgtgtcccatactggaatcatgctaggggtattgccatcttagtctgttgtcattgttctctctttgaaccaacagaaagttctaactaacagcagtctatcagttgatttcggtagaggtttgcctgctctcccatagactcttcttgctactttgtgtcatgctgtggtttgctcactattcatttctacacttgccttccttctttctctggctctcacatacacacttgtatttcctggctcatctctgtttgtgctagactattggaaaagtctttaaacttctttggacagaaagaataacttccaaagtagaatcctgatgctcccattgggcagagtaaggattcctcccacctgtgtgtcatcatcaaacacaggtgtaccagctcagtatgattgcaccctttttttatacctattatgttggctaaaactgaacaaaaactgtgtccttttatgaatgagaaaatataggagagaatttttaaaaaccttttgtcttctatgactaaagagacttgctttttttactagcccctgttttgagagccggtcagatgtagttttagtcatattggggaggacagtgtttaagcagataccagagctccccattatgaaattctttcctgacaccagccccaactaggtcccagtaagaaatagatgcagaggacaacatcctacaaaggaaaccctcattgttatcacaaagcatatgatataaaggagccctggtcaagcaggataccccttggggagaggatgtctttgccctggactaggaatcaggcaagtggttttctttccccttctcctttttcacctcccacccccacagagaggaaaagcagatccagagaagacatgcccaggaagagcgttgaagtccctgggaacaaggcttaattaaaatcattaaatctgacccatccatgtagtactccttggcttaagggtggaatgaataaagcaaagaaaagaggactgggcagggtggagaaagaaagggccatggctatcccctaacaaccaggatacaatggctctgtaggtaaaatcagaggtttcaagaaacattttggaagtgtaaaatatattttttcctaaagaaatctagactgtcactcaaaggaagacaatattgcatagtaaggcaaaaaaaatgtatctgtgtttcttgaacatccatgcttccttagtaattcttagcactgtactctaaccttacaagcaaataatacctaaagaacattggatggaacaggtatgtatttggagaaatcagccagacgtgagaatatgacaaataattcaagcatccagaataatttagaagtttttaatgtgtttctctattatcatgttatctaattttatgtaaactgcattgttcatcttcaatgaatccttatcttcgggtttgttttttgtttgtttgttcgtctgtttttcttttcagccccactgtgttctccttgcctcaaaagaaaactcggcacctgttaaacttggaggctttggggtagctattcaattaggggagtctggacttgtagctggaggtaagactgctttaaaaaaaaaaaattcttcaaaacctggtcacttgcgactggtataaaactttcaagctacatattagcccaacctcagtgtttcatacctcattccaccccaccccaactcccaaaaagcatcatcagatagtttttaatttaataactctgtagtcataactagaatcttagtcccttaagaatagactcttttttctctttgtacctccagtacttaagagactgtacaagattaaaacagtgttcagagaaaataagtttgaggcatagtgccttttaaagttgaactggccaaatgaagtcaaatctaaaatgtgtagattagccacttcctggtttacactgatggctaatttttaatttcatactgtttgcctttttccatttatcaaagaatcctgctcaagccatcagcctgtatattagcaaagaataagcagatgtgaatgcaggctgattttattattagccaaagcaaaacataatttttaaattcccatgtcagaataaaaagaaaaaagttacaaattatataatcttgcacagcacatttcatataactcaattccttatagctagaacatcaagcagtaacaacatagaccatcttcagaaaaatgagccataggtcatagttgtaatttttttttttttctttcagacaatgtcttgctctgtcacccaggctggagcgcacagtggcacgatcatggcacactgcactgcacccttgaccttccaggctcaagtgatcctcccacctcaacctcccaagtagctaggatcataggcgtgtgccaccatacctagcaaactttttttatttttagtagaggcaaggtctcactacattgcccaggctggtctcaaactcctgggcctaagcagtcctcctgcctcagcctcccaaagtgctgggattacaggtgtaagccactgcacccagccaatagttgtattctttaaataattttttcaccacagtgccctctaaaattaaattacattcaaattttcttttagtttcacattcttttccagttaatcatttccaataatatgcaaaactgcaagctgagtatagtttcaaagaatgctaattttttcccctaatttaaaactttctgttagtgattggaagactgaccaaagggtcaggtagtaaagcacagtttaatcatagaatctcaggactccaaagggccttaacttctccagtcttgtaactaatgattgaattcttccataatattcccaagaaaagattgagttctggtattaaacctcagagagcaaagtagtcactacatcccaagacagttcatttcatttttggataactccttaagtattaaaaagctcatctttgcatctttctgtaacttctacccagtcatcctaatcctgacttttgaaaccactctgaacaattttcatccttccgtatgataaccgttcatctgtttgtagacaactaccatgtccccctaggtcttatccaagttaacttccctagggtgatttggccattcttcatataaactggttcaaaatctcttcagtatccacaaagtacagggcctgaactgaacactctaactacaggtagtacagtacagccgatccagtgcacagtagcattgggctatcacttttttgtgttctgggccttaaatttccctcgagttccccaaattgcattagctttttggacaactacatagcactgatggttcatactgatcttgtaatcaagtgaaaatcctaaattattttttaaacaaatgtcactgttaagctaactctctcaattctggtacttatacagatcatttctatgttaagactacgtaattataacaaataatttctgatgattatattaccaaggttaatgggatgaaatgaaatgaatttattttatatgttatatactggccatatataatgactttgtttctgttgctctggatctatatcctgttggtatttagaatgtcatgttcttcgtattttattgtacatcttgactgggggggaaaatagatgcattatgtttacctggacattttctccatattaatctttttctaaagtccatgaacctttcacctaaattgtttatttttaaagctaattttgaactcccccccaccgcccaccgctggtatgtcagtattcaaaatgtatttttctccatgcttctagaattaaaatacttcctgatggtcaaaatattgtcatttcttagcacacctttttttgtattcttgaaataactgaatgttacgttttaaaaaatagaatatgaataaattagagataaattatttctcttagaaaaagcttttctgctgtttaaggtacttttgaaattttggtaattaaggttgggcacggtggctcatgcctctaattccagcactttgggaggctgaggcgggcagattgagcccaggagttcaagaccagcctgggcaacatggcgaaaccccatttctccaaaaagatgcaaaaattagccaggcatggtgacaagagcctgtattcccagctacatgggaggatcgcttgaacccgggaggcagaggctgcagtgagctgagatcgcaccactgccctccagcctgagcaacagagcaagaccctatctcaaaaaaaaaaagaaagaaattccgtcaatcatttaattatttatcaactttaaagcagaaagccattttcctgtcagtttgaaatcccagtccctagtcctccaaatagaaaggaattcatttctttatatgttgcatatagtaaaaatcatttaaacatatttacactccccctacctgaaactcagctatttaggaaacttacttatccagaatacaactagaaacctagaaaataactacaatagcagcaaaattattcctacccttaaaaatccactcatgctcctcacaattgagcatctaaagacactctctaaggctgacttgctcccatgttttaaaaagttgtatagattcgtgttccttcataccttgcacatgctattccttctagttggagtgccttttgttattttatctatctggttaactcctactgttctggaaggctgagctaacaattatctcctctttaaagcaggcttaccttcaccatcccgagttggatagccctattccttctctctatattcccataactatctgggctacatacctccatgtagcattggatgcagggacttacatcaaagactgtgatttgtaagagtaagggggaccatggctgagggtatctaggacctagcaagcacttaggaaattgctattaaatgaaataaactggttgctagtcaggttctagttaatagcagattataaaagcaacaaattaggagaacgcagaactaaagcatagtgagagaaaagaaataaaagcctgacaaaaatatatatgatatatactgagcagacaccaaaacttggaaagcgcaacagcctttcaatatgaaagaaatcaactcttgcatacctctgaagttcctgagggtgctttctgttctacagcctaggtctttaatcagtatctacaatgacaactctgagtcatcaagaaaaggttaaattatgagcagcattctgtgtaaaagaagtcaggaaattgtagaaagccatacaaaattatttaactaaggtgggcactgtgactcacacctgtaatcccagctacttgagaggccaaggcagaaggatcgcttgagcccaggagtttgagactagcctggggaaaatagtgagactctgcaaaaaaattattaaaacaaaaaggattgtgcgcataaagattcaaatcacaatgtatttaaaaatgtagctattcagaacaattctccccctgagattctggtaggaaggttttattgtattatcaaaatatataatatttaaatatttgtccaaaatatctcaaactgccatttaatttagtttgctaatttgtttccttttcttaaaattttgtggtcaaagtcctaaaagtcaagaagaagtatcagcaaaaacaaggatttttaggaagttggtgtatattaaagattaactccagtcctttttaccttctactgatttacatgaaataaaagagccttcctctacattctttctaccatggtttttcccctatcatctgtgagcaaattattgaaccaaacaacaggcatcttcccgaagattgaacactaattctccagaattgggtagtcttcgtctagctaaatggagagaaccttctcaggatggctgggactggccatggtcgctctgattattcccaagttaaggcccccattttgagtggcttggcccaggaagtggtaggagtcaagttgagtttcaaagcatcatccaaactgtcagcaggtacctaactggtaccctggtaccaattgaatgatactggtttcccctactcctgctagctcctgtccatcagaacaaggctaattctccagtggcccctccctgtccaggctattaatgaagtatggaaggcttagttcccatccctgcagcttcttcgtgttacttgaggaagcaaaatggggcaatacagaaataaaagtatttctctagccaggtccttctagtcaatagttttcactgatctatcgtacattttaaatgaaaatattttcactactggaaccctgaacttaagcttttctattatggggggaggaagggaaaccatatgatctgcagcaaaggtacatcctgatacacaagctaagagctcttttatctttctgcatcccaactgagtttcataatcatgaacagaacttgatatattctctctagctgaaccagaagatctctaaggtcttttaaaaccacagttctgagttctagataaagtattgcacaatcttcaaactaaaaattatcttgaactcagtatgatgaaagagagagacagagggaggaagggaggtggctgggcttgcatatatctagaagagctgccaagtctagtgggcagtgccccatcccacagtgatcttcctgccgggtacaagcctttcattccacaatagaagacttcttttgggatactgagttaaagatagttatgaatgtgcaaacagctagtatcagattccttacagaaagctaatttttgatagagaaacaaaagaaaactctttaaagaagatgaaagtcaaagaggattgaatgggaggagcttcataattttgcttttgtttatgccatatatttgctctcattctcttcatatgttaatgttaggaggaagctaaaaactcctactataacaaaatattactaactattgttaattgctataattaacccataaaatcaactgaacaggatttcagagtcaaattcatatttcaaataacagttctcagcatttggtttcattggggaatttccatttggcagtcaagtcatcttttttccaccgatttttttctcatgacttcctgccccctcctctcctttcccctgcctctgcctctgcccagggtaggcctcccaactctttcctggacagctacaggctctgcctgttgactctttcacctgcctctgctctatatatttggtgactttcaaccatgtgaaaattagaaaatttaaacttcttcatgaggtaagaaccacataaatacctactacgtagcatgcagaattcaatagggagtgccagtgtacaagacagaatacctattctgggctcaatgttttcaggaagcaattagataagtaatttttttcacctatgtgaacttgattttatggagaggtggaggagtggtgagagtatatgtattggtaaactttttatttggattgttattgttctattatttttagttttcaagtgaaaatcccattttatgtaaacatttttccttaatgttgttttaaatgtaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataaggtaatgcatcatgaacattttctttttccattgagattaatttatcctgaaaaatgtttttttgaagttactgtctgtctttgcccactaattgactgccaggtagttaccccatcagagaaaaggtctttgcttacatcattgatccagtggccttggtaggcaacataggcctcaagtaaatttctgagtcattgtcagctgagctatcaccctggtgaagaaaacatttatgaaccttctttgtgtaatttgagaaaggggcttcatttttaaagccttctgcttaatttgtaaagttaaaatggaatttcatccaggtataattttagtcattctttatcttaattttaaatttaggccagcacagctgaaaacatttgccatttacattccaggataaactgaaatgccaggatgacaactgcatttcatgatacaatatagaggcatttcagtgtggcttaaacattcctattcttctttggctattaggtgttggcagcctcatgtactatcacagacttgtgattagtaaatcattactttaactagtaaaaaattgaaaattcattactgactttatgaatagcgatatcacaaacacctaaggacttcttggaaataagtaagcttaaagttgatttcactaccccagcttttagactcctttgccctgtcccacaaggtacgactgacagtgactaggaggctgggcatgggaagcatggggatgtgtgtgtctgggtatcaggttaaggctgtttaagttggggaaattctttttcctctcattattactgaaactcatactttctattcaacctcatcactgtttcattttcagccatgactgacaacataaaaccaaaaacatgtgtatgtaacactggactctaaaactatgaggcccctaaagttttctcttcaattcctcggtaatgttagaattttatatgggacttggaaaaataaaatttaaaaagaagaaaagtaaagtggttccagagttacagtcttatccttttaagccataactgaagtttatggagatgagaatggtatatacttttgttggtttatttacctcactcaccatcagtttatgagtgcatataagtttgtcttttgttttagttagtttaagatatataccaaaactctgttaacagagaaagatgttttcagtgtagcatattctgctcctcccagagtcagctggccactggggaataaaatcaatacttaccaggtaactaaatgtctcaggaaactgcttgtaagtagtcatccctcttcaatccagggaagttgtaagttgctctcaggaatgcacagccaaattctggttgaatttagccaagtgaaatcacagatactaacgttttaaaagaaacatgattagtgatacatcagcataataataatactagcaataatgatagctaactcaggcatagcacatagcatagcatactttacataagtaaagtgcttagaatagtttaattcatttaaccctcacagcaacttgtgaggtaggtaccatataataataatcccccacctgcgtttttgagttataggcatttgctaataatagaattcttcctttgtgtttgttcagttgttaacttcctagtttccaaggcaatgtgcttcattccaacagactctggtattttatttcgtctatttttaaaacattgaatagttatttttgtttcttggtaaaaagacttagactattcacatatgtgcaaaaattaagtcatttaaaaattccctcttcctagtattatagtaagtcagatggatggtggcagctacatcataatttttttttgtacctggggtttgaagctttgaggttaataatttatttacttttttacttggctaacctcacctctcatttatcttcaggactttccttacaaaaagcctaggttttcaccaccttagtttgaagtatagatccatctctaccatctatgatgaatctcggcctttttcttttagtatactgtcatatgattctgtcagcatttatttttctatcttttattatcaaaaatttcgaacaaaaatagtagagagaatagtataatgagctcccagcttcagtaacacagacaatcttgttttatctgtattcaacatattattacattattttaaagcagatctcagctgggctcacttgagctcaggagctcaagaccagcctgggcaacatagggagacctggtctctacaaagagtacaaaaattagccaagtgtggtggcacacacttgtaatttcagctacttggaaggctgaggtggcaggattacctaagcctgggaggtcaaggctgcaatgagccatgatcacaccactgcacttcagcctgggcagcagagcaagaccctgtcttcccaaaaaaaaaaaaaaaatagatttcaaaaaaattatttcatcaccttggtggttcttttttgagacagagtcttgctctgtcacccaggctggagtgcagtggcacgatcttggctcactgcaacctccccctcccaagttcaggtgattctcgtgactcagcctcccgagtagctgggattacaggcgcatgcaccacgacacccagccaatttttgtatttttagtagagacgggggtttcaccatgttggccaagctggtctcaaactcctggcctcaagtgatccacctgcctcggcctcccaaagtgctggaattacagctgtgagccaccgcacccggccacatttcatcaccctaatggttctgagcaaaagaactattaacaaaattcttgatctctatggatattttaaagaaaagtttgatgacaccttttaaatgcagtactttttttttctttttttacctccagcagttgcaaatgtgagaccacattagaaaatactgtttcactggagtatatgctaacacttaacctcaattaacttctttgtaaagggcaaaaatatatttcccaaaccatatataagaagtgtaatgtcatatcattattacagataaccagttagtatatacacagcaagattctaagctgctatgggtttggtattcaaataagtaagattgttttatagccttattttgttcccccgtatagattcaatctccccaatttgttttagctactcttctcagctgaaggaatagaaaatcctgtgttggactgtcttgtaaaaaggacaagggagtatccttctaaacctctactcatttcagaaatcttaccacccctttcagatgatttctcaaccactttgtcaaggaaaaattattcagactttaaagagcacattcgctccaggatagggagaggaaacaagtctacccaagccctgtctaatcacttacctcatttcaaactggtcagttgaccacaatttcactaggatgaaaagtgtgggatttcatccctcccaaagtgtgggattacaggcatgagccactgtgcccggctggataatgataattaaacagccttatggcattagtcttaatgggatttgacaagcagaagtggctactatttgaaattctgcctgttggggggaaaaatgaagcacacttcaattttaagggctatccccaacataaagacacttttcactccccatcttcaagtacaaagtctcacattagtcagagctaatgctagcccttgctcaaattgtgatgattcatttatactgcagtgcaagtactgcagtttcatttggctttaaaatgttgtggagtttattcttcatctttcttccttagaaggtgatgtaggtctctgcctgttaaagccatggctttgcttgaaggtcctggcactgggtagctcacataaactcaccccatcagtaaacctgttgatattgaacaaggaatgagaccctactctgtctctgtctcctttccccacttgccttcccaaccccatgccctaaccactctgatttttttttaaatgattctgggtctcagacatatcccttttcccaggagccttctagcacttggctcacagatccacagcctttctcataagtcctgtgtcttttgaacaattcataattatttttgtttgattttaatcaatataccatgtggcttagttgtctcatctctaaaagagacaaaagtaacttcactgaggacagtattcaagcaaatctgttattctgtgggacctacggtagtagaatactttttcctaaacaccgaagttgatatgcagtgaccaaaatatcctattaaaaactttgcacagttcacaattattgctaacctcgattttttaaaacatatcttaaaaatatttctttaaaaattttaagttttattttagttctttctggatcgatgtattctagtctccctagctaaggatctaaagatagaaactggaataatgaacattctagtcttcaattattgaaaatattatcacttacataacaagaatatgggtatggaatatttactaacacaaattcttatgtagtaaagaacaacagaagaattgcatttgtccttttcttagaatgcaagcctttagaatcaaatttctgttctttgctctcagaattttattcacattgaagcaatataggaatattaaataatagtgaatgttaatgtctcatttaaggtaactatgtagttttcctttcctcctcctcagatgaatccaaggcagtggagccatatctctgaaagtgccaaagacctagtacgtcgcatgctgatgctggatccagctgaaaggatcactgtttatgaagcactgaatcacccatggcttaaggtacatgagcattcacaggtcaccttctacactttgtctgaacacttccagtgacaggaatgcgttgctctatgagatggtcctttttaccttttcttttttctgagcagttttcattagtttttttcatcttgtttgctgttcctgcacatcatctgtgaacatctgaatagaagacataccatttgagtgtcatgcagctatcagagggtaaaaaacaggattaagacagaatatatcaggggaaggcctcttttttctctgccaacatgtgttccaaagatatgcaacatcaacaactgaagtaataccatgttataataaattaactatctttattttgggtgtgactgtgtgctttatagcattaactatttttcagtagatactaggtataaattttctgtcttaggaaaacggcaggtttttttttttttttttagacaaggtctgacaacattgcccaggctggagtacagtggcaccatctctactcactgcaacctctgctcctgggctcaatcgatcctcccactttaacctccccagtagctgggagcacaggcatgcagtaccacacctggctaatttttgtattttttgtagagatgggggtttcaccatgtcgcccaggcttgtctcaaactcctggactcgagcgatctgcccgcctcagcttcccaaagtgctgggattacaggcatgagccactgcgcccagccaaaaggcagattttaaaagttcattttatatcccatcttgccagtgagtattaaggaaaattataacttgggacagcagtgaaacagtactttttgattaaaacattatacagcccaataattccaggcaattttcattttagatgttagaaagactaacgcttggagaggttaagaatttgcgccaagttggccgggtgcggtggctcatgcctgtaatctcagcactttgggaggccaaggtgggtggatcacaaggtcaggagtttgagaccagcctggccaatatgatgaaaccccatctctactaaaagtacaaaaattagcctagcgtggtggcgggcgcctgtagccccagctactgaggaggctgaagcaggagaatagcttgaacccgggaggcagaggttgcagtgagccaagatcgtgtcactatactccagcctgggtgacagagcgagtctccgtctcccaaaaaaaaaaaaagaatttgcaccaagtcacagaagttgtcagtggtgaaaccaggattctaattcagcctaccactaccctttgattttgcactagatcctatccctttttatttgaccacattgacccaacaacttcctcccttcctgcatcatcagagttctctctctgttggatctaacatgctataggttatttgtattatgcacactcttatatagacataataccttctcctgaccctacaaccccctccaggttttgcccctattctttgcttcccttgacagcaactcctgaaaagagttgtatagactactcacattgtccagtttcccattcctttcccatgaacccagtctagtcaatatcacaatcttatttattccactaaaacagctctggtcaagtcactactgaccttcatgttgctaagtccagtgttcaaatcccagggcttcttcttggcctgtcagcaacatttgacatccatccttctgaaacactgtcttctctgggcttctggaacacctgctctcttggttgtccttctacctcctggctgctccttctcagatcctactgattcttcctcatctcccctctcccacctcttcacactggaatgccataggcctccatccttgctcctcctctttttctctgttgaagctgaaaaaactcaaactgctctcacaccacacagcaacaatcaatacagaagacttctgtgaccagaagtgtggagatttcttcccaccaacaagcaagcaatcaactctgcagcagactgcagctgggtgtcctcccaactaaattcaaacactatctacctggagatagcatcagatcccacagattgagggctcagtcccacaaccctcacctcttcagacaccagtcataagtccaggccgctgaaacttctgccaaccaactacaaattggggacaccacagcctcttcctctttggggttggttaatttgctacagcagctcacagaattcagggaaacatttacttatgtttaccggtttgttacaagagatattacaaagaatatagataaagagatgcacaggacaagttacaggagaggaggggagcagagcttccataccctccccaggcacaacaccttccaggaacctccatgtgtacagctattcaaaagctccccaaatcctgtccttttggggttttatggaggccttattactataggcatgattgattaaaccatcggccattggtgatcaacttaacctttggtacctctcccctacccagagattgaggggtggggctgaaagtcccaaccctctaatcctgcctgggtctttgtgaccccatcctgaagctgcctagaggctgccagccatcagacatctttggcgtttctaaggattttaggagttgtatgccaggaaatgagctagaggaccaaatatatatttcacagtatacctctggtcttcaaacctggattccttacattaaaaaaatataggccaatgtggtgaaaccccatctctactaaaaatataaaaattagctgggtgtggtggcaggtgcctgtaatcccagctacttgggaggctgaggcaggagaatcgcttgaacccaggaggcagaggttgcagtgagccaagatcacgccatagcactccagcctgggctacaagagcgaaactctgtctcaaacaaacaaaaaaaaaagaaatataaaagaatatataattcaaaagacactgccacattactagaatctcattcaggcattgataattagttcagtccatcatcataatgtatgaataggtctcccagcatgaggccactcaggtttgcaggctttccattgatcttgccaggttctaaaagcaggaatggtcttggtttcaccgtttcagacacctgatataattgagctaagaaacagtatcctttcttgctctgagtctctttcaaggtgttaatgtaatgtgataatggatttccctgaattcataacacatttatttattcctttactctcagctgttaattttttcctcactttattaataacctttggaagaaacattagaatcaacatcgtgctggtctagatggcagacagcaatattagtctagtaattacctcctcctcagtccactcccatgcagggagactaaggttacataggtgccaatttagtggaccgtttttaccaccaggcaatatagctgcattcacaattaacccgttttgcacaacccacccccatcaggtccttaggaattctgacacaaggtttaaaaacatagttacaatttcttgtttaggaatcatccctggttctaacactggtagttatggctctggtcctagaaccactgcatagggaggggcagggggagtttagatgatatgggaaagaaggaaagaaaaaagtatagtcattatatcagcatactcccctcttgtcaagaattgcatagtcataacagcatcctctaccaccccccttccccagatcaatcagaaaaacgaaagaatatctagtggggacactcctttagccccactcatgttgagtgtgagtacacactggtaaaggcaagtaagccagcccttcctgctttcatctccccctgttttagacaaccaatgttttcattgcccattttagtctctatcaaactattactctgagaagaatatctctgcccactgctggaacattatgggctgtaccgtgtgttctttggcctaaagaaatggtgttcagctctccaaatatgtgcaatatcttctgttctggcttttttatggtattctcatcattcacatcttccaccgggcaagcaaagcccagtccagaatcagtgtctactcctgtcaaaacccatctgtggcctcccagggttaccagcatcagcctcacttgccagcttgttcagggctttcccaccagggaaatctgccccacagccatgggcagtgtctgtctcttttgctggcagacagaacagttcttattggcattttgtgcctgaaatgatacaaaagaaacctgtctagatgcagcccatctctgcactgttgcagtacccgtttatccactcatttgatggacccaggtggccacctcgagggagcacacagggttctctgcttgtcaatgtcaatcattttccaaacccagaaagaggctcttatgatgggcatcaacatattctacttattgcacccctcaaatttccatagggccattctccatatgggcatccctttaataaataggccaggtttccactgcccttctgcctgaccatgtgaccaggccactggtgactgtccatgagtcagtaaaaaaccaaacacgggagcttttgttattgttcatttcttcagaatgcaattcaactgccaagctaatgtgatcttaccttctttgatcaagagtggcatccttccaaacaggatgctgtcgattcaccttggaactgtcatccacacaccaagcagctcttcgttggtcagttgagagctgttcacggggccctgtccaagtgtcagtagaatcccacagttcctcacacagttccagagtcagtcctaggggaaaagaggctccctgcttgaggatgtttcctccttgcacttcccggagaggatgttcctgcataaaccatttccattttattatggaactattctgggcgctgccatccccatttgaatgtttctctgacatcatgtgagaaagcatgggtatttcaggtgtcaagatcattttatgtccttcagtcattagggatagtttcagttaatgtcccatagcaaggtagtaaatgcaccgagatggaaattctctagtgcaaagtcctagtggttgtcactgggagatgctcacagactttggccataagccccagtaaacatcctgcaaagggcgagcagatggagaatttgtccctaccagcactccagcttctcaactccacactgtgtgagctcaagcaatcttactggtgcctagttagcgtgtccaattaatatttctcgaagtgcagatttacatttcttctgttttacaatactgggtaggggaagtgttctccacccagtcataattatccagttccataaaacatttaggtaaaggagacataacttatttatgtatatcctgtttaaacattccaaatctcatactcctatcaaccctcacttttaccctttcttgtttaaaaaaaaaaaaaaaaaatgttgagtccccaacagcaggttgagccaagggaccttgccccttttgtcagtctttgtattgattaacctgcctcaacattaccccaagtaactgttggtcagctttctcactgtaatctctgccttctgactttttcaatttctccaaactggggtgaatacagcaaacctgtttggaatcccttaacattgggagaacagcagaagctccctaccaacctttgatagtattatattgagatctttgttttaaccccatcgatttccactttattcatctcatttctttttatttcttttttatttttttgagacagagtcttgccctgtcacccaggctggagtgcagtggcgcaatctcagctcactgcaacctccgcctcccaggttcaagccattctcctgcctcagcttcccgagtagctgcgattacaggtgcccgccaccatgcctggctaatttttttgtatttttattagagagggggtttcaccatgtttgccaggatgctctcaaactcctgagctcaggtgatccacccgcctcggcctcccaaagtgctgggattacagatgtgagccacagcatccggccctattcttcccatttcttattagccctctaaagattccaccctgctgggatgagtcccatgattctcctctttcttttttctcttagtttcaccccatcactgttttcttcattcaccttatttattaataaccatttaaactttccaccttcctgggatgagtcctgtgactctcctctctgcctttccccagtcttttgttaattacgctcatgttttcattggtgcccatacaaaagaggctccctcagccatagcatttactacagccagagtaatggatgtattcagtgagtgaatatctcagtcatcataaagccagtcccacatggcctgcataggaaccaaatgagccgcttcacctggggtactccacttggcattgataggtagagttggacagtctctaccttctcagggtgtacagaccttacagtggcttttattccattcactaggctgactgttccctcaggaataactccctgtgtgtctggatcacattatacccattgttgattgttcagtagtgagctgtgggtcctgcatcaacccaaacatgcctgtccactctgcagcatttaaaaccaaagaaagtgccctaaattagttattctcacaatccattttagtaaaggattttcagtaaactgatgataccaatctatgaaatgagacaatttcttcacactgtaccctctggtttcagtagtttcttggttttgcccttccctcacatcaactaccttcgtggtaaccacaggtcgtagaggtactgtcatccctgtataatttttcctttgggggtcagcttgaaggctagtggcctgggctcagatagactgaaatctgagcttggtctagcatcaaggcctcatccagcatttgtttcatttctgttcagctattacagacaaccaccaccaagggagtgaatatttcatctttttcttactagtttgcatatccttatgcatccagtgaaccaactccctgagttggatccatctctaaattccactggtaacttttacctttagcaattgattgcgacacagttgcagctccaaaccatggaagaccacgataatgaaccaggaatcaaaggttcctcatctcccaccctttcattctttctcttcccaaaccacatatttctgtgagccagggccgttctagcaaaccctacttcactgacactaactgaaggtggaaaaactcagaactgttttcctctgctctcgcaccacacaacaacaacaatcaacacacaagacttctttcaccaaatgtgtggggatttctccccattaagaagcaagtaatcagccctgctgctgggtattctctaattcaattctgacactatagtatcacatcccacagtttgagggcttggtccccaaggcctccccttcccaccctttcagacaccagtcacaagtccaggcctccagaatgtcagactgactggctacaaatcagagatcctacacctgctctttgggttccattaatttgttagatcagctcacagaagtcagggaaacacttttaccattgtgttataaagaaaattacaaaggatacagatgaagagatgcattgatggaggtataggggtgaagtgggaagcttccatgccctctgtggatgcaccaccctccaggaacctccatgtgtgcagctatccggaaactccctgaaccctgtccttttgggtttctatggaggcttcattaccattgaccattggaggtcaactcaaccttcagcccctctcccctccctggaggttgggggtggggccaaaagtcccaaccctctcatccctccttggtctttcctgtgaccacccctcatcctgcaactgcctaggggctgccagccatcagtcagtcattggcatacaaagatagcccttacgccattctaaggattttaggaattgtattccaggaaacggagctgtagaccaaatatatatttcaaaatatcacgtccatctacactccggcccttggagagctcatctagttttgatggctttaaatgctatctgtacaacaatgactcctgaatccaggcctctccccctaggtattctttcttaattctgtatacagtttggctccctgacacttgactcatgtcaccccttcctactctccctgcttactccattcccatcatatcagcctccttgctgttcttcagactgcaggcacatttcacctcagcacctttatatgacccttccctagaatactcttccctcagatatcatggcttgttccctcaccatcttcaggtctttgcttaggtatcagcttcttagtaagaccttccctgaccaccctatttaaaatgtgggggaaggaatgccaccagtattccctatcccccttcccctcccttatctttctccatagcatctgtcaccctaagacatacctatatgttacttatatgtttattgtctgtctaggtcataaaatataagctgcataagtctagggatttttggctcttggttcacttctgtctagcacctagaatgtatctggcatgcagtaggtgctcaatgaatattaatgatttaatcaatgaatgaatgttcgttgtattataccatgctacttcctcagattatgcaaaacaataaaatattttaaaagtagattaataatgtatcttaaggtgatgacatggaatagtattacaggacaattttgagatttcagtggatcttgattctccttaagaatattacttctcagcctgggcaacatagggaaatcccgtctctacaaaaataaaaattaaaaaattagccaagcgtggtggtgcgcacctgcagtcccagtgactcaggagcctgaggtgggaggactgctacttcaaaaatatgcattcacctctctgatactcagtgctagttattcctgatttcccctagaaaagagtagtgaacaatttttagatactttctttgttttgttttgttttttatttgtttgttttgccctcccagatatataatgaacactttagaggtaattcctatttctcctttacttttctcactttctccataacggggatcttttgttcattcaaagctggtttaaatgccaaataacaatgaaaatggcaggcattttagtcatttttcaaatctcttagaaggtggtttaacattataccatacctacttacagtgctttcaaagcttatcttggctaatagcatatttatttttggaaacctttgttcctgccaatgattatagttctcgttctaagtaatttgagcttaatacataataaatttctagcacaagaaagacaaaaaatgtcagtaacttaaatgaaaaagtttaagacggctctttgagctgagtatcgcatgccatgtctaaacaacagtttaacttcactacttatgtcatctgaagatggaaaaactcaattagaatgttatccagctggtaagagcaggcttatgttatatttcagtatttgtccatgtgtatttataaatcattactgtggatgtaagaggtatttttttagaatggttgaaatttaaatatgaaaaacacctggataccttgcaaattgaagaaataaaatgatactggttgcagtggcttgagcctatagttgtctcagctacttgagaggctgagtaagtaattactgagtaattactctaagtaattagagtaaggtgggaggattacttgagcccaggagtgaaaggctgcagtgagctacgaccatgccactgtactccaacctgggagacagagcaaaaccctgtctccacaaaaagaaaaaaaaaaacaaataagatgaagaaaaactttgtaatgaaggctacccaaagtcataataccattgctttgtgtcaaaaacaaaaaaaaacaaaaaaaaaccacaaaaaccaggcatgatgccatgcacctatagtcccagctatataattttttaaagttcacagccactgcaaaacatgccaaattgtaaagaccatcgatgctaggaagaaactgcatcaactaacgagcaaaataaccagctaacatcataatgacaggatcaaattcacacataacaatattaaccttaaatgtaaatgggctaaatgctccaattaaaaaacacagactggcaaattggataaagagtcaagacccatcagtgtgctgtattcaggagacacatctcacatgcagagacacacataggctcaaaataaagggatggaggaagatctaccaagcaaatggaaaacaaaaaaaaagcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacctagattcaaaaagcaggtccttagagacctaaaaagagacttagactcccacacaataataatgggagactttaacaccccactgtcaatatcagacagatcaacgagagaaaaagttaacaaggatatccaggaattgaactcagctctgcaccaagcagacctaatagacatctacagaactctccaccccaaatcaacagaatacacattcttctcagcaccacattgcacattccaaaattgaccacacagttggaagtaaagcactcctcagcaaatgtaaaagaacagaaattataacaaactgtctctcagaccagtgcaatcaaactagaactcaggatgaagaaactcactcaaaactgctcaactacatggaaactgaacatcctgctcctgaatgactactgggtacataacaaaatgaaggcagaaataaagatgttctttgaagccaatgagaacaaagacacaacatactagaatctctgggacacatttaaagcagggtgtagtgggaaatttatagcactaaatgcccacaagagaaagcaagaaagatctaaaattgacaccctaacatcacaattgaaagagaactagagaaacaagagcaaacacaattcaaaagctagcagaaggcaagaaataactaagatcagagcagaactgaaggaaatagagacacaaaaaacccttcaaaaaaataaatgaatccaggagctggttttttgaaaagatcaacaaaattgatacaccgctagcaagactaataagaaaagagagaagaatcaaatagacgcaataaaaaatgataaaggggatatcaccaccaatcccacagaaatacaaactaccatcagagaatactataaacacctctactcaaataaactagaaaatctagaagaaatggataaattcctggacacatacaccctcccaagactaaaccaggaagaagttgaatccctgaatagaccaataacaggctctgaaattgaggcaataattaatagcctaccaagcaaaaaagtccaggaccagatggattcacagcccaattctaccagaggtacaaggaggagctggtaccattccttctgaaactattccaatcaatagaaaaagagggaatcctccctaactcattttatgaggtcagcatcatcctgataccaaagcctggcagagacacaacaaaaaaaaggagaattttagaccaatatctatcgggggacttgccccgataatcacgtaggttcttttctatttttcttaagcgtcggccggcatgataaataaagggacagagtacaaaagagagaaattttaaagctgggcatccaggggagacgtcacacgttggtaggatctgtgatgcctttcgagccacaaaaactagcaagtttttattagggattttcaaaaggggagggagtatgcgaataggtgtgggtgacagacatcaagtacttaacagggtaatagaatattacaaggcaagtggaggcagggcgagatcacaggaccacaggactgaggcgaaattaaaattgctaatgaagtttcaggcactattgtcattgataacatcttatcaggagacagggttttgagatcaactggtctgactaaaatctattaggcgggaatttcctcttcctaataagcctgggagtgctatgggagactggagtctatcttacctctgcaatcttgaccataagagacaggtacgcctcggggtgggcgggggccagttcaaagacttactcctaggtgcgcattctctttctcagggacgttccatgctgagaaaaagaattcagcgatatttctcccatttgcttttgaaagaagagaaatatggctctgttctgcctggctctccagcagtcagagtttaaggttatctctcgtattccttgaacaattgctgttatcctgttcttttttcaaggtgcctacatttcatgttgctcaaacacacatgctgtacaatttgtgcagttaatgcaattattacagggtcctaaggtgacatagccttaggctgacaggattaagagattaaagacaggcataggaaatcacaagggtattgattggggaagtgataagtgtctatgaaatctttacaatttatgtttagagattgcagtaaagacaggcataagaaattacaaaagtattaatttggggaactaataaatgtctataaactcttcacaatccacgtttttctgccatggtttcagccggtccttctgtttggggtctctgacttcctgcaacatctctccctttctttttatataaatgtgccatggcgatgaaggcttgttcgttctctcgattttgacgcaggattctttgactggtccagcacactaaaaacaaaccgattaaacagagaaacttaattctaaaatttactacagtggagcccccaataggcttaatctaagtcgtggggtttaatctataaagattttctgccacctgatctaacgcctcagctccaggcagaatggataagtgagcttgagaggcttcaaaaatttgtttctttaattatgtctaatgataaattatcttctttacctagaaggtgtcctttgactttttcctatgaattatcagtctcattataggaatacggggtgatgcagaaatccgaagtattccaatcgcactgcatttgcaatgcgatgttcgagactcactacttgatctctaagccaaataacagactgtcttaaatcattaatttgatttgccaatttttgatcgatgccttgttgagaattccacatttgggtggaattggcttgccaatcattaacaaaatgagccctttgaatagattggtgtaatgccattctagcagtggtggccattgcagtgacagtaattaggcctatgataacagcaattaaagtgaaaacaaatctcttagatctttttttagaattcgctgtagcacttcattaattaaatgtattgagggggaggatacctaaggtctaggtaaagttaccggaacctagattccttcttgagctcgaaccaacattacacttttcctggagtcaaaatgggagttaatacaagtgtatagatgacaattgatgcatcggacggtttgattattcgtctaaattttgatatttcctactaacagtgtgtaaggaggcttaacacaactctgtatgggaatagtcaggttggaggtaagtaaagcagaatgtctgggtctacgttgatactgagagagtgggatggtaatgggaacaacagtcgaaatagttttcttttcctatactggcagtccagacatggcaatagccaatttttaaagttctgggtgttctgggctcagaatggggagtatcatacgaggcctgggggtgggtaatgcctttatcttcctattttaagagaaagaatgagctgatcctcgtatgcacagtagaatgatgattctcattctcctgataagaagtaaaataagtagcctccaggcattcctttccaccagaggagcaattgttttttaaatagccttttggtgcctagtctattactagaccatatgagtcattttttagtattactgcatgtgagttaacacagtcttcctaaattaaagttttagatgggccctcaaaatttttagggcatggttttcctgcaggtttatattgaaagtatggggtatctcctattactcctcctttcatttgttttaaaggagaaagggagagaccagagactaaatgtcctgttttatctgtagctgatgtttccggaagataagcagcctagacttgagttcgtagatggatgcaactaggtgcatgtccgaggcacagaggggggtatttataacctatggtaacattaaatgcagtgccttcttctcctggttgagcagggcaacggtcatctgtggctctaggcatccacacactatcgttagtgtagatttctgcaggagcatctatctaggtgagaggtcgaataagtggaggaaaaggcacataagcctaataagaataattatgtgtagcaggtaaatcagtgtgagaggaaactggtgagacagaaagtataaggaggagaatcattaaataaaacctagtgtaagcgagattgagtgctgaaggaggaagagaagaacagagggatgttattttcaggctaatagaaatggtgagatttttaggtttgtaaggagaaaaagaaaagtaatcaggagaagtgggattagttagatgggtctccattgccttcagggaggattgatttacacctattgtgatttgatgtgcctgtttctgaggaatcagcacagatctcatcatatctgaaggcagtctctgacacagacgtcttttctctgtggttttgattgtcagtattcacctgaagcttgagtcttctggtgggtacttagacaggggattgatgatctcctggtgaaacacaagcatatcctcttcctcatgttataattgtgccaggttcctaggtattggtttgggagtttttccataacactggcttgccttcgtttaaggaaaattttttgcctgtataatggcattcggctgcagttagagtattatctttaggaacatttaaaaaatttaaagtaaacaatgccaaatgtaattgggagtggggagttgttaaatcatgttttggttgttcagactgttgggacaattgggtttttaaagtgcgattgtaagggattctagtagtaggatctgtgatgcctttcaagccacaaaaactagcaagtttttattaaggattttcaaaagaggaaggagtgtgcgaataggtgtaggtgacagacatcaagtacttaacagggtaatagaatattacaaggcaagtggaggcaaggcgagatcacaggaccacaggactgaggcgaatttaaaattgctaatgaagtttcaggcactattgtcattgataacatcttatcaggagacaaggttttgagatcaactggtctgactaaaatttattaggcaagaatttcctcttcctaatgagcctaagagcctataggagactagagtctatcttacctctgcaatcttgaccataagagacaagtacgcctcaagggggccagttcaaagacttactcctaggtgcgcattctctttctcaaggacgttccatgctgagaaaaagaattcagcgatatttctcccatttgcttttgaaagaagagaaatatggctctgttctgcctggctcaccagcagtcagagtttaaggttatctctcgtattccttgaacaattgctgttatcctgttctttttttgaggtgcctacatttcatattgctcaaacacacatgctgtacaatttgtgcagttaatgcaattattacaaggtcctaaggtgacatacatctttctcggctgacaggattaagagattaaagtaaagacaggcataggaaatcacaaaggtattgattaaagaagtgataagtgtctatgaaatctttacaatttatgtttaaagattgcagtaaagacaggcataagaaattacaaaagtattaatttgaggaactaataaatgtctataaaatcttcataatccacgttcttctgccatagtttcagccagtccttctgtttaaggtctctgacttcctgcaacaaatatccctgatgaacatcaatgcaaaaatcctcaataaaatactggtaaaccgaatacagcagcacatcaaaaagcttatccaccacgatcaagtcagcttcatccctgggatgcaaggctggttcaacatatgcaaatcaataaacataatccatcatataaacagaaccaacaacaaaaaccacatgattacctcaatagatgcagaaaaggcctttgacaaaattcaacagcgcttcatgctaaaaactctcaataaactaggtattgatggaacttatctcaaaatagtaagagctatttatgacaaacccacagccaatatcatactgaatgggcaaaaactggaagcattccctttgaaaactggcacaagacaggaatgccctctctcaccactcctattcaacatagtgttggaagttctggccagggcaatcaggcaagagaaagaaataaaaggtattcgattaggaaaagaggaagtcaaattgtccctgtttgcagatgacatgattgtatatttagaaaaccccatcatctcagcccaaaatctccttaagctgataagcaacttcagcaaagtctcaggatacaaaatcaatgtgcaaaaatcacaagcattcctatacaccaataacagacaaatagagagccaaatcatgagtgaactcccattcacaattgcttcaaagagaataaaatacctaggaatccaacttacaaaggatgtgaaggacctcttcaaggagagctacaaaccactgctcaatgaaataaatgaggacacaaacaaatggaagaatattccatgcttatggataggaagaatcaatatcatgaaaatggccatactgcccaaagtaatttatagattcaatgccatccccatcaagctaccaatgactttcttcacagaattggaaaaactactttaaagttcacatggacccaaaaaagagcccgcattgccaagacaatcaatcctaagcaaaaagaacaaagctggaggcatcacactacctgacttcaaactatactacaaggctacagtaaccaaaacagcatggtactggtaccaaaacagcatggtactcgtaccaaaacagagatatagaccaatggaacagaacagagccctcagaaataataccacacaactacaaccatctgatctttgacaaacctgagaaaaacaagcaatggggaaaggattccctatttaataaatggtgctgggaaaactgggtagccatatgtagaaagctgaaactggatcccttccttacaccttatacaaaaattaattcaagatggattaaagacttaaatgttagacctaaaaccataaaaaccctagaagaaagcctagacagtaccattcaggacataggcatgggcaaggacttcatgactaaaacaccaaaagtaatggcaacaaaatccaaaattgacaaatgggatctaattaagctaaagagcttctgcacagcaaaataaactactgtcagagtgaacaggcaacctacagaatgggagaaaatttttacaatctacccatctgacaaagggctaatatccagaatctacaaagaacttaaacaaatttacaagaaaaaaatcaaacaaccccatcaaaaagtgggtgaaggatatgaacagacacttctcaaaagaagacatttatgcagccaacagacacctgaaaaaatgctcatcatcactggccatcagagaaatgcaaatcaaaaccataatgagataccatctcacaccagttagaatggcaatcattaaaaagtcaggaaacaacaggtgctggagaggatgtggagaaataggaaaacttttacactgttggtgggactgtaaactagttcaaccattgtggaagacagtatggcaattcctcaaggatctagaaccagaaataccatttgacccagccgtcccattactgggtatataaccaaaggattataaatcatgctgctataaagacacatgcacacgtctgtttattacagcactattcacaatagcaaagacttggaaccaacccaaatgtccatcattgatagactggattaagaaaatgtggcgcatatacaccatggaatactatgcaaccttaaaaaagggtgagttcatgtcctttgcagggacatggatgaagctggaaaccatcattctcagcaaactatcagaaggacagaaaaccaaacaccacatgttctcactcataggtgggatttgaacaatgagaacacttggacacagggtggggaacatcacacactggggcctgtcgtcgggtcgggggaggggagagggatagcattaggagatatacctaatgtaaatgacgagttaatgggtgcagcacaccaacatggcacatgtatactataagtaacaaacctgcacgttgtgcacatgtaccctagaacttaaagtataataaaaaaaactataacatgaaaaaaataaataaaagtaaagttttttaattaaaaaaaagataggaattatttctttgataaaaccaccaaaaaaaagttctattcacttatttcacatcaaaaaagaatttgagtgttagaccaagtaatatgttaatgtcttatgactgttaaatgatacctatttaacacctttatctctctgaattaatgatacttggtgtgaatatttattccaacaaaagtaggccatctaagattatattttcctcacagatggttgagctcttctcacaccctctatagccttaatatatagactgtaaagtatactgtcattttaaaaaaagtgaaaaggatatttatatcaggctaatcaatttgaattttgggtaatgaacacaccaattacccgtgttttccaaatctcatgtgcacaagggactatgaatcatgtacttcattaaagtgcaaggcacattactattgaattttttctgaattcatattacattattattattagtgtcaggagatactatttaattcagaaaaaacagcctggacaacatggtgaaactccgtctctactaaaaatacaaaaattagccgggcgtgatagcgcatgcctgtaatcccagctacttgggaggctgaggcacgagaatagcttgaactgagaatgtggaggttgcagtgagccaagatcatgctactgcactccagcctgggcaacaagagtgagtctctgtctcaaaaaaaaaaaaaaaaaaaaaaaaagacgagataccttaacagacttttttttaaatcttgtgattttactagcttagaaaataattgatatcataattgaagcataattttatttaaaaaaatacattttgactctgtcctcacctctctttccacatcaccttagtgaatggtgagcagaaaaggtgtttgctaaaaatagagttcacagtcagatatgtagtaaacttaaacatatttgcaatatgtaaagaattctcaaaactcaataataagaaaacatacaaacaacccaattcaaaatgagaaaagatttgaacagatacttcaacaaagaagataatacagatggcagataagcacaggaaaagatgttcatcattagtcattaggggaatgcaaattaatgccacaatgagatacctgtaaacatgttttacagtggctaaaatcaaaaagactgaccataccaattgttgacaaagatatagaacaatggaggccaggtgcggtggctcacacctgtaatcccagcactttgagaggccaagacaggcagatcacaaggtcaggagatcgagaccagcctggccaatatggtgaaaccccatctctactaaatatgtaaaaattagccaggcgtggtggcaggcgcctgtagtcccagctactcaggaggctgaggcagaagaatcgcttgaacccaggaggcagaagttgcagtgagccgagatcatgccactgccctccagcctaggcgacagagcaagactccatttcaaaaaaaaaaagaacaatggaaactcataacactgttagtaggaacgtaaaatggtataaccactttggaaaacagtttggcagtttcttaaaagttaaacatactcctatcatatagcccaggcattctactccttagtatttacctaagaaaaatgaaacacatcttcatacaaagacattaatattcatagcaactttatgtgtaatagccaaaaaatggaaacaactcagggtccatcagcaggtgaaaggataaattatgatacatgcatacaatggaataccactcagtgttaaaaaggaatgaactattgatacatgcaacaacatggatagattcaaaatcattatgctatatgaaagaagctggacaataatgagcacatactatatgattcaatttatataaaagtctagaaaatgcaaactaagtgacagaaagtagatcagtggctgactggggatggggatgggggctacaaaagggcatgaagatacttttgagcatgatggatgtgttcattatcttgatcatggtaatggttttatggttgtaaatatatgtcaaaacttatcaaattgtacattttaaatgtgcagcttattgtatgtaattatacctcagaaaagctttttggagaaaacaaaaaaatatatattcagagtctatctctctttcaccctttttattatttccagctggtttcatccaccatcatctttcacctggattactgtaaaagcctcctaactagtcttcccgctttttttttttttttaaaccctcatctccttccaatctattctcggcaaaactactaatgtttatttacagttcagggttgaaggctgggcgtggtggctcgcgcctgtaatccgagcactttgggaggccaaggcaggcagatcacgaggccaagagatcaagaccatcctgcccaacatggtgaaaccccgtctctactaaaaatacaaaaattagctgggcgtggtggtgcacacctgtagtcccagctactcgggaggctgaggcaggagatttgcttgaacctgagaggcagaggttgcagtgagccgagattgcgccactgcattccagcctggcgacagagtgagactccatctcaaaaaaaaaaaaaaaaagttgagggttgaaaatttacctattagttctgtaattgctctggcttggatatcttgtactgtgttgaataaaagtgagggaaaacaagaaaaattacctattgaatacagtgttcactatttgaatgatgggcacactagaagccaaacctcactgttatgcaatataaccatatagcaaacctgcatatgtaaccccagaatctataaaaataaagtcagatcatgtcactctagctcaagaccctccactggcttcctctcctactcagaataaaagccaaaggcccgcatggcctaccccagccttgtcatctctctgatctgacccgctattctccttgaccccttcacatcacttcacacacattggtctcctggctacttcttgaaaattccaaacatactccctccattgggcctttgcattggttattttctctgcctagaccactccctcacctcttctaaatgtcactttctccattgggcctactctgaccacccaatttgtttttgtttttgttttttagaaatggggtcatgctctgttgcccaggctggagtgcagttgcagtcatggctcactgcagccctgacctcatgggttgaagcaatcctcagcctcccaagtagctgggattacaggtgcatgccaccacgcctggctaattttttaattttttcatagagacaggttcttgctagatcttgaactcctagcctcaagtgatcctcccatctcagcctcccaaagtgctgggattacaggtatgagccaccacacccagccaaccaccctattttaaatatcaaggtacccaatccctcttacctgctttacttttttgccttattccatagtacttttgacatactctacaatttaccttttttgtgttttctcatcttcttgcactagaatatgatctacatgagggctggaatctttgttggttttcctcatgtatgccaaatgcataggacaatgcctggcatataatcagctcttgaaatatttatgaaattaatgagtgcttatagcatatgaatcctcaagatacattggcaaattagagtaggaccaaagtggggagaagagtaagaagaggtttaaaatacacatgagggaccaggcacagtggctcacacctgtaatcccagcactttgggaggccaaggtgggaggaccccgtgtgagtccaggagttcaagaccagcctgggcaacatggcaaaaccccatctctacaaaaaatacaaaacttagccaggcatggtggcacttgcctgtagtcccagctactcaggaggctgaggtgggaggattgcctgagccagggaggtcgaggctgtggtgagccaggatctcaccactgcactccagcctgggcgacagaatgagaccctgtctctaaaaatatataaataaataatgggggattcatttatttttgagacagggtcttaacgctgtcacctaagctgcagtacaatggtgagatcctagctcaccacagcctcaacctcccaggctccaacaatcttcctgcctcagcctcccaaagtgctgggattacaggtgtgagccaccacacctggcttgcagtgagctatgatcagcccactacactctagcctgggcaacagaggaagaccctgtctcaaaaaaaaaaaaaaaaaaaaaaaaaaaaaaaagcgtgtcctaattagaagagtctgtaattgttatagtccatgacaacgtagaatgctgaatcagttgtggaattgatttttcaaatgcttgttttacctggcaaatcatgtcaaaggtaacctgaggccaggcagagtggcttacacctgtaaatcccagcactctgggaggccgaggcggaaggatcgcttgagctcaggagtttgagaccaacctgggcaacatagcaatactccttctctattaaaaaaaataaaattagccaggctggtgcacttatatcccagctactcaggaggctgaggtgggaggatcactttgagcccaggggtttgaggctgcagtgaggtatgattgtgccactgcacgccaacctgggcgacagagtgaaaccctgtctcaaaaaaaaaaaagtaacaatgcctttataataattacgatttgttattttagccacatagccatatatatgaaatttacgtgacctattatttcagccctttattgctgaaaatgaaatattattttattactatcagtttaaccttaatatccctcatttcagattgcttaccagtatcatggaataaaatctccaatctaaaattcaatctgagttttatatttaagaattttagctttattatttgttttagattaagcttctgcacttttttaaacggttatatatgttcattatctttcatcttacataggagcgggatcgttacgcctacaagattcatcttccagaaacagtagagcagctgaggaaattcaatgcaaggaggaaactaaaggtaaattaaacaaatcagcaaaaaagccaaacagatatagttaatgatcatgtttttattctattttggtgcccataaatatgtactaatgctggccattgtttttgttgtagctaaattctcatttccaaaaattaccaccacttcaataagattttggctttttaaattatttaaggtagtatatcagtatgagtctgaacaataaattataatagaagattagttgtattttagatttgtcttaaatttatagcagagatatattattatccattattattgaatatgaatctagaccatgttttttcaaacttaaatattttgacaaatgtatgtttagttcaatggaaataactttgaattagaattggaattaggggccgggtgtggtggcttatgcctgtaatcccagcactttgggaggccgaggcgggcggattgcctgaggtcaggagttcaagaccagcctggctaacatggtgaaaccccgtctctactaaaaatacaaaaattagctgggcctggtggcaggcgcctataatcccagctactcgggaggctgaggcaggagaattgcttgaacttgggaggtggaggttgcagtgagctgagatcacaccattgcactccagcttaggcaacaagagcaagacttcatctcaaaaaaaaaaaaaaaaaaaaaaaagaattggaactaggattgaacaactatcagaaagcagtaaataaaatcttacactaccttgatctactagaaaatattttcagctcagatcacttttctcaccttctttattcttcctaggtgtctttctccctcttactactctccctatcctccacctcaccaaaaaaaaaaaaaaaaaagaagaagaagaaaagaaaactggtaatcaccccatatggggagtccatttgactttaaaaggttctgaaaaagaccagacataaagtaatggaatcttttcagcactgagagaaaatgctgagagaccatcccccacccaaccctccagagtaacaaagggaaattgattatcttaacttcttagaattaatttatgtttgacttacttttgatactgaaaaatgttaactgttctctaagtggttgattagatagtagtcttccttagtcacatgactcctgccaactataaaacttttcttcttaagtattttcagatatgccataaattctaataataccattttatttttcaacccctgaaattagtgaattattatgtataactctagacttataaaaacatttatatgaattttgaggaaactattaggctacaatattatcctatagacctgaaacttttaacatggtacccactggccacatgcagctatttaaatttaaattaattaaaattaaataaaattaaaaggtcagtttcccagtcacactagcacatttcaagtgctcagtaaccacagttggctagtggctactatattagacagcacagatgtagcttgggacatttccatcattacagaaggatctattcaaccatgctactatagaacaagggaaatattaacatatcattgttggtgttgattattcccattttagcctttcttctcactgattttgcagtcaagggttcaaagtgactcttctctatttgctttaaaaatccttggccaaaataattattaatgataagccattattgagatggtagccaaagaagtttcccaaaacttttattctttttgccttgatatccacctaaacctgtgtagcctacaaataaaaaactcttttattattcaaagtgaaatttggtcaactgtttttgaagttagtttcctccccaaagaaactattattacacttttttgtcaacttttctataagtcattctaaacctaattgctttggcctcatgtgacattacgctgtatggggttgaacctttcattgcccaaatacaaacatttcaccagagagcttgggcttgccccatcacaagaaacacatgctgtacttctcccggggccacagaatcagacttgggcctaaaatagccaaagtggtgactaagattcatttggacagggccaagctgtcaaaacagagaggggtcatgtggatttaccacatccccttgcagggctatttaaagttttaagacccaccaaacaacctagaactaggaacatcagcagggtcattagtgaatgtgtttggcttctgataaggctgtattcttttgagtagttcagccaccttgttaaaacatgttacacctaccatcctcaaggaactaattcccattctgcctcttcagtggacttctagaacagagattgcaacttccttggctttcagagtccaccacacactttattttcacacaactaggtgctcatcctacccagacactattcttaacctcctcagtggtgggtgacagtttaatttgtaatgactcccttggaagtgattaaaagggagttcacagaaagcggtagaaaattacttttgtggccaggcacagtgtttcacacctgtaatcctagtacatttggaggccaaggcgggcaaatcgcttgagctcaggagttcaagaccagcctgggcaacatggtgaaaccccgtctctacaaaatatacaaaaattaaccaagtgtggtggctgtgcatgcctgtaatcccagctattgggggcctgaggcaagaggatcacttgagcctgggaggcggaggttgcagtgagccaagatcacgccactgcactccagcctgggtgacaaagtgagaccttgtctcaaaaaaaaaaagagaaaaaagaaagaaagaaaattactttggtaacttagtcatgatggaatgatggaaaatgtattttccccattttggttaccacatgtttcatgtgtcgagttttttcctcctaattcatactaagctctggaattgtaatacttcattaaaaaaaaataaaaaaaaagaatcctctagataacaatactttctttaataaactacatcgttctgagcacagaactgaatatgaggacattttctcaaactgaatattaggatacatgagacagactgcatgatctccaggctgtgtggaaaatctgtgctctgtggtctggggcttttgagggggcacacctgtactctaaccctggctgtcatctactgaaggaggtactgaggaaagtggtaactgttgttatctgaggatgtctatccagagaagagactcaggagggaatgtattctgaagtcatccctattgcttcttcaattatttctacccctagaaagcaaattccccacagtgaagtgtgttgaagaaattctatacaaatagaagcaatattctatgtttgggtaagtttattgcagtccatttaagaaatggtgagtcgagtccacgtgattcagttaagaggataaaatcatttatttcctatatatacagaaagcaaggatttctaataactttctacagtttttctttattattattattatttttttttttttttttgagagagtcttactccatcacccaggcttagagtgcagtggcgcaatctcggctcactgcagcctccgcctcccaggttcaagtgattatcctgcctcagcctcccaagtagctgggactacaggcaccaccacatccagctaatttttgtatttttagtagagacgggatttcaccatgttggccaggctggctttgtactcctgacctcaagtgatccgcccgcctcggcctcccaaagtgctgggattacaggcataagccaccgcgcccagcctttattaattttgcaaattgcaaaagtattctctgacttactgattggtcacttgtgttcctgaactgtgcataactacgaaaggtttgtttaggagtgccattttctaatactgtataaagctgtactatccagtacagtagtaaatagccatatgtaactgtttacatttcaattttaataaattaatattaaataaaaagtaaaatttggttgctctgttgcgctagcacctttcaaatgctcaataccacgtgtgactgatggctactgtattagacagcacaggtttagaaaatttccttcatcacagatagttctattgtatggtattgctatagagtcttggtaactgcagagtaatgcttatacataagcagcactttttgataggtcaaccaggaagctataatagatattttttggcaattttctttctgttagttcaacaaaaactaacttaaagatttatcaaagacctttgtaccgtaatgaaacccagcatttacatacagtcctctctgtagtaagggtttgtacaaaggcagtaaattgagatagcagtcgttgtgggcttcagctaatcagagcattaaatctggtatccaaaaggtaacctttgagcctgagcaacataaggagaccccggctctacaaaaataaaaaatttgccgggtgtggttgcacacgcctgtggtcccagctacttggaaggctgaggtgggaggatcacttgagcctgggaggtcaaggctgcagtgagctgtgatcacaccactgcactccagcctgagtgacagagtaagactctgtctcaaaaataagcggggtggggaccttaattctaaaaactgaaaacttattctggtatgagcagttccgcaaatattctggtatgaacagttccacaaataataagtgaagtgattttgatcttacatattgattttacaaatcaattaatttgtgattttttttaagaaatacatatataggccaggcacggtggctcacgcctataatcccagcactttgagaggctgaggcgggcggatcacctgaggtcaggagttcgagaccagcctgaccaacatggagaaacgccatctctactaaaaaaaatacaaaattagctgggcatggtggcacatgtttgtaatcccagctactcgggaggctgaggcaggagaattgcttgaacctgggaggcggaggttgcagtgagccaaggttgcaccattgcactccagcctgggcaacaagagcgaaattctatctcaaaacaaaaaaagaaaagaaatacatatatagatatatgttgttttttcttttttaattgagacagggtctcactctgttgcccaggctggtctcaaactcctggactgaagcaatcctcccaccttggcctcccaaagtgctgggattacaagtgtgagccaccatgtcccaccagtttatgattctgaaatgtagaatatattacttcctgttgggcaatagattttgaaaattatgtacatttaagaccatctctataaaatacttttacatagacccaaaagaatttctaagatatctattctgtgcaattactcttaaatataactatatctagtacacttacaagtctcatttttcattttctctagagaaaatactgcagcctcttttagtcatatatcctgactgaaaattatgaaattaaaggttttagacctatgtttaggttatgtttgagtattatatatgtataggctatgctgactaaactgaatgataactctggttttggctatatggagacatatcaaaagttctgatttaattaatcatctcacctaattatcatctaggacctaattattaagtataatcaacccaaattctttaacatctctaccttgaaatgattttcttgacttttggtcatctctgttcagcctcaacctctccaaattctccaccctttttagggcttttgagttcagtcgtctgaattctaataggatgattatctttcaaatttctttgtcacactcctattggtatgttctggtgatacactttctcccctcagtatatttccctgttcactcaggaatatgactatatattaccttgttatttaggtacaaagccaattattctatatctgatacttgtatattttgtatttagatgttttaaaatgtaccctcctgccatgactgtgtattgccttgttatttaggtacaaaaccaattattttatatccaatacttgtgtattttgtatttaaggtttaaaaatgtacccttctgccattgtgcctatcaaacttcatgatgcgtgtttctgagctcaggaaataccaaaaagggagtattcggtttttggtttttgtcttcaagtcagcaatacatctttgttcagctcttgtgttcctcaataactttgttccctccttaagtgcattcagtagttaaacttagcagaaatctgacctaaccattttcttgttttccacttccttaaatgccacacagaatcatctagccagaagcataccattttgatgtttgacatattgacatttcaagaaaactataattatgattaagaattatttctagttcttaactacaaattaaaaacttgtggtgctctttttctctgaatttataatctgccttctcctttctaggttaatttgcttgatagaaaattacaactttaatattatttatcttaacagattgtgaatagtctaattaactcaaaagtattatgtttcgcccttaaaagatactaaattataccttctaaattaaagcaggtagaaaacttctttgtcaagggtttaataaaccagaaagtttgaagaactacttgtataaaatctgattttttaattgttgtattacattattgctatcgatgagcaatattacattattagcaatcagtagcaataatgtaatacaggggttggcaaactatgacctgggggtcaaatccaacccactgcctattcttgtatataaagttttattagaacatagcaaagtacattaatttgcatattgtccatggctgctttcacactacagtggtagaactgagtagttgcaaaagagatcatatgacctttagagcctaaaatacttactgtctgattatttacagaaaaaaaattgctgacccctagtatagtagaaatccttgaactggggagagtagtcattgaatgtcaattatgtctactcttcattatgtctctaagttgacagagaccttaacaggttgctaagcctctctggacctcagttttctcgtctgcaaaatgagtcccttagaatgaataatctctaaggttgattctcaaactaataaaattatatgaatccgtgacctatttcagaatgatgttgctgttttacataatggcttgcattgaatatttaaaccatctatagtcactgggttcagacaactaaatattaggtggggcaccatggcttacacctgtaatcccagcactttgggaggctgaggccgtaagagtgcttgagccccagagtttgagactagcctgagcaatatagtgagactcagtttctattatttaaaaaaaaaacaaactacgtaaacaaaactgctagtcataagacagataaatttaaagcatactactattgtttcaaaagcatttgcatctcagggctcttttagatactgttttcctagtagtataggtatttattacagatctttgacaatagtagcaagaacaggccttgaagcgtataactaacatcttaagaaatacagttgtacttcatttggaaataaaaataaagcatctctaaaagcctagtttccgtgtgtgggaaacgtgatttgatatataaaaattccattcccacccagcttttaggaaacatgtataatacgtaaagtaaaataagtttttataaaaagaagaactcaacattcactactgttttttcaacatggtaactataattctgcataagaacctttcatgcgtaactttagactttcagaaatctcaaaagttacctggaatgttaacatcaatatcacttctctctttttgcccttccctttctacagtaagtaaactttgtggaaatatattttattaatgttttctggccaggcgcagtggctcacaccagtaatcccagcactttgggaggccgaggtgggtggatcacttgagcgcaggagttcaggaccagcctgggcaacatggtgaaaccccatctctacaaaaaaatacaaaagttagccaggcatggtggcacacgcctgtagtcccagctacttgggagactgagatgggaggatcacttgagcctgagaggttgagactgcaaagagccgagattgtgccattgcactccagcctgggcaacagagcgagaccctgtctcaaaaaaataataataatgttctcatattagcagatacctaaacacaaacaagttttatctttccagaaaaattcaagagttaatatttaaaatttagacttagactacttaggtgatttgataaactaactaaatgagtgattctacatagaccagcaaaaggctgtgctcatgttctagatctttattagtagagttagtaatgatatgcacttacagaatgctttacaatttgcaaagcactttcattaatacattatgacttttgccaatcctgtaagataagtccattttaatattctttttttttcttttttgagacggagtttcacttttgttgcccaggctggagtgcaatggcacgatctcggctcaccgcaacctctgcctcccgggttcaagcaattctcctgcctcagcctcccaagtagctgaaattacaggcatgcgccaccatgccgggctaattttctgtatttttagtagagacggggtttctccgtgttggtcaggctgatctcaaactcccgacctcaggtgttccacccgcctcggcctcccaaagtgctgggattgcaggcgtgagccaccgcgtccagcccgttttcatattcttactttacagataagaaagcctagagaggttaaatgatttactcccaaataccacatgttctcccttataagtgggaactaagctatgggtacacagaggcatgcagagtagtataatggacactagagactcagaataggggagggtggaggggcaagggatagaaaatcacctgttgggtacactgtacactactcagaagacagattcactaaaagcccacacttcactactgtaccatttatccatgtaaccaaaaaccacttgtacccctaaagctgtttaaataaaaaataaaataaatatgatttactgaagcagtaactcccaacatttttccactctacagtcctaagggatgtcatgcactcaaatggcagtgatttccaactaggaataaggggaggctatgcatatagcttaaaagagtcatatgtagttgattctgttgtgtggcctgatggagaattactatacaaaagtaagacattgtcattgttaaaacaaaaagagggaaaaaagattttaaaaagaaaaatgacacataatcctaccacccagagataattaataacattctggtgtatatgcagtcttttatatccatattaacttttttacccaaaaatgagattataatatacattgattttaaacctttttcatgtaattaatcacagacatcttttcattccactaaacacccttctacaacatcattttataataactgcagaatattccatcctgtgttacatgtttgaattcaagatgtaagtggtttcatatacttctacaattcccgattagtgttattctggtatatgcatatgtaatttatttcaaggaatctgaaataatttaaaaactacctctcttctagccatcatctcctatatatttgacttaatggataatccttaagataaataatttgttaaataacttatttatatttgtgtatttgttttaataatctattttttcatctctttgttttagggtgcagtactagccgctgtgtcaagtcacaaattcaactcattctatggggatccccctgaagagttaccagatttctccgaagaccctacctcctcaggtaattggataattcacttattcacctgtgtgggtcatttggcatttacatccattctctcccattgtgaataaacttttcctgtgcatttagttaaatcctccaacggattctaaggaagtttgtcagcaaccaaatcctgtctacatgtgtcttgttccttttcattttaataccaaagttgctttctcctgtggctccaaaaccaacacttcatttttttttcttttcacctcagtaatacttcttcccctttccacactctagacccagcattgcactccatccaatccaacatcctagtcagtcttttgggatctttctgattaccttctctctcaacaaaaacttctaatataagcttttccccaggtcagtcgtattagatcagactgtgggcagcactgctttgaatggaatctttcagtgtagagctgtcttgtgagttatctcctgaaacagttaccaagttcttctttctgtataaaaatctataacacggccaggcatggtggctcatgcctgtaatcccagcactttgggaggccaaggcaggcagatcacctcaggtcaggagttcgagaccagcctggccaacatggcaaaaccccatctctgcaaaaacacaaaaatacaaaaaaaaaaaaaaaaaaaaaaaaaagccaggcgtgctggcctgcgcctgtagtcccagctacttgggaggctgaggcaggagaatcacttgacccgggaggcggaggttgcagtgatccgagatcatgccactgcactccagcctgggcgataatgcgagactccatctcaaaaaaagaaaaaaaaaatctgtaacacatgcatacaagtatccaaaggggaagaacacagaagagttatttgttttgatgaactgtatataagtacccctgaaacaacctgccagtgttcacaaaatcattttataagccagtgcagtggtgtgcatgtgtagtcatagctactcaggaggctgaggcacccggctcagggggatcacctgagctcaggagtttgaggatgcagtgagctgtgatcacaccactgctctccaacctggacaacaaaatgagacctcgcctcttaaaaattaagagataaaaggccaggcacagtggctcacgcctgtaatcccagcactttgggaggccgaggcgggcagatgatgaggtcaggagatcaagaccatcctggctaacacggtgaaaacctgtctctactagaaatacacaaaaattagccgggcgtggtggtgggcacctgtagtcccagctactcgggtggctgaggcaggagactggcgtgaacccggcaggcagagcttgcagtgagccgagatcacgccactgcactccagcctgggcgacagagtgagactccgtctcaaaaaaaaaaaaaaaaaaaaattaagagataaaaaaataaaaaaccaaaaccattttataaaatgctcagatttccatcttaccagtgtaatattctcaagaatcatttactaaaaacccatagggtccatttatatgtatatgtaaatgcgtgtgtgtgtgtgttctaaatttttatttatgcattttttatttacttaactcctgaatcatgtgtcctctggcctcagctttttttctttctttcattagagccactccatatttgtcatctttgatttttgtactcttggactagcttcatcaatattcatatattaccactgggactgaggccctgggcccttcctaaagcctgaggtttctgtcccacagttagtaatataggaagaattaatgtgctaatgcttctttcctgttggtaccatgagcatctgtcagtatttatgcttctcctctcctctgtttatacatgtgtgtgcacctacacattcacatacacacacacacaatttcttaccaattagtatgtgcttgtaccttgtgcaaaatgacaagatcttgaggtgatggataccccatttaccatgatgtgatcattatgcccatatcaaaatgtctcctgtaccccataaatgtatactatgtacccacaaaaatttagaacttttttaaaatgacaagatcaactttcccattccagcagttatacagttcctcattttgacctttaccaattaggatgtgaatcttcctcttttgagtgaaggtgatttccaaaaacattcagaaatgggaatcttagagaagagactgaggagaaagccttgccatttttctcttgtgctgacttggtcattatccagagcccttcccacatgaaaggcagggatctagttgtgtttataggtgtggtccccagtgcttcttattgtttcacgtctgtcttttcttccactccattttgttccctccacctgtaacttcttttgttagctgaaacctctgtcttctctcctcacactcagattacagtggaccctatttaaggggagtggatccagtaatggtttgtattgtcatactgtggctgtatgatataatcacatgcttataatatatttaggataaatctctttgagattttaggtcaagatctctactaccattttcatctttagaaatggagctaaaggctgggcatggtggctcatgcctgtaatcccaacagtttcagaagccaaggcaggaggattgcttgagcctaagagtttgtgaccagcctgggcaacatagggagaccctctactttgtaagaagtcaaaatattagccaagcgtggtagcacacacctgtggtcccagctactagggaggctgaggcaggaggatcacttgagcccaagaggtcaaggctgcagtaagccgtgagtgcatcactgtactcaaaactggatgacagaacaaaactctgtctcaaaaaaaagaaaaggggccaggcacagtggctcatgcctgtaatcccagcactttgggaggccgaggtgggtggatcacttgaggtcaggagtttgagaccagcctggccaacatggtgaaacccccatctctactaaaaatacaaaaattagccaggcatgatggccacgcgcctgtaatccacctgaggcaagagaattgcttgaacccaggacacggaggttgcaatgagccgagatcgtgccactgcactccagcctgggtgacagagcaagactccatctcaaaaacaaaaggaaaggaaaataaaaagagtaatactctatgcatttaggaaaatatgaatatttaaaataacagtttaaaaacttgtcatctaataagaagtcaaacatgtttaggtatattgtttacgatgtaaaacaatttttctataaatgataattttctattttgattattgaaattcatacattatgcatttactagaattcatttaatcttatgatgaactgtgtattgcttgaagtggggctgggcacggtggatcactcctgtaatcccagtactttgggaggtggaagtgggtggatcacttgaggtcaggagttcgagaccagcctggccaaaatggcgaaaccccgtctctactaaaaatacaaaaattagctgggcgtgatggcatgtgcctgtagtcctagctaccaggagggtagggagccagggctgaggtaggaggatcacttgagcccaggaggcagagtttgcaatgagctgagattgcaccactgtactccagcctgggtggtagagtgagaccccatctcaaaaaaaaaaaaaaaaaatcaatgttgaaatattcttttctcatatttcaaatcaagtaattcagaatcagaacccaacgtttgatgtctgaaatcccaaacagttccagtgattgtactcatggaacatgagggctcactttggggtcagctgggggaccatgcttctggtggctcatgtagtgggccgaactgtggcttgataacctgcttgttctaaaatcatactgtttgttgtttgtccatatgctgccttcctcctaggacttctagcagcagaaagtaggtatccctttgttttcctttaaggtgtatcttttatgcaaaagtgtttggctttgcatggttcgtaatcagcttgactttttccttggctgtttgtgtgtagttgtttaagtattaattttaacactgcctggtcataaaattaaaacttggatatattgatttttgaggcattgttgcacaaacaatattaagttctcacttctttcataagaggaaaaaagacagtgttaaaatttcaacggcatttaatacttcacatctgaatttcacatacgaatacattaattctggggaaagagtaacatttattttagagtttgctttcaagaaaactttcagggtaagtgaatttttctttgacaattacatcacctgtaagtggtctttattgcttcctgttactgagtccattttcagtttatttggacctgtgaaataaattctgaaatcatatctcttaacaacttttaccatcagatagaacatttataaggaataatgtaatagctagattttaattacaaaggggcataatttgagtttgggagaaaattaaaatgtaagaaatgtacacacagttgagtacatgtaaaactgaggcaatctgaataagatgggtggattgtatcaatgtcagtattctggttatgataatatactatcgttttgtaaaatgttaccaatgggggaactgagcaaagaatacaagggatctctctgtattatttcttacaagtgcatgtgaatctacaattatctcaataaaaattctaattaaaaaaataaacctttacctcaaagataaatgagaaagcctgggtactaatgattgaattcattttcacattttcttacattagttatctgtagctcaaattgcagctgatttaatataaatcttatagtatattagttacctattgttgggtaatgaattaccttaaaacagcagttgtcatctcacagttcctgtgggtcaggaatctgggcgtggcttagctgtgtgcctctggctcaagatctctcatgagattgtggtccagtgctgctatctcaccggaaggcacaactgcaggaggaatcctcttccaagctcactcacatggttgttgccaggcttcggttccttactggctgtggtcctcttcacagggctggctgttcacagcatggcagctcacttcccagcacgaaagataaaagaggggggcaaaagtgagagacagtgcccaagactgaagacacagtctttacagcctaatctcatagtgacgtcttatcacttctgcactattctgttcattagaaatgagtcagtaagtccagcctgcactccaggggaggggactgattacacaaggctggaaataccaggagaccaggttactggggcccatcttagaggctgcccaccacgtacaaattaataactattaaaatgtaagattcttcccgtctagatttagcgctcctcttttttttttttttaaatcagccaacctgtcatgttatttgagaatgggcatcttggatgtatcagtagtgattttccttagttgtaaagctttacacgagtgggtacttaatagcagaatgttattaaagtactttgaaaaatctgtgctcgaagatgtttctatatggaagcataaactattttaataatcataatggcattagagattataacatctatacgctgacagaatacatatgcagagtttacttcctttaataaatttcaaggtatctgtaccataatccacatatggagaatctaaagcatgtatcaccatatgtaagttctcataacttgagttggatatggcacagatgcttatgtccaaaatacagtttccattacaggattcattattgcttataacttgattgataacaaagaatttgctttgtgcagtgggaataaaaagtgttgaacagggtgtggtgatagagggaagagattggctgcaaagggacaagagagaacttttttgaagtgatgacagtgtacacttaaatggcgacttttaacttaaaacagtataccttagtaagcagattttttttaaaaagtattgtgcttgcaaggaggggctttgattgagtaggtgataatgtgtgtgtgtagtaatacaatgtattaattgatcgctaatataatagaaaaggtattgattactcttagaagaagctaggctaggttcagattctagatttgctcagtgatgctgagtttcatagctatacattgtaaattaagaaatacacacacattgagaatttaatgtgttattttgtgaaaatctgagaagcaggaatgggatttaatgatctcaactgtcatccatctgaaaaacctaacttgtgattttaaataagatggcatactgccttccactattcccttttaaaaacaggaaatgtccctgcttttatctttatgaagttttatttatgaataaagtttgtactatttaaaaaaaaaagaaatacacaaatctttattgaaacaattacagtgaaaacttgggtatatcaaaactcattgaatggtacacttaagatttgtgtatttcattctatgtaaattttacctcagagagaaaaataagcattgcaatctttgctgaagtctttaagggtgaagtgtactaatgctggccactgccatttaatttgaaatgaatgaaaaatacgtgaactgatggatagatgggtagacatgtgataaagcaaatacagcaaactgtcaacatatgtaggatctaggtggtgggcacgattctttcaaactttctgtatgtttgaagcttttcgtagtaaaatgtaaggggaaaaacttttaagacatactcagcctactttaacactgagaactttttagtctaaacatttgactgtttatttttctgtcctccttttggtttatttttacttggtcaacctttttatgagacttccactctcgtaatgagattattctagactcaaagcttttattgaccttaaaagcatatttctctttaaagaaatagaaacattttttaaacagttgacatatttatgctttttttgactattatttcataatagtagcagaaaacttttgaaaaacttgtttgtactggtgagattatttgaaaaagtagaagtattcaaagttaaaatgtgcaggccagtcatggtggctcatgccttgccagcactttgagaggctggggtgggaggattgcttgaggccaggagattgagatcagcctgcacaacatagtgagatcccatctctatttaaaaaaaaaaaaagtatgattataaacctgatttttagatacaaactttattgccaaatgaattatgaaaacaaaatactattctgaaggcagggcattatagtatctaataagttcatgaatgtggaagtttggaccaagggctaggaaaaaaccttatatggtaaatcaaattgagattaaagagagaacagaaattaggcatcacgcctgtaatcccagcactttgggaggccaaggcgggtggatcacgaggtcaggagtttgagaccatcctggctaacacggtgaaaccccctctctactaaaaatacaaaaaaaaaattagccaggtgtggtggcgggtgcccgtagtcccagctactcgggaggctgaggcaggagaatggcatgaacccaggaggcggagcttgcagtgagccgagatcacaccaccgccctccagcctgggcgacagagtgagactctgtctcaaaaaaaaaaaaaaaaaaagaaattggacatcacctcattaccaaatgcaaatcattctgatgcattgctgaggataaaacatgattttgtgggtgggggacagtctattatggaaggaacactgaattaggagtgagacctgggttctaggatttgatcttctgcttattgcctgtggcccttggaaaggttatttaaccctactgagcctctggtttttcaaatataaaaacacttgctgaccaagcatggtggctcaatgcctataatcccagcactttgggaggctgaggcgggaggattgcttgagcccaggaatttgagaatagcctgggcaacagagagagacccccaactctacaaaaaactttttaaaaaattagccaggcatggtagcgtgcctgtagtcccacctgtttggaaggctgaggtggaaggattgctcaagcccagaaggtcgaggctgcagtgagccaggatcacgccactacactccagcctaggcaacagagcaagatcctgtctcaaaacaaaaaaaacacttgcctgcagagacagggttattgtggaatcacataaggtagtaagtataaaagcactttggaaattataagctgttaatacaaatataagtattaaaataatttcaaatgtggctttaaggaaacagtactataaaagaaattgttttctgtggttaagtctttctcatactttgttttcaattcttcagaatttactcagaaaaaaatcattttaatcaggccattttatgaagtgtcttggtacaaaggactctgcaaagtacaccccagaatacagaggtaaataggatacctacagtcctgccgttaaatcaactgccctctgaggtgaacttgtgtactttttattgattgattttgttttcaagatagttacaagtttattcagaggttttataggaaaaacagcctttttagtctttgagaaaaatagttattttatatgtgacagtattgatcttcaaaatgaaaactagtaacatcttaattagcatgtgctgcatgtgttatattaataatcactactgcctcggggtttaaaatctaaaacaaatagcaatggagaagcccgagaagtgtctttgtgtctatttatatcttataatgaattgaaacaccatgggatttttagatggttggtactgaactacagatatcaattatacacacatctatccaaccaagaatgtgttctgtggttctgtttgtcatacccaaagaaagaaataacggaactagaacaggtgttaatggaaggtgttaaaataatcaagggtgaagacagattttgaggttaagccaaaaatatgtatttattccatttgaaaagatgaaggagaaatggaataaaaactctaatttttctacctaattacagaaacttaaaaataggggcacttttcagagcttgaaatagacaacttgagtacaactagggaagtgcttcttttcatgattgagaacccatcaagttaatcatatttgggtacaagataagactataaatcagttcagaagaggtgacagatccaaggaggtttaatagacctgttggaattgtggctcttgcctactttaaatgcctgctaacagatgcctttgtgctttccagcaaagtatctgctggtcctgtcaacacagctttgatcctgtgtgggggtggtgaattcctgctcatccacctctctgcggctccccaactcctccctaggcagcctgtgtgtcagtttgtttttacctcttctataccgtttacttcagggtataatatgcctacttcacacaccagtctgagagccccttcctcagggccggtgatcatatctctgatttctctgaagcccttgcctagtacctagcaaaaagcaggaatattcaataaagattttggggccaggcgctgtggctcacgccagtaatcccaacactttgggaggcctaggcaggcggatcactcgaggtcaggagttcaagaccagcctggccaacatggtgaaaccccgtctctactaaaaacacaaaaaattagctgggtgtggtggtgtgtgcctgtaatcccagctacttggaaggctgaagcaggagaattgcttgaacccaggaggcggaggttgcagtgagctgaaatcatgccactgtatgccagcctgggcaactgagtgaaactctgtctcaggaaaaaaaaaaaaaaaagattttggttattgtctgacccaatagggcattgttcaagttcttttccaacctccatattcatgcataaaccacacaacttcttgttgaaggtttcctgtatgtttcctagcatagcctattagtgtagtaagttaggcaaaacatagactttgaagccaaacaaacccaggattgagtcctggctccaccatttactagttatgcccttccatgaaccttctgaagctcagttccctatctagaaggtgggataatatatctgccttactgtgttgtcctgaggatgttcctggaacataataaacactcaagaattgggagctgctgttagtgtttccttaagtacttaattcagtgcatactttgtagatattataaaatgaataaaataaagagctgccttaaggaccttacagctaagggaaaaaaagagtgaacaagcacgcacataagtaactcatggagtgcgctggtggtacaggaatggcatggagcacttgggaagttcacagaccaacaaatgatacatccctggtctggtacagccaaaattgcttcctggtcttgagactgaccatcttagtattcacttgataaaaggttgtttttgctttaatcttatattattaataaactgctacataaactgtatatcagcatgagcaatgctggtaaaaggccgagcacagtggctcaggcctgtagtcccggcactttgggaggctgaggcaggcggatcacttgagcccaggagttcgagaccagcctggccgacatggtgaaaccccgtctctactaaaaatacaaaaattagctgggcgtggtaacctgtagtcccagctgcttgggtggctgaggcacgagaatcgcttgaacccaggaggcagaggttgcagtgagctgagatcatgccgttgtactccagtctgggtgacagagtgagactctgtctcaaaaaaaaagaaaaaaaaaactcagtaagatttcagtaagataactgagtgaagatgataattaggtttctgtggtatcagctgaattttttaatatacaaaaaaggcacttgattagtatttttgttattgtggtttcataagtccagaagtttagaactggctttagtaacttgataaacctagcatcatttaattctgttgttgatgacatgctggggtcaggggttcagtgggacatttgggactaatttcttcacatcatctcttgctttccaaggctttcagtaaaggatgaagagaaaattggcttttaactaatttccagattttttgatggaggggggggcactctgaacaaagtaaatcctgagaagatcaggtagaaggaagtggattgggttaatacctctttaggaataacagaggagatgaggactgatttctgccatttatctcttttatcccacttaatatccacttaatgttttcagtgaaaggataccaatagcctggcaggcataattcaaaatttaatattatccagccgggcatggtggctcacacctgtaatcccagcactttgggagctcaaggcagaaggatcgctttagctcaggagtccaagaccagcctgggcaacatgacaaaaccccatctctataaaaaatacaaaacttagatgggtgtagtggtcccagctactctgggggctgaggtgggaggatcacttgagcacaggaggtcgaggttgcagtgagccgagattgtgccactgcactccaacctgggcaacagagcaagaccctgcctcagaaaaaaaaattatccaggccaggcgcagtggctcacgcctgtaatcccagcactttgggaggccaaggcgggcagatcacgaggttaggagtttgagaccaacctgaccaacatggtgaaaccccgtctctactaaaaatacaaaattagctgggcgtgttggcacgcacctgtaatccccgctactcaggatgctgaggcaggagaatcgcttgaacctgggaggcagaggttacagtgagccaagatcatgccactacactccagcctgggcaacagaacgagactctatctcaaaaaaaaaaaaaaaaattatccatagttccttcaacagacgaatggtcaaacaaactggtacatccacacaacaacctggatgaagccccagataattatgctaagtgaaaaaatgcagtcccaaaaggttacatactgtatgatttcatttattctttttattttattttattttattttttaatttttagagggactcctccttgcagaccagggctaccccataggcagtatgcccagaataggagcctcatttattatcaaaatgacaaaattgtagaaatggagaacagatgagtagttgccacaggttaggaggggatagggtaggaggggaatgagcatggctataaaaaggcagtatgagggatccttgtggtaatggaatgttttatagctcgactgtatcaatgtcaatatccaggttgtgatattgtactacagttttgcaagatgttactattggaggaaactgggtaaagggcacatgagacctttatgttattttcttttacaactgcatgtgaatctacaattatctcaaaataaaaagtcaaattttaaaaaatagctacagtaatttccacgtggacagccacacagtatgtggcttaagacccaaatctttaacataattaaatagagctacaaaaatcagtagcttatatagcattttgttttgttttgctattgtagaaaaacttggaaagtatggataagaacagaatgaaatagaaataggacagtaaagataacaactgtaacacttttgctgtgtttcattctgttttttgtttttccggagtttgcatatatgttttgtttggttttttatcgtaactgggaatatacagtttatttagttttgcattctgctttcttgaattcttttttttttttttttttttaattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaagaggatcccaaggcagaagaatttttcttagtacagaacaaaatgaaaagtctcccatgtctacttctttctacacagacacggcaaccatccgatttctcaatcttttccccacctttcccccctttccattccacaaaaccgccattgtcatcatggcctgttctcaatgagctgttgggtacacctcccagacggggtggtggccgggcagaggggctcctcacttcccagtaggggcggccgggcagaggcgcccctcacctcccagacggggcagctggccaggcggggggctgacccccccacctccctcccggacggggcggctggccaggcagaggggctcctcacttcccagtaggggcggccaggcagaggcgcccctcacctcccggatggggcggctggccgggcggggggctgacccccccacctccctcccggacggggcggctggccaggcagaggggctcctcacttcccagtaggggcggccaggcagaggcgcccctcagcttccagacggggcggctggccgggcggggggttgacccccccccacctccctcccggacggggtggctggccgggcggggagctgacccccccacctccctcccggacggggcggctggccgggcgggggtctgacccccccacctccctcccggacggggcggctggccgggcagaggggctcctcacttcccagtaggggcggctgggcagaggcgcccctcacctcccggacggggcggctggccgggcggggggctgacccccacctccttcccggacggggtggctgccgggcggagacgctcctcacttcccagatggggtggctgccgggcggaggggctcctcacttctcagacggggcggctgccgggcggaggggctcctcacttctcagacggggcggttgccgggcggagggtctcctcacttctcagacggggcggctgggcagagacgctcctcacctcccagacggggcggcggggcagaggcgctccccacatctcagacgatgggcggccaggcagagacgctcctcacttcctagatgggatggcggcggggcagagatgctcctcactttccagactgggcaagccaggcagaggggctcctcacgtcccagacgatgggcagccaggcagagacgctcctcacttcccagacggggtggcggccgggcagaggctgcactctcggcactttgggaggccaaggcaggcggctgggaggtggaggttgtagcgagccgagatcacgccactgcactccagcctgggcaccattgagcactgagtgaaccagactccatctgcaatcccggcacctcgggaggccgaggctggcggatcactcgcggttaggagctggagaccagcccggccaacacagcgaaaccccgtctccaccaaaaaaatacgaaaaccagtcaggcgtggcggcgcgcgcctgcaatcgcaggcactcggcaggctaaggcaggagaatcaggcagggaggttgcagtgagccgagttggcagcagtacagtccagcttcggctcggcatcagagggagaccgtggaaagagagggagagggagaccgtggggagagggagagggagagagagagggagagggagagagagagggagagggagagagagagggagagggagagagagagggagagggagagggagagggagagctgctttcttgaattctatatcatgaagatttctctgtgtctttgaaattcttcaaaaacaattttcatttggctacatattccattatatggatattctataacctacgtaatcatcctctattagatttattttccattttgtatgataatatcattatatataaatcttccatttttttccttaaggtgggtttttgtaaatggaattactaaatcgaagtgcatgaacatttttaaggctttttgatatatgttaccagattgctttctggaaaagtggtactgatatatattctcaccaataattgcatgagaatggataaggtctaagtcaggaagaattagaaacagagttctggagcataaagatttttatctttatcaaaaatataatttctcaaccacagcactactgacattttgggccagataattctttgttgtgggggctgtcctgggtattgtaggatgtttagcagcatccctgacctctacccactagatagcaatagctgccctcccgctgtagttgtaacaaccaaaaatatctctaaacattgggaaatgtccacctgggtaacaaaattgcccctggttgagaaccactgatccaaagacttaaatgtgcaatgagacacttattcttagagtttctctactgtgtactaatgttctgaagcttagctccttggagctctttttttgtggagtatatatgtgtattctgcatattgcctgcaatgtaaaagaggctgatcttttttttaaggctgtgtaaatggctttgttactcctcattgtgtatctttccctactgacatctgcctggtttcctggttatgagaagaaacttaaagtgatggcacttccatttgctttgccctacaaaaatgatttgccttgaaatttaatatggtatttggaagtgtcagtcagcgtccctatactttgtctttatcttctgagtaagaagggtaagagtaaaacagaatgagaatgactttggatctcttgagtctgtatgtaaaggaaaaaaaaaggagtggactgggatttttgttaactaaagttcaagtcttaaaaactaagaagcctattttaagcagcaggagttcccagttgaaggtctgttccctgtatctacagctggctttaccttcagttcttgatggaatgcacctgggtaaaaggccaacctcgtttctataatatttcagaacatcttggagtcctgaaacccatactctcttcctgacataaaacttgctgtgtccagatcttctagtgcttaggttatacttgataaatttcattaattcaaagaagataagctgcagtttcctctgaaaaatgaagagcacacaaatacattaataagaacatgaactctctgaaaatactgtgtccttaaattatatgaaactcatttaagtctatccttcagtaaagacactagcctttgaagttctgatatgaattcattgttcttaagtgtaagatttaggtttaaaaagttagtttgacattgactttctatactggctgtttcttttctgtttgtcccccttaggagcagtctcacaggtgctggacagcctggaagagattcatgcgcttacagactgcagtgaaaaggacctagattttctacacagtgttttccaggatcagcatcttcacacactactagatgtaagtctgtctttttattattcttcttttttggtgaattgaatattggccgggcacggtggctcatgcctgtagtccaagcactttgggaggcagaggcgggcgtatcaggaggtcaggagactgagaccatcctggccaacatggtgaaacgtggtctctactaaaaatacaaaaattagccaggtgtggtggcgcatgcctgtagtcccagttaggactgagctgaggaggcggaggcacaagaatcacttgaacccgggaggcggaggctgcactgagccaagatcacaccactgcactccagcctgggtgacaaagcaagactctgtctcaaaaaaaaaaaaaaagaaattgaatatttagcatacctttttactttacatgaattctcagatgtctatcataacaattcttttcagttgccttaagcctatgagaaatgtgggaaatcatccatcaaaaattcatgattgaaatacagtatatggccgggcaccgtggctcatgcctgtaatcccagcactttgggaggccaaggcgggtggatcacctgaggtcaggagttcgagaccagcctgaccaacatggggaaaccccatctctactaaaaatacaaaattagccagttgtggtggtgcatgcctgtaatcctggctactcgggaggctgaggcaggagaatcgcttgaacccaggaggcagaggttgcagtgagccgagatcgctccattgcactccagcctgggcaacaagagcgaaactccatctcaaaaacaaagaaaaaagaaatacagtatatgtacagtacaaatgcaacagagcctagcaggctacaatgggaaaaaatttatatatctttatatttataaattatatgtacataatgcatgcaagtggtatgtgagttttaaaaaagagtagagtacaatcctactttactgaattatcttgtatttctgttaaaagaatccattgaggttagctgtgattactttttattgctttgcacattactttaaaacattatacctccagcatgagtataggagagagaaaagcaaatgagatactttgcaataggctgtattcccacacacatttcatatttaacattgttttgttccatagattcaatgtcttctccttaaaacataagcatatactccatctttaaatattacaggctccactgacagcagactgggatacaaaggaaaaaacagaagctgaccattttcatttcagtcacattttaagtaaaatacctttcttagagaacttggttcacttcagcaatgaaaactcttgggtggtttcgatggtatttgaacatgttagtctttttacaagaaaaatcttcccttaatgagagaatcatacttgctttggggtgcctagaactgtttggtgctgaataattcaccatatgatgtaaatgaagctaaagcaaaatttcccagaatgtgttctacagagcatggctctgggaggttgctatgggtgttgccatggtgggagggggaagtagatcttaaatttattggttaaattatttattgactaaataagtttgggaaatgctacattctttagtctttttatacagatccacaatgggtgttggtatattgatagctctgagatgatctaaagcaaagaaacctttttaactttctttatcagcatttctcaaactaatttgggcacagaacttttattcacaatcctgttgagttctgttttgatgaggaccagtttgggaaaagctcagctaagagtgtttgttgcattatgcttcagctttacactaaatgcagccgtaggtatctaacagttgcttctttccccaaatgtggtcagttcaaattaattatcagattttcatggctagtttggcctttgtatatagtgtacatattaattagggctgactaactgttataacatgtgattctaaaatttgagtggcttaacagaatagaagtttacttcttgctcacttcacagtccaatgcaggtagatgagggaggtcttttccacaccgtcattcagagacccaggcctcttccactaggtcacactgctatttcccagggtcttggaatcttctactgtatcctttgtacctagccagcaaatgagagaagagagaacatggagaatcttgcagggtcaagcttggaaatgggtttatctcacattctttggcaactgctagtcacgtgctcacctggatgtgagagctgaggaacgtagtttagaaatgtgctcaggaagataaggaattgggtcttctctttagtgtaatttatcttaagtagtatctattcactgtcattgctgcagaaagttttcacaattgtgtatttcccactgaagtttataccctttactagaactagttagtgcaatatttagaaaaggctacagcagtgtgtggagattttgtttattttattgtggtcagtgcttaggtcattgccaggtagatttactgaccttcttttgaatcaaggactttttgtaacaaagactttttgtaatttaaacactgagagaagcccaaattggtttcaaagttgtattttttcttactgatatagcaaggtatctgagcacatcaagcttgagattgcaggggagaagcaggaacattactggcttacacaaggaaaggggcagctattcagacacgaataactgctgcactgtttggtataaattgtcacaatttcagaagagattcttagatgttagtgagaaaaacatacttaactttcctttgcatttgtttacattataaagaagtatctgccttattggcatctgccctgtcagtgcaggtcaatttgaaagaggagctgttggactgaaaatgaaccatgcctattaaaaaggtgcagtataagaccaggagtagtggctcacacctgtaatcccagcactttgggaggtcattgtgggaggatcacttgagcccaggagctcaagaccagcctgggcaacaaagcaagaccccatctctacaaaaaatttaaaaagcagctgggcatggtggtgtatgcctgtggtcccagctactccagaggctgaggctgaaggatcacctgagcccaggaattcaagggtgcagtgagccatgatcacactactgcactccaacctgggcaacaaagtgagactctatctctaaaaaaaaaaaaaaggtgcagtatcttctgaattttgtaaacaggtgccatacatgagctccagtcaaattaatgactatgaggccgagccctggacaatatttgcatgcatgtggttctgaatctccaaactgagctatttctaaatgaaagtttaggccaggtacggtgactcacgcctgtaatcccagcactttgggaggccaaggcgggcggattacctgaggtcaggagttcgagaccagcctgaccaacatggtgaaacccatctctactaaaaatacaaaaatgtggtgggcacccataatcccaggtacttaggaggctgaggcaggagaatcacttgaacccaggaggtggagattgcagtgagccgagatcgtgccactgcactctagcctggtcaacagagcgagactccgtctcaaaaatgaatgaatgaatgaatgaatgaatgaatgaatgaaagcttaatcatcatgaatgaaataaaccatcattagaatgtgccctcataccctacatcccataaataaggcttattaagctcatttcacagctaacaggctacattttaataatataatcaatgaagaattcaagtgactgccatatagagaaatctaatcatttaaaaaattttaatatttaaatgtttgtggtatacattaaggaagaaaaatggctatgacgaactcttgaggagcagctgttaaaatgttggattttcagtctgggtgcagtggctcacttctataatctcagcactttgggaggccgaggcgggaggatcacttgaggtcaggtgtttgagaccagcctggccaacatggtaaaaccctgtctttactaaaaatacaaaaattagctaggcatggtggcgcatgcctgtagtcccagctacttgggaggctgaggcaggaggatcacttgaacgcaggaggtggacgtagcagtgagctaagatcacaccactgcacggtagcctgggagacagagcaaaactctgtcaaaaaaaattgggcctttcatttttctttcttcccatgttccacataccatggttgatttggaattgttttattttgcagaatcaaaacgaattcttctgcctttttttgtttgttgtttgttttttgtttaagacagggctctcccaggctggctcactgtagccttgaccttctgagctcaagcaccctcctacctcaaccacccaagtatctggaccacaggtgcaccaccacactcagcccttttttttttttgaagagacaggtctcaccatgtttgcccaggctaccaggctagtctcaaactcttgggctcaagcagttctcctgcctcggcctcccaaagtgctgagattacaggcatgagtcattgccccagcatgaattcctttttaaggattccaagtagggacacccagggggcatagttttatggaccatgaattaattaaggctaattaatcccactgagccattttaggaaatatctttaccatttttatgttatttctgttaactcaataacattctaaatagctaggtatgaagccataattttaaggctgacaaaaagaaacaggattaagttcctaagaaaaactaaagattatctatgacttctttattttttctagtcatgttcttaaaataataacaagctcaaaatttgaagaagcattattagaatttgtttacaggaaacaaaactgccaaactgaaacatttacattaaaatggagaagtactgtgattctactgaaagggaaatgctttctgaaaacctttgaatttgagtaaaacacatttagtttaatctgtagttagaaactgatacagaaaactctaaatatttgctatccaagtggttccagcctggcacacatatgcagcttctcattttgtgggaagaaatacagaggcatgaggaactgcttggtccagcttgttgcagtatgcctgtatttaaaaattaaaagcactggtgctaagatgatcttcgtatgaaatgtatagatcaattagtaaagtacaatttgacattagtttgctaggactgccataacaaagtaccacaagttgtgtggcttaaaacaacagaaattgattgtctcatagttctggaggctggaaagtcctaaatcaaggcattggcaggggcatgctccctccaaaggatccagggaagaatccttccttgtcttttccagtttctggtggttgcctgcaatccttgtcattccttgacttgtagatgcatcattccagtctctttttccgtcatcacatgtcattctctgtgcgtgtgtgtctgtgtatttacatggccttcttagaaggacaccagtcattggacaccctaatctagtatgacatcatcttaattaattacatctataaagacacttatttccaaataaggtcacattctgaggttctgggtaaacataaattttgagtgagggacaatattcaccccagtacagcatggaaaactgatttaaccctgaattaattcttcacgtgtgagtgcaaattacacaaatctaatataaaataatgaaatgttaccctgtcatccattaattatgctttattgggaattggtgttaaagtgttatttatgtcttgtaatgatattttgaatcagttatggattggaatttgtatgtgatacattggaaggtcagtgggtgggtgagtttttgatggactgaaaagccatgttttttggattaaaaacattttacaaatattatttggtagtagttttcagtcttctcagtttctagtataaattttcctattaaaataataaatgtttagtttgtaaatcaccagtgttacaaaacattgttaaatgacacatctctctgccaaactttgacaactaagttttaaacattaactggccatctgtcatacctctgaacagctgttagcatttgttacgcactgctgtttccatagtaaatgcccccacctaattaagattatttttgtaagaagtcttaaaattgtggtttctgaaaatataatgggtgattagattaatatagcaatttattgatgaatttttaaaattgcagtagcaattaatttaggagtctttataatattaatttataagtagacttttataatagacttagtaacttttaaatattgcattagcaattaactgatacttggaatctttcatattttgtatggccaacatctttattataattttttaccgtttagggagagttagcatttttccatctggcctggagttagccatggaaaactacaattcttgatttactatttcgcttttttgagatgacattaaattagtagccatatttagaagagcttatttttagaactcagaagtttcctaaaggaaaaagatggaacttctacaataatctggagataatgtttttgagcaatttggggtctgagaagtaagttaaatacaatgttaggtttggatatttaaagagattgccaatcaggaaatgccaaagctaagtttcccaagaatttgtagtccagccaatttgcatttaaatgtctagaataataaagcctatctgaggaccttcagaggatgagctactagtaatttctcagggccccatccagtcttaagagtcagctttggcaattatgaaaccagctgcacagtgggcccctgcccagtggtggtggtctttgtgcttcttgcctcctggggctgtagactgaagcgcattgctgttccctttgaatttgagtgtctctccactgttttctaactggaggggcaaaacctcccatatctgtttctctccatgtattgaagtagtattgtcagtgtaaaagtacggcatgaaacaaaatacctgaaagctagaaataccatatgtcgtgaatattctcaaagtatttttccttctttcttaatgtaaataaatgtcaataaacttagcaaaaaaaaaaaaaaaaagccgctaagcatatggttctttgttaagcagcaatagaaaactgatagaaccaggaacaagatgaggattgtccactccccacttctattcaccattgtcccagagactctggccagtgcagctaagacaagaaaaagaaattcagggcatgaagattggaaaggaagaagtaatatcatcctttcccagagttgttatcttgcatgtagaaaatactaaggaatccacaaaaaatctaatagcattataggcaagcttagcaaggtcacaagataccagattaatatacacacattatctaaatttctatatgtgagcaaaaaataacccaaaaataaaattaaagaaatattcacaatattataaaaagaataaaataggaataaattgaacaaaaaaaatgtaggatttgtatactgaaaactaaaaaatgctatgaaagaaagatctaaataaatgagcagagatatactgttggattggaggacttaatattgttaagatggcgcttttctccacattgatctatagattcagtgcagtccctatcaacatcccagtaggatttctttgtagaagtcaacaaggtgatcctaaaatttatataaaaatgccaaaacaattttgaaaaagaaaaaaattggataactgatttcaaaacttactataaggctacaataatcaaaatagtatggtgttggcataaggatagatatacagatcactgaaacaaaaaagagtccagaaataaaccctcacctttatggtcaatttattttcaacaagattgccaatgcaattacatggaaagggggatagtctttttttttcaaatggtcctggagcagttggagatccatatgcaagaaatgaacttagaccctgtctcataccatacacaaaagaaaattgcctcaaaatggatcatagattcactttaagagcttaaaactataaaacttttaaaagaatataggaataaatcttcattaccttgggttaggcaaagagttcttagatgtgacacaagggaatttggggggattacggaaatgttcttaagctggattgagatggtggttgtacaactatataaatttactatcatcccactagatttcacagggccattacactaaattaaaatttagctttgtggctaagaatttaccactgattcaaaaatactaaatatggttttttctcccaagaactgttttattaaccagcgtgtagttgtgccttatggaagaagtccaaattgtgttttttgtttgaaaatgttatgaattacataactttatagattttcaatatggaagacaccttagagcaacttattttagttcattccttctacattcaagtacatatttgccatttccaaaaattcacagctttttgatacttttttaacatcaattttttggtcttttttgttgtggcaagatatatataacataaaatttgccacttgcaccatgtttaagtgtacagttcaatgacattaagtatattcacattgttatacaaccatcatcactatccatctccagaactctttcatctttcccaactaaatgtctgtacccattaaatactgactcccattcacccctctccttagcccctggcaaccacccttctactttctgtccctatgaatttgactactctaggtaccacgtatataagtgaaattatccagtatttgcccttttgtgtctggcttatttcatttagcatgatatcttcaaggttcatccatgttgtagcatgtgttagaattttcttcctttttaaggctgaataatattccatcgtgtgtgtatagtacattttgtttgtctactcatccaatattgatgttttgtggttgataattatgtactaggaaaaaccaaattctcagaataaggctgtctaatcgtagggaattctgcctcgttccatctccacacaattactctttctaggatgcaagttaaatcttatgctatacatcttcgtgaaggaatgtgtgatttccactgaaagtattaatgactacggaagtccctccaattcccttatttgttcagataaattacttcttaaagcagggtttagaatttactctagaataccaagaataatgaatcagcttgtcaccagtatcagtgttacccactgagtgccattctctttttatgacaccatgatcaactttaccaaaaggcaaaggaatttgcagaaagccttctaagtacaataagcactgattcttctttatgctatgctcaaggaaaggaggggtttccccctagaaaggaatgtgatatgctcagttaaagaatgttcgatggagtggcttgcagcattcataatccaagaacatagctgttttcttctctttgtggcccttcaaacatgatctcataaaactcttctgccagactgcctttgtgctattctctttaaatttttcatgacagaaattcatttttgctacagctacaccaagtacaaatgcttggtgtttacctatgcaaaataaaaaaggtagcaaaagccaaaaataattaaataaaatattatctgacacacctaatgtaacataaatgttaccttttaaagcagcacattaataattgtatgttcatttaatgtaaatatcatttaactcttgtagttgcttaagaagagccaagctaggaaatgtgattttaacactttaaaaaaatagaaaggaaattaatatcatagtgaaaatttctcatagttgggcaagctcttgtatctgatactaaaaagtaccgtatttcagaagattttattaaaacaagataaaatctgcctatattatatcatgtaactggtttttttcctcatgctttcttttgctcaagaataggcattatgatttgtgttttacagggcttaattttagagttatttgaccacttgaaaaaggcatagagaacagtcaagctaggtcatctgaggccagtgtttgagtttctcagaaatagctgccaactgaccagaaatctgccacactggcctatgttgttaggccaccaaaggcacagtcttcttggattgaactaggaggtcaagcaagtcttaatttcttgaattcaaaaataaatccctgtaagtgcgatgttctaataggattagaacaaaagcagccctgtatacagacaaataaaacctaaacaaaacaagggcctccttagaggttcttttgctgtcaggatccaaaggatttttgcagctttttcaggaaatcttgtactggcccagatgtactgattttttaattgccttttttgctgacagaagaaaactttaataatggatttagagcagcgtattactaggccagctgcactccttcttgcaccttcaagtaaggatatattccccatcatgattttactaaaacttgatttaagttagcatttcactgctaagctattaaactaaagctttcccggaacacctaactcaagagcatccaggaacattcttcttggccattaaatacagtaagcagttgtccattacatgtccatcttcaacttgagttatgtagtacaaactgggccatggtattgggagcagccctgaaccttagtccagggaaaatctaaattccagggtggaactcttgctccttgatttcagtcactagatttaggaatttacacactttttaagatgagaaacaaatttagtgtaagatttgtaaaattttcaaaatgaatgaaatgaaatcttcaaatgaattcccttcaaatgaatggagtttgctatctccatgcagatagtcatctgtatgactattatttgagtgctttcaactatttaaaataaattgatttttagcaattttgtagaatataaaatttcaagaaaaacaatttttggtgcaggtaggataggcattctttgcacgtcaaaaaagaaaaatggcctgagtgattttgatttctttttgtaacttgtaatatcccaatgatacagaattgtgtttagatttgtaagaaggacaggttatagaagttcttccagccgggtgccatggctcacgcctgtaatcctaacacgttgggaggccgaggtgggtggatcacctgaggtcaggagttcaagaccagcctgtccaacatggtgaatccccgtctctactaaaaataaaataaaatacaaaaattagccgggagtggtggtgcgtgcctgtaatcccatctactcaggaggctaaggcaggagaattgcttgaacccaggaggcggaggttgcagtaagccaagatcgtgccattgcactccatcctaggcaacacagcaagaccccgtctcaaaaaaaagaaaaaagaaaaaaacttcttcctagtgtttaattgtagctccttaagtttttgaaaatgccattttaaattttgcaatgtttctttcacacttacgttgcccatcatgcaatctttaggccactgctaaatacactgctcttctccaagcttgaactacatgatgtttaatgatgccaaggatctttgaaaggactctgtgtgtgtgtgtgtgtgtgtgtgtgtgtcagggcctcagtctgtcactccggctggagtgcggtcatgcaatcatagcacattgcaacttcgaccttccaggctcaggcaatcctcccacctcagcccttcaagtagctgggattacaggagtgcgccaccacacctggctaatttttgtattttttgtagagacgaggtttccacatgtggcccaggctggtctcaaacacctagcctcaagcagtctgcccaccttggcctcccaaggtgctgggatgacagatgcaagccactgcacctggcctcaacaagtttatatgtaaacttgagcaagaaaaatagatttttagatcttacaaagttttctgtgatctccaacttcagaaaatcagttccagtacagtaattgaatatcagttctctgtgtttcagtattaaatcagctttccctaatattttgctcaatttcaaatgtatatgagaaaatacctgttatgtattgatggctgatctgctcagttcactgaaaagatgtgacattgaaactttgttcctatttacccacgtaattcacagaaactgaagaaagttcttaataagatagtcagtgtttccagaacaagttatttcaatggtcattattgctacacagtgtaattccgtgcacactgttattatctgttttattaggatcatcacagacacattcattaaatattttgcagctaaatatttgattcttgcaaactttcattcttttccagcaggaaacttcttcagtatctataaagtaagtgataagatgatggttgctaatgaacatcaatgttctttgcaaccctacaagcctatgcctacagtatagttgcaaaagttatcaacttgtctgaaacagtatacattctggtccttagatttggttttctctgtgcaaaaaaagttagtgggacatacaactcagtgataattattttatagcttcttaccatgcattccattttaaatgttgatcttgataaatactgcacataaactatgagcaaaacacaggtttctatttgataactaagaaatcagaagataatgtgatataatgagtatgataaaaaatgaaacttgatttagtgctttgaatgtaaataaaaggtgacatattaactgattttatcatctttatgtttgaaagtacaatctcaggagatttgaatttaatatcactaccaagtttattctgcttcatttgaaaacccatgtcaaatgtagaatgtgttctctttatggaactgtggcgacacttcctaagacagaaagatgaatgaagcgtgtcggtgtaggtatgtgtggtcatatctgactcagtaccagagatttgcagagagcaggcctatctgtgagacaatatgagacagtctgtttcccttgcagctgttcacatttccttgttttgccctggtgttgtgtgtacatgttttttgttttttgttttttttaataaaaagtgctgaatttgggtaatgataatttcattagaaaaagagagtaaacagtaacagattcattcttgttttccctctagggataatttattaacattcttccttctctcttcctcccccttcacacctcagctttacaaatacacctgataccttcaaatttcaggaaagcaaatagcaaaaggaaatacattttgtcattccaatataacttgaatttaagcttctagagcagggattcacaaactatggccctcaggccaaatccagctggccacctgtttttgtaaataaagttttattggaacacagccatgctcattcatttatggattattaacagccgccctcatacaacacaacagggtttagtggctgtgacagagatcatatggcctgcaaagcctaaaatatttcctatcttgccaggataggattaggatcctgatattctttttttttttttttttgagacagagtctcactctgttgcccaggctggagtgcagtggtgtgatctcggctcaccttaacctccacctctcgggttcaagcgatcctcctgcctcagctaccttagtagctgggactacaggcatgcaccaccacacccagctcatttttgtatttttagtagagatggggtttcatcatgttggccaggctagtctcgaactcctcacctcaggtgagaatcctgacattctttaacatggcaaggcttgtaattgagtagctaatagttttcaaatcatattgagtgtatttttccctgcagcctataaatagaattttttacagcttttttcccaagtatttgccaaagatatctccctggcacaaggcattgtgtattactgaattctagtaacaagctgaggagatctggatgagagaaaggacagcatatcagcagggcagggtcaggtccctgctactctggctgtatgaccctgaccatgacagttcacctgactggaactcagcttttgactttttaaaatggaggagttgaatcatgttgacatctaagatctcctcttttttttatttttatttttttggtaccccaaacagagtctcattctgtcacccaggctggagtgcagtggcacaatcacagctcactcatcctgggctcagggaaccctcctacctccccatcttgagtagctgggactacaggcaatcaccaccacacccagcaaatttttttatttttttgtagagacagagtctcactatcttgccgaggttggtcttgaattcctgggcttaagtgatcttcctacctcgtatggcctccccaagtgctgggattacaggcatgaaccaccacacccagccctaaggtctcttttaccttgaaagttgtataaagtaagtcagacttaaaagatacaaaagaaagaattaaatatagtcaaaacacatttcttaattttgagggaaagtttttaactgcacatgcaggatcgaagagaaataatatctggttcctaaagaaacaagctgaaataaatattcctggtgtgtttattttatgttactctgaattttttttaaatctatttacaatttctatgtactagtccaaatataatacttattttttctagaggaagcatttcttaaacactactatgtactcagcctcacgctaggggctattacctaatgtcagagaacccgagtctggtcgtgggaaagaaaaagaaccacttaaacagcatgttctataatgtacctcagacattcagttccctcttggctgttgatgcccttggtgtggcagacaccccagtgttggctctgtcctgagttgcagacgtgtggtttctgcatcgtcagtatactcagcacctggtctcagaaacgttctcgtcccctgcccccaggggttaccacatagctttttacttctgagtcctcttgtcctcctgggcagggctgtatccagatggctccagccaggctaccttctgcagtgtctccttgactcatgggaaacacacacatgcttaactcaacatacactacaagcatggcctgccccaggcggcctccagtcatgaaagaggcaggcaccagtctctttttgcttaggaccccaaatgctacatgtcaagctgccccaaggactctctctcacacagagatcctttctagtgtaccaaggtgggcctataagttgctacaattcagcaagcatccctccagagaatgagatagtgagctcttctggctggcacctccagtgtctaatgcgtggttcttttggggcatctaccatccttcactttgtatgagggagggtgcaatcccctctcctttcctcccgaacaagaaggagaagggaataatcaaatacttgctcttcttagtcctgtgactcctacaaatcccagacttctgcctctataggcagaatgaggggtcctggggtgaatatggaagggccattttgactgcctttcagcaagcccaggagaagtggtctagcagctttatagcaggttcagtgccatttacttcctcttggccttagctttgggctttagctgaaagtccaagactactggtaaggtcccaagtaacattttatatattctttatatatgatagaatggggggtgggtaaagggtaagaaagacaagctgcagtcttcctttgttctcaaaacccagctacctttcatttgccccagaccttgacaaaactctacctagatttgaaatttgagtcctgcatatctttgcaggcagcatataatatgcagatgacccatgagaatgagaaatccaaaagcactatgtttctaactactgtttttaaacacttcaatgttacatcgcattcgaacttttttccattgatgactttttatttacctgctttgccatatttctcaaatgctttgtatatgctatggatatcactaaagtattttgagtctctaagacaaaaatgtagaaattggtgggggaaatgaaggttgacatattatgcatatacatcaagatactttccaacttcgggttgcccactgagatcattgccagttgttattgctggggaccaaactacttactctctggtctccaaagggttgaatccttcatacatttctgggcctttggttatacagatttttggaatttgtgagctctttgaagacagaaactcatctttttcatctctgtatccctagtacatagaaccccacattttagtacctagtaagacttcaataaatattgagtggatgggtatgtggatgaaccaacaaagggtcacttctctctgacagtgacaaaatgagcccattcctcactccctcctgcttcagttcttacttgcccttttggttgatgagccagcagccgagattcacagtgtattctttgccacatggacaccatcctctctatcctgtggctgccttgagaggtgcagtttctaggacttgagagctgcagtttttagaagaagcagagcccaatgcccccacctcaggtagaagccccaccttttaattccttcccattgtatctgcctttcatattaagcatcccacctccccctcatcctgccactacttccactgaactttaggtgagttgaatttaatttaagtgattgaactggatcagaccagaccaaaggcgtggaaaaaaatttggtctgagtattttccttggagcagtgcctcaaaagagattccaggcacttgtgtgccacctatgaagttgtatggatagaacagcggttctcacttgaccactctgtgcctcatttttctcatcttaaagtgagaatagtaggggtaaccaactgcgtaggattgtttgaggttaagtgaatgagtatatgttaagagcttagactagtaactatcatctagtaagtgctcaataaaagtaatattgttgctattagtagtagtactattagtactctcaaaagttagcactggacataagattttcaaatacctaaggagtttattaaagcacagatttctggacctccttcttaaattctgatgttgtaggtctggaggggggtccaggaatctatgttccataagtactacatctgattcggccacacgttcttaagaaattacagatataagacctaaggaactgtatatgacatagtaagaccaggtcaaaaattatctccaatttggggagttgtgggattattttttctttgtgagaaaaattgatgtgcatttattaaatgtttaaatagaaacgaaccataatcatagttgaaaatgttggaaataatagtccttgatcaagaaaaaggcaaaacttacagtttatcatggaattagacattataaagtgatggtgctatcaacttgtaaagcctcaaattaaatttgctttttttctcaaacaggtttgagattttttttttttttttttcgagacaaagtcttgctctgtcacccaggctagagtgcagtgatgcgatcatagctcactgcagccttgaccttctgagtagctgggaatacaggcatatgccaccatgcctggctaatttttgtatttcttttgcagagacagggttttgccatgctgcccaggctgttctccaactcctgggctcaagcaatctgcctgcctcagcgtcccaaagtgctggaattacaggtgtgagccactgcacccagccgggtttgagattttataaaaatatttttatgtattcacttagattatttaaactttgcttgataatattatgacacgtcagggggtgactaaatgtgtttttaaagtgttatgtatttttttaattgtgataggaacacttaacatgagctctaccctctcaacaaatcttaaagtgcacaatacagtattgttggctgggcacggtggctcacgcctgtaattccagcgctttgggaggccgaggcgggcggatcacaaggttaggaattagagaccagcctggccaacatggtgaaaccccgtctctacttaaaatacaaaaaaattagctgggcgtggtggcacgcgcctgtgatcccagctactcaggaggctgaggcaggagaatcgctcgaaccgaggaggcagaggctgcagtgagccgagattgagccactggactccagcctgggagacaaagcgagactccgcctcaaaaaaaaaacaaagtgcacaatacagtattgttaatgatagacacaatgttgtacagcagatcactagaacttattcatcttgcaaatgtaatgtagtgtgtgtgtatatgtgtgttttatggtttcttagtttttttggttttgcattttgtttgggtttgggtggtggttttttgttgttttactattttttattgcatgcatgcagtgcaattcatttctataggctagtctggaaacctaatcactatttataacattatttttctgggaaaatatgatcccagttacaacattgacatttctttagagatagaaagcattcagaagatggagactgcccacatatattttacagggatttgggcaaacttttgtggacgagccacaaatcaccatttccctaaaatgttaatataatgttttaaatagagcagcattttactagtctacttatactatttatttaatctctgatttagtagtgctttcttaattaatacatcatttaaaaaattgtccctgctctatcttcacattgcttttgttaggcatttttatgtatgatgtggcccaaatatttataagtcataaaaatttatcttgcattagtataagcaaatctgactataatctgaagaatgtttatagtcagtatttgacttctcaactagcattggtgtacagagtaggtgaagaaaaaaaaaagaataaaaccgaccacgaaaatccccacctgttttagagaagttaggaaataaaagtgttcacaacagccgaggtcatctttaacttttcacttttcaaagcagactgttgactatgaaacactttatttgaggtagaaattaatattttaattgtatttctaaaataattaaatgtatgttcttcagaaagctgaactttggatcatttaggtttgtggaattttagaaatatatttagtttctttcttttttttttttttttttttttttggagacggaatctcgctctgtcgcccaggctggagtgcaatggtgtgatctcggcccactgcaaccttcacctctcaggttcaagcaattctcctgcctcagcctcccgagtagttggggttacaggcgcccaccactatgcccggcaaattttttttgtatttttagtagagacggggttttgccatgttggtcaggctgttcttgaactcctgacctcaggtgatccgcccaccttggcctcccaaagttctggcattataggcatgagccatcgctcccagcgtatatttgctttcttttcagtgtcttctccactctgaattggcagagtcaaaagaaaaaaagtttatgtccttgacttcctgctgaaggataccagcactgattctgttaatgaacagccctagtaaaacaaccataagcctttgtgagaacattccttcctagaaggagttgggtttgccctttcccaagatttaggtttctgtgaaaattcttccagacgtgccttggccagaaagcattctttcattttactccgtgtagacgtgccttggccagaaagcattctttcattttactctgtattcatgctattgaaagttgcttctgtcagaggaaacaaacactgtgattgaggaaatattgatgaattttaaatgacaaggaaattgccacattgacagaattttggtccatctatttaaagatgattttttgaaaagatatgcataagactcatattctgacaagtttcacagaacaattcagaggttattaccaagaggatcccactgaaatcatcagcctgcctttttaaaagaaaaatattgtttagtgaaataataaatatgaagctctgatttttagcaaagaattgtgagtgtttactggattttcttctttgctttttagctgtatgacaaaattaacacaaagtcttcaccacaaatcaggaatcctccaagcgatgcagtacagagagccaaagaggtaagtgatatattttatagaagtatttggcatcatcatatttgccacctttattgaagacatttctgttgcacattaagaggcagtttccctggagtcacaatttgactcattatattcagatttagtatttctaagtttattactgaacatacagaaaagaaaaaagatctctgcagcaatattgcctagatttctagttctggttctgcgatgtaaacttgaatacattaccatcaattttacttctctttttctgttttttaaaaaagcaagttattttacaacacttggtggaaatagacatgctataaaaatttgagttgctttttgaaggtggtaatgtttgaaagttaattaaatttctgtagcaattaaatatactgagttcaaagaagtcatttttgtaaattgtcaaggtatgtggctatatctgtcacaaacttttaaaaacctatttatgatagaaatacaacattgcagaaagtttggaaaataaaaatagatccataatctcatcaccctaacacagtagtttccatttttatatatcgttttctagtcactctccatttgcatataaatttttttatagttgtaatcaaaatgtgtcttttttaacctaccgttatataataagcatatttccatgtttctacttgatctttacaaatataacttctaatgactgcaatatttttctttgctgttattaaagtataacatattagcaattctcccattgttagacacatgggtttttttttttttcattttttgatcatgtcagtctttgtgcaaataaacatttttcttttagaaaaattatttcttataaagtgaaattactatgtgaaagactatgaaggacataatcccttccctaccagattttagacagaaagtctgtactggaagatggtgtacgttcactgagaaatgagacccatgcagtggaggctgcccggcctgcccacttggtcaggactagcttggaggggttgtctctgacttcaccaccaagggctcatagaagggaattaagatatcgctgatagaggcatgaatcaccaccctgtcttcacaatacgcagatagaagcagagagactctggggacaattctttggctcaactggacagtgaaaacctgctggtttccccctaaccctgcttaggtggaaataccacacctctgtatttaaaaataaactaggagaggagcaaggacccagagagagtatgtggttttgtcctctcatttcactaatagagaaactcggagcataaaatacaccaaggataattggtttatcatcttgaaacaatatgaattaacagcataaccagcactctaatgaacagggtattcggataagaaagctctgtcatttttgcttgtttgtttgttcttccctgaggcagtagttgagtagcacagaacattctagttatgatgctaaaatctaaggctcgggccatgtgacctcacaacatccccctcctgccccagtaggaagcttttgtatggttttcacaggttgaggtgagagtcctcctggatggatggtggtatgatcctgccatccagttgtgccaaagcaatcctttattggcttaatggttggaattcagttgagtgtaatgcaaacctctgaatccagccatatgcagttagaatagcagcaggtgtttactcagaaaaagaacagaggctttttcatgggttcatgtcccataaataacttacacaggtaaactccatcctggtggtaaaggagaactttttaaaacaattttatttgaaaacaatcaattttacctgtgcagaaaaatgttaatgactaattagtgaagaaaatttgagtggaaagagaaaataaggctttaaaaaattgttctcttaggctccctggcatttaaccctaagagccattagcagaggcatgactttctctgtgtgggcagatgactatggggaaaaacattgatccggcaggcatttttgcattttctacattacttaaagaaaaattacttgtgtattcttaattaagtagtctaattaattagttctgttcttgaaatcgtttctatttgtgcctgtgtcattttgacatttctaaagggaattggcagtgctgttaatataaaagaaaacttcttattaactttttgtccatattgatttttatggtgagtttggaaaaggatattcagagatactcttccgttaagtttcataaatctgtaataaatatatgttgcagccttgtcattttgctttatatttttcaataaccttttaggttatagttgacagacttttagaacaatttgcttcatttttattaccatcaatactgttcttctatgtattaataacatttgaataaaatgaaaagtttttcaaaataattgttttgcctgccataaaaatccactcataatttttaacttaaaagaatttaacattttgtaaatcttgtgtcatgtttgtattattgtatatcttgtttattttttaggtattggaagaaatttcatgttaccctgagaataacgacgcaaaggaactaaagcgtattttaacacaacctcatttcatggtaagtaataattaaacttccatagaactgaaacctcactttcaaaagaagtttttaaactaccctcataaaatgtagccagcttcatctcatgcatttttatccatatcatatgagactattaagattacaataccaggtaataccaaatattttaagactgttttgtttactttgtgtcacaactgtaaagatactcttggtgaagtggcttttcagggactgtactcatcagacaagggattttctttcttatggggtagtcctttagtcactggaactgtttatgttacttaaaccacaaagaactaaaattagagacagttttcaataataaggaatcgtctgaatctaggtgatatattggaagaattacatctcttttgacaatgcaaaactgctgcactttcttggttcatttctactatatggaaaatggggataacacctgtatttagccaaatataaagctaaatagctaaacaaagctcaaagctcaaaatagataagatactttgctgtggaaaaaggtccatgcttatctacctaactgcaatacaaaaacacaattacagatggaaattcatgttgaatataccattttaaaagcattagccacatcagtttatgtgaaaaatatgtgaaaagtggaaaatttacctcactgccctttgggagaaaatctgacttaaaagccttgttcttataactactattacagatgatactttgaatttttatttatttatttacttttgagatggagtctcaccctgtcacccagggtggagtgcagtggcgcgatctcagctcactgcaatctccgccttccaggttcaagcaattctcctgcctaagcctcccgagtagctgggattgcaggcgtgcaccacgacacctggataatttttgtatttttagtagagacgaggtttcactatgttggccaggctggtctagaactcctgaccttacctcctgcctcagcctctcaaagtgctgggattacaggcatgagccaccatgcctggccacaggtgacacttttaaaataatagtaacagtataatatgtgtatcaaagcaattacctgtgagttattatatatatgctgttttatgatagtgtttctttttttctttttcttttttttttttttttgagacggagtttcgcactgtcgcccaggctggagtgcagtggcgcaatctcggctcactgcaagctcagcctcccgggctcacgccattctcctgcctcagcctcctgagcagctaggactacaggtgcccgccaccacgcctggctaatttttttgtatttttagtagagacggggtttcactgtgttaaccaggatagtcttgatctcctgacctcgtgatctgcccgcctcagcctcccaaagtgctgggattacaggcgtaagccaccgtgcctggccctttatgatagtgtttctaaacttttaaccaagttattgaaataaagtttttttcctaaaagtaactacctggaaagaagcaattaccatattcatccttcctaactctcccacccaagcattaaaggctgaattcaagtataatccttgagagtatttgactttattctatggtaacagcactgtccagtgaaatacaattaggatacaggttctaatgcctgtagatgagtgcatttttacaacctaggtgtataaacacagaacttcgttcaaatctcacctcttttatcaaggtatcttgtaacctctctacccttctcttgaactttctcttctctaactcttttccacttgtttgtattcacctgcataacattctaatgcttgctggcctgccagagcaggtctcttcccagtgaatgagccagggcaatttttctttgtccttccatatcccagcccagttttgttgttctcattgagcttatctcatttagtcattgtgattatctctatttcacagagcaggagaataaagaaactatatgctttattaataatcctcaaatgtgatgaatcacaaatatctgcagttaaattaccgttaatattaccttgttcactgtttcatgcatatgtgctgtgtttccccagattataattcattcccttttagacagcatgtcttctatagcaggggtctccaacccctgggccactgaccagtacccatccgtggcctgttaggaaccaggccacacaacaggaggtgagcagcaggccagccagcattaccacctgtgtccccctcctgtcagatcagcctaggcattaggtcctcataggagtgggaaccctattgtgaactgcgcatgcgagggatctaggttgcatactccttatgagaatctaatgcctgataatctgaggtggaacggtttcatcccaaaactattccccgacctctatcccccacccccacccaccctgccatccgtggaaaaattgtcttccacaaaatgggtccctggtgccaaaaaggttggggaccactgttctatattataaaagtggttaaagatgtgaattcagatgacctggggttgaactccatccttgccaccgtaactttatgaactctgactctgagtcaacctcgtggagtcagaataagaattaagtagctgatatatctactgtgcgtagcacaatgcttgacatatgcttagtgcctaatagatgttatctgatacctattattagttgctccatagtatctatcatgtatagggcacatagtaagttatcagtaaaacattgaatagattaggaacctgcccgtttgcagataggttaggctctccttggctgactgctctgtgcagtgttccatagctagaaacagatatataataaattttggaccaggcacagtggctcacgcctgtaatcccagcattttggaaggccaaggcaggaggattgcttgaacccaggagtcaaagaccagcaacattgggagaccccatctctacaaaaaattaaaaataaactagccagacatggtggcacatgcctgtagtcccagctacttaggaggctgaggtgggaggatcacatgagcctgggaggtcaaggctgaagtgagccatgatggcaccactgcacttcagcctgggcaacagagcgagaccctgtctcaaaaagtaaaaaatgccaggaactgtggctcacgcttataatcccagcactttgggaggctgaggaatgagagtcatttgaggtcaggagttcaagaccagcctggccaacatggtgaaaccccatctctactaaaaatacaaaaaaaaaaaaaaaatagcctggcgtggtagcacacacctgtagtcccagctacttgagaggctgaggcacaagaatcacctgaacccaggagacagaggtttcagtgaggcgagatcacgcctctgcactccagcctgggtgagagtgagactctgtctcaaaaaaaaaataaaaaatgaatttggacagacatgtctttctataaattgctaagtaaactcagctcaattcagagaatgatatagggccgtatgagaccaatagatctttcagatttgaagtaagctaaataaattaacatatacccaaataggagccttttttttcatcaaaatcattacggctcatatagcccattgtatgacagcttatctgtcttctaagtctcgatatgttttgcttttctgaagtcagagagaagttaatatgtgcattgctattagtaaacattttcagaaataataagtaatttttataatttattgaatacctagctaggtgcttaaaagacattttcattcatttatcaaataagtaaatgcctactgtatgccaggcacactatgccaggcactaaggacctagtaatgaataagacaaacaagatccctgccctcatggaacttccactctagtggaggtggggtgggaggacaggtaggagaggtagaggtagacaatgagcaagtaagctaacaagataatttcatatggcaataataactatgaagaaatgaaaggataatggtgcagagattatagtaaagtgggagctgctttagataggggaaagcccctctgaggagtagacatttgggctgagactcctttgaggaagagcaaatgcaaaggcccagagacaggaaagagctttgtagattcaaggagcagaagtcctttgtggctgagatacagttaacaagggagagagtggtacttcctgtaccaagagaggtcagcagaggccagaccaatttatttatttttttaatatataaaataaggccaggcatggtggctcacgcctgtaatcccagcattctgggaggccaaggtggacggatcacgaggtcaggagttcgagaccagcctggccaacatggtgaaacctgtctctactaaaaacacaaaaattagccaggcatggtggtgggcgcctgtagtcccagctactcaggaggctgaggcaggagaatctcttgaacgcaggaggcagaggttgcagtgagttgggatcgcaccactgcactccagcctgggagacagagcgagactccatctaaaaataaaataaaaaatataaataaataaaagccttccaggccattgtaaggagtctgcagttttctcctgattgcagtaggatgacactaagtgatggcacgcaggaaaatatctaatctgtgccttgctggagctgatgtgtagagaacggactgtaggggggataagagtttagggagaccaattggaaggctgttgtgagaggttgtagaggcttggagaaaggtgaggatggtagaacatgggcagatggggtttctgtgttggagatggttacatacaagaggacttgctgatggttgggatgtaagctggtgtaattaaacccatttcacaattccgagaggaaattgtgccctaacaaggtaaagagacttgcttaaggtcactcaccaatcagtggcctcaatgaggttcaagccagatcctgctagcgccaaagcctatgctcctaaaagtcagttgatttataatgctaatcagatttctaataaatttaagttgagctcattggtcattcctaaataagcttttgtgtagataatatcttatgtgggaaatataattctgagatatatatatatatatatactatattaaataagcttttaaatgctggggctttctatcttataagcgtttttaaaatcatggcttcaaaatcttggtatttttaaagaaatattaatagctaaggggaaatatgttaatacttacaatttttttattatgccaaggtttgggagttattcttggcatatttataatttcacacttatttgctcagtcatccgaatttttctttgctttctgattattataacatgaggatttaacattgaattacccaacactgaaaatccagatacttgtagatatttacagtaactaaaggaagaggaaataagggtaaatttaaacgactttaaaattctgtgttttttttttttaagagacggggtcttgctctattgcctagataggagtgcagtgacaccttcttagctcactgtagccttcaactcctgggcaaagcaatccttctgcctcagcctcccaagtagctgggactacaggcatgcaccaccatgcctgtctacttttttttattttttgtagagacgggggtctcactttgttgcccagactggtcttgaactcctgagctcaaacagtcctctttccttggcatcccaaagtgctgggattacaagcatgagctaccacacctggcctaaaatctgtatctttagaggtcatcataaaagaatattatctcactgattacttttttagttattccatttgaaaggctgactttttaaaaagaatatttcctttgcttattgcagctgtaaaatatgaaacattaaatagtcagattttttccactctagtctgatgttgttagttgtcttatacatatccttactatagtacaaaaagtgaaagtgtttttttcctattacacgattgttacgtagttaaaactgacagctatttcagcttagtgacaactgctcactcatacgtcttaacatatttgaagaaaaatgttcaaattttggtttccctattttttattttatatactcttttaagcttttaaaaagatagtctgtaagtggccccctttttctgtttggatatgaattagagctttaggttaagtttcgttttgtggtagcaatcatttacagtgccaaattgtggttaatatcgagtatgaccttatttggtgacatcatttaagcatttttcttttagagtccagtttgagtattattttatgattgtgggcttaatccttccttgtaaataatgcattaaatacaaatgtttgcttatataatttaaaagaatgagtagaggcctgtaatcccagcactttgggaggccggggtgagtgaattgcatgagctcaggagttcaagatcagcctgggcaacatgatgaaaccccgtgtctacaaaaaatacaagaatgatctgggtgtggtggcacatgcctgtggtcccagctacttgggaggctgaggtagaaggttcacttgagcccaagaggtcaaggctgcagtgatatgacgaacataattttagcaaatgaaatgttccagtttttatgttactgatttttgctttttgccctaaatcttggtttcttatgtgaccacaattaaatcagaaaaagagggatttgcccacataggacagcctctatacttgggctcaggagtaccagtacaaggtgcagttagggcactggtgaggaagccaaggtccccagggccatcatggagcactactttcaagctatatattgcttagtgccccttggtgctcctcacccaaatcccagtttagaccagccttctgagattgtgaaaatatctgccatttccattagaaactcaactgtgtataatgctcaaagcatattctttactggtaacaaatcagcattatcttctttatgattttaccagattgttaccttttttttttgcctcgtatgcatgcctttaaaattaaatagccaagtcatgacttttttaagccttttaataaaataacttaatttcagatgctatgagttattatttttaaagcaattttaactgcatttcattatctgcagatattaccgcacagatcccaaattaaaatagaaccaaatttatagttagcacataagaaaatataatctttgtataaagctccagacattttgatagctgtagattctctttgaaatagaaatgttcaaatatttatgcttaatagaaagggtttattatgatggcacaaaaagtgtggtgagtagaaggacattcttttttagggaaacaagggacattttattgttgaagttcaccaagctgacaaatagagatgtcagttcaaagaaatcactttctctttgttaataggctttgcaaaaagaagtcataataataattctcaacttattttttatttaaacaagtgctccaaaaaatataatgaacaaaaaaatttaacatatttagagtttgagttccatatcatacgtgatattttggaagattacgtttttaaggtacatctgtgtgtatttttttctttttctaaatcatatgctataaattattttcatcctttgggttatataaaagcgtcattgtaaatgccattgatgaaagatacttgctcaatactccaattattgcactatttctttttaaatttgtttcaattctaagccccagcacaaatttgccaactctatttatagatgattcttttagctaaattacttgaaattgtaccgtctaccttcatttgaacaagttagttgataacacctctgacccagataatcatcaaacacatctcttcattgattcactcatttattcacttacgttttaaaaaatctatttatcatgattgtcacaaaaaaattgagatagttggatgtcgatattacacactttatgttctctttagatgaatgatacctttgagaggaaaagaatgagatatgtttatagaataaatttgtcagccccatgtctacaaagaaaacatttaaaaattagccaggtgtggtggcatgcacctgtggtcccagctacacagaaggctgcaaaggaaggatcgcttgagcccaggagatgaagcctgcagtgagctgagatctcaccactgcactgcaccctgggtgacagagtgagaccctgtctcaaaataaataaataaataaaataaatttctgctgaaatagtaatgttattaataatttttttcttcataaaacactaggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatggtaagtaggaagagaaagttttcaatactctcataagatcccagcatgagttatatcaactaacttcaacctatgctactaggagttggggagggaaggaagacatggatagttttaaagaaatcagtttccagatcttcagttcccccctgcccttcttttctagaattgttctgcctgaaactgtcttaggcattccggttctctttctcacctctcctttcacaattgcccttcaaccaaaaaaaggggaacatactgtaacattcctccagggtgtaaaaacctctggggcagcaaagaaagggacaatttgaaatattggtattggtattgagaaagtgaatgtctagtaacattgtaaaaatcatccttttataaatcttatagttttcagatcttttgccttcaacaaaattagaggaagattaattcagggggcattcaaagaattgagtaacactgctgaaataaatttcttccactcccagctacctacttaatatgaatcaatttactcagtgcttgggagtagagctggaagagaattgatgctgaaccttgcctccattctcatagaattctcgtagactgagaagatcaaggaaaggctccttgatgttaactgaacagagcaaggggagtgaggggaagcaggggaatactattcagcaaaccaaatagcacatgtgtaaacctggtagtaaaaaggctcttatcatagtttcccaatggaaagaaggcaccatggctgaactgcagacagcaaggtgagtggctggaacagaatcatacaagtgttggaagacatgttaaggattatgttcattatcttaaaaacaatgggaggctattgaagactttcaagcagggggataatattagatttttgttttagaaatatcactctagagaatgtatgagaggggtcaagagtggatgtacagaaaccagttaagaggctgttattgcagcagtgcagggcagatatgatggaactctgaacttgagggatggatgtcaagatggaaagaagtgaacacatttaagaaataatgaaagagtaggtaatatcagtaagccttaacaatggattgacagtagaactgagggagaagcaaagatcaagcacagcccttaagctttagtcttctaaaactgaatggacgttgagacagggaacattggataagttccaagttggaggagaaaccatatctttagaagaggaaaaaaattcaaatttatgcattcatatctttttcctcagaacatagaaaagggatattaggatatagaaaaacaaattacctacttctgaaagttgccttttagattaagggaaaagttatagcagtgactctatgaccatgatttttggagagccctcagcttagacatttctggtcctaatcctcatttagtaatctttgccagttatacaatattatcttgcagcacatggggggcatgcagatcacctcaccccttctggtactatccaggcaactctttggcttaagagcataggctacagcaggttttgggtgtcttgggcaaatcacttcatgtcagtggacctcagttggctcatctctaaaagcatagttgactaaatgaatgatccccaagatcccacctagctctgaaagtctaatattccattcattcattttatatattcattcatttattcaccaaatatttttgaagtccctactaagtgcaaatcactcttattagatgccagtgatctattgtcagataagacactgccccttactagagctcacgttccacagggctggctacattaaacaagtaaatttgtagcttagcacggtttacttaacaagcccagttatgacagagctggagaggagagaaagctgtgttggagaggcaggaaggtgtgatgttcagccaggcaaagcaggcaagaaggtagaagggaccacaagaaggaggcctcagagtgtcttgggatcattaagttctcaagcagtccagtgacagctgcttgattgtttgtgtgaagactcactacatagaaacatagactgaattggcccggtgcagtggctcacacctgtaatcccagcactttgggaggacgaggcgggtggatcacgaggtcaggagttcgagaccagcgtggccaatatggtgaaaccccatctctactaaaaatacaaaaattagccaggtgtggtggtgggtgcctgtaatcctagctactcaggaggctgaggcagaagaatcgcttgaacccgggaggcggaggttgcagtgagccgagatcgcgccactgcactccagcctgggcagcagagtgagactccgtttcaaaaaaaaaagaaaagaaaagaaaagaaaaaagaaacatagactgaataaaagcataaaactacatccctgagttactttttcagaaagcgtaaaatggtcttgagtctcccctaaaagtctccttccaaaagcttttctgtcttcgatgatcctagtgaagatgtatatttcttctccttttgatgggtttccatgaaaacaggaattattttatgtgaaatataaaatatatattttcaataatagagtgtcaatctctaatgcatttaatacaactttatttgctttcttagttgtcttattcaaagcattatgttactgtgcaggatattcctatatgatctgttttgtttttcagaccctctgcaatgtgtccattcctcaagggtgacatactcctgttacacacctctgttttcccatttgtagcatcatactcataatttttttttttattgattggaattcccatagttgcaagtgacaaaaatcaagcttgaactagcttacaaaatagaggaaaggcttatataaacagggaaaggccaggagtataactttcctaatatctcccctcaagctggtaggttcaggagtaggcacctaacccaagctatgccaatgccttccctagaatttgtgaacttgggaacagagagaaagtgaatcagttcctctctacagagaaatgtttgggacctacagaataataaatgttaactacagttggtttgaggtgaacttctcctggccatgggagaccctttttgtctcatttgctactgtacctagcagagtgcctgcctcatagtaaattcacgttaatgttagttgaatgaatacatacatctattagtttcaagggtggaagctgtattgtactatcatttcccttatgaaattagatttgacttacacactaatttacagcatttttccaggaacacttttcttagtaaccatacaagctgattgaatgtacaagttggaaatgaaacttgaatattacaattgaatcttaggactggaaatattttgataaaccagtttttcacattgctcacctaccacttctgaaaactgcaaaataggaacaatgcaaagttatagtttgtggagtggtacaaattaagtttagagtataaagtctcagatatttttatcaagctttctgacagtgttattctctagtgaaaaataaaagacacagtccctacccttaactgtctcaaattcaaggccactttccagcaagggagcctgttaaaaagtacagatttccgggctccattcgaggcctcctgagcttaaatctaaagagtgggtttaagagtcagcattatttaaaatttccctgtgtgattcttaggattaaccagatctagtgcaaaaaatatgtttatgaatgcttgttttttttaatagtggataatcagaaaacaaaaagtaatccactctgtagaatagtattctggcattaaatgtgactatagaactttcatttctgtccaagatagagtaactgggaccagatttatcctctcatttgaaacaacccaacatataaaaaacaaaatatcatgaaagaacagttttcaagacattagacatcaggcaactaaggacagtgatctcttgtgagacaggaaacaaggtgacccatatgaatgccccaccatgctgccttgagagagtttccaggccacagcacagggaggggaactaaggcagagtaggcagactccctaaattgaggggacagagctgagagtctggggtgaccaaagcaactagagttcataggacagagtactgaagaggagagagctgcacacagacagaacctcagatctgcagaggatctccctcaagtattcagcagagtatcgatcagtgcatgtctaataggaaattccccaacactgagaaactccccaacactctccactttggatggaaaaaaaaaccatccaaaaggattggaaggaacagcgcctgcactacctgttcccaccagtcagactagaaaaatttctaattcatggctcattgtgtagagcgctcagggaagtcttatctctgtaatgagaagtaattagccccaaactgacaactgctccagacctgcctaatggatcatgaacgcaagacccaaaggatcaaactatgtccgagtaactgatctaagtctcagaacaaaacataagaatatttttaggaatacaaaaacatcaactatgcaacaaattcacaatgtctgacatctaatcaaagattactaggcatgtaaaaagaccagaaagtgtgacctataatatggagaataatcaatcaaaaatgacatagaactgacagataatagaattagcaggaaaatacactatgggattaatggcagattagacatttcagaagagattagtgaacttgaagacagagcaataaaaactatcaaaaatgaaacacagcaagaaaaagaatttttaaagatgaaaagagcatcactgagccgtgggacaacttcagtcagcctaatacatggttaattggagttcatgaagaagagaggaaaagaaagaagaaatgtttgaagaaataacgcctgaaaacattccaaacttgatgaaaactataaacccacagatccaaacaccatggcaaaccccaagcacaagaaacatgaagaaaacaataccaagctacatcataatcaaactgcttagaacctatgacaaagagaaaatctgagaaacagaccaaaaaaaaacaaaaaaaaaaagaaagaaattgggagacagaggtaggagaattgcttgaccctggtaggtggaggttggagtgagccaagacatcatgccaccgcactccagcctgggtgacagagcgagactccatctcaaaaaaaaaaaaaaaaagaaaaaagaaattttacacacagaggaacaaacataaggatgacatcaatgtcttatcggaagcagtacaaacaagaacagtgtcataaagtactaaaaacaaacatttctcaacttagaattctaaaccaagcagaagtatctttcaagaacaagaaggcaaaataaaaatgtcttcagacataccaaaactgaaagaattcagcagacccacactataagacccacagtatatttaggacattcttcaggcagaaggaaaacgataacagattgaaatctgaatctacaaaaagggaataaagagcactggaaatgatagctatatgggtaaatctataagttctttttcttattacttcaatctcttataattggcaatttaaacaaaaataacaatgtgttttagagtttatagtatatggaaaaataaaatgtatgacaacagtagcacaaaggtcaggaagaaagacatagaagtactatatactattgtaaggctcttatatgatgtaggggggataagggttatatgtgaagtggtataatatcacttgaaggtacactgacaagttaaagatagatgctataaaccctaatgcaaccactaaaacaacaaaatgaagagttgtgagagaaaacacaggagagaaaacagaataaaaaataatacaaagaaaggcagaaaaagataacagaacaggtggaacaaatagaagtcaaatagcaagaatatatatttataccagactgtatcaatcatcatgttctgcttgtaaaacatgcacttcatacacaaagaatagtttcaaagtaaaaaggtagaagccaggtttggtggtgcatgcctgtagttccagctacttgggaggctgaggcaggaggatcacttgagcccaggagttcgaggatgcagtgggctatgattgcaccactgtgctccgcctgggtgacagtgtgagacttcatctcttaaaaaaaaaaaaaaaagtaagaagatagaaaaagatatactgtgataacattaatcaaaaggtagctggagtagctttattgatatcaaaatatattctcagaccacactgggattaaattagacatgaataacagagagagataaatcgccaagtacttgaaaattaaataacacaattctaagtaacccatgaattaaagaggaaatcaaaagggaaattaagaagtattttgtaatgaattaaaatgaaccacagtatgtcagaatttgcaggatgccactaaagcagtacttagggagaaatatgtaccattaaacacctatattagaaaagaagaaacatctcaaatcaatgacttcagcttataccttaaaagtaactaggacaaaatggagtaaattaaacccaaaatgagtagaagagaagaaataataaagatcaaagtagaaattaatgaaatagaaagcagaaagcaatagagtatcaataaaacagaaaatactttttctttggaaagatcagactgatcaggaaaaatggctatacaatcacggggaaaaaaaacatgaattaccaacatcaggcatgagagaaggggcatcactacagagtctacagatataaaaaggatgataaagaaataaacagatttatgccaataaattcaacaacttagataaaatggaaaaattccctgggagacagaaactactaaagcttatttaagaaggaataaactgaattgccctatactatctgaaaattgaatttgtagttaaaaactattcctcaaagaaaactccaggtcaagatggcttcactggtaaattctgtcaaacatacaatggagaaataataccaattctatacaaactcttttcaaaacattgaaaaaaaaggaatttttcccagctcatcctagaaagccagcattgccctgataccaaaaccagttaagacattacaaagaaagaaaactatagactagtattcctcatgaatgtagatgtaaaaattctaaacaaagtcttagcaaagcaaatccaacaatatatgaaaaggttaatatgttctcacttcagcagcacatatactaaaatataaacagtacagaaaatattatcatggcctctgtataaggatgacatacaaatgcatgaagtgttccagatctttaaaatatatatatgttatgatcaaatggtgattaacccaggaatacagctttacttataatagcccaaaccaggaaacaattcagtgggtgagtggataaactgatatgtccatacaatggaataccactcagcaagaacaaagaacaaactactgatacatgcaacatcatggtggaatctcaaaataattatgctgagtgaaaaaaacaacaaaaaagagttcatactgtatgatttcatttatgtacagtgcaaacaaatctgtagtcagcaaaagttgactgtatcagcctttggtcgacaactatattatcagctttttgattgtcacattagtagttgcttagggatgtggtggggagggtatggagggatgggagaatattaccaacgagcatgaggaaacttttgggaatgatagatatatcactatcctgattgtggccatagtttcatacatatgtcaaacttatcaaattgtacactttaaatatgtgtatgtcaattatatatcaatgaaaactgtttttaaaaataataggcaacattaaaaatggagcaacagggaaaataatcataattagaagatttaaaagcactatcggccaggcatggtgactcacacctgtaatgccagcactttgggaggccaaagcaggtggatcacttgaggtcggcagtttgaaaacagcctggccaacatagtgaaccatctctttccttaccctcgtctctactaaaaatacaaaaattagcttggcatggtggcaggcacctttaatcccagctactcaggaggctgaagcaggagaatcacttgaaccctggaggtggaggtagcagtaagctgtgattgtgccactgcactccagcctgggtgacagagtctcaaaaaaaaaaaaaaaaaaaagaaaaaagaaaagaaaagaaaatagtgtgttaaaagcattatataaaatatatgtatatagcaatcaaaaaatcaaaaatagtatttttgtcatggagcaattttgtgtgcgtggcatactggatggtcttctccattttccatattttctttaattttttttaactggtaattaaaattatctaccgcaaaatcacaaatattaagagaagcactgtcatagtaattctacttttgctgaactttttattttttttttaacagggaatcactttaaaaatgaatgaactaaatcattgtattgttgcaagaattatgcatgggggcatgattcacaggcaaggtaagtttcatatatatttctttctttgccttccttaattttttttccctgtagcctagtgaagaaaatgtttttgtttgttttgtttttgagatggggtctctcactatgttgcccagactggtcttgagctcctaagtgcaagcaatcctcccgtctcagctttccacaggtgcatgccatcacacccagctaagaaagtataaaggatacatataaagaatcttttaaaatcatctttgattttaatcattattggcctccattgtttcttattcatctgcacaggctccagcatgtagataatgaagggagaatatattagagttctgttagccagagcatctctgtattagattactacttacggggaccacgggagataaagcaaataattacactgggcctcacgatgtaggagagacatctgttctagagtaaaagatatatgtaaataaataaccatttaagaagtgttctctcattcatttaggaattagatatgctatttataaattaggacatcatagagttaaataatacaaaaattaaatggtaagagatgtcaaatcgatgattaaattattaatacctgccatggtgagtgcagtcattctgtggagagaattcactaagaactggaatagacaaagaatgatgtgggggttttttttgagacaaggtctggctcagtcacccaggctgtgcaatggcacaatcttggctcactgcaacctctcctcccgggctcaagcaatcctcccacctcagcctcctgagtagctgggaccacaggtgcacaccaccatgcctggctaacttttgatatttttgtagagatgggcttttaccatgttgcccaggctggtctccaattcttgaacccaagcaatctgcctgcctcctcccaaagtgctgggattataggcatgagctaccttgcccagctcgaagaatgattttttaagaaggtgcatcttcagttaactctcaaggatgggcagggtttggatatgtggatttaggctttttctttgaaaggattgagttatatgcactagtatttagaggatgttccaaaaatgattcttctggcagactctctgtctttgagatagggttatttttgtacttaacacctctttccttacccccagagagcgagaagtaacactctaagcattttagtgccttattctcctcttgagaataagaggagatcactgtgtacacaacatgatgtctggcatcattgctgctttcagaggaatccttgtaggcgtagagggtgtacagcactcccacaggaggatatttggttttagattccagtatgtgttttttgtttgctatttttaataatttttatatgttcagtaaagccacaacatcattctttcttttttttttcttttcttttttgttttttattatactttaacttctagggtacatgtgcacaatgtgcaggtttgatacataggtatacatgtgccatgttggtttgctgcacccatcaactcatcatttacattaggtatttctcctaatgctatccctcccccagccccccaccccctgacaggccccagtgtgtgatgttccccgccctgtgtccaagtgatctcattgttcagttcccacctatgagtgagaacatacggtgtttggttttctgtccttgtgatagtttgctgagaatgatggtttccagcttcatccatgtccctgcaaaggacatgaactcatccttttttatggctgcatagtattccctggtgtatatgtgccacattttcttaatccagtctatcaatgatggacatttgggttggtcccaagtctttgctattgtaaatagtgctgcaataaacatacgtgtgcatgtgtctttatagtagcatgatttataatcctttaggtatatactcagtaatgacatggctgggtcaaatggtaattctagttctagatccttgaggaatcgccacactgtcttccacagtggttgaactagtttacagtcccaccaacagtgtaaaagtgttcctatttctccacatcctctccagcacctgttgtttcctgacattttaatgattgccattctaactggtgtgagatggtatctcattgtggttttgatttgcatttctctgatgaccagtgatgatgagcattttttcaggtgtctgttggctgcatggatatcttcttttgagaaatatctgttcaaatcctttgctcactttttgatggggttctttgtttttttcttgtaaatttgtttgagttctttgtagattctggatattagccctttgtcagatgggtagattgcaaaaattctctcccattctgtaggttgcctgttcactctgatggtagtttcttttgccatgcagaagctctttagtttaattagatcccattagtctattttggcttttgttgccattgcttttggtgttttagtcatgaagtccttgcccatgcctatgtcctgaatggtattgcctaggttttcttccagggtttttatggttttaggtctaacatttaagtctttaatccatcttgaattagtttttgtataaggtgtaaggaagggatccagtttcagctttctacatatggctacccagttttcccagcaccatttattaaatagagaatcctttccccatttcatgtttttgtcaggtttgtcaaagatcagatggttgtagatgtgtggcattatttctgaggcctctgttctgttccatttgtctatatctctgttttggtacgagtaccatgctgttttggttactgtagcctcatagtatagtttgaagtcaggtagtgtgatgcctccagctttgttctttttgcttaggattgtcttggcaatgcgggctcttttttgggtccatgtgaactttaaagtagttttttttccaattctgtgaagaaagtcattggtagttttatggggatggcattgaatctataaattactttgggcagtatagccattttcatgatattgattcttcctatccatgagcatggaatattcttccatttgtttgtgtcctcatttatttcgttgagcaatggtttgtagttctccttgaagaggtccttcacatcccttgtaagttggattcttaggtattttattctctttgtagcaattgtgaatgggagttcactcatgatttggctctctatttgtctgttattggtgtataggaatgcttgtgatttttgcacattgattttgtatcctgagactttgctgaagttgcttatcagcttaaggagattttgggctgagacaatggggttttctaaatatatagtcatgtcatctgcaaacagggacagtttgacttcctcatttcctaatcaaataccttttatttctttctcttgcctgattgccctggccagaacttccaacactatgttgaataggagtggtgagagacggcatccttgtcttgtgccagttttcaaagggaatgcttccagtttttgcccattcagtatgatattggctgtgggtttgtcataaatagctcttattattttgagatacgttccatcaatacctagcttattctgagtttttagcatgaagggccattgaattttgttgaaggccttttctgcatctgttgagataatcatgtggtttttgtcgttggttctgtttatatgatggattacgtttattgatttgcgtatgttaaccagccttgcatcccagggatgaagctgacttgatcgtgttggataagttttttgatgagctgctggattcgacgttccagtattttatggaggattttcgtatcaatgttcatcaggggtattggtctaaaattctgtttttttgttgtgtctctgccaggctttggtatcaggatgatgttggcctcataaaatgagttagaaaggattccctcttttctgttgattggaatagtttcagaaggaatggtaccagctcctctttgtacctccggtagaattcggctgtgaatccgtctggtcctggactttttttggttggtaggctattaattattgcctcaatttcacggcctgttattggtctattcagagattcaacttcttcctggtttagtcttgggagaatgtaggtgtccaggaattcatccattttttctagattttctagtttatttgcatagaggtgtttatagtattctctgatggtagtttgtatttctgtgggatcggtggtgatatcccgtttatcatttttaattgcatctatttgattcttctctcttttcttctttattagtcttgctagcggtctatcaatttttttggtcttttcagaaaaaccggctcctggattcattgatattttgaagggttttttgtgtctctatctccttcagttctgctctgatcttagttatttcatgccttccgctagcttttgaatttgtttgctcttgcttctctagttcttttaatcgtgatgctagggtgtcgattttagatctttcttgctttctcttgtgggcatttagtgctataaatttccctctacacactgctttaaatgtgtcccagagattctggtacgttgtgtctttgttctcattggtttcaaagaacatctttatttcagccttcatttcgttatttacccagtagtcaatcaggagcaagttgttcagtttccatgtagttgagcggttttgaatgagtttcttaatcctgagttctaatttgattgctctgtggtctgagagacagtttgttgtgatttttgttcttttacatttgctgaggagtgctttacttccaattatgtggtcaattttagaataagtgcagtgtggtgctgagaagaatatatattctgttgattttgggtggagggttctgtagatgtctattaggtccacttgttgcagagctgagttcaggtcctggatgtccttgttaaccttctgtctcattgatctgtctaatattgacagcaggaaacatcattatttctttaacttctctttgttatattactgcactggctaggaccggcagtctttcaaggagtggtatagtagacatcccgtcctattcttgtttttaaacggaatctaaagttagccgggcatggtggcgctcacctatagtcccagctactcaggaagctgaggtgggaggattgcttgagcccaggagttcgaggctgtagtgagctatgatcacgccactgtactcacctgggtgtcggagagagaccttgtctctagaaaaaaatgtttttttaaaaaggaacctttccaatatttcttcattaagaataatgtagatttttagtacatgccttttattagggctaaagaagttcctttatattcttagttgctgagcattttaattgtgaatgggttttgaatttaatcaaatgctctttcagaatctgctgagatgatcatttgtttttttccttttatctgttaatgtggtgaatgtcttttaaagatttcctaatgataaactacccttgcatttctcagataaactcagcttagtcattacatattatcttttttatgtactgcccgactgtctgctaatgttttgtttataagatctcagtatgtgcatttatgagtgagactggcccgtagttaattttcctctcttgtatttctctgattttagtttcaaagttatatctacttcacacaatgacttggagagtattccctcttcagttctccgagagattttatataatattggaatgatttgtgtcttgaaagtttggcaggacttgcctgtaaagtatcacagcctagtgttttggtttttagttttaagaaagttttgtttttgttttttaacaactgcttcaatttctttaacattaaaaggccatccaggctttctatttcttgagtgagttttggtaaattacattttcctaaaaaaaaataagttttaaaatattgcagagagcttcttcatagtattctctcatctttttattctctgccatctttgtcattatgcccctgttcatttctaatattgtttatttgtgcctactctttttttcttgatcaaccttgccagaggtttgttcagaaacccactctgggtttggttcattctcttcattatatgtttattttctgtttcattgttttatgacctaatttttattatctcctttttttttaactttctattggttttggctaactttacaaatttgacacatagttcatttatttccagtcttttttttttttttttttttttttgagacagggtcttgctccatcggccaggctggaatgcagtagcataatcatagctcactgcaacctcgaactcctgggctcaagtaatcctcctgtctcagactcctgagttaggactacaggcaaccacactcagctaatttttttaatactttgtagagatagagtcttgctttattgcccaggttggtctcaaactcctggcctctagtgatcttctcgcctcactcagcctccgaaaacactgaggttatagacatgagccaccatgcccagccttcttttcttttctttttttttttttttttttttttttgagatggagtctcgctctgtcgcccaggctggagtgcaatggtgcaacctctgcttccgggttcaagcgattctcctgcctcagcctcccaagtagcggggattacaggtgcccaccaccacgcacagctaatttttatattttagtagagacggggtttcaccatattggccaggctggtctcaaactcctgacctcatgagctgcccacctcagcctcccaaagtgctgggattacaagtggaagccaccatgcctggcccagccttcttttctaatatgtgcctttaagactaaactctccctctaagtactgtcttaatgtatcccaccagttttgacatgacgcatttttataactcagttctaagtatttttatatttctattatgatatttttcattgacctatattatttataattgtctgttacttttcacacttaacaggattttctgtatatctttttgtaatttacttctaacttaattacattgtggtcagagaatgtagtctgtatgacaccatttctttgaggtttgttgagacttgctttatggcatagcactttaatcgtttttataaatggcccacgtgtacttaagatgaatgtttattctttaattgttgcatgcagaggtatctttttgtaatgaagccaggtcagtgtgtacatttctgcacaatttataaataaggaagcaacattgtaaataacactctaagcattggttcttggtcatttctttctagctgaagtattacaagatgctgaaatgccaaccaaaagattaaattatctttaacagaatttgctgttgtgtagatattatcatgtcacaactcttggaaaattgacaaccttcgtatcatatctggtagataacgatagcagccaacactgtcatggtgcttggtatgtgccaagaacagttctaagccttctgcatttattaaatttgtttagttcttaaaacaatcctatgagatgggtactattttcatctccattttacaaatgtgaaaactgaggtatggagagtttcagtaatttacccaagatcttaaagctagtaagcaaggaagctggaatttgaacccaggcagtctggatccagaagccatacttttaaaccactatacataccacctctctcagaaaaatagatttctgcagccatccatcaaaactgtgccttccacaagtagatatatctgttttgatgaggttactacatgagttaaataattctgctgcaaccaaacttgtacctgcctctgaaatattggccctcaatattcaacttagtttttaaaaattacattgatgcctctggattttgttactatgaaagcatatatcatttcatgtttataatgttatataatttcttaggtacacttcatgttggtgatgaaattcgagaaatcaatggcatcagtgtggctaaccaaacagtggaacaactgcaaaaaatgcttgtaagtaaatgaaagtttttcctttcctaaaattgacttttactttgttagcttgtttttaaatatacaaataaggagtattcttctgtaatcagagaatttctggtaccatatttatgtggacttgaacttatataacattcataaaactgacaactagaaaaatgttgaaatacaatagagtttacaaacattttgcctgtctttagcagtgtgggctttaacactctccttttatcctttatctcctgtttcttaccaagcagatgattaaagaaaaccttttcagtgtttgtacatgtgaactagtttctcactgacctcaactctcctgacatcagcagtgtcagaaacctctttcctgttgagctgagtcatagccagctgtcgtggatttctctacagcatagaagggaggaaagccacggtagaccaggccatttttgaccatacatatccaaaatctgtattcaaattaggctttggattttttaaaaaggcaaaatgacagcctttgcctatgttcattgtcatagcaagcagacagaggtgtttggggcctctgatcccttttcccactgcagtgtagtagcacccaggttatgaatacctattaagtatgaaataagcttcacagactcaccaaacatttttttttcttttttttgagacggagttttgctcttgttgcccaggctggagtgcaatggcgtgatctcagctcactgcaacctctgccccccgagttcaagggattctcctgcctcagcctcccaagtagctgggattacaggcatgcgctaccacaccctgctaatgtttgcatttttagtagagacggggtttctccatgttggccaggctggtctcgaactcccgacctcaggtgatccaccagccttggcctcccaaagtaccgggatgacaggtgtgagccaccactcccagcccaaaatttttttttaaaaaaaagccaaaattaataagcaaaaagtggctgggtgcggtggctcatgcctgtaatcccagcactttgggaggccaaggtgggtgaatcacctgaagtcgggagtttgagaccagcctggccaacatggtgaaaccccgtctctactaaaaatacaaacattagcaaggcatggtggcgcgtgcctataatcccagctacccgggaggctgaggcaggagaatcactggaacctggaaggcagagtttgcagtgagccgagatggtgccactgcactgcagcctggatgacagagcgagactctgtctcaaaaaaataaataaataaaaaatttttaaaagtaaaaagcatattctatggggtacaccattataatgtggcatactcaatgtaatttttatgtaattacctagtctattgtctaattcaatgtatattcacttttgaaaggcatgtcacttagaaagttttgtattcacatctataaaaaggtgaccattgaagatctgtgagaccattgctgtatgagcaaaaggcaattggctgctgggcttttcccaggaacttactctactgttaactcgagcagtccctgcttcatgactacatttcattttccggctatgtgctctcagatggcttgtgctaattgcccccatgtgttttgagtggcttcttacatggttttgtgaacaattgtttgtaagaaaacttttctttctttcccaccaccccccctccagagggaaatgcgggggagtattaccttcaagattgtgccaagttaccgcactcagtcttcgtcctgtgaggtaatgactctaacaaaccacccccatctgctctgagttcttaactaactgtctgctgatggctgtatgtttttgctttctgggaaattgtttctgcctgtgctgttagatcactgcacaccaattttacaacaaagataacggaacagagtaggtcccatccacctactcagccctgcttccatgtggatctcctcagcactttgaactttttgcaggctgaaatctgagcaaaatgtagagaagttacaaatgatgacataaggcttaataaggaaaaaacggagtgtctgagggaaaaaaactaaaggccataattgcagtaatatttccaggaagttcattcacttcccttgttaagaaatcacatagatagttcttctttctaaggatctgagaagtgatctatttctgttgagatacagttgttcatacaattgtgacaggtctctagatggaagttaagtctgcaatgaattgataattgacttcactagagggaaataggcttttgcaaccttttgtaaaactgtttaaatttagaatggtatgtgatctgtaaacaagtaagttttctagagtaatacagccccaaagtttctttcttaaaataggcttatcctgtagaaattatagttcttccaacctatattattcagttttgtgttggttgttaaatgagattcaaaaatctattctttttgtattggaaatataaatgggcataaatgatatcatcctttggtcattgcacgttcagctcgagtgttatttattgaagcttgttctttcatgtgcatcttccgagagtatgtgcatcaatatgaagtacacacttcctaaagtttatttttaagactgacaggtaacttattggatttgtacttaggagaacctgagagagaattgtaatacttctagtctctagtgatggtgtaaatttcataagaaaaatcagaggcttcatattttttaaaagcctattgaagatacatattaaaatgtatagttttgtcaagtatatttttggtgagccatggcaattgaggtgtccgttgtaacgggtcttgagctcctcttggtggctttttatggaacttcaattaatagtatatttcaaaagaaaatgcagaattgcttctgttccaggattcagagtattgaaatttgttacctagaacacaaactttgctgggaaacaaagaatgtcacacttaacattctatgtaaataattttaatattccagagttacagatgtccttatatcatttctcatctgttgaagaaatttagtaaatacaattgacttttgtctttttggctaactaaccagaaggtactgttagttattaatacaacataagtttctctttttttttttaaatggtcgaactagtttggggtggaaccagtatcatagatgtaaattctatgttcttgagtaagaagaacccctcttaccttctttgcctttgaatagtagaaaaaataatgatacttctctcctagctccacctccagcctttttggccctcctgttccctggcagaattcaagcttgtggttggactcttcccagctagggcaatacttcaaaaaaaaaaaaagaaggctctctggccacctgcatctgcatcccccaggtccttggttaaagagtagacccctgcccctcaccctggctctactgacttgagtctctgcgggtggcacctggagatcagtcttgctcactaacatatgagaatgctcttctaagggatctcattacctttaaggctgacaggttctagaaatgctcttaagtcatctggggaaaaaaaatgtcttttaaaaagacatgcacatttctaaggcttaaaagaactctacagaagcaaaaattaaaaagtacttatttccttcctctccttgttcttatcgttaaagttgatttggacactaagggaatggagcctggaaaatattttgagtgtatagaatagtagagagaaagcaagcgatagaggagcctggatataggaagagtggctgtggctcctaggatctttgctggaagtgtaatattgttataggcttgagattattgttttaatcaatctgctaaaatagtcttaaaaaaagagttcttctctgatgtatatctcttttacccttactagtaataatatttattctataatagaaagattctgaggtgattgtaacatgtgaaatcttaggtttgtttctcttcagattgggtcagttagtaactcttgacacaggtactaaaaattattaaatacttttcaaacctaatctttaataaaaattaggcagttgggatcttcagcacgataatttatggtaatgtttgtcatcttatacttgatagggttttaatatcaagtcactcttctgggtctcattaaaagaaagaaaaggtatagaatgttagagataggaaagaattgattaatgaatgacacagtcatcacttaaaatatgtgagccttcgaactgcaaaatttttttcatacttctgtgaaatcatgcaagcaagtcagtatggcacctatacagctcaaacctcaaaggaaatggttgtcagactgtggttgttactgttgatgtaaatatctctgtgtttctgtgctggtgttctgtgttaatgaaccttgtgtcttatttcagagagattccccttccacttccagacagtccccagctaatggtcatagcagcactaacaattctgtttcggtaagaactttagctccacacagcaaagtgtgacaattttgttggtgctcacctgccatgagtgttctagttacatgtgttcagtggaa

SEQ ID NO: 1184 - DNA, 364160 bp, mus musculus
ggagggcgtgtctgcgcgaggcgggtgagcggggctggcgagccggtcggctgctgaggcgtaggggcggagcagaaggcggcggccgcggctcccgcccgcacagagcgccggtcccgcgaagccccctcccactcccgggcgggcggtggcggctgcgggaggaggagaaagaggagggagcgtctctgccgccgcctcctggtccccagcgccgatccgccgccgccgccacctccctccgcggcgatcctcgctccatggtcctgccgcggccccctctgtagcccgagctgctccgcgacgcgacggagccggcctcggacagagggagcggtcgcggcctcgcggcccgcgcgggctgacgagcggagagcgcgacgccgcgcggtccccgaggatccgcacgccgggcagcgcggcccgagcagcgcgagaagcagcgggcgggcgggcggcgccgggcccgggccgccctcgctcccgcgccccggccccgccgcccgcgccggggcggtcgcctgcagaggaaggcgccgcagtctctgggcctcgcggccccactcgagcgtcctcggcaccgagggctcgcgggtcctgaggggaggaggcgatcccggggctgggcactgagctcttgggcgcccccacccccgttttcgaagccctccacgctgcggccgctatcccctccggaccatggccgacgacgacgtgctgttcgaggatgtgtacgagctgtgcgaggtgatcggaaagtgagtctccacgcgagggagcgggagtgtggaaaaatgcatttcagtgatgccccggtcttcccgcacccgctcggggcctgccccctgccctccctccttcccctcttcccctctcgtccttctcatcctggagtatttatagacgtgtacctggagctcctgccaggcgggggcctgggggttctcagcggtccattgaggccaccgagccgaggttggccaccccgtaaggcgtggggccggctgcctgcattttatctgacggttgcacagggacgtggcacagccgattttatagttgcttcagttggggttattgttaccttgcatgtaccatagaccatttttgaaacagagcagcttgcatttcctttgcttgtgtggtgagagagtccagggttttaattgtggggtgtgtgtctattgtgcgggatattagacagatgcctttgtgtacaccccatgctcggattggagggggtcatttaagacggggtgctttcagtttcagcaaattccctcctggtgtacacgaacgtggaaagagttgggggcattcgaatttttaatgccttgttatgcaatgactgttcaatcagtgctcgagactcccctcgactgttgttgggatggtggttagcgtggtagagccgtctgctttgagtcaccgggctggtctagaatatagaactgacagtccaaatgctcatcctttcatctgtgttgtataattacgctggggaaaagcagggaatcagattaatcacagtgctgattgagaattaaatctgcagttcctcatctaattgtccattccttaaatctattttgaatagtttccttttcattcttgtcaaacagtactccaagtgcacaatcctgctaatttgcttgtgaaggaaatgctggcaatctgaagttgatttcctaacacagcgtgtattctgcggctttagaagttgaggagataagatttaagagcaaatttttgcttaataaggatcgctagagctaacattgaaatatcttacctctttttttttttttttttttttttggaagcggtgctttattgtctattttaaggtccacagttgggaaatgaaaccaagaccttaaagcagttggccctatctcttttaagttgtctgcagtactcaatttcaatttgagtgctaatttgtttccttttctttccatattgaggtattacagtgttgcctcacatggtgaaattgtgggtagagcttgctacacactttactcagacccaattgatgtgaggacatgttactccttgccctattgttacatgaccagccagacttaaaaggaaagtatccaaatgtgtcctgttaaagtgcttgtggaagtgttctagaacagcactgtccaaaagatatattatgagccacatttgtaatttaaaattttctagtagccacatttaataaaaacatacaggtgcaattaattttaataaaatattttatttaaccctgtagatccaaacttaacatttcaacatgtaatcaatatgaaaaaatattaatgaaatattttacatcttttatgctaagtctttgaaatcccaatgtgtattttacactaatagcacatctcaattctgacactaagctacatttctgatgaaaatcagaaatacttaatctgtatttaggtttcataaaatttgcgtttgcaaaagtatattcacatacccaagttgttcccaatatacataaaagttttccaataaccgaatcaagtacctttttctaaatttaaattttaattaattaaaattaaatacaattcaaaattcagtttcccagtcggaccagccacgtttcaggtgcccagtagccacatgtgaatagcacagttctagagagaaaaatgcatcaaaaatctccttggtttcctcattcttaggagcacccagtgaagataaattaggtgtttcccaaaagcctccaaatgactgtatgtgtgggtgaatgatgtttgttgcatcttagttatagctgatgtaaatgaactaacaaagtcataattggaaaatgtgagattaaaatgttaattatattgtgaagatgtaaaatagccatctctgaatcagttttggtaactagttctgattccttaaagtctggaagggtgatgatgtgatctctttggatatcaaaaagaaatggtcagaatcacattaacacagtccatattctgctgatttgtaattgatagaatatttttcaggaaacacccctgggagaaaaaaattcatcttttctgactgtttcagagctgcataaagaggggcagcaagctaattttgaggtgataggtactctatggctaccttaactactatgaactgtgaaatctcattcatatcctacaaaatctgacttggtcagtgccaattataaaatgccattatgtgaaataatgaattcaagctagccttattgttaaagaatgtaataatagtgttcctcaatctgagtaaaggttgaaggtttctctagtaaattgtcttagtatatattgatctggaaattgaaattagcttgagattttcttgcagggaccttgacagcatacatttttaacttataatttgttcacctctgaatttgaacagaaagcccttgaagatattcacatgtactgaaaacctttttattgatttctatccaagttctatggaattttgattttcttttttaccaaattagtatcacaagttgtttttcaccactagatcttaataggttttaatttttactaaggtactttaaaatagatttcacttttcaagactaattgactacccactcactcctctacctacgcaaccacctactcactcacccactgtgtacttggccttacttgatggcataaatgaaagttctcgtttaatttagacccttcagtgtgtttttttcccccttggttgagaaagataacttacagagttaatgaggttttgaaatataagatcattatttggaatatgttttctttccagtggttgcagcctttacccttgttaaagctgtctttgagggaacatgtgcccaatttgttacaaatattggaaggatgccgtttccctttttaaaaattaaaactcttttccctgtgtttctcatttttgaaaatcttgcagaaactcctttgagtgactgttggttctataacattttctatgtaactatcttttaaatgactgaaacaaatctccaataataagaccttatcatagtcccaaaacttcttgtcttagcaaatgtagcgattactggaaaggaagggcgttatgcaaatgaggttaatgactaatttttatgtcatgatcatttactgtatcttttacaattataagtaagtgtacaaccggtaatactacatgaaggaaatttaagacaattcatcgaaattaaaacatagaaaaatgcctactttcttggtacagcagtgtgtatgaaagggaataacaaaatacataccatttttaccttgtgttaggtgaatacttgccctgtttagtagcctgtagcttcagactttcctgctctggtaggacatacactaaaattggaatgatgcagcatgacccttgcttaaggatgacgtgcaactttgtgaggcatgctgtatttgcttactcctcgagagcacttttatttaattacagttacttatttatggatctctctagttcactaataaggagcttcctgagggcagggaatgtttcttacacatctttctccattaacacagtgcgtgcaatgtaactgcctttcattagctgtggaatgaattgagtagttttaataaaatctcattaaaaggcaaaaaagcatgtttgtcaacctcagagcaattattgtccgaagagcctgcattagtttaaagtagtggttctccacctggctgcatattagaatcatccggggagcttttaaaaaagatcaacgccagagccctgtgtcaaagcagtgaagtccgagtttctgggactgggtcctggtcactgacatttttttaaagctctctgtgtgattctaatatgcagctataatgaggaatcattggcttaaaacttagattatgtatgtaatattttgggactggcttttcagaggcttacaattcttacaaagtagaataaattctttttggaaggtattgaagctaaatggctaaaacatggattttatcttctatgcacttgtgtttctcagccttattgtgtaaaaatttagttttagcttgtgtttggctttgatttcttgggccttttaagatccacattgatttatgacactcatctaatgctaacatggcgattgtctgacgtttggaacaacacagaacaaggattgcttcaataacagttgatgatggttttccactataatggcttgatttaatatgaagaaatttatcagtttagtatggattgtgtttgtacatacactctattaaaagagtatggttaagttgcttgtatgctttaaattacatacttgtgattccagtaatgctgttagctggagaattgagttaatgcagcctttatgtaaatactggattaataatacgtaaagtatataattcagcatacagaaaaattcagctttactaatttgtactaattactatgactttcacatgtattgattcatgcagtgatttgggtttctagtaccatagggagaatttcgcattgtgttgaaaaaatgtttcccggaaattttaactagactttgtaggtaaactagtttttaatgttaggaaaagatcaagtgtttgcctgaaggaaccgagaattttccagaaatgagtagatattccagaaataccagtgatcgtgaaagcagtgcatgatcacagtgacagccaagtaacaaggtaaaagaagtgatcagcagctaaattgttggtggcccagaaagaatgcaagccatgggagttaagctgtacttctacagaggaaaatccttttgaactcagggtgtggatgctacagatagcaggcctcaatgggagtggggaagcaatattgattcctgatgatcctaggatcatttggagggagaacagagctactccgttgcttttctgcatgtatacaaccttctctagtctcttcctgtctgctttttacagattgctttagggtgtgttgtttgaagttgtcttcataaatacttcctgtggactcccttaatttttatgtccgtaacacgcttctatgtacttgacatacgcagttcagctctctccattttttccttgtatctgcaacagtttcacctgatgaactacgtctcaagtgtccctaaattgtgtacctggatatttcctttaaactgaaaattctgtctccagctgtagttctactcaataaattgaaggagcagatataccttgcttcttgagattattcttgaattattacattttcttaaacgttttcacattttaaatgtggtaggagcactgcatttaaaggaactttgacataaggttgtttaaaaaacttctataacttaaagcttactttataaagggattgacatttatccctctaatgttaggcattttggatgtattatttaatcatacccattttacagagaacactgagattcagagggggtgatcagtaattcgcctaagatcacacagattccaacgcggttccatggttttaaagtctgttcatttcatgctgcattctgctgctaattcaagttgtgaaaatactgtgttggattttcttaaagacacgtcttcattttcagagtttctatactgcaaattttagttgtttgactttctggttaaatttcttatttcttcagtagaggttccatatactattcattctttcatctgtttcttttttatttttgtctttctctttaatgaaacatcagcatttgttaccaaactaactggtaaatctagcaatggaaatatagactcttggccatctgtccaaaatataatttgttttggaactttctctacttcttttactctccaaattttttcttccatttcccttgccccaacagacaggatagttgattaattacccctaacttgccaaaccagaagtaataaggtttcagaggtagatgtttgttggaagtggggtggagtggtttccaaaggatagttattcctttatcctgtgataaaaatacggagattgttctctctgattctgaaaaccgtgtagtgagctgcagccgctgagtctgtgagcttctagctgtttgccagcactgtacaccttaaataatcaagagactgagttaactattgcagagcaggtaccggaccccagccaacaagctgatgggatgtgctgttctcacattttttggttttattttttagttgcaactgacagtgaagattctagaagcaccaaatatggctctggatttatgctgtgggatttaagatgctacagaacttgctctccttcctttctgtcctggagccactatggtattggttgtagagcccaagtcagtatagagtctctgacttctaccctgggaaaatttcatttccgaagctagtttgttttgaagttaatgtttatttccaacattgagatttaataattttgtgttacttttctttattaattagtttttatacagtaaattataaaagtaatgatgcacgtagtaaattttattttctttttttgagatggagtctcgctctgtctcccaggctggagtgcagtggcacgatcttggctcactacaacctccgcctcctgggttcaagtgattctcttgcctcagcctcccaacaagctgggattacaagcatgcaccaccgcgcctggctaatttgtgtgtgcgtgtgtgtgtgtgtgtgtgtgtgtgttttgagacggagtctcactctgtcgcccaggctggagtgcaatggcgcgatctcggcttactgcaagctccgcctcccaggttcacgccattctcctgcctcagcctcccgagtagctgggactacagacgcccggctaatttttttttttttttttgtatttctagtagagatggggtttcaccatgtaagccaggatggtcttgatctcctgacctcgtgatccacccgccttggcctcccaaagtgctgggattacaggcgtgagccaccgcgtccagcctagttttttatttttagtagagacggggtttcaccaggctggtctcgaactcctgacgtcaggtgatccacctgccttggtctcccaaagtgctgggattacaggcgtgagccactgtgcccagccatacaatttaaaatataggtgatacaaagataagtagtgagtctgtctcaattctcctaccatccatatccccattctctagaggtaaccattgttcagtttcttctccatctttctggaagctttttgtttaaaagtgagatatttgtatactatgctgaaatattgatttttcatgaataatagtatatacttgatgatcttgtcatatccatcaatgtatctgtctgtctctatctcctctttagctgctgcccagtattctgtcatatggattgttactttggctttggattgagtgcaagccaattgtaattttacattgcttgaaatgctgagctggaatttgggtgagaggtatggaatggcagtgaagatttgggagtcatctgtgtggaagtaaaactgagtgaacaagttcttgggggttgactgctctagggctcgtggtttggagtataactcatagagttagaagaatcaggataatgggctgcacagaagtttaaaagaggggggaggatcaataatgtaaaatgccaatatactctgaggactaagaacacatgtggctataacagagaaacaatttaaagcacttatcaaaatgaatattatgtttaatagtcaattcatgatgtgtctgaaaagctaggtctggcttcttttctgtggatactagtaattttatactatctctctgtaaatctatctcagaaccaacatatttagggtaaaaacaaagtagatttctttttcactctaattgtgttttgcagatttctgatgactggcttttaggtaaaatcatttggttttcctaagattatgtccttttcattcccgagcttgtgcatgactgtcaattaaatggaagcctttcatgaagtgacaaagtaagttttagatactttacatttactttaagttcttggtatgtgtcaaaccactgttattgtcttatatctttctactataggaaactgaattctttctagcctcaaggatttttgtccacgttggatgaatgtagtactgtcctcctctttcacatttcttctcccatcacctcctaactaaatttgttcattggctatttttggttgtccacatccattcacaataagaaacgattgcttcgttgtacataagccagttttttggtatctaagtgcgtgctatttcacttcagcttcttgtattctatttattactgggctgttgtacattgttttttctcccaatctttgtgatttcttttaatatactttctttcctttttgctttgtaatcattgttttgagtatttgaatcatttgcaggtaagaatgtggattgttctgtctctcatgtagtttaataatatccaaaatatactatgttcagtctgtatttcaggcttttaacacttaagttagagtattttggtatatttaaatctaggatagaagtacactgtattaccattcaactacatgcagattttaatgttttcttaaattaaaggatgatgatattcattcagttacagaggtctctctctctagtccttccatggtgtgcagattaccattatactactgctatttcatagattctaatttgtgtttttagaaaacatcatcaattcttggccttctttcttacccttggtatgtgatttcccctaaaggtatggaatgcggttgctctgtggcttgttaggcagcccccttctgatctggtaacctttgggcacagtgtggctattttctccttatttataaaaggaatgatagctgcttcacaaaccatttgtgtggattagtgaattgtaaagtgcagcataagtattttttatttctagaatgtctctgagatactcaaattacttttggcagttatgtacgtaagtttcaacaatttccaaatgtgcacattctcagtgctaaacacaggctctattacataaataatatggtgaaatgaacattcttttctaccatgtgtgtaaaattgttagtggtgctaacttttattcattgttcatttatgtattcatttctagctatgaggtcctgggcaagttagttagcctctctgaccctcagtttctttatctgtaaaatgtggttaatggtatatactttgtaaggttgttgtgaggattgaatagcatgatctatgtgaaatgtctaaaggttgttattttaattgccattgtcattattattattttttaaattttattattattatactttaagttttagggtacatgtgcacaacgtgcaggtttgttacaaatgtatacatgtgccatgttggtgtgctgcacccattaactcgtcatttagcattaggtattgctattcaccaaacacttgagttctctggcctcagggagctcaaatgagttattcacacactcatgcacatatcctctgcgtaacttggtaaccaacagacacacatagtaaaatatttggtcagcagttgttgaatgagtgagtacattaactgagaaatccagagactgtgtgaccacctagtaggagaaggaagttggggaaatcattacagaggaggtgaggcttgaatgatttgtcggtcttctccttgggtaactcatgttatctttgtaggcctgcttcctcatttataaaaaggagtagaggaatacaggtagggaaaattgaagaaattttaataaagtcacatatattactttaaaaaagtataactttcataaattatgtatattataacattatatatatttttatatatattttatatatatatatatataaattacttgcaagagggaaggagagagggtctcactatgttgcctaggctggtctcaaactcctggcctcaagcagtcctcctgccccaacctcccaaagcgctgcgattacaggcatgaaccactgcacccagcctaagaaatatattgaagagtcctttctgtctttttaaaaactgtccaggccgggtgcagtggcttatgcccgtaatcccagcacgttggaaggctgaggtgggtggctcacttgaggtcaggagtttgagaccagcctgactaacgtggtgaagccccgtctctactaaaaatacaaatattagctgggcatggtggtgcgtgcctgtaatcccagctacttgggaggctgaggcaggagaattgcttgaacccaggaggcggaggttgcagcgagccaagattgcaccactgtagtccagctggggcaacaagagcaaaactctgtctcaaaaaaaaaaaaaaaaaaaaaaaacagaaaacaaacaaaaaaactgtccagtgagctgtaatcactgcactccaacccaggcaacagagcaagacactgtcttaaaaaaattcttttaaaaatgtcattgctctcattgttcaactcccacttatgagtaagaacatgcagtgtttggttttctgttcctgtgttagtttgctgagaatgatggtttccagcttcatccatgagaacatataggcacagggaggggaacatcacacaccggggcctgttgggggttggggggcaaggggagggataacattaggagaaatacctaatgtagatgatgggttgatgggtgcagcaaaccaccatggcacatgtatacctatgtaacaaacctgtacgttctgcacatgtatcccagaacttaaagtataataaaaaaagttaaaaaaaaactgtcattgcctcttatgtacatagaaaatacagtattgagttacagattttcataatttgtttccaagtctgttctagattataattccgtagtgttgtgaaaaactcccaagattgttaaaagaaggaattttgtatcacacttcttatgtttgcatttagacaattgacagattaattaattgttcataatgtgaaatttcaagactgaaaaaaggaaaatcccagaatatatatttcagaaacacccatatataggatttatgaatattgtagtgttcctttatgtaacttcccaaaattttattacaacagcaatttctacatcttaacagtgagcaaaatgaggtggaaagattctgaagttgtagtctctgacactactgggcactgaatctaaataacctaaaaccacagaacagtatttcatcttctagttcttattacattgtcaggtgtaagaatgatcatgttgaaattgagtggttggtctgtttagatcacttctatggaaatactgcttagattggtttcagaaatccttggacagtattatttatattgcattatttaggttagaaatttttgctgacttccatctgagttattagttcaaaagcagaatcatcagcctttatatggaatctctgctggtgctcatcttaggcttagtatcttcttaactgggtttttgttagcagtatagtgtggcattaaatttgagactatctttttaataaattttttaaaaattttgtcagttgtagaataattagatacttgtaaaacaagcaagaagctgttttcactgaggactttctttaattacatttcatataaatttaagagaactgttactagaatattaaaatcacaggttaaagtgagaatgtatttcacataatcaacatacataacatttttaacagcatgctaaagatggaaaaaacctttaccaaccatacatattataggcaaagctttaaaaaaaacaaaacattttgctcttatggatgtgaaagtaatctgtgtaaatatgtatttaaatgaaaatatctattcattatcattgcagaaggagtgtgggtatctggagagggagcattctaaacttgctgctctactttttggattatctacattaatatttctcccattgctgagtatttctgttatactgctggatcatcatacttccataatctgtgacccacttgctctaatggtagagtgggctttaaactgccatctgattaaagttcaggtttcttagttagacttgcctgggtggcttcagaattaggcccacaaatatgaatatggacttgaagatcttactagaacaatattttccccgataaagacacatccataaacatggtcctaaaaagatatgtgtaagttggatttgaaaaatgcaatttaagagttactaggaaaaagggattttaaggaaacattttaagtaatttgtgtgatatcaccagttggtttttcttcagtttcttcatcttgtaaaagaaggatagtaatggctatattatctacctcatgagattctcatgcacataaaattacataattcttaagtcttaaactaccttacgtatattattatttcaattttattgaaataaaacactttttttttttgtgatggagtctcactctgtcacccaggctggagtgcaatggtgtgatctctgctcactgcaacctccgcctcctgggttcaagcaattctcctgcctcagcctcccgagtagctgggactacacatgtgcaccaccacgcccggcttagtcttgtatttttagtagagacagggttttgccatgttggccaggctgatctcaaactcctgagctcaggtgatctgcctgcctcggcctcccaaagtgctgggattacaggcatgagccactgtgcctggcccaaactaaaacacttctaatggacttgtactttggctgggcacggtggctcacacctgtaatccctgcactttgggaggccaaggtgggtggatcatttgaggccaggagttcaagaccagcccaggcaacatggtgaaacctcgtctctactaaaaatgtcataaaattagccggccatggtggcgtgtgcctgtaataccagctacttgggaggctgaggcgggagaatagtttgaacccgggaggcatagtttgcagtgagccgagatcatgccattgcactccagcctgggcgatagagcgagactaagaaaaaaaaaaacaaaacaagaacatgggctttgttgacttttctttgattttgtaagaatcatttacctttgtctttaaaagtgattttattttcttgtttgatttatagacattaatacttctcaactccttatagggctcagaacatgttaggtgaaaatattgcataaagagatttgagaatgaatggggcaatgataaatttacactgaagtcaaagtaaagaaagacttctgagtattttgttttccccagcttctttttaaattgcttaattttgttggagctttgatgtgtggaacttactacaagtgacaaatgtttgtggccaatcagatggcacatcctgttccatctgatattgaacatcctgtttagtcagtgaggtttagatcagtggttttcaaagtgtggatcttctgaccagtagcagcatctggaaactcattagaaatgcagattcttaggccctgctctggccctacagaattagaagccctggggttggagcacagctatttctgttgtaacaaaccctccaagggaattctgaggcacgctaaagattgagaaccactgtcttggaactctagatcaggggtcagtaaactatggtccatgggccaaatcatcctactgcctgtttttgtaaatagttatttggaacacagccaccgtcatttatttaagcatcatctatggttgcttttatgctatggggcagagttgattagttatgacagagaccaaatggtccatacagccttaaccatttctccagctttttacacaaaaagcttgccaatccctactcaagataaagcattcgtgctgttttctttcctttaattctgaactgtgaacagctaaaatcattaggtaaacgcttgtgtttgcctttacacctgaccctcctatttctacagatccattcttctctctcatatcaaattattaattcaatgagtagagacttgtaaatgaaaataacatactactctaccctttccttttctgttaggtagtggtggtagcctgtttaacaattccatgaccttttctcactgattgtgtgctggtgtgtccttggtttttctgtactctagtgtaatctaacttaatcatgtattgtaatcttcatttttcccaattcttactgcctttttacttcctcaagagaaaacccaccttgtgactgccaagtttagggattcatgtgagctgtttggaatgtttgtttgtttgtttgtttgacagagtcttgttctgtcgcccaggctggagtgcagtggcacaatctcagctcactgcaacctctgcctctcaggttcaagcaattctccctgcttcagcatcctgagtagctgggattacaggccaccacgcctggctaatttttctaatttttgtattttttagcagagacggggtttcaccatgttggccaggctgatcttgaactcctgacctcaggtgatctgcctccttcagcctcccaaagtgctgggactgtttagtgtgttctaagccaggggtccccaacccttgggccgctgaccagtaccggttcatgacctgttagaaaccaggccgcacaacaggaggtgagcagcaggccagccagcattactgcctgagctctgcctcctgtaagatcagtggcagcattagattctcatagaagcacaaaccctattgtgaactgcacatgcgcgggaactaggttgcatgttccttatgagaatctaatgcctgatgatctgagatggaacagtctcatcccgaaccccctacccccaccccggtccccatcgtccatggaaaaattgtcttccacaaaaccggtccctgatgccaaaaaggttaggtaccactgttctaagccattgaaatagtgccatcccttctggaaaattgttacccttgtcctggagtgctgtagtcactggtatttcaccaggatgttagggtatttcaccaggatgttagtgagcacatagatattgaatatttcgggcaatcttagaatgtttactgggagagttttaaaagttagccttcccacatccctccaagaatagctgtttctctttgtagctggaatgtcatgttgtactcttgattctcctttgtacctgttcttagccattaaggtgattggtggtcaacttcgtataaaatacaactcaattttaccattgttcttattgatgcacatgaatgtttctctttatgcatatcactgagggaagtatagtagcctttgaaagaaaggccttcttgtagtctcccctggctctggtagcaaggtcaggcaaaagtgttgtttttgcagttgtgactccatggttgtgtttttctttacataactgatgttttaagtcaggaaatatgactttgccaaatgatactgagctatattactggtgagtttgtttggttcctgatttatttcagtaaatctgggttgaatagtttagtagtagatgctggggaagatacaggaaatagtgagtttgagactagaaatgattgagttagacatttaatttaggctttcccaatcaacttacttcataccttttgccctgcttactcatcccagaggtgaggaacaatgagaagaggggtcaggcaaaggccatccctcagaatgtggttacttaggtctgtcgccaaaggcaacctatctactggaaaatttgagctttactgtcttctgcagtatagtgttggaaatgcagtattttaaaaactaaattgttatttatagcagtgaataaaatgtgaactctttaaaaaaagagcagtgttactgtcccagctagcacaatagccacccacatgaatcatctgaacaacctcctcatttctgttttatctacctgaaataggggtcagcggtaggtgatgatgaaagcttgggaaatcatgccatgcattaggcaggagaaatgctgtggtgactctttctgtgttgtcctgccctcatgtgcataggaggctggggcagccccaagagctagaggtaagctttaataatttccctgggttccttggcagctggctgtgcttaggagccgggtgctacttccagagtagcaactgctgtagaaaagttctgccaaatgtgtagattttgaaccattttaaaggctatagtgttcagactcaaattttttagtaggcagagagtattatttaagggtacttatgctgcagtattggataaggttcgttgtgaaatagatactacaacaaggcctccatgtgacataaacttattggaacttgtgtacttttaaaaccatatgtttaatacatattttgagcttcattaggtcaggattcttggctatcatagtcattgttgtatctctacaacctagagtagtgtctggtacatagtagatgttcagtatatagttgaatcagttcaaacaaggggaagaagtgactgaacacattagaaaaggtaaaatttatggcctataatgcacaaagtcagaagttcatattttcttttagtgctaatatcttgctgcttcaaaaccatttagttctcataatgttcttttgaaataggttagtagacatagaattgtatagtatatgccgaacatagtagtggaatcctgaataatacctggtttccctagttgagatctgtaagaccaatgctctaattagatgaagaaaagaagtttctaaggttgaaatggaatggagaattttatagtgagtggaattactaatgactggcttacttgatctatctaaaacgatttcattgcttgtaaaatggagacagtagactttaactgatagtattgtttgaagattaaataagatagtgagtatgaagtccttggagacttgcaggtgtgcagtgagcatgaattgttttcaacatcaacagtaatttttgagagcttcctaatcagtcacctagctagtcccacccagccttaggcaaagcgaaggggccataggccaaatcctgccgtctgctttatattgtagccactagccagatgtggctatttcaagttaattaaaattaaaatttaaaattcactgaacagacatttctccaaaaaagatttataaatgaccaataaatacacggaaaggtgctcaacatcaagtcattatggaagtgcaaatcaagaccaaatgaaataccacttcatgtgcactaggatggttagaatcaaaaagacaataacaagggttggcagggatgtggagaaattggatctctcgtacgttggtgggaatgtagaatgttgcagccaccttgaaaaacacactggcagttcctcaaaaagttaaatatagagtttccatacagcccaacaattccattcctaggtatgtgcccaagagaattaaaaatgtatatttacacagaaacttatacatgaacattcatagcagcatttcataatagccaaaaggtgaaaacaaccccagtgtccattaatggatgaatggataaacaaaatgtggtagttgcacacaatggaatatcattcaactataaaataaattaagataaagacgcatgtgtatgttcatcacagcactattcataatagcaaaggcatgtaattgacctagatgcctgtcaacagtggactggttaaagaaaatgtggtacatatatactgtgggatactatgcagccataaaaaagaataagattatatcctttgcagtaacatagatggagctggaggccattattctgagtgaagtaacacaggaagagaaaaccaaataccacatgttcttacttataagtaagagataaacattgagcccacacagacacaaagaagggaacagtagacactggggcctacttgagggtggagcattaggatcgaaaaattgtaggatactatgctgattacctgggtgacaaaattatctgtacaccaaacccctgtgatatgcaatttacccatgtaatatgtatcccctgaacctaaaataaaagttggaaagaggaaaaaaaaagatcactttgggaagaattgatagcttaaattattgtgtcatccaatgtatgaacaaggtatatctctattatttgggtattgtttaatttctctcagcagtgttttgtagttttaaaagtacaagtcttgtacatcttttgtcacattcttaaatatttcatatattatgctgtggtaaatctgtttttcatttgaatttctgattgattgttgttagtatatagaaatgtaattgattttttgtatgttactcttatgtcctgcaactttgctagattcacttattctagtagaatgatgtatattgcattggatagtctacatagatgatcatatcatctgtgtataaagacttcctttccccaaaaaaagaaataaagtacagatacatggtgcaacatgcattaacttcaaaaacattatgctgagtaaaagatgccaaacacaaaagaccacatattgtatgatttcatttttaagaaatggcctcagtaggtaaatctgttgatatagacactagattagtatttactagggactgggaggaggagagtgtgggcagtgactactaataggtatggggtttcattctgaggttatgaaaattttaatggaatttaggtagttcttagtgatcaaggcacaactttgtgaatatactaaaaaccaccagattgtatacttaaaaagggtgaattttatggtatgaattatatctcaataaatgttatttttaaaaattcagttccttagttactttagccacatttcagttgctcagtagctacatgtggctagtgactgcatggtagacagtgcagatttagaacgtttccatcatcacagaaagttctgttagacagcactgatctaagagtctcaatctgagaccaaaaaataaaggaagaaaaaccagtctaaaaaacacagggagtggagaacagattatgttctgaagaaatgttactttggggtaattttaccctttgttgccctttgactgttctactaggagtcctcaacatgattttcattttattctcaaaacaaatgcctgtggtaggtactgttatactcatgttttataattgaattatatgagttttaagatatttgtgtagtaagggtagagcaaaatttctaacctaggtacataatctctgttacattgtttacctctgtttatggtatttgattttcttaccaaccatccttcactcccactttgttgctagcccactagagctattttcagtaccctaaatgcacagttctttttgtgccatagcagatgctagccctccttcctccttctgccgtctcccaacactagtatgtgcatgtgcacacatttactggccccacttacctgaaagtgtggtgcacatctctcttcctttgtgaagctatctgataccacagttttaggggctactctctcacctggttaaggttacataatgtcgcaagatataagcaagaatgctgacaggattcttgttgtgacactatgacacattgagcccaattcatagctgctgtgttggtgactctaacagggaagtggtcttctagtccaggcccttggctcccatttatacattatctcctttccattcacagccttctttaatccccacccacactgctacagtacctgactgaactttgcctttctttgcctcttcatatgtttttctgcttaagctttttgaacctgatgagatactgccatgtttttatatttttctgctcataaaacccttaatggtaaaaagatacctgattgaattctgaagtgctttcatggctttgcctgattctgaggtcatattttctaactttatgctaacatcagtttactctctggttttatatggagcatgtactcctgtagcttctgaagaaaggtttaatgggaagcaaattttgagactacatgtagtaggctaaatcatggcccaccaaagatgtacacatcctaattactagaacctgtgagtatgttactttacatggtaaaaggatctttgcagatcttattaaatttaggattttgagatgggggattatcccagaatatttggatggacccagtttaatcacaagggtccttataagaggaaggcaggagggtcaaagtaagtaaaaggagacacgacaatggaatcaaccagagtttggagtgatgcactttgaagatggaggaagagggccacaaaccggggaatgcaggcagcttcaagaacatggaaaagcttctcccctgaagccaacatcttgatttgagatttctgacctctgatcagaactgtaagagaataaatttgtgttgtttaaagccactaagtttgtggtagtttattacaacagtagtaggaaattatgaatacaccatgtataaaaatgtcattatgccctttaacttgattgatagtttatgtagacctaatatatatgtacacatactagtctccatggctccatgctgcagtggacccaggacccaggcccaccatccatggactcaggttccaaacccaccccagcagacttggcctccagactcaccctggcggatccgggctccaggatcatccctggttgtctcagactccaggcctgcccctgcagacccagtcttcaggcctaccttcgtgatcccaggcaccaagcctgcgtccttgaatccaggtgccaggctcattctagcaccaggctagtcccttaagactcaggctcaaggcccagtgcagcaccagattgagctttatggacccaggattcacactggcccctgtgaatacaggctttaggcctgccctgcatgcccagctgacaggcttgacaggcttacctgagtggaccctggcactaggctgttccccatgcacaccaggattgagatccaccctagcaaactcaagccgtaggcctgtcctaatggacccaagtttcaggatagcccacctgaaaactccagcagcaagcccccctgccagacagccctccggaatttctggacaggctgactggtaaaaggcttttcctgccaaagccagtctgtgaagactgcaagtgcctacttcttcttctttttttttttttttctgagacagggtctcactctgttgcccaggctggagtatagtggagtgatcacagctcactgcagccttgacctctcaggctcaagcaataccactgcctcagccaatcctactgcctcagcctcctgagtagctgggaccacaggcaagtgccaacaggcctggctaatatttgtattttttgtagagacaaggtttcttcaagttgcccaagctggtcctcaagcaacccacccgccttggcctctgaagtgctgggattacaggcgtgaaccaccatgcccagccaagtgcctgctttgtaaaatgtgcagacactaatgcaaaactgcaaggatcaccgataatcagggaaacatgacatcaccagaggaacaaaatgaagcaccggtaaccagtcataaagaaatggacatctatgaattgactgataaagaattcaaggccaggtgcagtgtctcgcatctctaatcccaccactttgggaggccaaggtgggtggatcacttgaggtcaggagtttgagaccagcctggccaacatggtgaaacctcatctctactaaaaatacaaaaattagccaggtgtcatggcatgcgcctgtaatcccagctactcgggaggctgaggcaggagaattgcttgaacctgggaggcagaggtcacagtgagccgaggtcatgccactgcactccagcctggctgacagagcaagactccatctcaaaaaaaaaaaaaaaaaaaaaaaagatttcaaaataatcaaataatcatcttaaaagaagttcagtgagttaaaagagaatatagatggacaacaaaatcaggaaaataatacacaaacaatatgagaagttcaacaaggaaacctcaaaaaaaaaaaaaaaaagaaccaaacagaaattctagagctgaagaacacagtgtctgaactgaaaaattccacagaaagcttcaatagtagacttgaagtagaagaaaaaattagtgagctcaaagatggtcatttgaaactacccagttagaggaagaaaaagacaactaaatgaaaaagagtgaagacagcctatgggagttatgaggtaccatcaaacaaagcaataaatgcatatgagatttccagatgaagcagagaaagaaaaaggggaagacagcttaaagaaataatgacagaaaatgtcccaaatctggagacatgaatgaacatccagatccatgaagtccaaagaacctccaactagattaaagagatcttcactgagacactttataatcaaattctcaaaagtcaaagataatttcaaaagcatcaagagaaaagcaaaccatcacctacaaggaaacctctataagactatcagtggatttctcagcagaaactttccaggccaggagagaatgggatgatatattcaaagcgctgaaagaaaaaaaaaaaaaacaaaacaaaaaacctgccaaccatgtattatatacctggaaaggctgtttttcagaaatgaagtagagataaagacttccctgtgggagttcatgtcccactagacctactttacaagaaatgctaaagggagttcttcaagttgaaacaaaaggactctaacaacacgaaaacatatgaaagtgtaaaactcactataaaagtaagaatatagttaaattcaaaatactctaatgctgtaatgatggtgcataaatctctcttaattctattataaaagttaaagacaaatattaaaaatgactatagttgcaataatttgttgatatgcaatatatacaagctgtaaattgtgacatcaataatagtggggcagaggagaaaaagtgtcgtacttttatatgtggttgaagttatcaatgtaagatattttataattataagatggtttatgtacacctcatggcacaaagaaaaaatctgtagtagattcacaaaagataaaggaatcaaagcattctcttacagagaaatcatcaaatcagaaaggaagggacaagagaggaagagtggaacaaaggaactacaaaacagaaaacaaggtatcagtagtgagtttttacccatcaataattactttaaatggcttaaattcttcaatcagaagacacagaatgaatgactggataaaaagaaataagactcaaccatatgctacctacaagaaactcactttagttttaaggacacacataggctggaagtgaagtggaaaaagatattctgtgcaaatggtaaccaaaagaaatagaggtggctatatttatataaaacaagatagactattaagtcaaaaactgtcacaagagacaaaaaggataattttataatgataaggggtcaattcatccagacgatacaacaattataaaatatatatgcacccaacatcagaacatttacatatataaagcaaatattaatagaagtgaagagagaagtagatagcaatacaataatactagcagattttaataccccactttcaacaatgcacagaaaatcaataaggaaatagcagatttgtactacactgtaggccaaatggatctaagagtcatctgcagaatatcttatccaacagtagcagaatacgatgttcttttcaagtgtgcatggaccagtctctaggatagatgatatgttaggctacaaaacaagtcttaacaaatttaagaagattgaaatcataccaagtgtttttttctgaccacagtggtatgaaactagaaatcaaaagaaaacggaaaattcctaaatatgtggaaagtagacaacacactcctgaacaaccagtggatcaaagaagaaattgtaaggaaaataaaatcttgaggcaaatgaaaatggaaacacaacataccaaaacttatgggatgccatgaaagcagttcgaagagagaagcttataatgataaatagcaatacatgaagaaaaaagaaagatctcaaatagacaacctaactttacaccttgaggaactagaaaaagaacaaactaagctcgaggccaaaaaaggaaggaaataataaagatcaatgcagaaataaatgaaatagagactagaaaaacaatagaagttatcaacagaactgagttggttttttgaaaagtaaaatcaacaaatctttagctagactgagaaaaagagaagactcaaaattataaataaaagagacattgcaacttaaagagatacaaaggtttataagagactactataaacaattatataccaacaaatttgatagcctagaagaaattgacaaattactaaaaatacagcctatcaagactggatcatgaagaaatagaaaatctgaacagacctataatgagaaaggagattgacttagtaatcaaaaacctcccccaaaagaaactcccagaacctatggcatcagtggcaaattctgtcaaacctgtaaagaggaattaatgccagtccattttaaactcttccaaaaaattgaagagggaatacttccaaactcattttatgaagccagcattaccctgatgctaaagctagacaaggacagtacaagaaaagaaaattacagaaaatacaagaaaaaaattcctgatggatatagatgccaaagtcctcaacaaaatactagcaagccgaattcaactgcatattaaaatcatgcatgcttggtacaacagatatatctgaagagactcttttctctatggttggtttcttcttgatcatcactacctcttagtgtacaggaagctcaaaatattactgtgtgaccttaacaaaataaatttacttctctggtctttaggtttttttcaatgggaaaatgggaaggttggctccattagtttctaaagtccctttgagctctgaaatgagtaattttataatttctaagtgtttaattcatcaactacatgactttaccttttttcttcattacctgtcaaattcacttaaaaactattatcacacttcatttgctttttaataaatttctgacagcatgaatgggagaaaaaaagggactatacagcatgatcaaagaagatttatccctggaatgcaaggatggttcaacatatacaaattgataaatcacattaacagaataaagtacaaaaaccatatgatcatctcaatagatgcagaaaatatgtttgacaaaattcaaaatcttttcatgataaaactctcaagaaattaggtgtagaaagaacataccttaacacaataaaggctgtatatgacaggcccacagctaacatcaacactcaatactgaaaagctgaaagccttttttctaagattaggaagacaaggatatccactctcaccacttatagtcgggataatatgggaagtctgtcctagccagagtacacaagaaaaatgcatccaaatcagaaaggaagaaataaaattttcggtttgcagatgacttaaaattatatatcaaaaactcttaaaactccaccaaaaaaacctgttaaaactaataagcaaattcactaaagtggcagatacagagtcaacctacaaaaattaatagtgggggaggagggagtagggatggttaatggtcaccaaaatatagttagatagaatgaataaaatctagtgtttgatagcacaacagggtgattacagtcaacaataatttattgtacatttgaaaataactagaagagtataattggaatatttgtaacacacagaaatgataagtgcttgaggtaatggatatcccatttaccctgatgtgattattgtgcctctatcaaaatatctcacataccctataaatctctacacctacgtacccataaaaattaaaaattaaaaacaatagcatttgtatgcactagcaatgaactgagaaagaaatcaagaaagtctgatctacaatagaatcaaaaatatataattcatttctaagaggtttttttgttctctcttcttgtatatagcttcaagattttgtttcttatatgctatgtctaatgtcctccaagagaaagagagggaaatggaattataattaacattgtcttttccctatattatctgttttctcttattttcttttttcctgttttttagctttggtacttgtctgtctttcatgttagaggtgtttctcaagcatcttcagctgtttgttgctattaaggaaaagtttattggaaactgtgttcatgactgtggcttgttcagtgatggacctcatgtggtgtgattgagggaaacctggctatttatggggagcctatcagttcttttttcttaagccagtcagcttttctaaataggatttctaaattgaatcttttgtgggagggagtttgggagtaataagctcatgtctagggctggatccttaatcattggctgcaaagacttatttaacccttgttttcagtaaggcatcccatttttgttctcagttatggctggtgttcctgagttcaggggctctgattcaacctctccagagagtaacttaagccctctgctatgtggagaaaaggcagttgccagatgctctggttggagtgagagtatgtgaaaatcttacttctcttttttaaacaatttttcagcatccccccaccacttgctttaaaaaaaaggattattttcttcaaatgtgcccataagctgcaattcctgagcttttaccttctgttcttccagggcactcaggagtgaactggcttacttgcctcaatttagattcccccactgcaggtacttggcacaaagaagaaagatacaatcaagtcagttacctcttttccaaatgcttttcattttaaattttgtgggcctatctcctttgctgtcatcatctccccacgctcttcatcttgttggtttatatcttttctaattcttcagtcttttgatttgtagagggagttagataaatgcttgtatctgatcagttatgtttaaacaaaagcgcctccctcccttgacaccttctctttttcttggacttctgtttcttagactgtttccaccattagaataagagcttgtcaagggcaggaaccagggtatttaatagctccagcatttgtataatgcctggagtatagtaggattattaaataaatgaacatacctttattttcaattatagatttctctgacttgagaaataatttcaaataaaacagtgaagtctctcttacagataagttcggaagctctcctctttcctcgattcttgcttatttttatccacagtgcgtctcgtgaaggaaaagaatggatcattctttcttgatttcctcgttggtaaagtatttggctttaagagctattcaaatgaatgtgcaaagtaagagtaagttgggtgtatttctagcactaagttgttgaggttctagaaaggtagttttgtgccttctagataccatgtctgcctttcctaatgagcctggtatgtatactattctgcctagcataactaggagcaataggatagagaagtgggatataccatttcaaagattcactgatgctgcttagaaacaaaaatctaaatgaaaaccaatgtacataaattagataattcacatataccattagaaattccacttaaagtcagtactgctagaaaccttgtcattaccttgctttaaatgctaagcgctttctgattaattctttttcagtttatttacctgggaggtattcgatctaagcaccagcatccctgcccccacttttatctattaatatttacaggtttttccctctttgaagctccctattgaattctgaatgactttgaacttggaattgctctgggtctgcttttcacctcctttctctacctcccaccccaaccttcactaatttgcttttttttttttttttttttttaatatttgggtggtttcttcttgcattctcttttttctatatgctccatgacagcctggactacatttctgttactcactgctgcatccagtgcttagcacatgctgggccttaagtcactgtttattgaaaagaataaatggattactcgttgaaatttttttaattatgaataacaaaaattagtaatctaactatatattatcaatcttttgctgtcttatcttacaggttttctttctggttttcatactggatagtctctattgacctagcttcaagtttgctgatttttttctactgtcaacttaaacttgctgttgagtccttctagtgaattttttgtcaattatagtacttttcaactcctcagtttctattttttttaagaattctttttctttattgatgttctctatttggtaagtcattatcctcatactttaaaaaacttctttaagtatagtttcctttaattctttgaatatatttataatagctaatttaaagtctttactaagtctaacagctgagccccctcaggaagtttctattggctgctttttttcttctgtatgggccatcttttcctgtttctttgaatgtctcataatttttctgttgttgataactgaacattttagataatatattgtagcaactctggattctgatccactcaggtagtggttattgtttttacttttgtttttccattgcttaatgacttgcctggactaattctacagaggctgtctttgctgaaatgtgtggccactgaagtttgtgctaggattttttgttttgttttaaattcttgtttttatttttaagcctggcttcctagggttttccccttggtcatccaatggttggccacaagttttccttaaacactttgagccaataagccttccatcttttgctgaaggaatctctgtgtgggttggggcatacgttgaaagttcaggcagtttaaaagtctgccttggctttcactttctgcttgtgtagggcctcacagtcagccaggagcagtagataattgggaatctttctggtctctcttgaacatgcatacatgcacagagccctccaaatggatacaaccttccagaacccccaagtatgtcagagctttaagctttctatggctgtctcattccccacatctaccttttacatgttggctagtgtcttgcttacctcaaccagtattgcagacttaagcagctgtgattgtttctaatgattgctattgtttttgacagtgcccctggccatggggctttctcttggagctccatatcaagtcagcttccttcagtggaactgtccacaaagctacaaggccagcgaattgtggtagaagcggacccaaattaaaatgtcacagaccctgctggtcttacctaggatcattagtagctgaggtcctcactccgccattccagaagtcctgccccccacctctgccttaggttttcaatgtgtttttatagctgtttatagttttgtggcttttcatttagtataaatattttctcatgttcttgataactcattataactaatttctactggctctcatcatttgaatgtctcataattgatttggtaatttcccctgttgttggacttcagataatcactggtgtaatttgcctttcccaacaggctctaacctgaatgaggcctgggactgctttgtttactacttcatcctcagtgcctgacacagtaattcttgttaaataaaggtcaccccacaattttttaaatgttataaataacactttgaggtggatcgtactgccaaaactgtattcagatttcagattttttttaagaatggagtttcagaaatggaattgcttggtcaaaggatataggcatttctaaacctcttgacataggttgccagattgatttcttaaaaagtcctatcaaaatagaaccttttggccgggtatggtggctcacacctgtaatctcagcacttcgggaggctgaggcaggtggatcacttgagatcaagagttcgagaccatcctggccaacatggcaaaaccctgtctctactaaaaatacaaaaaatttagctgggtgtggtgacgcgtgcctgtagtcccagctatgcgggaggctgaggcaggagaaccacttgaaccccagaggcagaggttgcagagagccaagaccacgccactgcactccagcctaggtgacagccagactctgtctcgaaaagaaaaaaaagagaacctgttttttcagcagcatccttatctgttgcattgtatatttggcgacatcagatgtgctagttgctcaagttttattgaccttattggccaaaaaaaaaaaaaaaaaaattctcgttgaactattttgtgtctttttttgagacagggtctcagtctgtcacccaggctggagtgcagtggtgcaatcacagctcactgcagcctcaacctcctgggctcaaatgatcctcccatctcagcttctcaagtaactgggactacaggtatgtgccagcagacccagctaattttttgtttgtttgttttagagatggggtctcaccatgttgcccagcctggtcttgaactcctgggctcaagcagtcctcccaccttggcctcccaaagtgctgggattacaggcatgagccaccatgcccagctattttgtgtctcttcgataaccaatgaaagtattagttttcctcatactttttaaaaaaaattctttctataaattggccatttgtttttcccccattttgctcttagttgcctaatgtttttcttgctaatttatgtaaactttatatatcaaagatatttatctattattgtcttttatatatttttaaaatttttcattttgttcctgatgagtttggatgtgcagaaactaaaaatcatacagaagaagcctctttgttcgatatgattggatattacaactggtctgctaaagagggaggagtataaaaaaagtctacagatatctcttcaatattttaacttgaagacaaaatatacattaagtagctaatcctttgatattgtgtgacccttttctttgaataagtctaattgattcgaaacctgctctatatttcttttatatatctcatccaaaatgcatcatcaacgatgtccagttttgatttatttaaaatggggtaatgacttaatgagctgtaatctgagtgcaaaatccttttggatattttatagatccttgctccccccgcccccccacccagtcttttgcagttttgtcacccacatttaattcagtatctcctttatctggtctttgaagccagttcttctcttttgtagtcacattcaattgctgtaacatatatgtaacatataattaagaattataggccggatgcagtgcctaacacttgtaatcccagtactttgggaggccgaggtgggcagatcgcttgaggtcaggagttcgagaccagcttgaccaacatggcaaaattccatctctactaaaaattaaaaaaaaatagctgggtgtggtggcacgcacctgtaataccagctacttgggaggctgaggcatgagagtcacttgaacctgggaggcagaggttgcagtgagccaaggttgcatcactgcactccagcctgagtgacagactgagactgtctcaaaaaaaaaaaaaaagaaattatagtaacacctacacaaccaacataaagaggtacacatttaggaacaaatacaaatagctcttggtatgtagacaacttaatttgtggggttcatgggctcatatgtactacacagtaccctgtcagcattgagcagtcagcatgcagcaggcattcattaggtttctacagagggaatggagaatggatcagtctgtgaaatttgttaagtggggtcaattaagagtgcttctaccatggtcaaaatctaatcagtctttttctttgttgtgattgtttccatgcttagaaagtccttcccttcttgagagttatgtgaaaattcacctacatttttctgtctttcttttgattcatacatttaactctttagttcatctgaaatttattttgttttttagtaagaagtaaggatgtaagcatctaaatagattttccaccttcaaataatgtgctgttttttttttccccagcatagccagtgcattcttcaaaggcaaagatcaaaaatgtaatttctagttttcaacaattagaataggggttgaatgggtctgggtcttgggagtggaaggtcagtatggtccttggggttggggaagggcaggcagagcatagagtggaatttaaaacacacacacacatacacacacacacacacacacacgcatgcacattcacatgataaggagaaaaagataactgagaaattggataataacagagctagtaggaagaggatatagtacaatgaaccctctttagaatgcaggccctttccaaaatgaaaatttgaagggtacttgggctctatttgatgaattatagtgaggtaaagtagtttattaagcatttgaataaacctaaatagttaataagctattgtttattaataaaaggtatgccaacaaggaagtaattatgcaaagttctacagagctgtcaaacttgaaagcatgtttttccccaccgattttgccagtctctactgggaaattatttatgatcattccctcagtcttttgaataagtcaacttctctcagtgcaatcattgctttttcctgggccatagcattaggtcaattagtgaaatattaggcataatactctttaaggctatgaatggccttgaagtactgtatgaaaaatatgagattaatattaagaagctgctatgaagcaaatgttaccagtggaaaattttattatacagtggtgtttatgctggttttaagttttaaaacattttatctttaaatgaccactgtataaatgttactttcaaaatattgtttggtgttgataggttctatttactcttcccaacatttatttgtattatgagtcacttcatactgactcaccagcattgcattaaaataaccagtcaccatcaaaaagtggactaaggacatgaatagacaattctccaaagaagaaatacaaatggccagcaagcatatgaaaaaatgctcaacatcactaatgatcagggaaatgcaaatcaaaaccacaatgcaataccacctcactcctgcaagaatggccataaatcaaaaaataaaaaaaaaaagatgttggcatggatttggtgaaaagggaacactcttacactgttggtgggaatgtaaattagtacaaccactatggaaaacagtatggtgattccttaacatctaaatagattttccaccctcagataacgtgcctttttttttttttccaggatagcaactgcattcttcaaagggacagatgaaaaatgtcatttctagttctcaacaattggaatagaggttgaatgggtctgggtcttgggagaggaaggtcagaactaaaagtagatctaccgtttgatccagcagtcccactactaggtatctacccaaaggaaaagaagtcattatacgaaaaagatacttgcacacacgtttatagcagcacaatttgcaattgcaaaaatatggaactagcccaaatgcccatcaatcaatgagtggataaagaaaatgtggggtgtgtttgcgtatatatacacacacacatatatatacatacatatatacatatacatgtatatatacatatatatacacatacatgtatatatacatatatacacatacatatacatatatatgtatatatatacatatattcacatacatatacatatatacgtatatatatacatatattcacatacatatacatatatacacacacatatatacacatatatatacatacatatatatataatggaatactactcagccataaaaaggaatgaaataatggcatttgcagcaaccttgatggaattggagactgctattctaagtgaagtaactcaggaatggaaaaccaaacattgtatgttctcataagtgggagctaaggtatgagaatgcaaaggcataagaatgatatattggactttggggactcaagggaaagtgtgggagggggtgaggaataaaacacattgggtacagtgtacactgcttgggtgatgggtgcatcaaaatctcagaaataaaaaaaaaataaatgaatcaccaaccaccaaccaaccaatatgggagatttgtttcagctggagggccttagtttcttaaagtagttttcttctcttgctctggaaagtactaattccaaggcctcttttctcctcccagttgtaggatattggggattcttactagaaagcgtaggcagagcacatgcagccagtgtccccaagttttttagaccatctggagctacctgtggctgctatgtagcctaaaacttcagaaggccttatgatctattggcagatggctaaactgggatccttgtgtcagggttttcttttatgttatttttaaattccagaatagaagagaaaatgaaatggagaaagaagacattgaaggttgtggtgttttctgtgaagttcaagaagtattgacatttctcagaagagtatgactatagatgatattgttactgtttggggttttttgttggtcatggtggtagtgatggatttttttttttaagagtcacgtttcttcacctagaattagctgaggaaaagtggcatctgtattgatggttttaatagatatgattttattggtggtgccttcagagtagtggcttagagtaattagaaagacatcattgctttgtataggtcttaaaaagattgttaaacttttaattcaatgttggctgagcctgctgtgcctgatacattaaaagaaaaaagtcttatgatttactgaaaagagtaaaatggtcctgatttcagttactcccttctactcatgcacactgtgttgcttactgccctttttaaatccaaggtgattcttcaacctcatacattgttttaacatttcactctatgtctaggacatgtctagaatatttaagtgcctttttcttggaaataatagagatgtatcatacccagttttatttgcttaggtagcagataaagacttcagaaatactcaatatttgagtatttgggttggaatttgacactgtgtgtgtgtgtgtgtgtgtgtgtgtgtgtgtgtgtgtgtgtgtggactcaactagcctaaaagaaagataaatgcctcttagaagctagaggggaaaaacctatgaaaacttagtttgggatgtacctatgatgaagaatttgccctctgatttctcttccatgtggctgattttgaaggttgtatagtattttgtttttatgttttgatacagctgttaattcttgaccattttcctcagaaattggcatttccagattggcaaaatctagtatcattgtaggtagctctttacagataaatttgtacgggagagtatgcaatatattttgaaacttctgtttttgtgtgtacaaatctctaaatcagcccagatggtggccattatggattagtaatagcaagaaagaaagctgttaatatcacagcttctaacatatgtctcctgattgtgggtatatatgcctggtgtcaaagataacgctacagcatacctattacggcttttaaaaagttactaaggcatttctatctgtatcagccaactagaaggatggattagacaacatgatatatgtagtgcttttatctctggcaggtagctaagtctttgaaagaagatatatcttctcatctggccagaatgttttgattttaacttgaaatttcctaacaagagttcttatgtgtttattattgcatgttcttatgtgtttatttttaaaactatcctttagcatttaggcacattaatttatagcacctgtagagcaatcagttgcaatatctgcatatatgccttttattttctgtaattgagatctgtattatatttatataatcagtgtgtaagttactctaaaagttatctagtcaagcttgactttaaagatgtctttgtaacttgttctacattgttactgtttccttcagaaagttaagtttccaagcttctttaagttacattctagacgttccgaggggttccaaagtgttgaaaaggaaattgaagtaagctttggaatatgttaataagcttcaactggaaacatgtatggtagcagctgttttaaaggccgctgatagtgagatgttaattgagtactttttaaaatatattacccaaccttctctaagctctgaagcttcaattacatttatcctaggcactaagacttgaatccaaaggggttacttcactgctcttcttgaggttgggggtcctatgttattcactattgtaacagcaacagattataatgattggtaggcaaccaaatgcttgctgatttaattaaacttgcctagttatttttaccttattgtaaattttggtctatagagctgaagagatttctccccttttctttgaattaagaaaaagccacatatgtgtggtaaactccccttcaccataatgaaactactttttcttcattctttgtaaaatattaacccagtagagtaaaaactgaattcttccatgaatggtggtatttcttctatctggcaaattaaagcaatggagaccattagggtataaccctgaactttttgtgctccctccaccctggtccgttatttctttggtataaaatcagaagaatgaaatcttagtagagttctcgtaccactacacaagacaaggtaaccatgctcttgaaatagatttaattttagatgttgagtgttcctaatgggtggcaaattatttatgctaattgtgaggaataaattacttatagatttattaataatttacacatagtaacttaaggttcaaagtttgttaacacttattttatatatgacattcacatcaactgtatgaggtaactagatttttctttttccatctcataaatgaaaaaaacaggttttttgtgaaaatgcaacttgcccaaagttgtagaattagatttttataaacagatctgagttacttaatatgtgtagaaatctttacttgacaaattttcgacattgtaaggtttgtaattttatctcagaatcctagaattctagagctgagagaaacttaagttgatacaaatggaaaataggttctttattgagtgccaggttaatatcaattgtagctgttgagacttggagttgagacatttttattgacttatttccagtttattggcagagagtgccctaattgattaaccatgcctgaagtagacatggggcaacatatagatgacaaatatgtggcagtcagactcagtaacttgatatagcattttgaaagtacctaatatagctttttacagattctgtctaacgtgagtttctattaaatttggcaaattcctcagtaagttacaggattctgtatgtatcaagaattgaatttggcaatgtggaacagaaaacccaaataatagtggcttaagtaaatttggattcatttttctgtaatgaaatgagagaattaaacattccagggttgatagggtgcctccatgatgtcattagggccctaagcaccttctcaccttcttcccagccatccttgttgtgtgctcctagttataagatggctcctgaggctccagtcatcccatttgcgttccaggcaggctggaagacagggaggagcaaaatggtgcctgtcagctgagtaagacctcttaaaagagctttgctgtaaaccacatctattgaagtttgcttttatctcattggccaagctgtatcacatgactgtctcatctactgcaaagctaggaaatgtatttttacttaagcacattggaacccagcaacaatggccttctgacagcaaaaaaagaagcagatggatgattaataatctttgctacagtacacctctttagctatccagtccttactcagttatcttcccacacaaagaacatgcttaccccttccttaatgggaacacctccaaagtcttatctagttactatatccaacttttaagtctttgatttcttggtgatgtacagtcctctcaattaggtctaggtgtggcttcttgtggtctggtgtcccacaaactgccccctccttcattgttacatagatagaaaaagaataggataactttagtaaaagttcccacccaaccaaaaaggagagagtaggaaacgtagcatttaacagatcctattgggcaggaaaagcaaagactctctgtcctgccttcttggatggcccatttggcaggccctggctctgctctaggggaatttcctttgcctgggaaagaaatttgtaagggaagccccagcatccttgaagaactctgtgatcagtgagaaattaacagcgggaactgcggccactgattgggaagcctaaatacaatgagggtaattggatcccaggatggcaaggaccagtagcacttaattgccaaaggaagggcaggtatggttactgaaatggacagcagagtcaaagcaacaattagaatgaactgactagtacagggtgatttcttttgctccaagcaggcccctggctgttctctggagattctttattgtccattcttctccatggccctatctgaaatgctctttggggagcacatttttcttggggactacacagctttcatagctaacatattactgttgagggtttggagccatgaattattttagagatttaatagctattggctgctgcagggcagttttggggtttccatgacaatatcgtttcgtcaaaaaatgtcgatatttttcttcttgtttttagtaagctccacgggggagaagccacatctagacatagtttcttagcctgaaaattcttctacttactggcctctgtgctctgcccttttctttcagcttttgagttaatagccagctgcctcgaggtaggcaacacccttaatctgatttttgctggctagttttctttcctgtcctgaagggaactcttaaaacagcttggggttgtggtttcatctcctgctaagacagccacttctctgagttactgcttataatcacctcagtttgagagtacaggagctgttgatgtttatagtcctccaaagcttcaaattatgtgactttcagtcgatttaaattgaaggctgcaggcacagaatggctggctcaagttctatttggtctctcctaggactgggctcaaaagctgcaagaggaaaccatcatacatccatatcccgaaaatgtcctacatttccataaactgtagcctcatttggcatatggtattaccaaatgttttgccactacctaacaagagtaaccagctttaagagtcactgtgaattggttagagactgatgggattagttaagactaattttccttaaagtcttttcttttccttgatataggtatattccaagtgttgatgggcagcttggggtttatttactttttagacttataaattgggagaaattaggactaagggaaatgattttttctaaggacatgaacatttataaaagacaaggaaaaagtatgacggaagaaatatgtggatgtaattgccaagaaaggagttcatcagtgatgggtaaatggtcaagaaaaaatggacagtgtgatctctgtgtgatcctgttaatatatattgtgccagccattttcctatttcagccaccaagtgatgcagtttacccagggtctgggttccagtcctcattgagaggaaccatggttaagaagaaagtgaacttacaaccaggagtttatatgttctcccacatttacccttcggatggtatctaatcattttctcctctaaatgaaatgtattacattctcttgtggctgatttctctagtacttatcttatatattcttaaacttacctttatgtaaatgtgctcaatcaattttagtaagacttaaacttcctgagctctaccttttaacagcatcctagactgagagttagtctcaaaagtcaagttctacaaaagaatcctttatgctgtttaacttaatatgttgtagtgttgtgacttctctacctttcagtgtttcttgattaggattcttcaaggtatttcttttgtttttaatcttaaaaaaattaacatgtcaaataagagaataaatagtacctggcctttattagaatcttattttccataatgttttaaatattttcatatcctatgagatatgaagggaagagttatcaaacaataaacttttgaacaccaactatcagccttttactacaccatgaggcttaataatagtaaatagtagttggtttttattgagtgcttattaaataccaggcacagtggtaaacattttatcttatatatattcattttatcctgacaacaatcccaagagataggtggtgttatcttcgctttatggatatatgtaaaccaaggctcagagagttgtaagccacttgcccagggttaccaggctattgagtggtaaagctaggagtctaaggaagttcaactccaaagtccgaactgtgtagctaccttgctataattgtagatggtccctgccatttgggaacttggtttaacagaggaagtaaacacggaaataataaattgaatgatttccctttcttagtttggccatagttgttatgatcatttcataataatcatttctataaatgtaagttggcacatatgaagcacctttggtatgatgtcagaatatcatttttgaagtagtgaactaaaatggcatatcaagtgacccaaaatgtcatgaagctttttggaaacattcactctacgaaatttattgaacaattattatggtccagggtcttctgggcccagagggtacagttgtgaataatatagaagctgtcctttctgtcatggaacttgcaagttagagagggagagacaggttaaataattctacaaacaattgtttaaaattcaatggtggtgagtgctgtgaaggaagccatggaagtgctgcaacagtataaaaagggaactgaacctacttcaagagtaagaatcaagggagtgattcaccttgagtagagctgtctttcaaactccataacatactttaatattttatcagtgagtcttgtaattcttgatcgttattctttctactagtatactgcagtcttgtgctttgtgagcaccaaggggaagagagcttaacttggtctgaggggaaatgaaaacaattcttagatacttaagctaaatcttgaagggacagtagagaggaattagaccaggggaagtatattctaggcagaggaaacagtttgtacaaagtttacacaaaggcattgggggcagatgagaacataatcctttaaagataattatggttagtatagctggatgcggtgtgtgtctagatggtattgagagatgaggctggaaagatagatagaaaatgtgaaatatttatgtaaccaaatctggtttctgtagagttggtctattaacttttccccatatttcagaggatctaagagatatgagattttcttttctcccccatattttaattgttagcattgttaaataaagtgtaaggattggcctaaatagatgtatagtgagatatcttatagttttaaaatgtatgtaatgcagtaattttaagggttgcagtcagatacccaaagcaaggcaattaattagtgaaatacatttggatctcctggctagactgaggcttgagtgttgtagaaatacatattactgcatgtgtataagattgggtctgcctgaagagaaggtttaagtgtggtgttccaggtatattccaatggtgaggcagaatattttgttaatgatcaaaggagaaataagagatcaagtgggaggaaattattaacagtgaaagcaacatgggcagtttgatgtagagcactgagaactatgtaggagacacatggcttgcatctgagctggcctctaccactgaccataggcaagtctctgggtattttggaatctgaatccaaacttcctattgaagtataacatggcatacagaagagtatataaattataagtatgtagcttgatgagcttttacaaactgaacacattcctgtaacagcacccaagtcaagaaactagaatgttaccagaagccctctttgtgctacctgtacttccatttgtttaatctttaaaataggggtaataatgtcttcttcacttttagaagtgctgagaaaatgacaacttgagaagtgccttgatctctctcagtgttgttatacaagtgaaatgagatgctaggaagtaggaccagcttccaaaattgtagaagtacatagagcttacttatagtattattagtaaacctattaaattggggatgcataaggagataactctgaaaaccacaaagcaaaggacaaaacagttgtctaaaatgaatcataaggatgcatgggcatagtatatgtgatgtcttttgttcttataaggtgtcattcttgggattcaggagagcaacttgtgtatttttacctgttcaaaaaatgtgaaactattctcattatttgaggatgctggagaaatggtagcttcctgaaataaaagtaagttctgttttaaaaatagccataagtcttgaattcaccaaatatttctgtttgggtttcaggaggtctgatgctgagtctctttttgttaatctgaatgcttacgaatacttttagaatgggaagtcctccttcatgttcttaatgccattagctaaattgatttttttcaaagtaacaaagtcatcataaatgaaattacatacattagtccccacttatccaaggttttgctttccatggtttgttacgtgtggtcaacagtagttcataaatattacagtagttcaaaaataaagtattttgagaggggggagccacatttttgtaacttattatagtatattgttgtaattattctattttattattagttgttagtctcttactgcacctaatttataaaataaactttgtcataggtatgtatgtatgtatcagaaaaatcatagtatatatgggatttggtgctatccacagtttcaggcatccactgggggtcttggcatgtatcccacgtggataagggtaggggactgctgtactcttgtagtactttttgaaaaagtttcaattttgtttagtgtaataacagattgatgcataccatttcttacacgacactagctgtagtcaccacaataatctgcatttttctatcaggcctatttgctttccaattctccatcatctccctgtacaggtatcttattagatccccttaagatctattctgtcctttacctgtatacagtgaactaagacttttaatttctataaggtaagatcattttattagcatatttttgtctttgatatataaaattatctctgctgagctcaaaagtttagtaaattttttgattgataatttaagaaagtctttaacataggcagtacagttataagggatagacaaatagagcagctttatttataataaacatttggctcttttgcaggatttccagattttaagatacactgaacccagtttatagccttttatccctcacgcccccgacctttccctcccaccagtccccaaagtccattgtatcattcttagaaacattctaagaacttcatgttacagttctgaaaactgttacatttacacttgttgtatttctgaagactttgttacatgtgagttacaggtgaatgaatttgagggaaaaactgacaaaactcagcttgaaaaggaacccacagtgatttctctacaagggtattttttgaatttgtgaataatttattggcagcttgctttgcaaaaaatacacaaaaacctatggaaataaaattttaaaaaaaaagtcaggaaagactgcaaaaaccatgaccttgcacaaaggccattgcaaccgtatacaaaaaaaagaacacttctgttgaggacatctgcccagccttggactggcatcacccttattattgatccttgaagccaaggacaatgacctaaaaacaattatgtaatcttcctcattttatctttgaaaacctttgtcttcctttacttccctaaatacacacatagtttactgtggcacacatattttcattgcaatgccctattcccaaataaataccattttctgtttttttttttttaagaatattttgtgctattatgtgattgatgttggttagtgctattagtgaagaagttggtgctttaaaattgaagcaccagagtctacttatttcgcttaaaacacgtgctaatttttaaaacatatcttcacacctcatgaaaataagaggcattgtgtttaaaatgtatttttttttgtttctttcccattaaaaatttaattgtggtaaaattatataacataaaatttgccattttcaccatttataggtgtacaatttagcggcattcattgcatttacaatgttgtgtagccatcaccactatgtctatacctttgtgctatattaccctacgtagatattatgggaagaaggaaaaattcttcccataatatctacaatggtatagaattgttaaatgatttcttaagatagttttattattttagatctggattaagaaaatcctttggtaaatgttatagttggatctgattggccagaattcaaaccagcaagtaccttattcaatagctgcttttgtaggcacaggtattccagtaccacagggtaatgagtatttcaaacaaaagagggttagagatatgtctaatgtttattgccataccctcaccctctgggctttgatctttctggtggtcttaagttactactatagatttcttccttgctcataatatctatttggcaatgggactgaaatctggtaacttctattgggaacaaaccattcctctccactgtggaaatggctgttgtctcataagtattctccctcctgctcccgactgttaatactaaatctttgggtaaataaagttactcatctgtacaaagagattggagaccagtctaattcccctatttgaaggaagccccagagagttggaactaatagttaagtgatgcatttagaattagaacacacctgttccaatctccaatcagggaagttgattgtcttgtggtggttgaagaaacagagagggacggggtcagcagaaaaacctatgaataaacctccagtgccttatggtttttcctgaagtcagaatttagagcttgacaaaatgaaagtatttatctagttctaacccactctattaaaaatgaggaaactggcgcagagtgactgtaacttaaaaatatataaccagttagttgcaaagctagaactggacacccgtatgtcttgacttttgccctagtgccaaatatatgagagtgtgactctggccctgcctctaatagtttatttgcctacaagatatttagtggaattgtcagtgccacattactgtagaattatttcaaaagaaatatttttgatattctggttttgtatccccttctaaccaattaggaacaagatatttttagtgccagttaatagtgcagtctttcagcagaaaggaatctaaatcaatatgcagtgttaaattcactttaataaatgtgaaaattgtttttaaagtaaccattgattataaagagagatgctttctatacattttggtgggtacatatacagtatttttctcatataagtgaatacttactatatactattttttaaaagcctaaagtcctacagaacataaacatataaggcaactgaaatctgtacaccttctcaatatataaaataagtgaatatttgcttctaatgaaagagataaagattagataacttcaacaggggaccttggcatatgtctgataatagatatgagacagggatagcatattgattaaaaaagtcatggactttggatctggaatttttaggacccggattctcactgaaccagttacttgatctggggctatagccaagttatttaacttctctgaaactcgatttccttatctgtaaaatggggataaatatgctaccttagagagttatgagaattaagtgagttaataccagtacctcttagaaaaatgactggcatatagtaagtactcaatagctgtaataataataataatataccaatacatactaatactaataaagtatctgttactaataattttatcattgctactgttgctcttgttggaagattatggtaaaggtgacatgtgaacagataatccttttatgcttctatggtaagtataggactttttacctgtggatgcttttgactacttggatttaaatacaaatattttaatcataattaaacaactattaatgaaattttttgttaagaaaatatttcccagtccagatggttccactaagccagctccttgatcagttttctgtaccatgcagttaaactattttttccattttcatgtttatgttcctgaaagtatattcattgggattacttttttctgtttaaatactaaaaccaggctttttaaagtatcaaattgtattaatcatggtttccactattttaagtcttcttttgtactggtattgaagtacattttttttttcttcatcattatacactaatgtactaaccaatatagcttttttaaagaagcattgttacacctccctgattatgcttcatttaaaatgcagtcccctacagtcctctccaccaatccccacccccaacctttatattgttcttaacatcactttcttcaataactctggagtgagggagcataaacagtaggttatgggtgaaagtgaaatggccccatagtgctgtttctgatgactagaagagtagcatggctgagtcttgcagtacaccaagatgttctgcatgagaggataaaggtgggaaaaggaagaaagctaaaatgatttcgcaaatgctctacagcatctgagttatgaagagaggcatttcaacaggaaaaggaggccacaatgtttagttaagtggtaaagaagactcactgaaacttaaggaaaaaccaaagagtatttccatggttattttcaaatatttgttctctcatcagttctactctgggcaaatatataatgcagaatttcactttttaaagatcacattattgaaactattctgctaagcaatgacttcttgatttacggtaggactcaccaagattttaaataaagcaataaaaacagatttgctctaatggctttagtgttatacactgtggttgatagtgtaatgttttattaagattgataaacattaagcattgtgtatttgaatcaaccactaatccaaaccagtaagcatctgttaccattcgtgattgtctgttatgtgaaaagcaacattattgcagagctaagagtatcttgagcagtaattgaaatagtagcctttgctaactggactgatcactacaactgtctttattttctgatgattataatgcattttatctactagagttgaggttttagctgagtgatcactttcaaaaagaatgattagtcttgatcaatagtgtattacctatagatgagacttttagcataatgcaatttccttagctggtgttgagatccatttcatctgttcaggaaatgaaagcaggagatatatagtactttggattgtttgtattgcagattagctaaatatttgtgggaaatcagaggtctaaaacatgcttaaaattctagtctgatatctggataaagaaaatgcagtacatatacaccatagaatactatgcagccataaaaaggaacaagatcatgtcatttgcagggtcatgggtggaagccattatcctcagcaaactaatacacgaacagaagaccaaacactgcatgttcttacatataagtgggagctaaacaatgagaacatatgcacatggaggggaacaacacacactcgggcctgtagcaggggagggagagcattaggaaaagtagctaatgcatgctggacttaatacctaggtgatgggttgataggtgcaacaaaccaccatggcacacgtttacctatgtagctaacctgcacgtcctacacatgtaccccagaacttaaaatttttaaaaaaaaatctagtctgttatatggtagtaacagactattagattggtgcaaaagcaattgtggtttttgccattaaaagtaatagcaaaaactggctgggcatggtggctcacgcctgtaatcccagcaattttggaggccaaggtgggcagattgtctgagctcaggagttcgaaaccagcctgggcaacatgctgaaaccccgtctctactaaaatacaaaaaattagctgggcgtggtggtgtgcgcctatagacccagccactcaggaggctgaggcaggaagaattgcttgaacccaggaggcggaggttgcagtgagccgagatcgtgccactgcactccagccttggcaacagagcgagactctgtctccaaaaaaaaaaaaaaaaaaaaaggaacaacaaaaactgcaattacttttgcactaacctaatacaatctcattaagcacagtaactctgcattgtgtattgtagaagcaccagaattttcttacaaatgaaatgataatggctttttgatgtgttccctagaaagaattgtggtccatcatcttttcagtagatatactttttgttatttagtgctttaggtgttatttgctaatattacagccaaaataaaataggaatgtgcagtggaactcatttcttctctgttatagctggctctttgaaagttgtttgaggaaactctaattacctacagccctgcaatgaattgcacaacagatgtactgttttaaagtcttgattcttgcatgcatttttcaccttttacttcagttttagtctttgatttggaacacttaatgttaagcagtataaatgtgtctttctaggtgacataattggattctctctctctctctcttttttttttttttttttttttttgtgaggaagaaagcaaggtcagcattagctttgcattttcttcccaggttgttgttccttgaatggagtcagagttgggtcagggtcaaaaatactgactactactgctactactacttcttcttctttagctaaaatattgtagtagaatctacatatttttgataaaaaccccttctgaaattttgcattttaggtaatattcaaatgacatcatttcagtccttttgtttgttattacttctgacaaaagcacttttctgtaagcttttcatttattttactcttcagctatgaagtatttgattatatgaggacacaggaagaaataaggagtagcccatggccccagctaatgtgttagacatcttatacaggattagtgctagattagttccatgaggtgatttgaactgtcaaggtcatcaaaaacaaggtaagtctgagaaactgtcacagccaagaggagctgaaggagaatgatgactaaatgtaatctggtatgctggatgggatcctggagcagaaaaagggcatttaggtaaaaactaaggaaatccaaataaagaatggacttgagttaatgctgatgtatcaatattggtccattaattattacaagtgtaccattctaatggaagatgttagtaataggggaactggattcagggtatatggaagtctctgtactatctttgtaatttttttgataatccaaaactattctgaaaaataaagtttattcttttaaaagaacagcatcataagaggtgatctttctgtttagatgacctcttggtagtaaggtataagataactgtttaataaaagcacaaggagcataggtaggggtatgccatgagatctagaatgtgataatcctggtagtgcagtatcaattcttggacaagggcaattctaagtcaaatagacatgctgaattcacttgaagcagaattgaagaggtaggaaacatagtcatttagcataacctgaaacctttactccaaatgcattatgtaattgagattaaaacttgttgggaacatctaagtgaggggtggacaaccttgtttctgtaaagtgccagacggtaaatattttaatctttgcaggccataccgtttttgtcacaaccactcaactctgctgtagcaaaaaagcagtcatacacaacgcgtaagcgaatgatgagtgtggctctactccaataaaactgtatttacagaaacaggtggcagtctggatttgtcctgtggtctgtagtttgctgacccctgatctaagtgatcatactgcccagctccattaggtgtactataatatctatttcaaaaaggaatgcaatctgagcaagatagaataatattgccttccctctgttttcaaggagagtagaaatggcagcaatggagggacagaagtacatggtttacttgtacatatggtcattgtgcctctggaaaccccaaggtctatgtatctgaactcagagcaatttattaaccacactctttttagatttagtctgattatggtctttttgtttatttgtttattcttaactgattttactatgacacagtatacaaaatcctttagggaaaccgtataccacttctctttgcaatgaaatttctaatcagggcttaaagtagtattttcccaagtgcatgacaggtattgtggtaggctgtgtttttaggtggtaccccaataagtcattaaataaacagtaataaacagaattatatacagtcttctttcagtctttcttattaatacatttgagaaaatttagttttaatgtagcataaacaaccaacatagactctgtttttggtttttgtttaagtgagaatagccctcaagttcacagcatttggaaaggaacaatactttcctggacttttgtagtgctattgttttagtttgttctatttctttttaaggttaccttctgtttatggcaagtgatactgtttcctgttaatgaaagtggtataataaaaaaaaattacctaagtaaagagagtcaacttaaaggagatttcctgaagaaagagattcagattatgagaagaaattggtatgagagagattctccattgctggcttgaagatggaaagggttgtggcacaaactgagtggcccctggctgatagccaacaaggaaatggaccttcagtcctacagctgccaacaacttgaatgaggttggaagtggattcttccctacaacctgtagataagagcccagcccaagtaacttcttgatttcagcattgtgagaccctacgcaaacaacctagctgagacacctggactcctgacctacagaaactgttagataataaatgtgtgttttaagccggtaaatttgtagtgatttgttgtgcaacagtaaaaaactaatacagcctataggctttgttcttactgctcttcaaacagagaccatgccctcctccaccaccaccaccagttcccctaacactgtgtctcagttcttttagtggttacccttaaaatagcaacatgtattatatacttaccaagtataatattagtcagtctcattagccttatctcagccaatgcaaggatcttaggacattttaactttattccttcctgatttacatgttaatgtctatcatatattttaattctttctgtacttgaaaactcagcaagacattattattacttacatagtcagtttacttaggttcattcacatatttatgttttattttactcttcattctttgctgtatctttgactttctatccggggtagttttccttctgcctgaagtatcctttagaaatttgtgtagtgtggatctgctatgacaaactctctgtattgtcttaagtttactttcatcattgaagattattttccctggttataaaattatttggatggcactttattttagctcatcaggtacatcatcattctgttgtcttctgatttctattgtccactgtcaaactgtcacttctttggagatactctgtccttttattacctctggttattttcaggtttttgctttgtctttatttttctgtagtgtgtctaggtataaatttcttttgtttatcctgccatgattcagtggaatcttgaatttgtagatagacacatctgatgaaaattctataaaaagatcctatgaaaaattctcagccatttcctcatagattttctctaactcattctctctttcctctcctgctgggaccccagttgacatacattaaatcttctcattattttatctaagtttcttaccctaattctgtgtttttcacctttttgtttttctccatggtgtattctggatcatttattttgacctatatttctcttcattaattttattcagctttcagttcctctgaaacccatccattgagttttaaattttggcttttttttttttttttttttttttgagacagagtcttacttcatcacccaggctggaatgcagtggcgtgatctcggctcactgcaacctctgcctcccgggttcaagcaattcctgtacctcagcctcctgagtaactgggagtacaggcgcgcgccactgcacccagctaatttttatattttcagtagaggcatggattcaccatgttggccaggctggtctcgaactcctgacttcaagttatcaacctaccttggcctcccagatcgctgggattgcaggcgtgagtcactgctcccagcctgtattttttgtttgtttcaatacctcatgtattttgtcttttatttttgctaattctaagatacggtatcttttcttgagagcatctgcctaccaggtttaggggataggacagctcatggccaggactgctttaatccaactttaagatttaaaattccatggaccaccagataaaagagagccaggctccaagtccatgcgaggccaggtttgttttgggttcacctccaccctaggcgtagcctttcagaacaaaacagaataaggtggaggttggtttatcaaatggactgtaggtattcactcactcattcattcctatgaggccctatgagtcctatggggcagttgcttcccaggggtggagaattaccctccaggcaaaagtagttttatgtgattgaactcactactgtgagttccctttttctcctagatcatcaactggcaaaatttaagtaccttataagatatttgatactttcaaaaaatgatggagaggggaaggttttattttgtttttcagtaggaaggctagtgtaggttatctatttcatgatcattggaagcagaactttctctggcttcttccttgtttctttgttttggtagtgaaagggtacccttttggtatggcagacatgatactttttaggggagaagtaatgaagaagtacttgtacaatagcagatgagccccagaagaagtctcctgttgttcgtatgcgccagacacaaccctttatgccttgttatttcctgtactgctgagaaccctctaaagtagctattatctccatttcacagtataaataaagtagccccagagagattgaataactggcctctcattatagttagtaatgagtaatgggcacatccaggatgcagccccaggtcttttgagctatcaagcccttgctctgtttatgttgtggtggctttgattcaaagaggaaaaagttaaagtctatcaggggctaaagtgcattctctcaaggggactttcccataattatggggtgtttgcagctggagtgtctgtacgtccaggttgcctgggcttgccaaaaggaagttgtaagttcattgtaaaatattaatgtgcagggattcttggttaatagaataaattattttttctttaaaaagttcaatggtctctcagtggagctgcctaaaaaaattcatgttaaaacatcttgttcttttacatgatctcaagccatctgtttgcatctatgatagatattcttcatgcttcattccctatttcttccctactggttgatataaagtaaaggattccattaaaggacagggcatagtaattgcatatgtcttgatttttaatgaattgataaacagtcattggccaaaatgtttctaattttatgatctcatcctgtgtctatttactggtttaaatttgtgctcaaaattgtcagtcttcagtccagcattaattaggaaccatgaagttttctttgtcatctgagtcttaattgagtttatatacctctaacttcacaaaaaggtgatcatgtggataatataagtagtttatttccatttaatgatattttctggtggtaagctattatagtgattgagtgtcatatttcatcttgccagatcatacaaactgaaatttttaagcaaactattaaaacatccaaaccaacaaaaagcttgaatgaattctgagctaatcattgtcacagctgattttgtaaacctttaggttgaaaagctttctgaattttaggagctatgtttggttcagttctctgctattacaaaatactattttgtaaaatgcctcaagtttataaggcctattttaaatcattaaagtatttaagaacagatgttattacatggtaaaagttaaaaagtctgctttctgagtcttagttatggtatcactggaaggattttgaattagcaatcaatgtctctagtaaaacaattatttttgaagatgtgtttaaaaaatagttaacatgttatatgattttacagcttttgtttacctttcagtaattggcattgacaaattaacatttttatttgtattagataagtgaaaatctcccccaaggtatcagagagctatagcttcaaattaacttaaatgtaactatgctaatgtaagtgtctggaagatggcacccatgtttgtgcatcctaaaatggatttatctatttgtccatccagtagcatttactgggtcttcattagcacagtgtcaggcacagttctatatgttagagactcaggatggataagagaaaattcctgccttcagagaactagtttagtcaactggtaggtcctttattaagagctgaccttcagttatgcataaccgtgtttgtgtagaatactgtaacccctaactttcctatttgtgtaatatggaaggccaagtgatgaaattgttattaaaaacaccaattcccaaacagtgtgccatgattttaatatgctaaatagactgtggcaatgttagatttcctttttgactcaggaagactgtgagggtgagtgagtgagtgagtgaggatgtatatgtgtgtgcatgaggagacaacagagcagaacccctagtctagtatgctttggttagttggtattcatcaaaccccaaaagattgagaaacatcgttgtttgagaccctaaaattctaaggtagagtgaggaatcatggaagactacattatggacctgatgagtttaatgcctgccatttttaactgagtatgttgatcataaaagaactgtagcttgtactctcattttaaatagactggactccttctgtaatagggattgtcaacaacaacaataaaaagaatggactcctaatgctagccagaataaaataggttgaaaatgcacagatttccatttccagaacaaaaaggcgtagacttacttttcactgccccttccttcctctataaatataactaaatgtcctggaaattattcaactgacagcaataaagggattctgaaagttgggaagaaagcagagtagcttggaacctcaggactagaagtttgaggacaatgagtataagttcactgggttttcttttaatctcccattttctcctagactgggtgctggagagacctacaacccagaatcaccagtgggcaaagaaagcagaacaaaaagcctgctttctctggctagaagaccaggaaagggaaagcccaacaaagacctaagtgggagtgctcatccccactgtttcacagtgggtcccggtgggcactctgatctgtccccattatggccccagttgctgcgggagcagcaaagcccctggccctcccacccactgctctacaactggggccatgacgggtggtttgttctgccaactacggtgaagaccagaccatttcagcccctgtggtctgctctgtagacagcagcagcaacagcaaagcccaggctatactgcctctgctcccaactggccccagcaggtggtctcttctgtagggagcagtaagcagctgcagccgcagcgaagccatgtgtcttcctgccctccacctcatggcttaaggagacccaggccccagtaggtgaccccctccccctcaaggtttcccagcaatagcaagtggccctgggaagtaccttttatccctgcagatggcatcagcagggattgagtgggagtcccaacatcaccagaagaatgaagcacaccaaaatagcattgtgagggctcagaaaactaaactgtcattggaactgaagcccacaaaagtagtctagaacctacacactaaacctaagcagggtgaccaccctgctaaaatagaagatcctgtcatcaagtcttctaacaataagcaaaacatccagggtacaattgaaaaccacttgtcatagcaagcaccacaaaatatctaggatacaatatgaatgaaaaaagacatcaactgatgccaatacccagttgaatcagatatgggaatttgataaggtttttaattcagctgtcatgcaatttatccaacagtcagttgcaaattttcttgaaacaaatgaaaagatagaagatctcaggaaagtagagccaagagcatttcctaatgaactggaatgtcagagaaaaaaaaagggtcaagaatggtgccataatttttggctaagctatcagaaggaaatacggagttgccttcaactgagatagcaagaggagagattagaaagctcagttcactcagatgttttgggggatctgattgccctttctcttgtcttccatgctctcttgtgtgccttattgattagcaggagtcattacggagactgagaggttggtccatccatgggaaactcgttaaaagtgagcattactaacttgcatactcacatgcagggagtttggtttcttacctaacttgaaaaattccccaagtgtttagatgtttgattttactatgtcgcctaaacagttacatccactatactcttattttcaaattttttcccctaaagcaattattttccagatcatctactttatgtctttagacctagaaactgattactacaattatgattcaaaacctattttctgctgccctgcactgagctgagtaattgggtgtaaatggttatttcgtttgcatgctttgcctttgtgttaagtgttttttggttaaaagaccagaggttgcattattgcctgctgaatatgcttatattaacaattgtaaaaaagtaaattacttttgggagtattaatgaataggcacttaaattgcatagttaaatcttttccatcctttactaagcaaacaattggattaccccccataagaatttaattgacaatttccatgccacatttgggtagggaatatttcttacagacaaaagttgtttgaaatcagaaggttcttagccatttcaatttcataatttgtatttgtgttgttattataaatactaaaatttagattatcatgtccaaagtccactgataataaatgctacatgggcaacggggtggagtgtgacagaagagagaggtttcttaaccacaagactggactgctaatgtgtaatatgagtacgggggcaggaggtaggtattttatatggtgtttcccaaacttacttgaatgcgaaactttcattctttaaggactccacaagatgccaatttgggaaaccctgacttagagtgttaggtaattacatttttgtttctgttttacagtataattttgtataatcctgatgcaactgaaatgaatagagagaggcgtattggtgactgagatatctttcactagcttatttaaattagataatttaattttatttaatttagaagtaggtttacctggttatggagatctttaaaacatggttttaaatgagaagagattaacggtattccacagaagtatcactgaaataaaaatctcttaaggaggataacaacttcagagtgcagatattaacctccgccccctagctgcagagttgtgattaatggcttgcaacaatactattataggataatgtagcatttggaaaacaacctatgttagtggcatattaacagaacacaccccttagaaatatgatttacaatgtaatttcagacttccagacttccataattattagtttccatttacaaagagtggattatgcacagagaatttgacaattgtgataatgctaggtactagttaaaagtaattaggtttatgaacactagtagagaaggaggagtgaagaggaggagaaaaaggtcaatagtgaatttcaaaaaagttgtttctctactaaatattttcattgggccaatttctgatgtataggcccacatttagaaaataacaaaatgtgaatatatagctcttaacataaaaatgaaagttatggttttcttgcaccagccttaagaggagtgttcctgtttagggcagaccctgctaggccttcctgtttgttatctccacaagatattgtaccttaagagcttgcctttagcactttttctttttcctttctgggcttcttacagtctttctatggggatgtttccagcagccccttggggaggggtttggggatatattcatgttttctggggctctgtcctctgtatcctgaagtgctgtcattagcagcaatggcttcaattacctctcattcactcatgctacctagggagtatagaggttaagaatttagatttcaaagttccatatgtttaggctccagtcctagctctaacatccactaactgtttgaccacagacaacctcttagcctcagtttcctaatctataaaatgaggctgatattatattagctatgatgacaaataaattatgataaataacaagaatctatgtaaacttcttagcagcatgcttgctgctgacatgttatattataaatgacagttgttgatgtcttcattatcatgacccgttccttgaactttatactcctatctatatgccctctataaatctctgcctggatattccatggaaaccaatattttccaaacatagccatgtgcttcgtttctttctcagccttctatcagttctttctcttgtaattcctttctcatttggtggtatcattcacccagtaactgttgccagaaatttgtaagttttcttacaactcaaccccaaccaccatctagctaatcattcactgtgttatcttgtgaatttattttcttaagtatctctctgtcgcctttactttatcacctcttgcttgggctaatgcaataacttcctgagtggctcccacccactccacaacgtctctcactctctgtcatagtgatctttggtccccttttccttttccagccacttctcaccctccagtttttcatgctagcagtaccaaatagcttgaagtgcccagcacacacttttttttttttttttttttttttctgagacagagccttgctctgttgcccaggctggagtgcagtggcatgatctctgctcactgcaacctccgccttctgggttcaagcagttcccctgccttagcctcccaagtagccgggattacaggcatgcaccaccatgcctggctaatttttgtatttttagtagagacagggtttcaccatgttggccaggctggtctcgaactcctggcctcaagtaatctgcccgccttggcctctcaaagtgctggagttacaggcatgagccactgcaccctgccagggcccaaaacaccatgccctgtgttttgacttggctgtaggccattgcacaggctattacttacctctggaatcctctcctttccctgcttagcccaacaaactcctattcattgtttcaagccctccaggatgtccgtgtgtcatagaggccttctctcagtaccatgctatccacagatttttaaaactcatagtgttatactatttctatactttataactttacactaacattatatataacgtatgtatacatacataatgtatatatgtatgtgtataatgtatatatacatatgtatacatacatatatagtatatatagtatatatacatataatgtatatatactatatattatatattatactatatatactgtatgtatattatactatatattatatgtatatattgtatgtatatatacatatatacaatatatacattatatatacatatatacatgtaatatatatacattatatatgtgtatatatacatgtaatatatatacattatatatgtgtatatatacacgcacacacatatgtcaacagcagcctactagattggaagttccctgaggacaagaattgctttattaatctttttcttgtttattctttatattctttgtcttattttcattggggaaatgaggtaaataagataaaatgtgcaaatgtcaatagaatttttaaaatcttagtgctttaatatttatttttgatttagctaagattgcctaaagtgtgtaaccaagtcagaattctcacttttgtaaggtttatcttcatatgttttcttgcttgtttctttccatgcatgtctaatctccttcttcacatttcttatgttataaaaatcttttttcttctctattaatagttcttgatatatcctccatcaagtgtgagctaacaaagacctagaatcgatgtccctctacattggctctaaccccagcccttctcacacacgcatgcacacgcacacacgcacacaaacacacacacacaccaatcaaattttccagaacctttgctttgagcagaaattgccttatgtgactggcagtcctctcataaaagtagtaaatgatgagtgtattatagttagactcagaccagaagatggtgtgctacatgaaatctaaagtgaagtctactaaacttcactgaagtatcaaggtgtgacagaggtactaattatgtcaatataagtactgagttagtaaatgctagtcttaactctgaattgttcagctttgacaggtgagctagatttgttccattagcttattggagattcattgctagctgtttcaaataaacctcccccttctattttcaaggaatgatctgaatcatactcctttgtcaagtctttaattgttaacatttaggcaacagttcctgagacttttattttaataattttccactccgtgtgtgttttttgcggtagcaatgagtaggaaaacttttttttctttggtttaatcactgtacctaaagcaactcagcttggtgaatgtatgtaagcatatgtgttggagctggggatgggtaccagaagtgttaaaaagtgtcaggacagcatctctgttcccttactgctatcacattgattaccgcgataatcattgtcacagctgattttgtaaacctttaggttgaaaagctttcacaaagctatcacaaagcacaggaagacaaggaaaggatttattgatgaaattatatgcataagctcttctttagtggcaatgactacactaaatagtgttgaaatagggaacagaccatcgttatctttaatcggtagagtttttatataaatttatatatgtctataattttcaagattttattcttactgctaatgttgtcatttatagttattttattttagctttgtttcctttttgcctacccaccatctatgtccctcaattcttaacgtcagaactgtataaaaagtagtaggaagacacagatttagaaaatgggtagagaaatatctagaagcaccatgatttctcaaaattttatgtacttacataaaattgcgttacttaataaatgtatcaatggcttattcatttctagtttgtcatttttcttatatcattcaccagatattttttgagggcctaatgtgtactgggtactcattaagtttatattttaatatgaatacacacacataaatataacattacatattataagtatatatgaaataatataaatacatgtatgtgtgtatatatgtgaatacacacagtttattctcattattcatggtagttgtgttctataaagttaccatgaatgctgaatgaaccaatactgaaccattgctcctaggggaagtacaaggttgggttccttcaaacctctggtcacaacattttcatcaaccgatcaatacataaccttgttttatgtgtgcttctgtttaaagatactgcatgtaatatatactgttgattcattaacattgaactcacagccaacattgttataactcatgcctgaaggaagcttccctaactcacgtattttccccataaggcacatcacagccttcttgtgcttaggaacactagacagtcccttcagcactatgcttggtgaccatattaaacagcaaaatcaccaagaaaaagcgcaaaatgcaaaaaaatgctctaaatagactttgaaaagatgacttgttgatggcatgagagctgaaacaagaaggcagagcatcatcttgtttgccctcagctggcatcatgcacattgggtgattcaaatttttcaccattacatgcgtgcctgtaaacgactgaaagtgccatgactgttgatttgggggttataagtgaattttaccaagtaggcgaatttacagacatgcactctgcaatgtaatgaggatcagctgtatatcaactttgtgtgtgtgtgttgtgtatatatgtgtgtaaaaatttgttcttggccttcactttccccatctttgtcttttcttttttaaatcattcacggttttcctacgtatcttgtggtacattgcacaattcattataaatgtaatggggcttctaggcctgttgttatggacagaaatttcattgcgtttattaaaggtttcctgagacatgatgtgtttttgtttatagacctctcatagggtgaaaatttaacatgtaactccaaagtttatatgtagcaactcaaagtattattttaaatttattacaattagatataaaattacaactgacaattcatattgactttattatgtttgagatgcagtgtttttttgaagtgccttcaaaagccctttgtgctcctccccaatcacaaccccctccccctcaaaccactatcctgccttttatattaatctttttaaattctctttatagctttaccccctatgtttgtatctctaaggagtatattgtttaatcttttagaactgagtagcaaacacaaacttagctgggtaaagaaaggacaatattactactattgtatgaagacttaggagaagagaagctgaacaagctcttgttcatagtctggcttcagatgttctgagagtggttaggagcccattctgggaagtcggttggcaaggtcatgcacaaataaatcccgagacaaggggctcttcacaggcaggacatttccgctgtagtgcaggatagggggaggtactgagcacccagcaggaatttggtggggggcactggctgccctgcatttcctgctcttcagctccctgatgcctgcctcccattctcaggaataggtcaaagcaggcactgctgtagggtgaaattaagagtcctctgctagtctaggcagcagagaaggacagaaatctcctcagccaattgtcaggaaaagaaaaacagaagaatctggatgcagctcacctacctattctgttttcaggttaaaaaggtggcccgtggcagtggaaaactgatggctctcagtctggattggttgtcctctgtgcctgaggcacagctgtcagcctgagatttcccttccttgcattcctggggattcccttcatctctcttctgtgttggatctcctatttgctgtctccaggcatgctttttattggtctattcttgttttagcaaacacgtcctacaataatttcttcagaaagtgtgcatggcaagtaatttattgaccttttttgtctgaaaatgtccttatggttaatgatggtctggctggatgttgaattcaagattagaaatcattttccttcatgattatgatggtgttgctctattgtcttctagcgttggcattgagagatccaaagctattctgggtgaattgtgtcatccttcctcgctgcacatctttacccccacttctggaaacctgacaatctccttgtccacagtgattttaaatttcacagcagtgtgtgtatggacatgggtcatttattttgctgagtacttggtgggtccttttaatttgagctccttatgatttaaattctgggaagttttcttggattattcccttaatttcttccccttcattttctttgttatttatgctctgcttttcccaaattatcggccaacgcttctattgataaatttctctgtgtgtttttcaagggctcttttgttttctgaaagttctggtttttgtttcacaattgtgatatctttctgaggatattaatggtaatttgaagtcttattgtgtagtgtgtttcctctaagttgctctttttgtttgtttttggttctatcttccaaattagagactcttcagatgtcttaggagccttggttgttgtatacttatgattagaaatagagcaatgattctcaactgggggcaatttgaaccttccgtaccccaggaggatatttggcaatatctggaggactttttggtggttaaagctgcagggggtgctatgctactagtatctagtaagtagaggctagggatgttgctgaacatcctacaatgcataggacatccctgcacaacaaaaaattatctagctcaaaatgttaatagtgctgatattggaaaccctataatagagggcctcaaagctgattaagagagctccgaaggtgcaggtggaacgtgttgactttgggttttgctggaggatgatctagttgagtagtttggagaacctcttcattatctttaggtcttttcttctgagctagtcagatattcaatagaaaagtctttcatctcctgccttaagggtaaagatctggcttccaatattccccctgttagtcaaaaagggactcgggctgtctgcgttcagtgtatatgtgaccacataatacccttgcttttcatataatacccacttcctcaacagccttgtgtttccagttgtgagaccctacagtttggttttttttttttttttttgagacggagtcttgctctgtcacccaggctggagtgcagtggtgcgatcttggctcactgcaagttccgcctcccgggttcataccattctcctgcctcagcctcctgagtagctgggactacaggcgcccgccaccaagcccagctactttttttcagagaccctatgttttatttactctttccagataattaacctgttgggatgagggagcggcagttatccatggtatggagtacaggagaccacctagggctctaactgcttctctaacacatttcattcaaaccttgttactttaactctaccctctcttcacttccagttccagagttatctggaacccattcatgagtttcttggggattctacagtatagatgggtttggttctgaactttccttattatctctttgcagttcagcttttccaggtctgccaagtcaattaccactctccatctgctttcttggattccaaatttaattattactattatctcctctcttgtactcccaatcctttttaaaaacccctttggtatcattgtagtggagtttggatagggaaataaattagatacattgtgctcaatctatcccatgatcctggaaaccaacatgctgtattctagcataatttcatttaattctagtcttattttggtatatttacctttgttatcagaattatttcctagacttaggttttcttcacataaatgaaaactagaggatattagtctgtgtctgcatagggacataattgaattcttttcaaaaccttaggggatattgtagtgatatattcacttctaacatattctggtttaatttacctttttgcttaaaaacatagactgctgtaagcagccatctgcctcaagtagaaccttgttttaccatcccaatcaatattcagaatttgtaaagagttgaataaagaatatatatttcattaaatctgaaatgctgtcaattatctttttccatttttaatacggtcataattagtggaaatatgagaaagatagttgtttatgatgacggcttataactatctctaccagtattttcccccacataaatattcaagaattgactgtaccttagatttaaaattttaagggtgatttcaaacatcaataaaatgtacaggccagactgaaacctatacctcctgaatttttgctgttccctaaactgtcatccaagcataagtaataagtgtaatatagtaggtgtgttacactactttatcactcctccctttttaagatgggaaaccaagccaaattttaaattttttatcagtttctgctgagtttccagttaatgggttaaatcgcaaaaacctcaaaacgtattttagtatctttttagggtgttaaatttggtttaccattgttaaccccctggatgtcattgacggacagacccttaaaatgctttacttgtaacctgtcttcaggtcttcagtagttcatagatataattattttctttgcctcgtactataaaattaaagaattggggatttgatttgatttttattcacagatttttaaaagtttgtgttttgttgtctaagtattctcttttctccctagctctattaattttattgttactaaaagaaaaggggggagaagatatgctttcttcctcacctttgttcaagcaggaaaaagtaaagaattgactcgattgaccatgaacaatcaaccccacatacagatgttgggaagtttccaaaaagatacagtgaattgaagcagactattcaaatgtatcataaatagagtcccaagggtttatgtgtggacaaaaaccaattacatgaagcatttcctgaaattgcttgctattgtcaggataagtaatcagaagtaagacatccaggttgagaatgaaaacgtttgtccctcagtttgtaatattgtcttctcacagaggaaaatctttgaacagttttgagggattatcaaaaggatcctctttctgtagagttttgaaagatatattattaccatttcttttcctcccaggttagcttttttaggttgcttgaaaagagagatttgaagctgtggtatagttgatgtcctcatgatgtcatcttggataaatgtttaagtctaagattaaatttagtagttcgtcctgtagttgaaagaagaaaaactttaaggccagcagtatcacaagtgtagtactgtaaatgaagaacttttctctatctgctaattgagcacatgcatctaggtgtactgtttgtacctgtaataagcgaatgaaggtggtttttttgtttgtttgccttctccccaggagggggaaaatacacgcatgtatacatgtacacatgtatttaatgaccaccatattaaccttcaaataaaccaatcacattgctattgcattctgtattttatagtcaattcacacacacacaaatctatatttggattatcttaactgagttcagatatttcttttataactggtaaccacagggaaccgtgtgtgtgtgtgtgtgtgtgtgtgtgtgtgtgtgtgtgtgtgtgtgtgcgcgcgcccgcgcgcgcgcgcatgttccctggaccagggtatgggcatctttaaatcatctcagctgattcaactgtgaggtctgggtcagcaaatagctagaccagtggctgtgctcatagaaattacttcctttcctctagtaatttcaaacaattctaatttgaagtttgaggaaaattaaggatttctctgtgatttcaggtgaaactggagagggttggagaccaaaccacgcaggcctttctctttgtaaagtgtttgttcaagtcttttgcccagattttattggagtgtgttttttttcttattgtatttacaagttacttatatattttggttcttgacttggactgtatattgcaaatactttctctctctctggtgttttaaacagggatatcatatcagattttcattttttaaatatcattacaagaatgaatgggagaaacaagtttttcagtggttctagtagaagatggtaggatgtgggacatggagagaagaggacaggttcaagagatatttgagataaactcagtaggatttgttagtgatgattaggtaaatggtgggtaagatgagagggaagtgtcaagaatggcttgggtttctggttcataagaataccaccattactatggacttcacttattttgtttaagatgttgataatctatatagaattgtacagtcattatttgccttgagcataagactactatttagaatttttaaaaaattactgcaaattgcaaatttattggtcatttttatggttttggtaatcttttaaaattatctcatgaattatagaaaaatatgttggaagttatattacttaaattttattttgaaaactgtgttcaatttggagtctaaagtagaatggcaaacattatctatattatatagataatgaaacagtaagacattaatgggaaataggaacttaagagaatcaatgaattaaaattgactttttgttttataggggtcccttcagtgttgtacgacgatgtatcaacagagaaactgggcaacaatttgctgtaaaaattgttgatgtagccaagttcacatcaagtccagggttaagtacagaaggtaagagatggatttcaagtaagttatttgatgtctggctttattccatctccaaaatccatttaccaacctaaccttcatctgggggtggggaagcagagggtatgatgtagagggaagtgggtggagacagtttaaactctattctagtttgtcagaattctaggacatagtatttgaaagacagggtaatttacagagttataaaatcatctaggatttctatgggcctatgttttttgactaggaagaaagcaaaaatctgggctttttttttagggtctaattttgaattatattgtgtgggtcatgggatgggaaaggaaggaggtgaaataatggcaagaatgataattgaagattcagaagaaacttagttacctcaaaatgcatcacttactacctttaggattatgatttagtggaatcaaaagattcatatctcacatttggcttaagtcacatatgatatatgtgtaaaaatttgaaaggtcagtactgttaggactttcaggacttaaaattttgtttcaatacattattatagataatcatatttatatgtatatttataaacagtacgtaaacattttaaagttttattttgtttgttttttaagccatagtttcatgtaactgtgacatacatgctcatacttcagatggcacaattgatcatgatactaacttttctaattagcccattactaacttttcacttttccacagttcagtaaaatatgaatccttctttagtccttccctttttaatcccaagagcaatacagttgataatttagattggaaaatctagggcagtgtagcctatttatattttatccagttattttactttgggaagtagaagcccacatattgtgagcttcaagtttgtctgttcctggagatctttttttcttttaaatacttttgtgaccctttgaattattattattcatataatgattatggaagattcttagaagttgctactcacaaagaataactgatttgtttttagtgctttaatatttaaaatattatggtaagatttagagattttatattttatggttttatgctctagaattggctattattgcttttgaatataaattattttataaatctagcaacatttaaaattgacttttaagtggggtttagaacaaaattatatttccttacacctttaactgcctttaagcttaatattctatatttgatttttctctacctctgttgtctgaccaaatactgaggtaattttgtataaacctaattcattaaacatatgttctgatcctgtttataaacttagtaagattccaattttaaatcacaagtctaagtcagttactcagttaccaatattaaattggaataatataagccaaattctcttaagcattgttataaataattaaaataaatattaatagcttctttttcaacccaaaattatcaataccagagttttgacttatctcattgttgtaccaaattctaaatctccccaggctaaagacattctttcgggaaacaattacttaccttctcattggctgaggttgtttattgacagatttcttcagccagatctcttgagctacagactcagaatgccaagctgaacctgtctcttgtcacttggtcagggagtcaaattccaaatttacaaaaggggaaagtacttagtatatagttcatatacctggtattaagtcctgtcttcatttaatataatatatgggagtctgttgctgaagttatagctcactccttcattactttgccattgctttggctatataaatgtcttcaagtcctattctgaagacaaagccacccattctattgatccctcatactcttaagcctccttgaacttaatagaatcatgtactcttttcatatccttcctatatggtaggaccacagcgtatagatattaaatgacatccagttggatttgggatattactcatgactttatctgattttggtcggagtttagtggtattcaagtgaaaatatgcaattggccctttatgtttatggcaccagaattaagtttttccatcttctttagcacagcgactcagtataaagttaggaaacaatcaaaattccatctccaccacctctacctttttttcttgcgatgggattcccatgccctctgttgctcatgttcacacaagctttcttgattctgacttggacacattttattataagatgtataatatatgtaataaatagtaaattatttcattatataaagtctctgtgaacagtgcttcccctccctcaacttctttcaacccttttccagtcactatgggcaacacatcttaactcctctgctcttctggtccatttacaaattgttagggtccaaaaatgacctcattcatggcttagcatagaaggagatgctacataagaagacacatattttgaagtaaaatttaacacagtaaaaaggaatccataagttcaaataatatctagaaatatctatatttaccgttacattctttcccaaataaacttatctcttaagcaacagataatttaaaatctattttattctttattctttcctttttgtttcattttattattttatttttggcttagtggtttgtttgctctttgttaattacctcaatattttttcttgttttcctagtgtacttgtattcaaatacattattgagtgaaataggtctttaaagggttatctaagaacctaccatatgctatttatttggataggtcattataatacaaatgataaataaaaagagcccctagccttatgggacctatgttttaatagtctccaaccattgtttataacatggtttttattaggaaaacaatgtgtaataaattcgaagtaaatcatttacaaattaattttttttgagatggggtctctctcttgcccaggccagagtgcagtggtgcaatcatggctcattgcagcctcgacctccttgggctcaggttatcctcccacctcagccgcctgaatagctgggactacaggcatgcgccaccacacacagctaattttttgtattttttgtagagatgaggttttgccatattgttcaggctgatctcaaactcctgagctcaagtgatctacccacctcggcctcccaaagtgttgggattacaggcatgagcctccactcccagcccacaaatttacttttgaaatgaaatgtgttgatttgttgcagaccacctgtacgttttaatattttaaattctcattgctctaatgaagatgagatattataattggtgaggctaaagatgagacatttcataacagatgagatatttttgaatatctgttctctacttttgccatcaaaatcataatttttattttatagggcttcttaacttgcaggttgccgactattcaataatcccttgaaatagtaagcagaattatgtttatttttttagagagtccatagctcttattagattcctaaaaaggcatattattcctaaatgatttagaatttctcctttcacatgtatgaaaaaatgaaattcatgcttatgaacatgagatgaataagaagtttctactaaatcaaaactggatgaatttatattaggatatgacttctgattgggggattttttatacttacatatacagcttccattaatgaatttcctagattattatcttgaacttttaattaatatactttttgtctcttactctactgagccactaatttagagtttttgtcttaaaaatagatatcaaaattaattcagacaaattataataaggaaactaaaggaaagtaagatgtatagaattggaaactaaattatcaaagttctgagttcttgataggactcaattctttatggtttattataaaagtccaaaattaactgtttttatttgggagtattataaattgtgttctagaaagagtatattttgggctccagtttgcttagtcttcaagaatgtctcattctaaagtcccagatagtaggtgatatcagtgaaattgaagaagtaaggaccttgacagttctcacttttcatttaaaaaaaagagaaaactgacagaaatgtcagaatcaactttttcagggctctggaaattgaccaaaggcttacagctatccaggaataatttattcaagaaaactgactgattcttagtaacaacagtgaacttcatagcattgtataataatttgtcccattcacatccccctttcttccagttctgtagtaaccttgaaaacaaacagttcacaatcacgatgaaaaccagcaacttgacagccatcaaaggaggctgaatggggatggagctcctctaaggccgcattcccataatattgtcatttttttacttgtctggtagttccctggaagacttgtcttagtacatttgtgtttctataaaggaatacctgagagtgggtaatttatgaagaaaagaggtttatttggctcatggttctacaggctgtacaagaagcatgacaccagcatctgcttctggtgagggcttcaggaaacttccagtcctggtggaaggggaaggggaaccagtgtgtacagagatcacctggcaagagaggaagcaagagagagatgggaggtactaggttgtttttaacaaccagttctcatgataactaacagagtgagaactcacttgttactgccaggatggcaccaaggcattcatgagggatccacccccctgactcagacagctccattgggcccctaccttcaacattggggatcaatcttcaacatgaggtttcaggggacaaacatcccaactatagcaacccctcttgcaataccatctttaattggcctgactcagagatcacccagtgcaaaaaaagtttcctctgggggcatttgccaaaaacctttagaggtagttgtttaatttcattgctgcctgaggcatagataacagctgggcaaacaaaaagctaacctaaaagcttaaaacaaaaagctagctaatgagatgcccatagaggctttgaaaaagctacaacgtattctctagaaaatactatgttaagaaggccatgcacatatataaggctatgaacaagctcaggaaaaatctaagaaggccttaatttctcacctctagctgactttcaggctacataaacaggaattgaatgataaggtagaaatgtgaactccctgactgagtgttgaaggtatgccctacacatccacaaaacccttgagcaaagactaaactaaataagcagagacttaagtggccacacataaaaaagaatacagactgcagaatgtgttcccccaaaaaatcactaagcaaagagcaggagtaacaataaacagcaacaataaatcctgcagaaaaggagattctgatttttagagttgacacataatattatttaagacactcagttttcaacaaaaaattatgaggcatgcaaagaaacaagaaaatatagctcacactttggggggaaaagcaatccatagaaactgttcctgagcaaacccagatgttggacttactagaaaaagagttaccaaatggaaagtatcaataatgagatagaaactataaaaaacaaaaagagaaaatcaaatcaaaattctggaattgaaaaatacagtaactaaagaggctcagcagcagatatgagcaggcagaataaagaatcggaaccagaagacatgaagataggttcattataattatctggtcttcagaactgaaagataaaagaatgagcaaaatgagcagagcctcagagacctctggggataccatcaagcataccaacatatgcataatgagaatttcaaaaggaatggagagaaaggagtagaaagaatatttgaagaaataatagtccaaaacttcttaaatttgatgaaaacataaatctacacaaccaataagttcagcaaactccaagtaggataaatgcaaaaacaaaccataatcaagttgtcaaaagctacagacaaggggagtatcttgaaaatagcaagggagaactgaatcatcacatacaagggatctataaaaatattaacagcagatttctttcaaaaaccaaggatactgaaaggcaacaggataacattcaaagtgctgaaagaaaaataatatctaccaagaattctttatccagcaaaaccatacttcaaacatgtaggataaatgaagatattgtcagataaagaaaaacggatagaatttgtcactagcttccttgtcctacaaggaatactaaacgtagttatttatgctaaaaggaaaacttatttttttaatttttaatgtttatgggtacatagtaggtatatatatttataggtcacatgaaatattttgatacaggcatgcaatcacatcaggataaatgaggtattcatcacttcaaacatttaacctttgtgttacaaacaatccagttatattctttcagttattttaaaatgtacaattaaattattaaattatttttgactgtagtcatcctgttgtgctagcaaatactaggtcttattcattctttctattttttgtacccattaaccatccctactttccccaacccctactagccccccgcccccccaactaccctttccagcctctggtaaccactcttctacctgtatcctcctgacttcaattattttaatatttagctcctacaaataagttaaaacatgcaatgtttgtcttcttgtgcctggctcatctcatttaacataatgacctccagtcctatccatgttgttgcaaatgacaggatctcattcttccttatgactgaatagtaccccattgtgtatatgtaccacattttctttatctattcatctgttgatggacacttaggttgattccaagtcttggctattgtgaatagtgctgcagtaaacatgggagtgcagatacctcttcaatattctgatttcctttcttttgggtatatacctaggagtgggattgctggattgtatgatggctctatttttagttttttgaggaacctccaaactgttctccatagtagttgtactaatttacattctcaccaacagcgtacgagggttaccttttctctacatccttgccagcatttgtcactgcctaacttttagataaaagccattctaagcatagtaaaaggaagtgtagtaaaaggaatgacaagaaatcaaagtagaacaccataaaatatctatttaacacaaaaggaggcagtattggaggaatacaggaaaaaaaagacagatagaaaaccagtagtaaaattagaaacataaattgtaccttgtcagtaataatattaaatataaatgaattaaacactccaattacaaggcagagattggcaacatggatgaaaaacaggtgagatggtatctcatgtcgttttttgctgtctggaagagacatacttcagatttaaaaaatacatataagttgaaagtaaatgagtagaaaatgatatactatgcaaatagtaaccaaaagagctctgaagtggctattactaatatcagatgaaatagactttaataattaaatcagaaatttaatagtcaaacaaattgttactaaagaaggacattttataacaatagcagcattaatccatcaagaagatttagcaattataaacacatatgcacctaagaacaaagctccaaaatacatgaaacagaaaaaggcagaattggagggagaaatagagaattcagcaataataattggagacttcaatacctgacttaataatggattcaacaactaaacagaagatcattaaagaaagagaaggtagatttgggcaacactagaaaccaactagacctaacagacatctgtagaacactccactcaacaacaggagactatacattcttttcaagtacacatagaacattatctaggatagactgtgcattagcccatcaaatatgtctccatcaattttaaaatatctgaaatcatacaaagtatcttctctggccacaatggaatggaatcagaaatcaataacggaagcaaatttgggaaattcacaaagatgtggaaattaacatagtagccagtgggtcaaagaagaaattacaagaatactttaaaaatactctgagatgaatgaaaacaaaaatataacttaccaatatttatgagatgcagcaaaagcagtgattagggggaagtttattattgtaaatgcctatattgaaaagtaagaaagagctcaaatcaataatttaacctttcactttaagaaactggaaaagaaaactaaacttgacaggcagaaataaggaagtaataaggattataggagacatagagactagaaaaacaatggaagaagtcaataaaaccaaaagttgtttctttgaaaaggtaaaaataaaattgagtaggctttaaactgaccaataaaaagagacaactcaaagtaataaaatccataataaaggaagggacattactactgaccttataaaaatgaaaaggattataagagaatatgctgaaaaattgtatgccacttaattagatagcctagattaaatgagctaattcctagaaagaggcaaactaccaaaactgactcaagaagaaatagaagatctaagtaaacctgtaataagaaatagactgatatgtactcaaaattttcccataaagaaaagcccaggcccagatagcttaatggtgaattctactacatgtttatagaattcatataattccttcacacatatttctgaaaaataagagagggaacacttctcaactttttgtataaggcctgcaataccctgataccaaaaccagacaaagatattgtaagaaaggaccaatatcccttatgaatgtaaacacacacattctcaagaaaatactatcaaactgagtttagcaatttaaaaaatgttctgtagttcttcagaaagttaaatctaaggttatatgacccagccattttactcctagacatatgcctaagagaaatgaaacatatatccagataaaatcttgtatatgaatgttcatagcagcattattcataatagctggaagatagaacccaaatgtctaccaactgatgaatttataaactaaatatggtatatccatacaatggaatgattttttcaaccataaaaaggaatgacatactgatataagctacaacatgaatgaatcttgaatatattgtgctaagtgaaagaagcaagtcacacgagattacatatgttctattcatgtgaaatttccagaataggcaaatctatcagaaggaagtaaattagtggttgcccagggtatggagaaagatgagatggggagtgtctggtaatgggtatgggatttcttttcgaagtgattaaatgttcaaaatttgaacacagtaatggttgcatgactgtgaatatactaaaatccattaaattgtatactttgtggacaaattgtatgataagttaattgtacctgaataaggattttttaagtaccacgagtaagtagaattataacagaaattcaagcttgtttaaacatttaaaaatcaacgtcatacaccttattaatagaaaaatgaacaacagtccacatgatcatctcagcagacaaaaagcatttaacaaaattcaaccccctttcatgataaaaacactcaacaacctacaaatagaagggaatttctttaaccttttaaaagacatctaggaaaaaccaaagtctaactttatatttaatgttgtaagataatgctttcctccgaagatcaggaataagataagagtatctgttctcaacatgtttattcaacattgtactggaaattttagccaaggcagttatgcaagaaatagaaataaaagcatccagattgaaaaggaagacttaaaatgccctctattggcatataacattatcatgtatatatgaaaatccaaagaaattcacaaaaagacttagatgtaataagtgagcttagcaaggttgcaggatacaagataaatatacaaaaaccaattgtatttgtatacacaagcagtgaaaaatctaaaaatgaagttaagaaagcaattccatttaccacagcatcaaaaagaataaaatacttaggaagatatttaaccaaggaagtgcaaggctaataaatggaaaactatattgttgagaaaaattaaggaagtcctaagtaaatggtaagatctctcgtgtttgcctactagaagacttaatattaaagtgaaaatatttcccaaattgatctatagattcagtgctatctctatcaaaatccctactggcgctttttgcaaaaattgacaaactaatctaaaaatttacatggaaaagcaaggtaccccgagtagccttaacaatcctgaaaaacaatggacaaagttggagtactcacatttttcaacttcagaattttttttttttttttcctggagacagagtttcactcttgtcacccaggctggagtgcaatctcggctcactgcaaccttcgcctcctgggttcaagtgattcttgtgcctcagcctcccaagtatctgggattacaggtgtgtgccaccacacctggctattttttttgtattattagtagagatggggtttcaccatgttggccaggctggtcttaaactcctgacctcagatgatctgcccacctcgcctcccagggtgctgagattatagccatgagccactgcgcctggcccagaattttctataaagctacattaatacacatagtgtaaccctggcataaggatagacatatagattgatgaaattgaattaacaatccagtagtaaatccatatatttacagtcaaataattttcaactgtggtgccaagacagttcaatggagaaagaatagtttcttcaaaacagtggtattgggacaactggaggctgacatgcaaaagtttgaaggtggacctctaccctacaccatatacaaaaattaactcaaagtagatcaaagatctaaatgtatgagttaacaccatgcaattttaaaagaaaacataggcataaatctttgtgaccttggattaagtagtggtttcttcattattacacctaaagcacaagcaaccaaagaaaaaaatagataatgggattcatcataatttaaaatttttatgcttcagtagacactatcaagaaagtaaaaagaggctaggcgtggtggctcatgcccataagctcagtactttggaaggccaaggcatgcagatcacttgaggtcgagttcaagaccagcctggccaacatggcaaaaccctgtctctactaaaaatacaaaaattagccaggggtggtggtgcatgcctgtaatccaagcttcccagctactcaggaggctgagacatgagaatttcctgaactcaagaggcagaggttgcagtgagccaagatcatgccactgcagtccagcctgggtgacagagcgagactgtcccccccacccaaaaaaaaaaaaaaaacaaaaaggaaaaagataatacacagcattgggggaactatttgcaaatcatatatttgataatctagtatctcagatatacaaagaactcttgaaaatcaacaataaacaaaaacagataacctgattaaaatgataatggatttgaatagacatttcttcaaataatatttacaaatggtcaataaacacatgaaaagatattcagtgtcattggcttttaggaaaatggaaatccaaaccataatgagataccacttcacacctactaaaatggctgtagtaaaaaaacaaaacaaaaaacaacagcatgtgttggcaaggatttggagaatttggaaccatcataaattgctattgggaatacaaaatgatgtaaccgctgttgaaaagcttggcagttcctcaaaagttgaacttagagcaccctatgacctagcaattctcatcctaggtatatacccaaaagcattgaaaacatatgtacacacgaaaactggtacatgaatagtcattgcagcattatttgtagcaggcaaatgtggaaacaaaccaaatggtcatcaactgatgaatgggtaaacaaaacgaatattacatacaatagaagatttattgttcaaccttaaaaaggaattaaaggtatgcaaaactggttcaacatttgaaaatcaattaatgtaatccatcacgtcaacaagctaaagaagaaaaattatttgatcatattagtagatggagaaaaggcagttgacaaaatctaacaccctcaacttgataaagaagtctacaaaaaaaaccctacagctaacatcttacttaatggtgagaaactgatgtttttcccctaaaattgggaatgaggccaggatgttcctgttccctactcctgttcaacatcctaccagaaacccttgctaatgcaataagacatgataaggaaatgaaagctatacagattggggggaaagaagtaaacctgtctttgttctgagatgacatgattgtctatgtagaaagtcccaaagaatcaacaacaacaacaaactcctggaacaaataagggattatagcaggttgcaggttacaaggttaacatataaaagtctatcgctttcttacatgccagcaatgtgcaagtggaatttgaaatttaaaatataacacattatattaacaccaaaaaattgaactgcttatgtataagcataacaaaatatatacaagatacatacaaaggaaatttctaaactttgatgaaagaaatcaaaaaagatctaaataaatagatactccacgtttgtggataagaagactcaatgttgttaagaatcagttcttaccaacttgatctgtagattcagtgcaatcccaagcataatttcaggaagttactttgtggatattgacaaattgatctaaagtttatatggaaaggcaaaagattcagaatagacaccatattattgaagaataagaataaagttggagaactgacactacctgacttcagtacttgacttcaatactttaaggctacagtaatcatgacagtgtagtattggtgaaggaataagtaaatagatccatagaatagaatagagaccctagaagtagatccacacaaatattgtcaatagatctttgacaaagtagcaaaggcaaaccaatggaaaaagtcttctcaacaagtggtgccagaacaactggacatccacttgaataaaaatgaatttagacatagaccttacatttttccaataagttttttcataatacttttcccctaagaccaggaataaggcaaagttgatcactttcaccattcttcttcagtatatttctggaagctaccacagtaagggaagaaaggtaaatataagcatatagattggaaagaaagaaatgaaactgtccctgtttgctgatgacatgacagtctacgcagaaaaattaaaaggaatctacaaaaaaaaaaaaaagactcctagaactagtgagtgcgtttgtcaaggatatgagataaacatacgaaaaatcagttatttctctatactcgcaaagaacacctggaaaccacagttaaaaacatagtaccatttgcagttgcttaaaataaaatgaaatgcttaggtataaatcccacaaaacatatacaaaccttgtatggtgaaaactacagaactctgatgaaagaagttaaagatctaaataaatgaagagatgtactctgttcagggattggaagactcaacatagtaaatatataatttctccccaaatctatctctagatttgacccaatttcaattaaaatcctaggaagattttttatggatatagaaggcttatcctaaaatatttctggaaaggaaaaagaataagaatagctaaaacaattttgaaaaactatgataaagtgggaggaatcattctacccactatatagatttatatagctataggaattaatatagagtagtactggcagagagatagacacgtagcttgatggaacagattagattacccataagtacccccacacaagtacagccaaatagtttttgagaaagattcaaactcaattcaatgaagaaagagtaatttttttctacaaatggtggtggagcaattggacatccataggccaaaaatgaacctcaatttaaacctcatgccctataaaaaattaactcaaaatagatcatagatttaaatataaaacataaagctacatagcttttttttttgagacagagtctcgctctgtcgcccaggctggagttcagtggcgcgatcttggctcactggaacctcccatcccgggttcaagtgattcttgtgcctcagcctcctgagtagctagctgggactacaggcacacaccaccatgcccggctaattatttgcatttttagtagagacggggtttcaccatgttggccaggctggtctcaaactcctgacctcaggtgatccacctgccttggcctcccaaagtgctgggattactggcatgagccaccatgcccagccaagatacatacttttgaaagaaaatgtaccctaatatcattaggacatggagggagatgaagaattcttagacatgacactaaatgcacaattcgtagatgaaaaaagaaaaacaaaaaacctcaacagtaaaaaataaaacaaatagtccaattggatagtggttaaaagacatgaacatttttcccaaaaagggttatacaggttctaaacaattacatgaaaatatgttcaacatcattatccattagggaaatgcaaattaaagccacaataagatatcgctccacacttaatagaacagctacaataaaaaggtgaggccaggggcagtggttcaaacctgtaattccaccactttcacaggctgaagcgggaggattgcttgagcccaggagttcaagaccagtctgtgcaacatagggagaccctgtctcttaaaaaaaataagtaacaatatgacaataccatattctggcaaggatgcagagaactggatctttcatatatctggtgtgaatataaagtggtacagtcactccagaaaagagttaggcagcttctttaaaatactaaaacatacatttgccatacaacccagcaagtgtactcctgggaaatgtacatcctaaggaaatgaaaacttatgttcacagtaagacctgtaatcaagtttttatagcagctatactcgtcatagctaaaatttggaaagtaccaaaatatcctacaatgggttaatggttaaacgaattgtgatacatctataccatggaatcctactgagcaataaaaatgaaaaatctactgatgcatgcaactacttggatagatctcaagaaattctacttcgttaaaaaaatctcttaattgtcgtgtactgtatgatttcctttatataagtttcaaagtgataaaattatagaactggagaacagattagtgattgtcaggtgtgggacactgcaaagtttaggtgaggattgtgagatgggtgagtgggtgtgactagaaagggttagcacttggggtttttgtgggggattattatgtagcagttctgtatctctgttttggtggtgactacttgaatttacacatggcgataaaattgaatagctgtgcacatagacacatgagtgcatgtaaaactattgaaatcgaaataaagtctgttggttgtatcaatagtcagtttcctggttttgatattgtactactgttatatgctactatgggggaaaatgggttaaaggtacacaaaatctctgtactacttttgcaactttctgttaatgtacaattattttaaaattttaaaaaattgtaaggtttcccttatgaactgtatgctcttccatgaaagagataattagcccacaaatatttaggagtataggtaaaagcattttaactacaggttttggtttccaaacattccaaattgttctgtacaggcaaaccctgactgatataactgatagcatcatcaaaaactgtcactcgttttcctcaagaaacatgaatatttaatagatttaatttacataggaaatttgtattcattttgtggaataattactggtttagttaatgaatctctataccttccttttgcatgcagaaatcatttgccaaaaccttttatttgcagttgcattttcttagtgtcatcatttgcttgactatggcttgcaattgatattgttagaagtaatccagcaaatttcaagatattaaggcttatacttttgtttaattttgtcatgcaaaatactatagaatatgcttccagaacagtttgatcatgtatttttaaattcccatcccatatttatcaaattatagtttataaatttaatatttaaaatgaaaactcattctttgaaacattaatgaattatgttcattatgtgacataatacgtcacataatataaatgtgcaatattttttgagttgtcagataatcattttgagcattggtattattaattatagattcttaaggatgatgaaatccttaaacttggctagtatttaaaaaacgtatttgttaattgtggttctatggggaaaaggttttgtgtttcttggaatagtttgagcaaaactgctagagaccagcttctagctgctgtaataattttcaatgaaacacctccttttcacagttcctgatcataatagtcatttaattattgttttgctcattggctagtattttcctaaatgggatttcccttagatttttttttgtttttcttcacttttaaagcaaatattctttgtatagaatttcatatatttctgtagaccttatatctttttttccccacagggcaagttctatctgtagaccttagacaataaattatgagtactgttttagcaaactgtacatctttggctgtttttcctaatggttttgtgtatgtgtgtctgttttgaattttttcaggctaatgagagtcaattttaaatacgtctgtttcttaatgattaattttgctgtattatgacaagcatttctggataactatttacaatgagatacaaatattacaaatgtaaagtttatacttgtcttgctaatcagatcctgctattctgtgaaaaactgctgatgaatctctaaacctaagacaatttatagtgattatgcttgagatcaactgcatgggaaaagaaaacttacttctttcatcttgttttttgccttttaaaaaatagtgtagattacctacttctgaaagtatgtggctatttgttaactaaaatgactcatacttgttcaatataattctaggtgtaaacatggcttgatattacatgtaacatgttggccataatccccaatatcaacgttttatttgtaaatgtctcttaacctgaatttctcatcttatatgacttcagtatgtagatgaggaggctcatgtttatataatagagctctcaaagttcattggctcatatattcaatttttcttagtatcatcttaatgttacattcgggaaatatagcaatatgaaaaaaatgtgagatgagtttctctactcattttttattctgaaataaagcagcttttaaaaaatgtttttccaggccaggtacagtggccaggcatggtggctcatgcctgtaatcccagcactttgggaggccaaggtgagtggatcacctgaggtcaggtgttcaagaccagcctggccaacatggtgaaaccctgtctttactaaaaatatttatttttaatgtttttcctctactataagtggaatttgtgtttcacaagttaaaaatgatttttatcattgttttctctttttctatacaaatagctacctattttctttcaaatctgcattttgctagcttttacattatgtgacgtagagaattccttaggaagctgtgggaatagaaaatagataaagacaggaatttggtgggttgacataacccttgatatatgggctacagtagctggaaaattcagtctgtacactaggtacaagatgaattttggagtatacttgctaattaaaatttgagtctgaagaattagatgggggtgttcttagatgtattgaataagttactgttatcccatctatatgaataacctttggaaataacctaagaagtgtcttttgttaagtttgctctgtaagaaatttgtattacacaattaaataatacatgtcagatagaaaatataataaattctaacttagcagacagtttattcaaaagaattatcgcaagggggagaaactattgcaatagggagtggggtctattttaatagaacactctcaccataagatctatgagtatctcaagggttaggcaaaaaatatttttcttttatgggaggaataaacaagactagaaagaacttggtgggaggaagtgggaaggcctgggggaaggagagaagcgtaaccagtttgattaacaggcaacttcaaattgggtacaagagctcctaattgttcacaaaaacttctatacaatatcaatcacgaatagttttaagggaaccacttttcaaattcttacttctatatatactcttcgtaaagttgatatgcttaagaaaatgtctgtaatggacatagaagttctcctttcttatatcccctttcacaaatttttcttctctcattttactattgtccttcctcctacccatccagaatcttaattgtggtgcgttacaagatctgttgtaatatgtatcaaaatctccagggcgccaaacaaaaggacagtttgaaaattggcatcagtgttgagaaagtgaatgactctgaaagaccaataacatactttttcaagttagatctattcttgctttgctttcaacaaaattgatggatgaccttatcaatttgtaagttgatggattattaagagtaatttttgtggctcactcctgtaatcccaacacttggggaggcagaggtgggcagatcacctgagcctaagagttcaagaccaccctgggcacaacatggcaaaaccccatctctacaaaaaatacaaaaaattagctgggcatggtggcatgtgcctgtagtcccaactacctgggaggctgaggtgggaggatcgcctgagcccaggaagtcgaggctgcagtgagctgtgattgtgccactgcactccagcctgggcgacagagtaagatcctgcctcaaaaaaaagcataatttttattaagtcattataattcatggtgtataactcaaaaagagattgctttaacagaactccatctattcccgtatacttggtttttttcaaataggtttattgagatataattcacacaccataaaacactcctttaagttgtataattcagtggattttagtatattcagagttgtgcaactgtcattgctacctattttcagaacattttcatctcccccaaaagaaaccctataccttttcatagacacccactattttcccccctcccagcctctggcaattaccagtctactttctatttctatggatttgccttttttggacattttgtataaatggaaccatagaatatgtgttgcatctggcttctttcgccttacatattttcaaggttcatccatgtagtagcaggtatcagtactttattccttcttatgactgaatagtattccattgtgtagatatatatcgattcattagttgatgtacatttgggttgtatcagttttttagctgttatatataatcttgatatgaatattcatgtgtagttaagcctcgttattcaaggattctttatttaaaaattcacctacttgataatatttataacccccaaactcatactcttggcgtcacgcacagacaggtgcaaagtgacaacaagtttgaatcattcaacatgcacattcccagctaaggtcggacaacgcaacactcttctatcttgttgtttgggctctcataccataaatgagttcccttttctatgtctacttaattccatattttttcacatttttgtgttttttgctggtgattttgcttcttaaagtggccccaaagcatagtgttgagtgctgtctagtattcctaagtgtgagaaggctgtgatgtgccttacagagaaaataaatgtattagacaagtgtcattcaggcatgagttatagggctgttggccatgggttcagtgttaataaatcaacaatatatatgaaataacatgtctttaaactgaaatacacatgtgataaggttatatattgatctgtggacaaatatggtgcaaccagagattcacagtaacctgtattttccctaaggaacagtgtttctgtgtttcctcagtcagtgtttgtgttgactttatagaatataagtactgcaaataatgaagatcgactgtatatggtttcatgtaaacatacgttttcagttctcttgggtgtatacccaggaatagaattgctaggtcatatgataacattgcttgttttgtgaacaaggtttctcagcgttcacatctataaaagtgaaaataggaatagaatttgtgttgagccctgtcttattctaccacatgcaagaaaatgagatccttgttggactggtgtggaactggccccatgacacacaggaatgtcaccttttgtgacacttccatagacataacttccaaggacccctgaagagacatgcccaagtggaagaaatcaccacattcaggaaagtccaaagctgttcaattgtaattttcctagagtagattgttttctttgttattataccagctttccaccatctgtctcactttcctctttcccagttcctagatggccgctttatgggattgaatctagagagtttaagccttacatagaaagttgatgagcctacaagtgggttaaagcttagtgtttttttttttaggtttcgtgttttttaaaaaagcattttcatatgaactgttgcttttttatttatttatttatttatttattttgagacggagtcttactctgtcacccaagctggagtgcagtggcacgatctcagctcgctgcaacctatgtctcctgggttcaagcgattctcctgcctcagcctcccaagtagctgggattacaggcgtgcaccacaatgcccagctaatttttttgtatttttagtagagacagggtttcaccatcttggccaagctggtcttgaactcctgacctcaggtgatcagcccgcctcggcctcccaaagtgctgggattacaggcatgagccaccacgcccagctgaactgttgctttataatatctcaattgtttacttcttcaatagcatgaataatttactatataattaaaagattttagtgatagtacatcaaaaagagtagtatctgcaaacagaagcagttttgtgcttgtttgtagtaaagactctatctataactgagtcagtaagcatattctcctttttaattactgccatgtactaatcaaacactatttaaaatgccaggcatgttgctaggtgctgttcatatctgttgtcttatcttcagagaaaccctgcaaaaaaatactttatctacattttgcaactgaagattaaagaagttaaataacttttggattgatgcacaggaagtggtagagccaggtgaatccaagttggtctgtcttttggactgcaaaagctgtatttttcccacatctgaagctgttagccctcaccctttatatcctagtgcccagctactttatgtgtcctgcacccctaaacccaaaagcggtatgtgtgtgaagtgaaggtagagagttttgtttttctggatttgttttttcacagctttactctgaccacctagaaccatgcctggcacaatataggtaatacttattgagtgaatgaaggaatgccacgtaagttttgtgaatttactgaggagtctcgggatggtgcaataagagaacagtgtgacagttgataaacaaaggaaggtttctgctttttggcaaagattacatctgtaaaaggtaaataggctgagtaacactttcatggtcaggactacaaagctgggctataaaaacacattattctaatccatgtttatctatcacttcttttgtttttttttttttttttttggcagagtctcgctctgtcgcccaggctggagtgcagtggcgcgatctcggctcactgcaagctccgcctcctgggttcacgccatactcctgcctcagcctcctgagtagctgggactacaggcacccgccaccacgcccggctaattttttgtatttttagtagagacggggtttcaccgagttagccaggatggtctcgatctactgacttcatgatccgcccaccttggcctcccaaagtgctgggattacaggcgtgagccaccgcacccggccatctatcacttcttacctggctggcacgctagtttatccaaactactttattgtacacgcttgttgtacagcttgctattaatataatgaggtcatataattagttatggtagtagatggtgacccttctcaaactatgaggaagatgtttaggtatcctcaaagtaaattctgcagtgatcccagagacagattaggaagtctcagagatggacaaaagacttgaaaggtatttcagaggctgggcacagtggctcatatctttaattccaacactttgggaggccgaggcaggaggatcatttgcgtccaggagttcaagaccagcctgggcaacatagtgagacccgatctctacaaaaaataaaaaaattagccaggcatggtgatgtgtgcctgtagtcctagctgcttgggagggtaaggtgggaggattgcttgagcctgggaggctgaggctgcagtgagccgtgattgcaccactgcactcagcctgggcaacagagtgagaccctgtctcaaaacaaaacaaaaaaaaagatatttcagaaaaaaaatgtatccacatgagcagtaaacaaggcacaactccattagtcatcagagaaatgcaaattaaaaccagataccactgcattcctaacaggatggctaaaaaatgaaaatgacagttgtaaagtggcagtgagaatgaagagccaccagaactcttactgctaatagggatgcaaattagtttaaccactttgataaactgtttgggaatatctaccaaagctgacatatatatatatatatatatatatatatatatatatatatatatatatatatatatatatcttgtgacctagcatttgcatccctgggtatatacccaacagcaatgtcttaacatatgttcacccccacccccccaaaaaaaaaaaaaacaaaaacatgtacaagaattcttttagcagaattcttcataatagccctaaattagaaacaacccaaatgtccaacagtggcggaatgacataaataaataccactgtattcatacagtggagcacaacaaagcaatgagaatggatggaactttgttacacaaaaaacacagatgaatctcacaagcataatgataagtgaaagaagccgggcttaaaaaactaccaactctatgattccatttatataaagtacaaaaacagtgtaactaatatatgaagtttgaggtcaaagtagtggttaccggtgggggaaggtagtgaatgggaggggacatgatgggagctacggaggtgctggtcatgttctgtttcttgatctggatgctggttgagttcactgaaaattcatcaagctgtacatttatgatatttgtaggaaggataggtatacattgtccgaagggaaagagtggagcagttttattttgtcagctcatgtggtctggcataaagatctgtctgggctatttaaatatttatattttgcataatggggatctgacttgttcacaaaagtattcattcagtcttggggagaaaagggtgatgacatacctgttctgtgccaaatgctaagtactgggatatgtaaaaatagaaagaaaacatagatatctttaaatctaataatccagacataagattctcttcctcagtagtaaatgctaaagagacagagtgactccatgtacaggtgaatctgctttgttatccttattggttactttaaaaataatgacagaaggcattggtgcaaaatgtatctaaagttacaacgtaagtgccatttctaaagcgtttgggagaaaattccactagtctatttgaactggccttgtgttgtctgtggtgtttggctttctcttgggtagcttaaatttcctccccatcagtatagtagattttatctattttgtttactcttcagaaataactgccaggggatttttaagactactgattgaggaatgattgccaaattacccatttttaagtgtaaagtcagtaagcaatgccaggtttctgaggagcttcaccaatttgtctctataatgtgtagtatttttttaacagttttaatatatgaatgaaaatactaccaagtttctcctggatccccacttttgttcattcagtgattttttttactgagctttggaaatgaaccttttgtctttttagtatgatcctctcccctcatgtcgtttgaaaatacccatctcttgcacgagactaagaacaatgctgtcctgttgagttcttataaaatccaaagaaaatttaagtactaagtggatgatagttaaagggtttacagcttttcttacagatccatcaaagtgggaaaatcatgagaagagttggagtcagacatgccagacattccaaatctgtcctgtacaatgtgaccttaagtagttccataaacctcagctttcctagttgtcaaatgaggagaatgatactgtcctcatggggctggtgcagggattaagggtgatgatatctgtgaagcatctcagcttagtgcttagcacactgtaggtggtcagtaattttcctgttctctgttgtgatatatcctctactaattctggagttatctttatcttgcctacctcaatccattctctacaatttccatttgtttatcttaattattttgtcttcctcttacttttttcctaaataaagctacaggagagtagattttctgtactctgacaagacatacatttttcttcttttaatagtgttaaaacaaatgtccaaaaaaacctttaaataaaaaaccaaacatgttcaaggaagttaccatcttttctaaactctgtcagcagggtggctgataaaataaattttctactcattagtctgagatgcttattgaagactgctaatttaggaagtatgggcctgctatggtctgaatgtttatgtcccccaccccaaatttatatgttgaatcctaattgtcgaggtgatggtattagaagatggcgcctttggaagggctctgccctcgtgaatgggattagtgctcttataaaagatgccttagagagatcacttgcccccactaccatgtaaggacacagtgagaagatgccgcttatgaaccagagagcagcctgcattagataccagatctgctggtaccttgatcttggacttcccagtttctagacccatgagaaataaattcctgttgtttatagaccacctagtctatggtattttgttatagccagcccaaacagactaagacagggcccttttatgttctggcttaccgtatttaactatggctattttactagtcagaacccctcttttctctagtgtatgtttctgtgacttagatttagtttgagggcattttcatgtttacttttttcttaaaaattttcccaagattattaacagatactaaatgaacttccctcttccatttcaattttatatggtatctcttttagatctttctcttaaagtaaatgcattacattgtatttttaaaacattttttgccttaataaactgctagcatttcagttaagaggagttaataacagtttcaccaatgcacattgaaaacgatgggttccattaaatagtcaataattattaaaattaagccaagaataatgaaagggatacaattacactaaagtgatatttatgtcttataaagatttctcttaaatgaaaattgacaattattagactagccatacacaaaatctggtattttaaaactaatcttggctgggcgtggtggctcacacctgtaatcccagcactttgggaagtcgaggtgggcagatcacttgaggtcaggagttcgagaccagcccggccaaccaacatggtgaagccctgtctttaccaacaaatacaaaacttagccaggcatggtggcatggacctgtagtcccagctactcaggaggctaaggtgtgagaattgcttgaacccaggaggcagaattgcagtgagccaagatggcaccactgcactccagcctgggcagcagagtgagaccctgtctcaaaaacaaaacaaaacaaaacaaaaaactaaaccaagggccaaagcagtatggtgacagggaaatattttatattttcccttagagacttcagagtgctgactcaccccttccacctaccatgtgaggacgcagtgataacacaccattgattaatgtctaagaatatattgaggaaaatactctatcaggctaacagggaaactggcacagttttgtttccactatattttattggttagagaagtcacagagccacctggttggaaggagaaaggatgtagatcccacctctggatgggagagatgacaaaaaaatttctggccatctttaatctgccacatcaattaattttaaacttaaactttgttgccttaatgtttgagtgagattgtagtagttgatgctactccattccgaggcagtactaaaatcctaccagaggatccaatgtcctcattaagtcccaattcaggatacatatgacagcagtgaataatttgtcactgtgaataggagactaaaataaggacataccatgttgcacaattacagactatttgaaatccagtctggcactgtttgttaaaacagaattttaatatttttgtaatcaaaagatagggaaattatttcaggcaggctgtttttataatttcgttttggcattcttctcttaagaatgaataataatataaggaaacaggtagtgattgccttttgaactataaagtgcttttcatttttagtaagaggttttatgtctataaaattatctgaaaagacaggtcatctgctaaccagtggtagagtatccactgcaaggctcaggactcctgaaacacatcataaaattgtcatgtaaggaaattcttggagctgagtgcagagctagtttgatttcatcataataggcagatattgatggattaactttgagtatttcatgaaataaaacatactttgctgtttttggtttataatacattttaaaacgtttgagtctgaaacaaaaattgtgaagctgatatttgtctttcctttcattctatatgtgaccagtttaatttttgtgattcggggcaatcaaagtatttgctgggtatctagagtgaatattttatcactttagataatctaatctaaaagcccagtaataacagttttggttatttttttcacaggtggggtagtatatcaaacagggtccagttaggagacagaaaccaaacagtaatttaatgtgtttcttttgactttttaaaaatttttgttggtacagagtaggagtatatatttatggggtacgtgagatgttttgatataggcatgcaatgtgtattaatcacatcctgtaaaatggggtatctgttccctcaagcatttatcctttatgttacaaaaaacccaaaaatactcttgcagttatttttaagtgtaccattaaattattatctgctgtagtcaccctgttgtaatatcgaatactaggtctttttcaatagtaatttaatttgaacatgcaaagtttagtataaggaattattgccaaggggttggggtaattggctagtaaaagttagagaactgtgaaaaatacaggcataaggaacagctgctattccaacggctgagatagaatgctcaaggaagaggtttggccttcctcctggcagcactaagatctgaaccttgttgaagaaaatatggccatgactcaccggatcacagtgaggttcactgagacaccatgctagtgggactcattggaaatctgccctctggagtccaggggaagccatccttagggacagaactctgaacatgcagcaagctcactgaggggctgctggaggaagccagtaacaaggagagtaccttgccagcagcgctctgctgtaaaggcacctgaagggggttccaagagaagctgcacatggaaagatgcatgctgctggccactgtgcactgcagataaactgcacacactgcaggagcctgatgagaaaaacactggaactgggacaacagaaccctttctcctccagtgcccctccagtgcccttagtggacaaagcttaatgttgtgccagttggaaaaatattcacagtcaatctccagtagtgcagagcaggcaatgaagtgtggatttggagctgacagacaatagattgataagtggcatgaggagtggagagattgtgtatatgacagtgagtatagttttgatgacatgtatcaagcaacctcattcattatacttggcaatgattttatttcattttgcttttttttccccctcctttaaggagattcattcaatacaacttagtggtatagggcttaaggaaggaaatgcccacgtttttgcttcatatgactagttggatagtggtgctacttattttattcaaatggatactatcaaagggtcagggagaataaatgagtttttgacatcttgcatctcagtaacttttgaaatataaatgttgatcagttaaatattttagtctaaaatttaggaccacaatctgaacaaaagagaaaagatttgaaaatcttcatcgttttggtaatagacgaaacttcggaaatacctgtgattgcttaaagaaagtatattaagaggccacaatgaaaaaaaatgatcatgaggaaccatttttggtcatgaaaaatggtcatgaggaatgatcctgacgaacacctaaatttaaagaaaggatggaaagagacagaggaaaccaggagggggaaagagaagtacaagaattattatcagagaatgctgtcatagacgctgagatcaaaaagattttctgtgttgtcaaatgctataaagaagccaaatgagggaacaactgtaatgtctatggaatttggcaacatggaaaccagtgtgaactttggccagagcaatttcggtattgcactggggacaaaaacaagattgtagtaggcagaggaaggaatggggagtgaggaagcagggaaaataaatataggataattttcaaatggctagactgagaagaggagagagaaacagtcatagatgcaggggcatgtggaggcaggggtagcgattaaaatgggaaggattccagtatctttttttttttttccttttttgccagaagagagagctaagaggaaagaaaagggtgcactgatggactgagatcttcgataggcagcaggtggagggtgggcccctcttccatcaagaccaaaagaaagtcaaggtactgatagagctaggcctgcaggcaggagaaggaaccagaggatgtccctcagctgatggcctgattttcagcaggtgggaggcagagccacctgctgagagtaggcatggtggtagagagtagagagataagagagttagtaatagcaggttaagagagataagagacattgctaggctgcctcaaggcccctccccccacccccgctgaggctaaatgcaaggaatttgtagcagcgcttatcaacatgcagatatgatttctctcagcaacactaagtagcctacaattgaggaaaggaaaattgtatgggtagattgtgctagagtgagaagtattacacacagcagacatgatggacaaaggaatcaagagagatgaaagtaatagtaatagcaagagaaaagaccatggagctggatggggaggaagattttagaggtgcatcaaacatattctagttggtcagtctcctcaccagtcacaatagttttcacgacatcaccgtaagagggacaatagtatggtaagtaagaaaaggaagttaatttcaggagacttgggttcaaataatgatcctgccatttatttattttgaccttgtgaaagttacctaacttctaagcaagcctgcatttttctttctttcttttttctttttttttttttttttttttttttgagacggagtctcactctgtcgcccaggctggagtgcagtggcgccatctccactcactgcaacctccgcctcccaggttcaagcgattctcctgcctcagcctcccaagtagctgggactacaggtgcacaccaccacgcccagctaatcttttgtgttttagtagagacggggtttcaccatgttgcccagtctggtcttgaactcttgagctcaggcagtccgcccgcctcggcctcccaaagtgctaggattatagatgtgagccaccacgcctggccacctgaatttttacacatagtaaatgctcaacaaatatttaatatgaagtgatatttcaagaaataagaaggtgcaatacaacacattagagatgccattctggcacaaagaaacaagtcagtgcctgctctaattttaatttaatgttacaatagccagttttgattagaatattttgcttcaccacatggtgctcaaggtactgtggctgcataacaaattaccccaaaacttagtgtcataaagcaactatttaatatactcacagcttctggggctctgcagtttagacagggcaaatctggggtgtgagtcagaagactcgagggctagggcaggaatcttctaaaggctcactaactcacatctggccattgatgctggctgttgactgagagactttacctgggaactttggcttacacttcatgtgacttctctctgtgaaaaggcttcctcatagcatggcagctgagttccaagggcaaatattgagagagacatccttttgctcagaataatggtattgagattcatccccatgtctgttgtattagtactttttaaattggttagtaatgttccatttcatgcatatagcaaagtttttaaatccattttcttgttcttagaaatatatgttgtttccactttggggctgagtaaagccgctttgaatgtttgaatgtaaatcttttgagttggacatattgtcacttctctcacataaatgcaagagtgcagttgctaggtcattaagaaactgccaaactattttccatagtggttgcactattttatgttattaccagtaatgtatgagagttacagcttttccacatccttgccaatacttggtattgccatcctttttaattttagccattctggtgggtatgtcatgatatttcttgtggttttcatttgcatttaccttatgactaaaaatgttgcacttattggccattcatatatctttgttgaagtatatcttcagatcttacaccgatgtctatttttcattgaggtgtgtgtcttttgtattaagttgtaggagttctttgtatattctggatacacttccttggtcaaatatacatattgcaaatatgttttcccagtttgtaactttcccttttatattcttaatggaatctttaaaagagtagaagtttttcattttgatgaagtccagtttacagtttttttccttcatggttcctgatttttgtgacctaagaaaatttcacctacgtcaaatttgtgaaaattttctttatattttcttgtataattgtagttttggctacgtttatgatgcactttagcataagagttgtatatcgtatgaagtgtaagggttgagattcatgggtagccattcgctccagcactatttgttgaaataaccctattgagttattttagcacctttatcaaaaataatgtgttggtctattttctgcactttctattctgatctgtatgtctatccttatatcagattcacactgtctagattattctatattaagtcttaaaatccagtagccaaaatcctacaattaggattttgtgtttaggctattctagctacttaaattttcataaacaatttagagtaaatttgtgaatttctgcaatgaagcatgagattttgattggtgttacttttaatctatatattaatttggggagaatggaaatcttaaccatattgagtcctccaatccatgaacactactccatttatgtagatttttttacattctcccagaaaatatctttgtagttttaagagtagatattttattcatatttcattacatttattgttagggcctcatgtttttgatgctatggtgaatagtattatgttaaaatttttaatttaatgattattgatagtatatagaaatacagttgattcttgtatattgatctcatatttggcaaccttgctaaatttacttattctagtggcttaaaaaaatccttaagattttctatttgaacaattgtgttattttatttctgtccattctgtatcccttttatttctttttcttacctttatgccctagctaggacattcaattcagtgatcttatattgatctcatatttggcaaccttgctaatttcacttattctagtggctttaaaaaaaatccttaagattttctatttgaacaattgtgttattttatttctttccattctgtatgacttttgtttcttcttaccttgatgccctagctaggacatacaattcaataatcttagggagcaaaccagtctcttaccattaggtattgtctgcaggtttttcttaaatgccctttattagattcaagaatttgttttatcgtcctaatttgttgaatttttattatggataagtgttgaatttcttagaatgctttttttctgagttgagtttttgtatagttctcctttattctgttacttacattgattgaattttgaatgctaaagtaaccttgcattcctgggataaaccctacttggtcatggtttattaaattttttatatacccatgtggtaaaaatactaatattttacaagatttttgcatcagtggttatgatggttattgctttctagttttctttttaaagtttctactggcttaggtatcagtagagtcaggtttactggtctcatataattagctcattattttctcaaaatgtttgtattggattgctattactttttcttagtgtattgtggaattcaccagtgtcactatctcctgggcttgggattttctttgtggggttattttaaattatacatgtaatttctgtaataaatttagggctattcagattttctattttttcttgtgatagtacttgtaatttgagtatttcaaggaatttgtcagtttcattttatttgttggatatattggtatatctttattatatttcttataattttcttgtctgacatatctgtactgatgtctcccctttcattgctgatattgataacttttgtcttctctcattttccttgatcattaaaatctttccaatggaatctttcaaagagcagaagttcttaatattgacaaactccagtttatcatttttagctagaggtttattattttcattgatcatacattgaacaagcttttggtatcattaactttattgtttgttcattttctgggtaatttctatcactgttttaataaagtccaatttgtcgacgtattgttttatgaattgtacttttggtgctccttctaagaaatctttgcctaatccaaggttggaaagcttttctccttttttttaatagaaatttaatagttttaggttttacatttaggtctttggtccattttgagttaatttttagatattttctgaagtctggatacaagttgtctttttttttggtcttgtcttttttttccatatatatagttgttccagcatcatttgttgaaaagattatcttttctccattgaatttccccttgcaattttgttaaaatttgattgtacatacctgtgtgggtatgtttcaaaactctatattgtttcatagacttattgatctgtctttagggtaataccacactatcttgattactgtaattttatgtgtctttggattttttaaaaaatagagacagggtatctctctgttgcccaggctggagtgcagtggggtgatctcagctcactgtaaccttgacccctcgggttcaatcaatcctcccacctcagcctcccgagtagctggaactacaggcgtgcaccatcacacctggccaatttttgtatgttttgtagagatgggatttcaccatgttgcccaggctggtcttgaactcctgggctcaaacaatccacccacctcagcctcccaaagtgctgggattacaagtgtgagccactgcacccagccctgtagttttatacgtcttgaaatcaggtgtcagtgtcccaactttgttctactttatcaaaattgtttgcacttttctaggtccttttcgtatgaattttagaattagtttgtccatttcagcaaacacacacacacacacacacacacacacacacacacacacacacacacagaaggcctcctgggatttttattgggattatgttgaatacaggtagtcctcaccttgcatggcactatgttaaatgaaacgtgcatattgaaaccaaggcctcaccatgcacagttccaatattcatgtttcagttaacacagtactagcactgtgcaaagtaagtatggcctatatgtagaataatttgggggagaactgacatattaatgatactgagtcttccaacccatcaacccaatatcattcttttatttgtatctctcatatatctctcagcagcattttatagtttttagtataaatgttttttcaacgttttgtaagaatttttctctgtatttcatatatttgatgctattacaaaatttttctagtttcaatatcctttttttaacttctggaatatataaatacaactgatatacaattgtatatcagtcttgtattctacagtcttacaaaactcagaacacattgagctctctagtccaaaaattcagaatgctccaaaacctgaaactttttgagtgcctatatgacatcacaactggaatattccatagctaatacctaaatccaaaacacttctggtcccaaggactttggataagagatattcaacctgtagttctaatagcttttttgtagactctctctgattttctccatggatgattatatgtcagttatgtcatcttgaatacaatcagcattaattacatcttcctttccaatctggattcctcttgtttggttttctggccttattgcactgactggctagatgtctcctccagtataatgttgaatagaagtcatgacagcaaatgttttcttattccttagagaaaaaacattagattgtttaccattaagtattaatattagctgtaggtttttgtggatgacctttttgaggttgaagaagtttctttctattccaagtttgctgagaattttcagtaggaatggatgttggattttgtcaaatgctttttctgcatttattgagatgacctttttagtttattgacatcatgaattatattgattaattttgtagtgatcaaccaacctgtattctaaaaactgcatattggcctctagttttcttttgttataatagtctttaactggttttgatatcaaggtaatgctgagctcatagagtgaattagaaagtgttccttttcaattttgggggaaaggtttgtgtagatgtggtattatttcttcatgtttggtagagttcatcttggcctgaagttttctttgaaggacgatttttaactaaaaattctattttttatagttataggaatattcagtttatttcgtcttaagtgaggtttggttgtttctttcatgaaatttgtctgttttacctaagtgggtaaatttattggcatggagttgtttgtaacattcattattcttagtatatctgtaaaacctttagtgatgttacctttctttatccttaacattattagttcatgtgttttctctctttttttttttctgagcagcctggctagaggtttatcaattcattgatctatttcaagaacccattttttgtttcatttatgttttctgttgatttactttttcctattctatttatttcaactttggtctttatgttttcctttcatgggcttattttgctttaattttctcatcttctagtttattaagttggagactaagatcaagttagttaatagtattgttcaacttttctatatcctcattcattttctgcctacttgttttatcaattataattttggatttgtctgttcatatacttttatcacttttgtcttttatgtattttgaagttctgttattagatacttatacatttaggattattatgtcctcttgatgagttgactgtgttattatcatgaactgatcttttttctttgttcttcctttatgcagtgtatccttttttctgaattaaaaaattttgtttttttagctgggcacagtggctcatgcctttaatcccagcagtttgggaggacgaggtgggtggatcacttgagctcaagactagcctgggcaacatggcaaaaccctgtctctacaaaaatacaaaaataagccaggcatggtggtgtgtacctgtaatcccagctacctgggaagttgaggtgggaggatcatttgagtgtgggaggcggaggttgcagtgagccgagattacaccactgcactccatactgggcaacagtgccagatcctgtctcaaaaaaaaactttgtttttatcactggttttatgcaatttgttgataatctgccttagtgcctttttttatttgtattttaatttgcttgagattctttgagcttcttatatctatgggcttatagtttacataacatttgaaaattttttgggctttatttctttagggtatttttcttctccatttgtctcttctctcctttgaagggctccagttacatgtatgttagacccctttatattgtcccacatgtcattaagcttctgtattttaattttatacttttcatgcattgtctaatctgtttagttcatccagtgactttttcatttgagataatatatttttttaattctagaagctccattttgttcctatttatttttttgtatttcttttctcattatgtccatgctttcttttaaatctttgagcatattcataagctattttgaaattcctgccttgtaatgcctacatagctatcatttataggtctatttgtattgactagtttttcttttggttatattttacaatttgctgctttcttcattagactatatctagaatagccattattttagtgccaaatttagctccactacttaggtgtgaattatccttagcatttcagtgaggtctctctactgtgtctggttagaactgcagtatctccctgctctttttgaccagcctcatggagtttcaagttatgcaaggacaaattattattaaagtattgttgggactttttttatacctcagtcccttcttttcagtaccctctcctgaacattccatctccctcatcctccccaaaccataatctctgttttctctactcagtgacactgcatgcactgctttgcttcccctccctgtgctgcatactggaaattgcttccaggaagaagccaggctctcatttggtactcattccattcatttccctttccataggaatcacaatcttttactgcctattgtctcagtgcctgataatatttgtttcatacatcttattcaattttctagttcagtgggtaaagaaagtcctattccaattaaatttgcatgattagaagctctttttttcccttcaaaatctttatttgcatttctttttttttattattatactttaagttctagggtacatgtgcacaacgtgcaggtttgtaacatatgtatacatgtgccatgttggtgtgctgcacccattaactcgtcatttacattaggtatatctcctaatgctatccctcccccctccctccacccaacgacaggccccggtgtgtgatgttccccaccctgtgtccaagtgttttcattgttgaattcccacctatgagagaacatgcagtgtttggttttttgtccttgcgatagtttgctgagaatgatggtttccagcttcatccatgtccctacaaaggacatgaactcatcattttttatggctgcatagtattccatggtgtatatgtgtcacattttcttaatccagtctatcatggatggacatttgggttggttccaagtctttgctattgtgaatagtgccgcaataaacatacttgtgcatgtgtctttatagcagcatgatgtttaatcctttaggtatatacccagtaatgggatggttgggtcaaatggtatttctagttctagatccttgaggaatcgccacactgacttccacaatggttgaactagtttacactcccaccaacagtgtaaaagtgttcctatttctccacatcctctccagcacctgttgtttgctgacattttaatgattgccattctaactggtgtgagatggtatctcattgtggttttgatttgcatttctctgatggccagtgatgatgagcattttttcatgtgtcttttggctgcataaatgtcttcttttgaggagtgtctgttcatatccttcacccactttttgatggggttgtttgtttttttcttgtaaatttgtttgagttatttgtagattctggatattagccctttgtcagatgagtagattgcaaaaattttctcccattctgtaggttgcctgttcactctgatggtagtttcttttgctgtgcagaagctctttagtttaattagatcccatttgtcaattttggcatttgttgccatggcttttggtgttttggacatgaagtccttgcccatgcctatgtcctgaatggtattgcctaggttttcttctagggtttttatggttttaggtctaatatttaagtctttaatccaccttgaattaatttttatataaggtgtaaggaagggatccagtttcagctttctacatatggctagccagttttcccagcaccatttattaaatagggaatactttccctatttcttgtttttgtcaggtttgtcaaagatcagatggttgtagatgtgtggtattatttctgagggctctgttctgttccattggtctatatctctgttttggtgccagtaccttgctgttttggttactgtagccttgtattatagcttgaagtcaggtagtgtgatgcctccagctttgttctttttgcttaggtttgacttggcaatacgggctcttttttggttccatatgaactttaaagtagttttttccaatttcgtgaagaaagtcattggtagcttgatggggatgccattgaatctataaattaccttgggcagtatggccattttcacgatattgattcttcctatccatgagcatggaatgttcttccatttgtttgtgtcctcttttatttccttgagcagtggtttgtagttctccttgaagaggtccttcacatcctttgtaagttggattcctaggtattttattctctttgaagtaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacagtggggttttctaaacatacaatcatgtcatctgcaaacagggacaatttgacttcctcttttcctaattggttaccctttatttctttctcctgcctgattaccctggccagaacttccaacactatgttgaataggtgtggtgagagagggcatccctgtcttgtgccagttttcacagggaatgcttccagtttttgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggttctgtttatatgatggattacatttattgatttggatatgttgaaccagccttgcatcccagggatgaagcccacttgatcatggtggataagctttttgatgtgctgctggattcggtttgccagcattttattgaggatttttgcatcgatgttcatcagggatattggtctagaattcccttttttttgttgtgcctctgccagcctttggtatcaggatgatgctggcctcataaaatgagttaggaaggatttcctctttttctattgattggaatagtttcagaagaaatggtaccagttcctccttgtacctctggtagaattcggctgtgaatctgtcgggtcctggactttttttggttggtaggctattaattattgcctcaatttcagagcctgttattggtctattcagggattcaacttcttcctggtttagtcttgggagggtgtatgtgtccaggaatttatccatttcttctagattctctagtttatttgcatagaggtgtttatagtattctctgatggtagtttgtatttctgtgggattggtggtgatatcccctttatcattttttattgcgtctatttgattcttctctcttttcttctttattagtcttgctagcagtgtatcaattttgttgatcttttcaaaaaaccagctcctggattcattgattttttgaagggttttttatgtctctatttcctttagttctgctctgatcttagttattttttgccttctgctagcttttgaatgtgtttgctcttacttctctagttcttttaattgtgatattagggtgtcaattttagatctctcctgctttctcttgtgggcatttagtgctataaatttccctctacacactactttaaatgtgtcccagagattctggtatgttgtgtctttgttctcattggtttcaaagaacatctttatttctgccttcatttcgttatgtacccagtagtcattcaggagcaggttgttcagtttccgtgtagttgagcggttttgagtgagtttcttaatcctgaattctagtttgattgcactgtggtctgagagacagtttgttataatttctgttcttttacatttgctgagaagtggtttacttccccttccaactatgtggtcagttttggaataaatgcaatgtggtgctgagaagaatgtatattctgttgatttggggtggagagttctgtagatgtctactaggtccgcttggtgcagagctgagttcaattcctggatatccttgttaactttctgtctcgtttatctgtctaatgttgacagtggggtgttaaagtctcccattattattgtgtgggagtctaagtctctttgtaggtctctaaggacttgctttatgaatctgggtgctcctgtattgggtgcatatatatttagggtagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatcctttattttgagcctatgtgtgtctctgcacgtgagatgtgtctcctgaatacagcacactgatgggtcttgactctttatccaatttgccagtctgtgtcttttaattggagcgtttagcccatttacatttaaggttaatattgttatgaatgaatgatcctgtcattatgatgttagctggttattttgcttgttagttgctgcaatttcttcctagcatcgatggtctttacaatttggcatgtttttgcagtggctggtatcagtttttcctttctatatttagtgcttccttcaggagctcttgtagggcaggcctggtggtgacaaaatctctcagcatttgcttgtctgcaaaggattttatttctctttcacttatgaagcttagtttggctggatatgaaattccgggttgaaaattcttttctttaagaatgttgaatattggcccccactctcttctggcttgtagagtttctgctgagagatctgctgctagtctgatgggcttccctttgtgggtaacctgacctttctctctggctgcccttagcattttttccttcaactttggtgaatctgacagttatgtatcttggagttgctcttcgcgaggagtatctttgtggtggtctctgtatttcctgaatttgaatgttggcctgccttgctaggttggggaagttctcctggataatatcctgcagagtgttttccaacttggttccactctccccatcactttcaggtacaccaatcagacgtagatttggtcttttcacatagtcccatatttcttgaaggctttgttcgtttctttttactcttttttctctaaacttctcttctcgcttcatttcattcatttgatcttcagtcactgataccctttcttccagttgatcaaatcggctactgaagcttgtgcatttgtcacgtagttctcgtgccatgattttcagctccatcaggtcatttaaggacttttctacattagttattctagttagccattcgtctcatcttttttcaaggtttttagcttctttgcgatgggttcaaacttcctcctttagctcagagaagtttaatcatccgaagccttcttctctcaactcgtcaaagtcattctctgtccagctttgttccgttgctggcaaggagctgcgttcctttggagggggagaggcactctgatttttagaattttcagcttttctgctctgttttttccctatctttgtggttttatctacctttggtctttgatcatggtgacgtacagatggggttttggtgtggatgtcctttctgtttgttagttttccttctaacagtcaggaccctcagctgcaggtctgttggagtttgctggaggtccactccagatcctgtttgcctgagtatcagctgcggaggctgcagaacagcgaatattgctgaacagcaaatgttgctgcctgatcgttcctctggaagcttcgtctcagaggggtacccagccatgtgagatgtcagtctgcccttgccggggggtgcctcccagttaggctacttgggggtcagggacccacttgaggaggcagtctgtccgttctcagatctaaaactccatgctgggagaaccactactgtcttccaggctgtcagtcagggacatttaagtctgcagaggtttctgctgcctttcgtttgtctataccctgcccccagaggtggagtctacagaggcaggaaggcctccttgagctgcggtgggctccacccagtttgagcttcctggccgctttgtttacctacttaagcctcagcaatggcgggcacccctcccccagccttgctgccgccttgcagttcgatctcagactgctgtgctagcaaggagtgaggctccgtgggtgtgggaccctctgagccaggcacaggatataatctcctggtgtgctgtttgctaagaccattggaaaagcacagtatcagggtggagcgcagtatcagggtgagagtgacgcgattttccagatgccatctgtcacagcttcccttggctaggaaagggaattccctgaacccttgcacttcccgggtgaggcgatgtctcgccctgctttggctcacactcggtgggctgcacccactgtcctgcacccactgtccgacaagccccagtgagatgaacccggtacctcagttggaaatgcagaaatcacccgtcttctgcgtcgctcacgctgggagctgtggactggagctgttcctattcagccatcttggaactgcccccctagaagctcttatcgtgagttttaatgtgattttaaagaatcttaattctaatgatattactttcaaatagagacagactattacagagttttatctaacaaagctaacatttatttagcatttcagtgatgtgagacgccttgctaagaggtgtctcagttcccattataatcctattataaaggtgccatgttatgcctattttacagaaaggaggactgcagcttgaaaacagttaagtgacttgttcaagctcacatatcagtcgagtaaatggcaaaacctagattcaaactcaatcttgtcaaactgccaaggccttgcttatcatcaccatgtgctatggtttggatgtccctgccaaaactcatgttgaaatttaattgccgttgtaacagtattgggtgctggatcctttaagaggtgattggcctggcacgatggctcacacctgtaatcctggcactttgggaagccgaggcagatggatcacctgaggtcaggagttcgagaccagcctggacaacatggtgaaacccatctctaccaaaaatacaaaaattaactgggcatggtggcagacacctgtaatcccagctacttgggaggctgaggcaggagaatcgcttgaacctgggagatggaggttgcagtgagctgagatcatgccactgcactccagcctgggtgataagagtgaaactccgtctcaaataaataaataaatacatacatacataaagaagtgattaggtcatgaggaatcctccgtcatgaatggatttatgttgttatcgcgagagtgggctagttattgctggagtgggctcctgataaaagaatgagcttgggcccattttctctctatgtcttgtgcttggttgcccttctgcaatgggacgaaccttaccagatgctcatgccatgctcttgaactcctcagcctccacaacagtgagccagataaacctgttgtttataaatttcccagtctgtgggtttctgttataacagcagaaaacagactatgataccatagtatgctgctttgaagtgggtgagcagctgggacaattaaggaatcagcttcagtactaagtgtctgggatgcaatgctttgggggccattttcaggttttgtacagcagtctttcttgggtcacattttcactgctctttacttcaaatggtcaagtcagacatcttttaagcaacatttatgggtaggttctgatggcatcttccttatatctgcatatgattggaaatctaagagcatttgggaaccttgtcactgaccatctttttttattgtaactctacattaaagtggggtgttttttgttgttgttgttgttgttgtttgagaatgataaggtaccatgggagcagaattacattactggaaaagtggtggctaggtttataaaagcaaaacagtcaatgatgttctcagtctcaaattatttcaaaataaaaagatttttaagaaaaatttacctaaaataattagtctcttttcagtttagccaccagcttcctatattcttagattgttttattttgatttttgggggttttttattgtgatttaattttttataatcatgtaaaacatttacgtggttccaaaggcaaactataaaagaaaatattttcaaagaagtatgttttctatccctgttcccaccctccttcataagtaatcattttcattagctttcagtttatactcattgtctttgctttaaaattgtaaatattgtagctgtgtgtgtttttacatacacatacatacacacacatttccctcttccttggataaaaggtggcatattctacacactattctacatcttcttgttttattaagtcgtagatactctggagttcactcaatagcatggtattaagattgtccttttttctttttaaagctccaggatattccactggatttaaatttttcaaaatctcatttgataaacatttattgtctactgtgtgtgtcatctgtcacgggtagtgcatagcattgtagggcaaacagaaatgaacaacatatagtcttcaccctcaagaaacttacagaattttaaaatacttttacaaatgtgtacctctcacagtagctgatccagtaacaattatttttatttttacccatctcctttttagagaacagagtaaaaatttttttgccatctattgtttctgttatatttaatgtcatttcagtagtatttataagcagtctaggaacacgtcccaacatttaaaatacttagatatatgattgtaaagtgtgaggcagagaagtacatcatatgaatgtatgctatttctaaatacttgctattaattttagtcactctaaagtcagaatataccagacagtccaaattactgtaattataccatccttttaaaaacttggcacctctttattcccaatattactccaaccattatcattataacaggttcctgttctgtacctcactcacatctgtactcttctccaatatttcttatttctttaatgtctgtacctcataagatgctgaacttttctttgaagacttaggcattggggctgtgggggtactagcctagacttattgaaagcagctcacctatggtactttgtcacgggagtgggtatatctgtgctaggtattgtccttcctatctctttgttggctcttaggggcactccgtctctcagggtcctgagtctgactttgcatctttgaatatggtgtctctccttaaagtcatcttggttacaccttgggtttaccttttctttgcctgtcctccagtagtggccctgaagcctatccatgttatcatttggctactcctggctcttccatcctggagctgttaacctagttgctcttgaactctgcatataaggcccccttccctttctctttcccctttccccagttgctctctaggttttctaatttctttcctgacactatgtatggctttagtcaagcgtaacccttgtccctaaatccacaaatataaagctaagacatgttacttgtctagttttcttagagaaggaaacttctcaggtctttgtatgcttcctcatacaattgtaggttgcagtaaggttaaatggctgaaaagcggtgaaggaacatgttcaagaagtttcatatgatttcactacatgaatgtagatgtggtaatctagcacctactgtactacttaaagcatttcctacagtgaaggcttctgagaaaataaatactattcctgaagtagtctcacaaaaaaaccttttttaattcagaaaattgattccaggttcactaagtcagcattttctctcatcaggcattgcaactaatgacattaatgagagccatgccatattttttaaaacaaaggataaaaagggcaaaactgagaattttaaaagggagttgtttccagtagtctgtttgaacattgtaattaaccaagaaataaaacaagaaaaggccattttaattgtgttttttagtactccattaacagtgcatcaagctccttatgaattgagacagtataaaatgagtgcttacgttaaagtaggaaagccatcagtctgcggtacagagcattgtatttattagagtatcccagacctgaatgagtattaccaccattaggtaatgcttaagtgtctattttaacaaaaggcatttttttttgttattatagagaacaaacactaaattgactaaataaatgaagtttaaacaagaaataaaacagctagaatttgcttgcttttgttggtggtgatatgctcttgtagccccagcaaattacatcagcattgttaccctcgacagggagctttataatttgtagcatgtaaaataacccttcccaaaaaagaagagagccaggacctgtgttgaactacttacaaagcaagcatgtccctggtgtcaccttagtagttttagtgagaaagatgggatttctaaggacagtagttcacagttgtgctctctctgttttctgtctttcatgctttaaggtttttttgctctcttattttaatgtgtgtgtctctatgtatgggcatgtaaataaatatgcagatggtggcacctatgtaagaaaatgtttgaacacagccccaatttcagagctcaatatggcatggggaattcttgggagaatgtgacctattgagggttggttggttgtttgtttttaagatggaatctccctctgtcacccaggctggagtgcagtggtgtgatcttggctcactgcagcctccgcctcccgggttcaagcagttatcatgcctcagcttcccgagcagctgggaccacaggcgcccgccaccacacctggctaatttttgtatctttagtagagacagggtttcaccatgttggccaggctggtctcgtactcctgacctcaaatgatccacccacctcagcctcccaaagtgctaggattgtgggcatgagtcaccgcgcctggccaattatcataaatatatgctttttagtggaccatatagaaagttctattctggttctttatatggttgggttttacttttatctaagtaatgtaagcacatggttttaaaagtcaaatcatgctacttctaacaacaaaaaagcagtgtctctcctaatttgttccaactccaccactttaagcatttttgctgtttcttctgtaaccagcaacatatattactatttcttgatttcatagtttcagatatcatcagttattgcctttttgctatgaaagatgtagctgttttatgttgctaccctcccaccccacttcctggtccctacttactttcccttccccatttttataatattcatatttcagttattcatataatatgattgtatttcttgtgtaatttattgttatatctggggtgaatcattgactcatttctttgattgcttagttttttgttgttgttgtttttgagacagtctcgctctgtcacccaggctggagtgcaatggcgtgatcttggctcactgcagcctccacctcctgggttcaagcaattctcctgcctcggcttcccaagtagctgggattgcaagagcgtgccaccacacctggctaattttttttaatatttttagtagagatggcgtttcactatgttggccacgctggtctcaaactcctgacctcatgatgtgcccacctcggcctcccaaggtgctgggattacaagcgtgagccaccgtgcccagcccgattgcttgttattttatgtattattgctaatttatccctaggctgtcccactaaactgtgtaactttcctcggtacattcaaccccattggataatttatcacattcattgtttttcttggtgacagagggccccctgcctgtgagcctttcatctgtttcattgtaagttggttgctgtcctggcctgctgggctcgtcatgagaattccttttgcctttcatctgtgctagagtctttgttccctaggtttcttgtttttttgcttttttggtttttttggcttccttcttcattttgataaagtatgccctctagtaactttctgagaagaggtgcttttttgagatacctgaaaatgtctttatattactctacaatttgatagtttggctgggtgtagaattctaggtgacaattttgaaaatatatagcatatgggtgaaagtttatatgatgcaacgagactacttaggttcatatcacacttaaccagctgtgtgtgacatgggcacatcacataacccttctgtgcttaagttttctcatctaaaaatcaggcataatatcttacctgcccttacagttattgagaggattgattgaataatgtatgtaaagcacttagggcagtgcctggccgtttttctcccaaagctttaatgatattctctttaccccagtgccctaaaattttacaatgatgtgctttactgtgggcctttttaaaagtcgttatactgattgcttagaaatatttttaaatctggaaactcattgttctttagtttagaaattctttaaaatatttcttagataacatccttttctccagtttctttgttcttcttttcaggagttgctgtgattcaaataacataagggcttataaggtagggcttcatctctaaccttttctttcctgttcctctttctttatctttttgctctactttgagagatttcttcaacttgatcttctaacccttctgtttgagtctcgtggtttagctctcattttttattttcaaggacttttttctgaatgtttttcttttaaactattatatagtttcatactcttgtcttcataggtttcatattcttatctatctcaaagtagtatatttttgaaattttctttgccttatacagggaacagtttcctcagaaaaatattaagagggaagtgttaaataggtgcctgggaacactctgtatatgggtaaattcattatcagtgatcagacaaagactaggccattttttgagcgccttatggatatccgttatctgtagatcttttgttcttaagcaggtcagtttgacagaagaatcttctgatcttctgccttgggctaagggtatgtgtattagggggagaaagggtacgtaggggcatttaagtctgactgcagtggttctgagagataaaggctgagggtctttattttaacatgtttaatacatggaactttccagttaatcctcttgtttgagtacagcacttcagtttgacgtgagctaggggtctggtgtccaaagtctccaaaaagtggggtaaggataatttgcttggccaaagatatccaaggtcatactgcatacctataaaggttcagccagtcctcctgttatctgctccaccatgcaaccctgccctcaaagatacctggtgcttcctattgctaaacctttcttagggacattttgacaggcatatcagcgtgcttcttactggctcgccttattgaaagcttgtgttcaggttctacagaaagcttgtgttcaggttctacaaaaagatgtcaagaagggatttgatgtgcaagaaatttattgagagtgaaaatgaatggtagggagctggaggaggctgggacagccatcacaggtcatgcaggtctgaccccgttggaggaaaaagggaagaaaaagaggaggattgggtggggaaattatttgaccaaggtgcagtttcaaggatgttttggcaaggcgtattgggagtccttgagccaaagttgaccatcagagacccatatctcacaggaattagcctgcttaagtattcctgctgctcttagtcaccagctgagagtatttataatagctgctttgaagtcttttctgctaattccaacatctgggctccctcaaaggcagtttctattttctgcttttttttcccctcctttgtaaaggtcacacttttctgcattttgcatgtctcctaacactttgttatagcaactgtggatactgacaccttcctccactccagggttattcttttttagttacttgctggactagttcagtgcaacctctgatgtccctcttcaggacaggtgtggtccttatccatgcatttctctgctacctctattggtgttaaacttaaccaatcgatagctgattgctcccttctttttgacaatgccttgtggtataaattgctccatagtctgatccaattaaaattgggtcccttcatggatgaaattggaaatcatcattctcagtaaactatcgcaaggacaaaaaaccaaacaccgcatgttctcactcataggtgggaattgaacagtgagaacacatggacacaggaaggggaacatcacactctggggactgttgtggggtgggggaaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaagaaaagaaaagaaaaaataaaaataaataaaaataaaataacattgagtcccttgtcagggacaagtttttctagtctttgagacttgctatacccttccctgagcagaatctctgcactatagagtaggagctggggaaaatggggaactcactcctcattggctgttccacccagatcctccctctgaagcagggtttttgtgttgccgggaaggaggaggtatgaactgtgcctccttttgcctctgctgctactcagtgtggatcttccacagctcaaaaccagggagtatgatatctgtcagtgttcaccaggtgctgaaagtactcagaatagttctttcaccctaggaagttgaaggagatgggagctgccactcagctgccaaacacatctctgtagctctcttgacaacacagagctgtgtgggcaggggggactacactgtttaccagcttcctcacctgattcctctgtttttagctggagttcaggggagagaaatggctgctgccatcagcttctgccgcttgctctatataggccttccacagcatggagccgtggaaaatgggatctgccaatgtttactagctgccaaatccaccccgagtagctcttccatctcaaggggcggatctgcccttagctgctgaactccttaaaacagttctttggcaaaacagagctgtggggggacaggtgcagtccctgtgtggtccctatctcgaatgctacagcctcttattgttcttatcgaatttctgtagattctattgaataaatgcttctctatttgttgtaagccctttgatcagtctccagggactttgaatgattgtgatttttgaccagctaaatatatgtctctccaggggagagatatccctgagctcctttatacagccattccagaagtcccacctagtcattgtgggggttttctgggttttttctgagacagagtcttgctctgtctcccaggctggagtgcagtggtgtgatctcagctcactgcaaccggctcactgcctcccgggttcaagcgagtcccctgcctcagcctcctgagtagctgggattacaggcgcacgccaccacacccagctaatttttatacttttagtagagacagggttttaccatgttggccagggtggttttgaactcctggcctcaagtgatctgcccacctcagcctcccaaagtgctgggattacaggcgtgagccactgcacctggctgtcattgtgtttttaatgattctgtcttaatagaaaactagttttacacaaatataatcaagtgacttaaattgaaaggactaagattgaaaactgaattgaaattgaaaattgaattgaaattgaaacctaagatttttttgaaaggtatgattttattacggaaatttgcttgattgagctttattttaatcaagactttgtatttccatttttagaattaattcagagaaatagctaacctataaagttcatcttcagaattgagtcattgtagacctaagaagcaatatagcagagttattaagagcataggttctggggccagactacctaggttccagtctttgctttgcagcttattggttctacctgggttccaatctttgctttgcagcttgttagttctttttatttttatttttgagacagtcttgctctgtcacctaggctggagtgcagtggcatgatctcagctcactgcaccctctgcctcccaggttcaagcaattcttctgcctcagcctcccaagtagctgggattacaggcatgtgctaccacacccagctgatttttatattattagtggagacggggtttcaccatgttgtccaggctagtctcagattcctgacctcaggtgatccacctgccttggcctcccaaagtgctgggattacaggcgtgagccaccgcccctggccgcagcttattagttctgtgaatgagttacttaactgctctctgtctattcatatataacatgagcatcatctgccccttagaattattgcgaggttaaatgggtcaacacatctaaaatagagcctgactcatagtaagtactcagtaaatgttagctgatggttattgttgttagacacattaaaggcaaataatcatctcatctttgtattttattattgagaccaataatattgtctaaagccagagaccttggtgaaacgctgggtgcccagctagctataatatgatctttagttccctctagtggaagaaaattagataggctctttgcataaacatgctgcttttggaattgtgatcatttaacctaataaaattacccctgaataattaaccaaagacaatatccacatacataaatggatttaagaaattgttaaaacttacaatcttaaatattctttccaagtgaaacttttttggggacgtgtaatttataatattaaataatatagtatataaaccatccagtgacataaaaagttaggcatatattacttttgtttaaaacaagtgcattcagtagtagtagtaccttgaagttttccattttaacattcatacccagttatctgcaagtagatggcatttcttggtcattctctgagaagtctttaatcattgtgatatgccacctggagtagatttccttgaagttttggcatttttagtatcctcttccacacagcctatggggtaacagaaagattgctagattgggaatctgagacctgggttcatcttccagttctgctatgaaatatctgtgtgacttcgggcatgtcttactagggcctcattttccttctgagtaaaatttgaggatagagaggagcatgtgatgatgactgtcttgctgtcacttctgtttctaacattctctgattcagtgatacatacactttgatgtgagacaggagatgtataatagatgttgagtctaagttgggtaaatgggtcctgtatgcttgatgttgccttctagcaggattggcaggaatggaaatcaccagcagtggaatgatttggtaaatgccaagatcttgaggcatctatggaggcggttgctagattgcagcagggtatgcctccctcagcttgggagattgttaaagagaactttgaggcaacgtctaagtgggatcttgatgaacaagtaggggtttaccaggcagagaaggaagcacgtggagtatcatacagagggaacaacatttgtcaggggacagagagcagggggccggtgcacaagctgcgggtggttcaggattggggtcagggaggctgaaggaagaagctactggaaaggaatgtataaatgtgtgacttcaaaaaaaaaaaacaagagctaaattgtttgactaagaagccggagagctagcttctatttccagttatactgttaaataggtctgtgaaccctagttaagttgttggacttaaaagattttttggaaggctttcaaagccatgcttagggattataatgtcttgctgtatggaatggagctcagtgaaggttttggaataatataatatctgttttagagtaaaactatgatgacactttaatgagtctaaagagaagaaactagaggcaaagaaacccatttaaagatctttgctgtgatccagtcaagaattgttgagggctgaaactagggtaaccgcagtaagggaaagatagttttgacaggtgttgcagaaatagaatggacaggttttggcagctgcatataggaagtagaggagaagtggtagatggtgtgaagatgactccaagggctgtctggaagattaataattttggtaatcagtaggccacacacatacagctacatgggttctgttttacttttcttaactagtgtccttattattaaacattttgagtgtgtctagtttttttcccaaataaccctatggtcatcttgaggttttttacgaaatatgtgatttcccaaaaaactgtagatgaaaaactgcaaagttaaagtaggcatagaactacactatatatagcagtgtggtttactaatagatgttcacattgctgccttcttggtgtcaaactcggtttgattgacatttgttaaacatagaatgatttccaccaaaaatgatgaaaggaaaagaaaacaaaacttattgtgcatgtgcactctcacatactttattaatcatccaggcctaactacaaccctgtataggagttgttatcttactctttctattttacaaatgaggaaacagatgttctaaggttatgcagctactaagtgatgaagacaggaaagacaggtcttttgactacaagtctattgccctatctattatatcataactgcctgccagcagaatgtgttagtgcttaaaaggatagatgccagatctgtggaagtagggtgaccagtcatcttggtttgcctgggaatgagggtgggttctcagaacccaggactttcaacctggaaagatcctcggtgccacaactgagaaagttccaggcaaaccaggacaggttggtaccctgtccagaaaagtcacttatatgaaataaaccattatctagaatgacttaaataaggtatttactgtatttctttcccataatattgtgtcatcaatgctaaatgacaaatgattcctaagtgaagaggagttaaggccccgccttccttccatctgtttgttttcactggctctgagcatcctgccttgctgcagttacactcaactgtgtgtgaatcagatactagatgcctttgcttctaagtcagttttattttattttttatttttatttatttatttgtttatttttagacaggatctcactctgtctcccaggctggagtgcagtggcatgatcttggctgactgcaacctccacctctcgggctcaggtgatcctcccaccccagcctcctgagtagctgggactacaggcacacgtcaccgcacccagctaatttttgtattttttgtaggaacagggtttcaccatgttgcccaatctggtcccaaactcctgggctgaagcgatccacctgcctcagcctcccaaagtgctagtagaattacaggcacgagctaccgtgcctcgtctctaagtcagtttttaaggaaacttatgctttgcccattccaaatttgatgaaatggcaaaagagctattcagggaaaaatcaaggagggctgtcagtatctgtgatttcaaagtatttatcaaaacaattaactcatttttcttggtcctttttcaaataagtatcacatattggtagttatttctttacgataaatttgttttatactatttttatgagactttgttgacaaaaggattctgtagctggatggggaaacccatattattaaaagaaaaaaaaacctcagataatcatttcactatgccgtacagaatttttacctcattcattttttacatattgaaacagaccacaaattgctttctgggaaaagttttggccctgctgtcagtatttcctgggctggccccatcctggaagaagatttgggggagaaatgggtggtaaggaaatctatcctgtcaacgtgtccttgttgagctcctcagctatcagttaataaatatagaaagtaaattatagataacacaattatgaaagtataaagcacaggtatgtgaagaacattttttttctttgacatattagttgaattcccattttatttcagtaacttctcgtttgctttttaaattttattgaagaacgtgtatgcacaataaaatgtacccatctaattgtacacttcagtgagttttgacaaatgtatgcattctgtcatcccacaaagttccttcgggctctaacatgtatgatttttaagactttaatattgaaaagtaattgagttataaactgatatttctctaattttcttgtataaagtaaggaataccatgttgaaataggtgtctggtttttctaatagtcaaatgccctgatcttcccccctttggtttacatttcccaaaatgaaaagcaacagagcaattgcaccttttagacaaacttagagcattgtatttctatttttgtcatatacaaatttgttacacttatcagaactgaaaactctttgggaaatatattaacaaaaccccattaatttgtaaatgcttaatgcagctaagattgatttctaattaatacacatttgcctatttaagaaaattttcacatcagtcaaacactgaattaatggtatgctgcttcctttctttattcacctgatgatgatatttggggccataggaattttttttcaatgggcaagaattcaaagaaattagaaggtgcttggatttctgtttgtgtgtgtgaaaaaagacaacaaaatgtatagagctagtagtgaaacatgtaaaaaagaatcaaagaaattatgagtttgcagttgacccagatttctatggtggcctgtctaggcctctactcttcactagctgaggtcaactttcctgaaggtcaatgaggaagatagcctcattaaagccaacctgacctgtgttgttgccaaaggcagctgggatctttattcttcaacttgattatgagataaaggtagaacccagcagcagaaattgactttgctactataatccttccaaggttctgcttggattcctttcttaaagtatcatttggtcattcatttcagtacactaaggaaaaatatgttgagtcaataatgactttcatttacttattttgttattaatatttattgaaatgaacacattagtacttgtcctagttctttctatgactagattagaatattctttattttgattttgagtccaggtcagctcttagcgaattttgtttaactgttgaatttctaacacaacctagacattgtttggaaatgaatgagaatacttgtatatttgttaggaaaagcgcagtatctagtttctgactatcactagttacaatgcagctgaaataagccggttctgtaacagtcttgatagcctgtcattcaagtcagtattaccatattagcactattgtgtgattggatcttaggatatataaaaactatgcagacccaggaggcactgtggtgtgatgtaaagagcaaagggctttggttattagtcctgcttcctccacttactagctgtgtgatttatatcattgagccctggacctcagtttctacctctgtaaaatggggagatatatgtgcatatatatgtatgtgtatatgtacatgtatgtcatgcagggttattacagtaacaaatgaggacttatagaggggcactttaaagtctcagagtttgcattagattaacaatagtgaagaaattccagatttagttattaaatgatggatttgggttattaaaagaagctataggatttccttctgtgaaagtattttttaaaaacacatctgtttgaatttagattctttttggaatgactgacattataaatatctgtaagaattacagaactcacaatcaggagaggataagaattaaagcaagtcaacttatctagagtggcaccattccaatttggtagacactagccacatgcagttattgagcacttaaaatgtggccagaccaaattgagatttgctataagtgtaaaaatacatgctagatctcagagataatagtacaaaaaaagtaacttattttattaattttagtatgattatatgttgaaataatactttgtatacattgaattggataaaatatgttatcaaaatgaattttacctgtttctttttacttttttaatgtggctactggaaaatttaaaattatatgcatggcttacattatacttaaattggatggtgttgatcaaaatctttattgagctaggtgcagtggctcacacctgtaatcctaacactttggaagtccaaggcaggaagattgattgaggccaggaattcgagatcaacccgggcaacatagcgagactctgtctctataaactatttaaaaattagctgggcatggtggcacgtgcctgtagcccagctgctcaggaggctgaggtgggagcatcccttgagcccaggagttcaaggttacagtgagctatgatcacaccactgcactccagcctgagcaacagaatgagaccctagctcaaaaaaaaaaaaaaaaaaatccttattgaatgctctcgagcaaacgaaatcttaaatttagatcttttaagttcagatacagatagaatgaaaagttctcctagttcttcaagaaaaatagtagtaaaataatactttacaggaaaatcatttttaaaacagaccacttgaaccagcttccctaactttcccttacttgaccagtctgataggcagaccctggtgggatacttgctttactattgttggagagcccaaactttttaggaaaataatagtcattctaatgccatatggcaggttgatttcatttaagtttctaatttgggttagaaaattaaatattgctacctgtattactagttccccttttaaagggaaataaattgataaaataaatataggcatatagttaaatgtaaggacactaaacacagaaatagattagtttaaaatatttttaaaatttcctgagaaattacaaaaaagaaagtacaacttagccataaaaaggaacaaaataatgccattcacagcaagctggatggagttggagaccattattctttttttttttttttaatctgagatggagtctccctttgttgccctggctggaatgcagtggcgtgatctcggctcactgcaacctccgcctcccaggttcaagcaattctcctgtctcagcctcccgagtagctgggactacaggtgcacgtcactacacccggctaatttttgtatttttagtagagacggggtttcaccatattggtcaggctggtcttgaactcctaacctcaggtgatccacctgcctcagcctcccaaagtgctgggattacaggtgtgagccactgcacccagctggagaccattattctaagtgaagtaactcaggaatggaaaaccaaacattgtatattctcactagtatgtcagagctgagctatggggacgcaaaggcataagaatgacacgatggactttgggggaagggtgggaggggaggtgagggataaagactacacattgggtacagtgtacactgcttgggtgacgggtgcaccagaatctcagaaatcaccactaaagaacttttccatgtaactaaacaccacccgttccacaaaagctattgaaattaaaataaaaaatgtactcattaaaaaaaaagaaagtacaaaggagagtgaagagaggtaccagttactagtctgtaaacaaaacaatacttcaaaatagagatggtaaccctgggtcatgtcattcccaggtacattttgtgctaacatctgtaagcagtcagataatcaccactttaaatcatattttcatcacctgctttcaaattccttcctactttgcctctagagttgatttgtaggcaaatagtgtttttagtttgctatatcagcgtggacttaatagcacttaatacatatatctttaattcacattcatatttagaaacaaacattttgagtttaatattcgtggaatctatagttggaatggatatatttgtgtttttaattgtgctatttgagctatttaatttatacttgaattcaggaaaacatgaccacaatttttctagatcattgcccttatcatttgaaatatatttttatgttgctagtttcatactagcaaatcaagtcaaatcagtgttctgactttagttctgaaatgtcagatccggtgacatttaaattgctttgaaggctggccccccagcaattctgcctttattttgagagtgggtaggtgataagagactagaccaaggacttgttcagccatttaccaaatcaaaatgtgaggctcaaatggagccaaatgtgtggcagaaatggagcatccatttctgcttacaaactttcagtataaccaatgtatcacatagcaaatggtgaatgtggagataaaaatacaatttagactgggcacagtggctcatgcctataatcccagcactttgagaggccgaggagggtggatcacttgaggtcaggagttcaagaccagcctggccaacacggtaaaaccccatctccaggtgctaaagttgaacgagctgatggatatgaaccaccagtccaagaatctgtttaaagttcagacttaaaatagtggcaaataaaaagtcctcatttgtgatggtttgcttctgaaagaaaaaaaaaagtctctactaaaaatgcaaaaaattagccaggcatagtggtgcacacctgtaatcccagctattcaggaggctgacgcaggagaatctcttgaacctgggaggtggaggctacagtgagccatgatcacgccactgcactccaacctgggcaacagagcaagactctgtctcaaaaaaggaaaaatacaatttagttacatgaaagaggcaaaatagaaaataagctgaaaataaagagaaaatatcagttttaattgtggcaaacaccaaatctgtttacttcatgactcctgtgtcacaggatagagttaaaatcaggcttttgattagaatagagaggaatggaaagagaaaaacttaagtcgaaaacagaagatatgaaagggtgagttctaataaaaatgggaagctagagataaacataaaaatgagtaataaaaattttaagcttttcctagaattagaaggcagaacactcctggagaggaaaaatctgtgcaggcatgtgattgatgttgtctggctcagcctggccctccagcacacttgttaaaagctttcctcatggttatgacttcccagcacaaaccccacagctgcttcacatcctcccctcctgcggggccttcctaactacttttggagatggaggcatctttcctgtgcctctgatctcttcctttgcagtaaacactgagcccccagccctgccatgctgggctccaaacatccagcttctcattagaatcttaacactgccctctccaactgatttggtagactctgcaggtaccacatcacttgtcactgccccatttcattgactctaagaaagtcatttgtagaagttagcagtcagcttgcagatggtaggacaaaggcaggaccagcaccatattttctgactccagatcctgtaggcttttcctcactgccacttacaaacacacagagtgcttcctttaaaaaaacaaacaagtaaaaccttctcttgaccccgctatttctttcctactgccagattcttctaatatgatcgtgttcaaacccagcatggcattattggaaggactgctgactttggaattgggcaggccagggttcaaaacctaccctcatgatagctgtgtgatcttgaacacgtttctaagcctcagtttctccatctgtaaaatacctacctcacagtgtggttgggacatcaagtgacagtgactatattaagtacttagcccaatgagaggtgtgataattttaactgattattacataattgtctctggcatactgacctcaaccctgactcctccccaaaagttgatcttgctcaggattctcattaccttttctggctgaatcttgtggtcttttctcagctttcagccttctccagctatttacaacttaatttcctctactctcttgattttcttaatattattgattcttcctttccttgtggcttctcttttgtcaaattttctgacttctttttctcattctacccttatgtaagtcaatcttctaaggttccatctacgatcattgctctgttgacaagactaagttgaattaataaatcagaaaggagataatattatctattttactttctgcagtacatccttagccttggttcttccttacctgtctcccttcgactttctaatataaaaatgtcacattggattttaagtcatcagcaaacgggtaaagccccagtgctattagcactggatggctttcattattctattccatgtagacatggcaagcgatttccatgcccaaactgttttgtatgatgatgatgatgatattaacaactttgttttccaaatagtattatagagtttacacagtagtcctacatacattatttggatttgttcttcaaagtaacattgtgaggtaggtagagtttggaattatccaacactttttttttttttttttttttgagacagagtttcactctttgttgcccaggctggagtgcaatgacgcgatcccggctcactgcaacttctgcctcccgagttcaagtgattctcctgcctcagcctcccgagtagcagggattacaggtgcccgccaccatgcccggctaattttttacatttttagtagagatgtgatttcgccatgttggccaggcttgtctcaaactcctgacctgaagtgatccacctgtctcggcctcccaaagtgctgagattacaggtgcgagccaccacgcctggccccagcacattttataaatgatattttaaaaattctgactttgactctaggaatagtgccttttctgtttaaaccatactattttttgttccctattccgtataacttccctgataggtctataaatgctagattttaggctaaagaatagacaacatatttttattttatttagggaaaactaagaaaaagaggtaaaaatcaaaacagtaaattgagttattagtttattagcagatcaaggaagagttacaaatttggaggctaagattttattagaagagttggggaaagtatttgtggtttgtttttttttttttttttgcttttggggaaagtattaagaaatgtgtactttttttattaaaagctcactctatactgtatatagatttaagcttgcaaaaaatatgaaaagctatagtcaaagattttaaagggtaaaaagttaagctaagtttaaatgggggatttcatctctctagttagagaagtatccatgttaccatagatcacatccattcattcatcattcactctaattgtcttttgttcctacctaatgaagtatgctgtatgtttgttttacagatctaaagcgggaagccagtatctgtcatatgctgaaacatccacacattgtagagttattggagacatatagctcagatggaatgctttacatggttttcgaattgtgagtgtgtattttaattcttaaagggtaaaacttgaagcaatgttggtgttggataatgctaacacttttctcttgaaatttagcagtagttgtgaacttatctgttcagaaagacctaaagtcacaagaaaaaaggattatgtcatcataaggtttacagtggcaaaggaagcaaaagctgggcatattcagttactcttcatgctttcagcatgcttcagagaagagactccaaaaggaaattgagttcagaggaataggaggaccccaaactataaacttctgaccagtagaagtcttagtgaagaagagtaggatgaaagtggaggcatccatgtagcaagactcttggcaactaaaaacaagtaacgacagacttagttcctcttttgatataatcaccatatggcatataagggcaattttatagatcacagtgtatcttgatttcaataagtcacttgatatgtctgtcgcagactttttgttggtaagatggagaattgtgagctaaggatagtacaactgggtcatccagctctggtcggatgattgtgtccaaagagattatataaagctttataggacagcatcctacagggttttatctttgatcctattctgttcaaaattgtaatcaggccgggagtggtgactcatgcctgtaatctcagtgctttgagagtctgaagcagggaggattgattgaggccaggagttcgagaccagcctgggaaacataccaaaacctatctctatttttttctaaaaaaaaaaaaaaaaggttgtaatcagtgactttgattaggaaaaaaaacagaagatatacttgctaaatattcaaaagataccaaggtcagaggttatattcattacctattgcttcataacaaaatgccccaaaatgtaatggcttaaaacaacatacatttattatcttagtctctgtgcatcaggaatgtgtgttccaacttagcagggtcctctggctctgggtctctcacaaggtgataataaagctgttggccagagctgaagtcattttgaggctccactacaatgtggatctgcttccaagctcactcacatgattgttggcagtcttaccttcctcacaggctactggactgagagccacaattccttaagagctgttggcccaagcctcccttggttccttgtccgttgggcctctccatagagcagcttccagcatggcagctggcttcatcagagcaagcaagaggacaagtgagagtatgagcaagacagaagtcacagtctcgtaacctaatctccaaaattacacaccatcacttctgcagttagaaatgagtcactagatccagcctatacacaagggggatgggattataccagggcctgaatatcaggaggtgaggatcactgggaggcatttcacaagttgccccctacaaagggctagctaacatattggctgtctacatcaaaattcaaaaatatttttacaagtttgtagcaaaggagctgaaacaaagaaggtgaaatttaagaccagttaatgttaactccttcattcaaatatgagtaagtgcaagatcagtgtgaatttagttgtgattatgtgaaaaaagatgtaaacattttagttgttgtttgcaacagcttaaaaagcgctgaatggaaggttatgctacattaattaggagtatatagtattcagaacaaagtcatactcctcccgttcaccctggaccattcatagtaagcaggacactggaatgtctgcagaataggataaccagaatggaaaggagcctgaaaattgtgtcatagagacacagccttcaaaatcttttctggcaaacctgctaaaagaattttgaggccaggcgtggtggctcatgccaataatcccagcaccttgggaggccaaggcaggcggattgcttgagctcaggagttcaagaccagcgtgggcaacatggcgaaaccctgtctctacaaaaaatacaaaaactaggtgggcatggtggcacacgcctgtagtcccagttacttgggaggctgaggttggagaatcacctgagcctgggaagtcaaggctttagtgagccatgattgcaccactgtactctagcctgggcaacagaacaagaccctgcctcaaaaaaaaaaaaaaaaaaaaaagaattttgaaaaacgtatgtaccccttcacatattttttaggttgatatataaaaacttttattgtgagaatataattctcagtatcttgaatattcttttaaatatgttttgtttgtttgtttttttgaacagagtctcactctgtcacccaggctggagtgcagtggcgcaatctcggctcactgcaacctccgccccctgggttcaagcaattctcctgcctcagcctcccgaatagctgggactacaggcacgtgccaccatgcccggctaatttttgtattatttagtagagataggtttcaccaagttggccaggctggtctcgaactcctgaccttgtgatctgcccgcctcggcctcccaaagtgctgggattacaggcatgagccaccacgcccagccttaaatatattttctacacaactgtagaattgcctgtttatctcattcactgtatggaaaatgtctgctatgtgacctacatggcaatgctagtccttattgtcaaatcactcagccaaatcagactcattttctgtcagggaaaaaaaaaatctgacttcatttttcaaacaaaattaaagtgttaaatggacatccctgtgacactcatcttagtattgattttgaattcttaaacagcttaccatgaatatattgcctggataaagtaaggtggaacctccctttttttctcaaactctctttgttttgctttcaaaggtctctccctccctcaggggctgtgcatttcccagccatctctttgaagttaggctttttgggttggaggagtagtttgccttttggatgggtaactggagatgtggagatgggtgattgtagttgtggagatgtaaaagaaaaaccgcagaccacagacttgtttacaaacagacaaaattatggaaaatgaagatatggaaattgattgccttaaaaatatcctagttcatgtgtctcctggaaggactttgggtattcccagagatacccaaatcctaggttgaagaccactggcctagaagagctgttgaaaagactgggaggctttggttatccacgaatgtattcgtttcattattctgctggaagagtccccaaagcagaagcccatagatagaacataatcaatgtccacagttatttgaaagattgtcatatataagactatatgcttattcagtgtggcatcagaggctgtaactagaatcaacaagtggcagacgtcacctctaactaaagaagacctttttgatgattaaacttactccatgaatgaagcagcctgtctcacagactatgtagtttctcactagaagcactcaagttgaagctggatccttccaaggggcctgaagataaggttttaattttggactagagatggcctctaacatcccttctaattttaagatattgtaattcttttgttttttttttttttttgagacagagtcttgctctgttgtccaggctggcgtgcagcggcgcgatcttggctcactgcaacctccgtctcccaggttcaagcgattctcctccctcagcctcccaggcacaggtcaccacgcctggctaatttttgtatttttagtagagacagggtttcaccatgttggccaggctggtctcgaactcctgacctcaggtgatctgcttgcctcggcctcccaaagtgctgggattacaggcatgagccactgtgcccggccaagatattataattcttttaaaattacttatctggtttaattttattctttattcaagaaatatatttctgtctgtatgtttattttctgagaaaactaagaacaagttgggtttgttttttgttgttgttgtttttgtttttaacagtctcactctgtcgcccaggctggagtgcagtggcgccatcttggctcacttcagcctccacctcctgggttcaagcgattctttgcctcagcttcccatgtagctgggactacaggcgcatgccaccacgcctggctaatttttgtattttttgaagagacggtgtttcatcatgttggccaggctggtctcacacccctggcctcaagtgatcaaccctcctcagcctcccaaagttctggaattacaggtgtgagccaccacgcccagcctcctaaaaagcaagttttacatactatataaagtaatgatcacagaaagcaaattttaaaaattcacctaaatttcaccatgtatgctaattgtatcaaaggggacttagtgacagtgtagtagagaaaaaaggatctttggtttcataaaacctgggttaacatcccagctctgtcacttttactaattatgtgaggttggccaagttttataagttccctgagcctcagtttgcttaccttcagaatcttcctaagattatgagaactagatgagaaactgtatgtgacttccctttgtaagtggtgaagtgctttttaactataaagtattatttccagtggctttaacaggatagttttagtccctcattgttgaagtagtctgtgtgggattttatgtaactaattttgtatgttgtgatggaaataattcatggttggctgtatatcgagatgagacctggttaaattggatattttccagtgacctgatcccagtgttaacccaaatcactagaacatggccttatgttttcttttgttttgttttcttttttaacagtgtaattgtggaaaatttcaaatgaaaagagagaatagtataataaaccccagcatactggtcaccaagcttcaatagttatcaaaacattttgccattcctattctgttcctcctgatgtctttttctcccctggagatttctaaagcactataatttcacctataaatactcttgtttgtatttctaacagataaggattttttaaatgatcatattattattatacctaacaaaatcaacaataattccttaatatcatgtcatgatcagttgatactcagttttccctgattgaacatgaattttaactgacagatttctgaatttagaattgttttattagctctagggacctgaaagtagattataaattcagttaaaataacttagttatttctcaaaagggccagaagcaaactagaaatagaaaattgttcttttgtatcattgttttgtaaattcacctcaacaattggccttgcacagttttttgcatcctccttatctcctgggtttcaaacaaaccaaaaatatcgattactctaagatttaaagtcatgtggagcaaaaaacaaagccaatgcacttgtgtatagttccacctactggctaggtgagagattgcttctatagctgctacgtagactaagctactccagaattgccctcatgtttctggcaacagatgtaattacccctggtatttaggggctcattgctcaggttatgggttatctggatcctttttacagtttttgtaacatgacacccatacagtgtagacaatgaaaggcaaaaaaataaaataaaattaggtcagttagttttgttgtttgttggctacttagaagcagcatttatcattttggtggagaaaaggctagacaaaacagcatatttggatcatgagtgagtttcttaatatggtgtccatatctgtctttgccacagactatgtataaccaacactcctttttttcttcctaaactgaagtcatgaaattatatggcccgagaatgttgtttatcatgttagaaaatccttagaactagttgatggctgggctcagtggcttacgcctataatcccagcagtttgggaggccaaggcaggaggatcacctaggggtttgagaccagcctgggcaatagagtgagacctcatctctacgaaaaaattttaaaaattagccaagcatggtggcacacacctgtagtcccagctacttgggaggctgaggtgggagaattacttgagccacagaggcagaaattgcagtgaaccaagatcatgccactgtactccagtgtgggcaacaaagtgagaccctgtctcaaaaataataagccggacttggtggcttacacctgtaatcccagcagtttgggaggctaaggtaggtggatcacttgaggtcaggagtttgagaccagcctggccaacatggcaaaaccccgtctctactaaaaatacaaaaattagccgggtgtggtggcacacacctgtaatcccagctactcgggaggctgaggcaggagaatcacttgaacccagaaagcagaggttgcagtgagccaagatagcaccactgcactccagcctgggttacagagcaagactctgtctctaaaaataaaataataataataataatagttgatatctacttaatcacaaatggtttataagtttaaagcatgcttaaaaacagagactcacaaaaccagaattttagatatggaaaagattagattagtaaatttcaaattttaggttagaaaatccggtataaaacttgttaaacaagcaggtacccaggtcccacctctagacattcacttttgcagatgtgagttctgaccgggcaggtcaagagatgattgacctttaaaatgggggtaatacaacataaaggctatatcatcattgtcccaacacacacagtagttttgtagacatctgcatatatttgcacatccattactttgggattacacttaaatttgaacctgtctgtagcaatttgctgaaacatattttaaatacaggttcagttttgaagacaggctgagttgggttatccccacaagttaaatatttatttctaagtgacacatttgggcttgtctttagtagtatctggtacttgagttaagctgtaaatcctaaattggctggccaaggaattttaattaccttattacagagcgattacatataccacggggagacttttacaataattaaatattgatttaaaacacatccgacatgatgtgtatcttttaaaataatttttttgtatcttttaaattttttatctttaatatttttaccttttatatctttaatttttttgtatattttaaaataatattagcagtttgtgtttttgtagctcacaaaggcgataaactgaaagctctttttttattattatttttttttggtctagtatttatgcctggggaagggagtgtttgtgaaatttatttatactgatagagtggaactgattactacttaccagcaaacttgctgcttaagggaaaatatgtttgtctcataccaagcaataaatatctgtactgtagcattttaatctatttgaagatttgctcatattttcatagctagtcttatataatctattttgattttttctttttatgtgtgatgatataaattgctatttgttctttcagcaaagtaaacatctcttttgactcacagtatcaaaatgtttagttgattttagttttgcaaactgtgtgtcagggatccccaagaccacccccaggcttgatgattcactaagaaaactcaaaggactcagcatatagtcatattcacagctatgatttattatagctaaaggatataaagagaaatcagcaaaaggaaaagatacattagctgaagtccaggggaaaccaggcacaagctttcaagggtctccccagcaatgagttgtgacaacacatgtgaaatggtgccaaccagggaagcttattagagactctgccctgggtttttattgggggctggtcacataggcatcttccacttggcacttaaccaaattccagactcccagaaagaaagcaggtgttcagcctaaatcacattgttagcacaaacagtttagacacagtgagtcagtcttttcagtcaggaatgtagaggaccgtcctgaaatccaagttcccagataaacctctcaagggccaaccttagtaggcctttcaagccttttatgagatagtagtttaggcctgctatattaactcttctgcacaaactaaaatagagataaatagaagaagggttttaaaagagttgatataaactcctggatctgcaaacaaaatataattgactgtaaagataatgacagggtttggagtttggggtttttttttttttctttttaactgtaaatacagtatcatttttatatctgttaaaaaacatttaggtggtcagatttttgtataaaacaaatcctggattgggatgttacagtatagaacagattttaaactttgaatgctatatgagaaaataaactattcagatgctactgtcttagaaatacatttgaaattgtcactccgataacttttcgtctatgacaactaatcttcaagccactaaaataattttgaataaatttgtgtacatataaaatctgaagaaaattcagttaattttctgttatttaaaagaagtatagtttgttcatttaaaaataaaagttattggccaggcacggtggctcacacctgtaatcccagcactttgggaggccaaggcgggcggatcacttgaggtcagaagtttgagactaacctggccaacatggtgaaaccctatcactactaaaaatacaaaaattagccaggcgtggtggcgggcgcctgtaatcctagctactcgggaggctgaggcaggagaatcacttgaacctgggaggcagaggttgcagtgagccgagatcacaccactgcactccagcctgggcaacaagagcgagactcagtcttgaaaaaaaaaaaaattcttagtgtacaacctttgccatatacataacttgtaaaaatttagaaattacagaaaattttgacaaaaaataatgtcttaattttgttataaaaattgtaacagaaataaatgtcattcacaaacattttggaccatttccttctattggaagcattttgctataccattaaatattttttggatacaatattttaatgacttcattaagacatctaaatgtgtgcatgtgccatgtttaataaattccctatagttcaacattaacattgtttttccctattagaaataatttataattaatatcttgtacataattacttgttcacgccccttgattgctttgtttcctcagaatacatttctgaaagtagaataactgggtaaaagagtatatgaatacatacaaatacatacatcatacttagatttaacctttttctcagtacaatgcctcacattttgaaaaatacattcacataaatatacaacttaaagaattattgtagaagtgaacaaccatgtaactataacccaagtcaagaaattttaaaactgccagtacctcaacagcccctgaattcccctttctcatgataatccccttcttctctcagaaataactaatctggacttcacttctgtgctttttatatccctagcatcaaaataggaattctcagaattctcaaataataaagttcactgtcgtctgctaaaatctattttttttttttttttttgagacgatgtctcgctctgtcgcccaggctggagtgcaatgctgtatcagctcactgcaacctccgccccctggattcaagcaattctcgtgcctcagcctcccgagtagctgggactacaggcatgcaccaccacgcccggctgatttttgtatttttagtagagacagggtttcaccatgttggctaggctggtctcaaactcctgacctcaagtgatccgcctgcctctgcctcctaaagtgctgggattacgggcatgagccaccacgcctggcctaaaatctttatttgaatggaatcctacagtatatactctatttttggtctctgagattcatctggttgctttgtgcagctgttcctttattttattgctatgtagtattgcagtgaacaaactcgcactatttattcattttaatgctaatgagtatttgggtgattcccagatttcactattttgtagagcagatccttccacgttgttcttcagccatgttttaagggatgtacttgtctgcatttctcatatacattttagaatgaggttgtcaatttccaccaaaacaaaaaaactattgagatttttgtcttgaattactatatcaaatcttgatagcaatttgagaataattgacatgtttacagtgttgaatcatccaattcgtgaacatagtgtctatcttcccatttatttagctctttgatttcttgcaataaagttttatatgttcctctgtagaggttgtgtacatctgtattagatttatgtattgtcagatttattcttaggtattttgtttttagggtaagtcagtttctctcattctcccttctctttccctttccttgtactaactttgtgttcctattcatcaggcttcattaattccaacaattaatctgtagaatcatttggattttctccatacataatcatatcatctgtgtataaggaggatttgatttgccctttccaacttttttacatcttttcttgcctttattacaatggataaaacattcagggcagtggtgatggcagttatctctgcttatttctgatcttagagtttgctaagcatgaatggatcatgaattttatcaaatgtcttttttctgcatatgcagtcatgcatcctataatgatatttcagtcaacaacagactgcatatacatgggtgctctcataagagtataatggagctgaaaaattcctatcgactagtggtatcatagctgtcataacataatagctcaacacatcactcacgtttgtggtgatgctgctataaacaagcctgtgctagcagtcatataaaagtataacacatacaattatatacagcacacaatacttgataatgataataaataactctgttactggtttatgtatatactatacttttttgttgttttgtttttattttaattttatttattattattataccttaagttttagggtacatgtgcacaatgtgcaggttagttacatatgtatacgtgtgccatgctggtgcgctgcacccactaacttgtcatctagcattaggtgtatctcccagtgctatccctcccccctccccccaccccacaacagtccccagagtgtgatgttccccttcctgtgtccatgtgttctcattgctcaattcccacctgtgagtgagaacatgcggtgtttggttttttatccttgcgatagtttactgagaatgatgatttccagtttcatccatatccctacaaaggacatgaactcatcattttttatggctgcatagtattccatggtgtatatgtgccacattttcttaatccagtctatcattgttggacatttgggttggttccgagtctttgctattgggaatagtgccgcagtaaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcctaccaacagtgtaaaagtgttcctatttctccacatcctctccagcacctgttgtttcctgactttttaatgattgccattctaactggtgtgggatggtatctcattgtggttttgatttgcatttctcggatggccagtgatggtgagcagtttttaatgtgtcttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggctttggttgccattgcttttggtgttttagacatgaagtccttgcccatgccttgtcctgaatggtaatgcctaggttttcttctagggtttttatggttttaagtctaatgtttaagtctttaacccatcttgaattaatttttgtgtaaggtgtaaggaagggatccagtttcagctttctatatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagttgggtagcgtgatgcctccagctttgttcttttggcttaggattgacttggcaatgcgggctcttttttggttccatatgaactttaaagtagttttttctaattctgtgaagaaagtcattggtagcttgatggggatggcattgaatctataaattaccttgggcagtatggccattttcacgatattggattcttcctacccatgagcatggaatgttcttccatttgtccttcacgtcccttgtaagttggattcctaagtattttattctctttgaagcaattgtgaatgggagttcactcatgatttggctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcttcttttcctaattgaataccctttatttccttctcctgcctaattgccctggcctacagtatgttttaagctaagtgttattacaggagtcaaaaaggttttaaaattttttaagtttattatataaaaaattatagtaagctaagatttattattgaagaaagaaaaatacttttatataaatttagtgtagcctaagtgtacagtgtctagaaagtctacaatagtagaaagtaatgtcctaggtcttctcattcactcatcacttactgactcacccagagcaagttccatgaatgcaagttcccttcatggtaagtgccctataccagtgtaccattttttatcttttatgctatattttgattgtaccctttctatgtttagatacccaaatatgtattacagttgcctgcagcattcagtagtcacatgctatgtaggtttgtagcctaggtgtgtagtaggatatcccatctaggtttgtgtaagtacactctatgatggttgtacaggaacgaaatcccctaactatgcatttatcagactatatccccatcgttagcaacacatgactatattgaaataattatataataccatccttcaatctattgctgtagtgaattgcattgattcttgggttaaccaaacctggtcatgatttatgatcttcataatcctttttacatattgttgggtttggtttaggctttctgtgtctctcttttttaatttatttttacttttttttttttttttttgagacagggtctcattctgtcatccaggccatagggcagtggcaccatcacagctcactgcagcctcgacctcctgggttcagttattcctcctacctcagcccctttctgagtagctggaaccacaggcgtgccaccatgcctggctaattttgtagagatgaggttttgccatgttgcccaggctggtctcagactcctgggctcaggtgatctgtccgcccagcctcccagagtgttgggattataggtatgaaccactgtggcttcctggttttcatacctagattacacttgcctcataaaatgaattggggaatgttctctcggtttttttgttgttactattgttctattgattgattgattgactgagatggagctttgctcctgtcgcccaggctggagcgcagtggcgcaatatcagctcactgcaacttccgcctcctgggttcaagcaattctcctgcctcagcctcccacatagctggaactacaggtgtgcaccaccacgcctggctaattttttgtatttttagtagagacagggtttcaccatgttaaccaggctggtctcaaactcgttacctcaggtgatccgcccgcctcggcctcctaaagtgctgggactacaggtgtgagccaccacacctggcctctattgttctctttatgtgatttgtagaactcacctctaaatccatccaggccagagttttcaatcttagttcaattccttaaatatttataggaatattcagggtttttattcattactgtgtcacttttagtaaactgtattttgctaagaatgagtgcattttatctaaattttaaacagttttggcataaagttcataataccactgcaggttctgtagtcatgtcttctttttcattcttgatactggtaatttgtgccttctctttttctttctcagccttgccagacatttaccagttttattattcttttcagtgacaacttgtagctttgtaattcttttttttttttttttttttttttttgagacagagtctcactctgttgcccaggctggagtggcgtgatctcggctcactgcaacctccacctcccaggttcaagtgattctcccaccttagcctcccaggtagctgggattacaggtgcctgccaccatgccaggctaatttttgcatttttagtagagacggggtttcaccatgttggccagactggtctcaaactcctgacttcaagtgatccgcctgcctcggcctctcaaagtgctgggattacaggcatgagctaccgcgcctggcctgtaatttctttttattgtgtgttgttttctattttagtaatttctacttgctgttatttccatccttttattttgggtttaattttctgggagctttttcccttttagtttcaacctttttgtatccttgggttttatttgtacctcttgttaaaggcatatagttgtgttttattccagtctctcaatctttgtcttttacttggatcatttagtccatttacatttaattatattttagtatattttgagttttatctatggtcttatgtgttctctatttgcaccacctattccatgtttttttctctcttgatttatttgaatcaaatgaatatttttatcattctattttccctctgttaattttgaagtttaagcactcttttctgttatcttagtgtatatcccagaaattacagtatgcttcgtaacacatcaaattctgatattgataccattattgtcctcctgaacagtgcaagtactgtagaacatgttaattttatataattccttccttgacttttaggctatgtttttcatgtatttaaattatattcgtgtgtataaaaacataaatcccatgtatttatatcatctcctatttcttatattatttgtatcgatttggatttacccacacacttatcctttgtttgttctttattctttcagcatctctaaggttttatctgggttcattttccttgtgtcagtctgctggatgcaaactttccatttttcttagtttcagagttatttcttatatccccttcagtcatgaaggatattcactgggtagagaattctagattggcattttctttccattagatatcattccactatgttctggcatccattgatgtggagaattcagctagcaggggctgtaacttctctgaaggtaatgtcattatttctcaggttattaaaaattatttcatcttttgttttctgtagtttgtgatgtgtcttaagagtgtgcgtatgtgtgtttgaaccttgccttaggttctttgttttttcaatcagtgtattgatattattcatggttttagaaaattctcagccattatttcttcaaatgttgcttctgcccctttatctctttcgtcagctttgtgaccaaattaaatattggtagaggtataccttgtggtattttctatgtcttctaccttcttttctgtattttgcatgtttttttttctccatgctttggtctttttgtttcttctgtcctctcttactggtctctttctcttcagtactgtttaatctgatgttaatctattcactaatttttaaatgttaattatatttttcagttttatgtttctatttcctttttaaaatctactgtattattttttggccgggcatggtggctcacacctgtaatcccagcactttgggaggctgaggcaggcagatcacctgaggtcaggagttcaagaccagcctggccaacatggtgaaatctcgtctctactaaaaatacaaaaaaattagctggacgtggtggcgagcacctgtaatcccagctacttgggaggctgagggcaggagaatcgcttgaacccgggaggtggagtgagccaatcagcctgggcaacaagagcaaaactccatctcaaaaaatagatagatagccagccagccagcctgggtaacaagagcaaaactctgtctcaaaaaacggatggatggatggatggatggatggatggatggatggatggatggataggtaggtaggtaggtagatagatagatagatagatagatagatagatagatagatgatagatagatagattgtattatttttggcttttattctcttgcaaaaaaaaaaaacaagctcagcttttatgttctagggcatagtaagcttcattgtttgataatctgtgctggataatctcagtatatgaagtccctgtgggtttgcttttattgtctgttatttttgctggttattggtcgagatctcttatcccttcatgtaccttattcatttttgtcttgtgctagaaattatgttgaaaattattggcctaagatgatgctttctttctccaaagaggaattttgttgttgttgttgttgttgttgagacagggtcttactctgttgcccagactgaaatgctgtggctcaatcacagctcactgcagcttctacctcctgggctcaagtgatcttcctgcctcagcctcctgagtagctgggatgacaggcacacaccaccacagccacttaattttttttatttttagtacagacatagtctcactgtgtttcccaggctggtcttgaactcctgggctcaaggaatcatcctgcctcctcagagtgctgagattacaggcatgagccactgtgcctggcccaaagaggatttttatttgctgcttctactgcgaaccttcaggcacctagctgtttaagactttcttactcaagatttaaggcttagattttcagtgccacctagatgtaaagccgggttgcaagtctgtgaaggggctgattgcttccagttcacccctagctctttagggcatcagctcagtgctggagagtagagtttatcagattctcttgaattctcactcattttcccttttgagcccaggaattagagaccagcctgggaaatatagtgagacctcatctctaaaaaagtttaaaaattagccaagcatgggggtatgcacctatagtcccagctactcaggagactgaggcgggaggatcacttgggcacaggagatggaggctacaatgagccaagatcatactactgtactccagcctaggcgacagagtgagactctgtctcaaaaaaaaaaaaaaagaaaaagaaaaagaaaagaaaaaagtactttttttttttacttatttagttgtcttcaatgggagacatcatctagtctaccattacaagaagcagaactctagcaatgtatttaaaactcttttaacgtagttttcatattactctccataaagatttaccaatttatattcacacatggtaaataaatgtatctatgtttacattttgataggtcaaaaggatgttttggtttaatttgcatttattttgtcattagtgtggtcaaatattttaaaagtaaatttacccatttcttttgcatctagtcactttcattagttgtttagttttccttagttgttttagttgtaagaattcttttttgtttgtttgtttttgttttttgtttttaatagagatgggctctcccttgcttgcctaggctggttctgaactcctgggctcaagcagtcctcccaccttggcctcccaaagtgcagggattacaggcatgagccaccacacctggcgaagaattctttatttgctaaagatatttacctttttcatgtatttgtaaatattttccccaaatctgcctgttttattttgcttgttgatttttttttaacatgcagaacattaaaattctgtcagaaaattacagataagcaatagggaaggctagaatgaactcttagctactagattagagttgaagacagcagtataatctcatattgaatttattatatgtacacacacgcacacatacacatatacatgtacagatatatacagaaatcataaattatatgtgcatacatgagttagtacacatacattcctagctctgtccacttagagagcctaaagcatacccacacctagatttttgtttctgaatgtcctcctctaatttaagcagccagggatcctcggaaaaatgattataaattctagggctggaaaagagaaaatataagataaacatgaagcatcttagagtgcctgaaggtaaggaagtattcaaaaagatgggggcatatcagagagacataggaaccaacctgaaagcatgtccagtggccaaaactggaacaatttgagcaaaaaataacacagtatagattacaatccaaagtataaaataaatacttatgagtgcatagtgatataaagaaataattagataaacaattgagagagaaaaaaagaagaattccaagtgttaggtatagataatttccctccacccttgagtgtaggttggacttagtaactcactttcaaagaacaaagtatggagagggaaatagtaattttacagtagagagaactaacagattatcttcaccaagtgatcacattagcattaccagtgatcattcctgcgtatatcatccgctccttgatatgatgtgatgagaagggcatttcacctctgatattcttcccaagaaacccataaccctgacctaggcaagagggagacatcagacaaacccaaattgaggaacattctataaaatacttggccagcatgctttaaaactatcaaggtcatgaaaaacaagtaaagactaagaaactgtcaccaaccagaggagactaaggaatcttgacgactaaatgcaacgtggaatcctaaatggcaagggaaaaagtatatagttgacaaactgatgaagtccaggtaaagtctggagtttagttaatagtaatgtaccagagttactcttagcttttacaagtgtactatagttacctaagatgataacactagaagaagttcatttagtggtatacaggaactctctgtacaatcattcctcagtatatatgcaggggattggttcctggaacctcacgtgtactaaaatccacgcatctcaagctctgcagtcagccctgtggaacccatatataggaagttagccttccatataggcaggtttcgcatttagcaaatactgtattttttatctgcatttggttgaaaacattctgcatataagtggacccatacagttcagaactgtgttgttaaaggatcaactgtactatctttgcaacttttacgtcaatctaaaattattctaaaataaaaagttttctttactctaaacaaacaaaaaagaaaccatgagtttacaccatttccagtttaaagtagcaattacagatttttatttacaagacagttattaaattataaggaattattataagtaattttggtattatagttatataacaaaaaagagttcttaccttttggagataagtactgaaatatttatgcataatgctcttgtttttgtttttttgaaacagggtctcactctgttgccccagctggaatgcagtagcccaatctcggctcactgcaacctccacctcccaggttcaagccatcctcctgcctcagccccccaggtagctgggactacaggtgcgcgtcaccatgcccggctaatttctgtattttttatagagacagcgtttcaccattttggccaggctggtctcaaactcctgagctcaagtgatccacctgcctctgcctcccaaagtgctaggattacaggcgtgagccagtgcgcctagccatttatgcataatgttttattgatgtccgggatttgcctcaaaatcaagcagtgggtaggcagtgggtactatgttggaatacaggtgaaacaagattggccaatgtgttgttaattgttagagcagtgtaatgaatgtatgaaactctgtattttctacttttgaaattttccataatataaagtttttttaagtgagaaagaaattacatagtttttaactttttaagttttatatttgtatatcttatctctgaaaatctgggttccttgccacattaatatacttatttgcttcatcctactagtttaaatatgcaataaaaataagactattgaatgcagattaggatttctttgcacttcttttcatccgaagggtatatcccacaggaatgcacaatcaaaaccctgggttttaaagaaattttaaataactcttctcattgtggttttgccacaagcttgatatagatagatttaagtttgtttgtttgtttcagtttgtttttttatttacatagtttttattacaattttagattcacatacagctataagaaatatagatccttgtagactttgcccaattcttcccaaaattaacattctgcaaaactactgtgtcacagccaggatattgacattgatacaatccactgatcttattcagatatctgcatcagtttgtttttaatttttaaaattgtcttttttttctccttgctttaattttggttttagattatgaaaaacatgtatatgattacacaaagtcaaacctgtgaatagggttcattcagaaaggtctagtttgcatccctgtccccattcactttcttgccctaaagaaaacaatttttaaaaattagttattttatttttccattatttttatttgaaaatatgagaagatatgtatatgattttgtgccaccccccttcttacacacttccatatattctcatctaaaccttgatttttaaaaaattttaatatgaaaacactggggatcactccatggcagtaagtagacatcttcttcattcctgtttatgcctgctgaatactccattatggcaaagaattgtttattaaaccattcccctaatgatggactttgggattattttcagccttcttttactacatgaataaccttgtgcatacgttatttcatactgttgctaatgtcaaattccttcctcaaatgttgtgtcattttgcatcgccaccagcactgtctgagggttgtaggcttcaattttaaattgtgatttaaaggactaatctctgtcatataaattagtatatgtcttacttcattaaaaaactgtactcatatgtataaggctagacaaagagagtcatagataaattctgatttattttatggccctcatttatatctgtggacttgaccagaatgcttttaactagagtgggtttcttatcattgtaaggtcactaggtctaagaaaatttgtaatactcagaaatagagagaaggtcatttgtccctctgccatttgtttactttagatagtaggcagagtcattgaatcttattaggaaatataaaaaacatacttgctctttttgccagactcgaaaaagtactaaagctattcatatttcttatacacaccattgagagctcaagaggttcacaggaaataaaggcaagattttgatgggacttttaagacaaggcaaggatttggggtttatcttgaagatgtggatgccatcctaaggcatgtgatcagatcaccatttttaaaggttgtttttttttggctacagtatggctatagtataggaaggaacacatttggatatggggagaattgggaggccattgccattgttcagtatggatattgatggctaggatagatcagtgtcagcagagagcaacagaagtgaattaggaattagaaaggatagggtttgatgattagataaaggaagtaaaggaggaagaggagtcaaagctgacttgccgtctctggcttgggcacctgatatatgatggtgccactgactaacttgggcaaccctggaagcagatgatgcagtatactttggacatgctgagtttgaagtctctgtaagatatctgaatgaaaggactaaataggaagttagatatgtggattaggagcacagagagagatcttgggtagatacagagatttgggaatggttgctacttagatgatttagaagagtatatagagggagaagaaaaaaggacttgaggactgaggttcttccaaattttggaggttgtagaaaaggaggaatagctagcaaatgagatagagaaggaatagctgaagagatagaaaatcacgacagcaaggagttgcagaagccagaaaaaaaaaagtgtatcaggaacaatattataggaaaatgaagggtttgggtaattcttagttccatcctttactagattcctgtattcttcaactattgtcgagtgttcatgctctgcacagctcccattcggcctcatttctgagatgtgctgccttttggtatctattggtatctctttgctgccatttggtattcctatctgatatctcatttccttagtgagggacatagtgagtgaaagaacattagaggacaaatggaaaggcctatactgttgtcctagctctgtcaccaactttatttagtaattttgtttctttatgcctattatctgtgagatatagctagaatttcaggacagagatggctacacatggaaacaattacaatgagaagtaaggagagagaggaagagaaagagccgtcatagaggaggtgatactgagaattgaaggatgaccaggagtttgccaagtggtaatggcaaggatgaaactagaaagaagtagtaaatatattataaagatacagaaatatcataaagctttctttttgagacagggtcccactctgtctcccaggctggagtgcagtagcacaatcatggctcactgcagcctcgaccacctgggcccaagctgtcctcacacctcagcctccaagtagctgggactacaggtgcacgctaccacacgcggataatttttgtatttttttgtagagacagggtttcaccatgttgcctgggttggtctcaatttcctgggctcaagcgatccacccacctccgcctcccaaagtgctgggattacagacatgagtcactgcacctggcaaaataataaaatttaaagaaagaaaatagaatgaagccaggcctcataggaactaggaaaaaagatctcaggaatccaagttactgttctcttcattccttagggttttgtgtctactttgctctggaagaaccagctttctccagttactcaagcgcttgcacatgaccccaaaacgggcaccccagtttccaaaatttgtatgaccttgaagcccaagtaatttctttctgcttttcttacttcacattccagatagaaaaaaaataaacatgaatgagtgaatgtatctatctgattatctcagtttcccccccttttttctagaactgagtatcctaagttgttgacctgacccccctatagataaccttcttttgaatcagggatctgtttcatccagtggcaaacagaagcccactgctgtttccatgattgggctggggctttagatgggagagtttaatagaatatagatggcaaatcgactatatgagtgggaaaagagagaggcattacaggcaggcaaagagcatgtggaatgaatggccagaaatatgagccagcttgtgtggttgggacactgctaatagtggtgggctatgactttggaacaaggtgcaagatgagagaatggagattagcttggatgtgtacaaataaaaccatcggtaagtatgaaagagaagctgagagtcatagaggccagttgagaatatccaacacacataaacaggaattctagaagtagaacatagagggaatgatgaagaaaagagaccttattcaaaaagataatagcccagaactttcccaaattgaagaaacattgtaacctcagatagatgtaaggtttggagaagaaaattgctaattttcttggattatttgagtttatggtggttgtaggatacccacctgtaggtgtctactccaaactgcctgagtctggcccccaggagaagaacctaggctagcaataagagtttaggaggcattaccattagcacagggtccatttcacttcttggcacctcagtttctaccctagcaacttttgagaatgaaatgaagtgtaaaagtactctgataatcacaacactacatagttttaccattgtcttcattgtcattgtcataaattctattgagtatagagcctcagtattagaggagaagagctaaggaacctggagccagatttcctatattcaaatcctggctctgctactttgtaaccatgtgaccttggacaagttatataacatttgtcttaagcctcaatttcctcatctgtgaaatagtacctgtctcctagtgtttttatgaggattaaataagttactacttgtaaagcactttaaatggcacttggcatgtagataaatgcccagtaaatctttgctattagctattaaagtacctgcatttcacaggaaccttcagtatcttatttcagaggagtgactaatgtaaaaatcatagtctatgaggataataaatttaggtatctgtgtcttcctgtaatactcaaaggatcagtttagttaactgctggcttttgtctatgtaaagagttttgtggttgtttgcaaattgctcatgatgttatttgaacattcaaggacttctatttttttcttggtaatgtctgaaacttggaaataattcatgggcatatgggatattctcctgaggacacaataatggttccatttttcttgctaagttggaacaatttaatcttgagcaaatacctatgcttgtgcttctgtttttgtttatatctgtatacatctatagttttacaaataccaatattgacattttcattttagccagaaacttgcctaaaagtaagattacacgagctagtttgatttcagagtgcaaatggcagtaaaatgaaagcagaaaataaaaaattaaccatatgattattttgtaatccccagtgtgtttgttcaaggtgagatcattttccagattcatccttcacctgtaccaccttcctgatctgcaaggccatatcagggctggcatggttatttacagttatttagatgttctgtgaggcagataaacagaagacaggacacaagtagaactgtcaaaaaaaaaccccaaaatccatgaattccacaagcgactagaaggaacttgttgtggttttcatatctacatcgtttgaaagggcactccctctcctagagatcaggagctgtactgttagtgatggcaggggctgcactgatacacctgcctctgaatgaagagaaggttttgaggagcaagaaggagaacttatttctagagagaagaatggaaataagggctagagagacttagaaacaatcgcagatacacatccataccagagttacaagaacttacacaggatagcaagcaaactgatgcaatggttatgactgatttggtttggggtggcagaggatccatcccagcttctacctgcaaaagtaagtaggactaggtcaaaggtctaagaaacttaaaaaaaagtgtgtttaaactagctgaactaatacatccagtagataaagaattgcacataaggtatttgtataataattttttttgaattaatgaagttaaaaaatttggggagagagggctgggtagaagagagagaaactcgagaacttgggcctttaaaccctgcaagcataactggggccatttaactaaccaacgtcctagttgaacagagctcattttgagtacagaaacaatagtagcttggaaacttagttctacctaaccccatgaaaccctgtctgtctcctggtcagttgggaaagaacttgtgaggatttcagtaattaaaaaaataatccccttgaagaattagaatgtcactgttctctcgataacccccgtaagtccaagttaaggcaatagcagcctcctccttcaaaaaggtgaacaggaagcatggagttatacagcgggctgagaatcaagagactgaggttctagtcctatctgctattaattagttactaacctaaagcaagtctcttaaacttccagttctaagattctgtgatgtaactcatcgtgatttatatctggaggtccctccccctcactttagtgttagagattagggaggtgggtgtttagctgtgaggattagtgagtacactgaggactaacagtgaagttcctacatggtagaagctagaacagaataggggctattgctcttatctgccttgctttttttctggaaattattagaaagccatacagatatgtatgttaacgtaaacaacaaatccagaggtcgtcttagaattatttgctatcccttgtagctggagcttccttatccactaggaggcaccattgtcaaacaacattgattaggggtcaagagctcttgatcatttaagcaattggagaggaaaaatgtctagaaagaagaaaaaagaggtaaatataggaccctggaaattgtgaaaaatcaatctttgttatctagatggacattagaacagttctcagtttctaaaattcgataaacagtatttcagactacatatcaattttagaagtggcaaaatctttcaaggcagtctttttttcgaagaaacaaataagatatgaaaaaagaccttagaaattactgagccaaatcccatctttattgaggagtcatgatcaacccagaaaggttaagtgtcatgaccaagatctgccaggcttgagcctaaaaccgatgtgtagggggggcatttctcattgattttggccatcccaacacctgaactctcttcaagtatttggagaatccctcattttaagagccttgataggggaaaaaatcccatattctactataaaagctaaaaatggcagatatttgcactactaaacatttagacccacagaactaccacaggacacacttggcatcagattcacttagaaggatacaggacagggggaaagaaaaaacagctttttagtcaggcagcaccaggcattcctctgcagtacgagtcctttcagtagtatatacaataaagttcagtaaatataacagggaaaagaaagatttttaaatagtgttgagaaaacaagttaacagttcagaaatcaatttagattcacccttccccacacacatgcacatacaacaaaaatactacaaacaaaatagagttgatagaagctaatcaaatcataggaaagctagcaaaagataaaattatttaacagatctttagagagcttttaaaacttcaaagaactgggatccacaaagaaaaaaggtatcaatagatttaacaaaaattgaaaaaactagaaaattaatttgcttcaatcttgacataaaaggtttacattctatcgaacataaagagttcaccccaacgaaagggaagatattaagcttcatacacaaacaggcaaggacaggaatagacagcttccaccaaaagaactacaattggtaaagaggcatttgaggatatgctcagtcattttaatgtctttgacagtatatcagaattgctttattaaacagtgaatattccctttctccattgaaaaggtgaaggtttctatctacttgcatatcttaattaacaatcctgaataagcaccattcatattgaaaaaatatgattatatcctatttacagtatcagtgcaagaggaggccttagctccatttatagcacctcagacattcccaaccccaaacccacctactatgttgacacatttcctggtgctccaggccttattgttctttgtcggaacaaatgccttgaaatgctgctgtcctcttaactaccatgtagtcaccaccactcccccatgctctcacccttgcttcttgaggacctgtctcagaggctgactactccatgaagactttctttttttttcctttttttttttttttttgagatgaagtctcgctcttgtcacccaggctggagtgcaatggcatgatcttggctcattgcaacctctgcctcccaggttcaagcaattctactgcctcagcctcccgaatagctgggattacagatgcctgccaccacacctggctaacttttgtatttttagtagagacggggtttcaccacgttggccaggctggtctcgaactcctgacctcaggctatccgcccgcctgggcctcccaaagtgctgggattacaggtgtgagccactgcgcccagcccatgaagactttcttaatctctccttctgtaatgtaggctcttagaagatgggatcttcatgtaactggtccttctatcctctacaaatagtagatgtttaatgattgaatactgaatgaaacataatccccccacaaatacggagtagtttagatggggaaagggtgaaaaagattatgcgtacatgactcctttctttcagaaatgaattcgccaccaacaaatatttgtatatattcatcaatatgtgggatagtatgctgaagacaaaatacctgtttatgctctctatttgtctatagacaattgtacagaccagaaggcacctacccatgaaataaataatagtaactgccaggtgcagtggctcacgcctgtaatcccaacacttcgggaggttgaggtgggaggatcacttgagaccagcctgggcaatataacaagattccatctctacaaaaaaatttaaaacttagccagacatggtagcactacttgtgaggctgaggcaggagaatcacttgagcctgggacttcaaggttacagtgagctatgattgtaccactgcacttcagcctgggtgacagagcaagactgccattcattgacttataaataaatacatacgtacacacaaacaaacaacttgtagtgtaggtctaaatgaccgtagagaggtacagattgttagggcctcataagttcattggaagaaacagttaggagctagaataggcagacaggcttataggaagttgataaagggcatcagcaccagtgtaggagtcagatgggtggaaaggtgaagaaaggacatcccaggcaggagcataaagaatgcaaaagtgttgggaaaagatggtagttatgggacatttgtgaagacatcaaaacagtaccacaaacaaagccctgaattagaaaaaaaacagaattaaagatttttttaaaaaagactgatttgtgtatgcaaggattacagcatttatcaacaaacttactaaatatagacaattcatttaaattatatcaataatatagtattcatatgtatcatctggaaagatggggacataggctctgtattttaaaaatccccctatatggttctggaacatggggcccccataataggcatgaaaatggatttcacatatggagcctttctttacattatgattttacctacttagttgtaatctcttgtcttccattaagtaactgaaagcctggagcagaagtgaggaagtttccctctttgtaacctgagcattttgtggaggataatgcatggactgtaagtcagcttgcctgagttagaatccaggctctaccccttacaagctgtgtgatctcttggtcaagttacttaacttttgctgtttctcagttttctcgtaagtaaaataggggaggtagtcataatacctatgtcgtagacttctcgtgtaaacattgaatgagttaatgcatataagggacttagaaaatacctttcacgtagtaagcactcaataaatgctagctttaattatttattacagcaaaataaggttacttctgtctttgaactgtatataaaataaaccaagcagtttaggtttggctacatctgcttcactcagtattttgtcttcaggattcagccatattcctttgtgtagctgtaattaatttcctttcattgctatatagtattctatacccattttatctattctactattgatggacattgggttgttcacagtttgtgaccattgtgaacaatgctgctataaacattcaggtacacatatcctggtccacataagcacacatttctttgaagagactgtgtttgcccagtatcctcctttgtcataaatcaagcctctatgtatgtatggttatgtttctaggctctctgttatgttctactgtgctgttgtctgtcctagtgtcaatatcatacacttaattactgagctttgtaggacattccatacatagtacctgtggacatggaggtgggggctaaattttgaaatcaagtacagcaaaaactccaagaggtgttattcttccagaatatcttgagtcttcttggccttctgcaattccatatacattttagattctgctttagagtttccacaaaacctgttgggattttcattcaaattctgttgaatctatgcttcaacttggaagacatcggctgtttacaatattgagtcttcttgtcagtgaacaggataattttctctccatttatttcatttgtttaatttctcttaaaaaaatcatacttttctccacagagatcttatatacctttcttttagatttatttctacattcttaaagaaacactcttttaaaatttcatataacttacaatgattttgctgaactctgcttagttctaattttaacttagattattttggatattctatatataccatctgtaattagtgactgtttcttccttttctattctcatacattttatttctttatcttgccttactgccctggctaggacctccagaataatattgagtttaaattgttagagtggactttcttggcttgttcctgatctaagagttttttaagttttttaatcacaaatacatagttttaagtgttttgacatttattgacctgaccacataatctttcatctttaatctatcagtgtacacaattatattaattccaaatgttaaaagttttgcattcctcgggtaaactcaatttggacctggtgtaattcttatatattgcctgtttggggttgttaaacttttgtttaggttacttgcatctatgttctttagtgaggttgtcttttaattgtctcatactgtccacagtaggttttagtatatggattaaactattttcataaagtgagttggaaactattcctgctttttattcttttatttctccttagaatgttcaatagaacttgtcagaaatgggctgggtgcagtggctaacacctgtaatcccagcactttgggaggccgaggcaggcagatcacgaggtcaagaaatcaagaccatcctggccaacatggtgaaaccccatctctactaaaaatacaaaaattagctgggtgtggtggtgcactcctgtagtcccagctattcaggaggctgaggcaggagaatctcttgaacgcgggaggtggaggttgcagtgagccgagatggcaccactgcactcctgcctggtgacagagcgagactccatctcaaaaaaaaaaaaaaaaaaacttgtcagaaatggcatctaggcctagagttttctgtctcagaagattaaattactgattcagtttcttgaatcagtaaaggattattcaagttttctaattctttttgttaattttggtgagttttatttttctgagaatttgtcggtttcatatacatttttaaatttgtgacataaagtttcagtatcatcttttatttctgcagcatatgaaatgatatctccttcattgttaatactgggtgctatatgtgtcttttctcttttctttttgttatcagtcttgccagagattcatcatttcacagggaacaacttttagctttgttaatttcttgaatatgtttgtcttccatttcattaatttctgcttctatttcctttcatctaatttctttgaatttaatttgatgatctttatgtaacttatacaggtagatgtttagttcttaaatgtttagcccttctctttttttgagtcagggtctcactgtgttgtccaggctggagtgtagtggtgcagtcatggctcactgcagccttgaccttccaggctcaagcaatttggccgtctcagcctcctgagtagctgagacaacaggcccctccatgcccagctaatatttttattattattatttgaagagatgggggtctcactatattgcccaggctggtctcgaactcctgggctcaagtgatcctcccacctcagcctcccagagtgctgggattacaggtgtgaggcactgcacttggccagcctttcttttctaatatgtacatttatagcagtaaatttccctctaagtactgctttacctacattttacaagttttgatgtgtttactgttattattattcagtttaaaatattttctaatgatttattctgagatacatgtaataaaagtatattgtctagtttccaaatgttaggaattttctagatttattaattgctttaaaatttatttatttacttttttagagatgaggtcttgctccatagcccaggttggagtgcagtggtgccattatagctcactgcagcctcaaactcctggattcaatcaagccttccacctctgcctctggagtatctgggactacaggcatgtgctgccatgcccagctaatttttaaatttttagtagagaaggagtctcactgtgttgcccaggctgatatcgaactcctggcctcaaatgatcctctcaccttggcctcccaaagtgctgggattataggcatgagccattgcacctggcctttattaatcatttcagagaatctatttgttgctttgctttttctctattttgtctctttacttcattaatttctgcttattatttccttctaccttcattgggtttaatttgctgttttttaaaacatgtctcatgatgagatgtcactgacttggtaacttttcatattttctaatattttaagtcagcattcacaatatttctattaaatttctaattaaagttttaaaacaagtttatggatacaaactactttgtaagtaccatttcatctgcattctgctttttttttttaacagaactgatttcctatgacaaaagtatagtgcctattcatttttttaaaagtaaaggtaaaaagaagaaaacaaaaaatttcaaatagaattctacccagtctttaacaccccattttaatagcaaaggcttcacactgcatctacttatacataaatatgcatatatatgtttatacatgttaatgtattatgaacatctatgtcaataaatatatgtctataacatcatttaatggcaatataatattctactctagttaccacaatttatgtaaccattctgttgggaatttaggttgcttctaatttctccctattataaatagctgtgataaacccttgtcattaaaacttgaccagtattcctaattatttcccttggaaggaaataattgagccgaaggacatatacatgtttaaggtttttgtcacacattataaaattgcccttcagaaagttgtattggtgtattgttctatcaatagtagattacctactttaagcaaggtttctccagtgccaagttgtgtatgtaacatggatcaccagcttcttaacctgtaagattggacctatgcccctcctcctttcagccatttttctatatttgtgggtctattaatggcaaaaccctgatcttgaaatgtaacgtaccaatcctgtacaagttttgatagtactcttttcattatcattgttaggaatatgttctgctgggcatggtggctcatgcctgtaatcccagcattttgggaggccgaggcagaggggatcacttgaggccaggaactcaagaccagtctggccaacacagaaaaaccctatctctactaaaaatacagaaattagctggacgtgaggtgtgcgcctgtaatcccagctactcgggaggctgacgcagaagaataacttgaccctgggaggtggatgctgcagtgagccaagatcatgccattgcactccagcctgggcaacagagcaagaccctgtcttggaaaaaaaaaaaaagttctaattttcattatgatgatttcttatttgattaattggctatttagcatgatttctcaatttccaagcatttagggttttctagttattttgttaatttatttctaacataactactttgtggttaggaaacatactctgagtactcgtttcttgcagaagtttttagactgagcttttatctccatagtaagcattgaggtttttggggtgttttttttttgtgtttttttttttggtgggtggggatggggtcttgctctgttgcccaggctggagtgcactgacagagtcatggctcactgcaacctcaatctcctgggctcaagcgatcctcccacctcagcctcttgagtagctgggaccacaggtgtgtaccaccacacccagctaatttttttttattttttgtagagacagcatctcactcttttgcccaggctggtcttgaacttttgtgctcaagcaatctgcctgcctcagcctcccaaagtgctgggattacaggcctgagccaccaccatgcccaaccagcattgaggtttttctgtgctaccaacatgacataccagaatttattctgtaccccatttttcatagtgcagctctatggtcccagccaggagcaaagggtgtttcatcagagccttaacctcttagatcaccctggtgcaaaagcaactggaccctgtcattctccatctgaccaccccaccccctcctacctctctagagttcctaaaagtacccctcctttccaaaacccacattcttcccctagggcagaagcagctcttgttcacctctttgagttgtaatcctttctctgttctcaggactagtttttcactcactatactgttaattctcacaagctttaacaaaaactttttgtttgactgggcacaatggctcatacctgtaatcccagcactttaagatgagaggcccaagcaaaaggatcgtttgagcccgggaattccagaccagcctgggcaacatagccagatcctgtccctacaaaaattaaaaataaaaaaattagccaggtgtggtggtgcatgcctgtagtcacagctacttcagaggctgaggcgggaggatcacctgagcccaggcattccaggctgcagtgagccatgattgtgcccctgcagtccagctctaggtgacaaaacgagaccctgtctccatttaaaaaataaataaataattttaaacatttcatacagtttttgtagttggcgtttttgtcatcctcagaaaaaatgctggttggaaaaatccagatttgctctgtacaacagtgttcttcaaggatatttgcagataagtaccaatctgtcaccagtctgccatgagatacatacagaaattgacagtaaacatttagaaactgttacagcaatttgacattgctgtgaaatcatagcacgtgattttgtgccttcaactccagataatcctgttgccaaagcagcatattttggagtggcatattctgatctccctcaatgtgcagccagtaataccttgtgcctcaagacctgtgatctgttttgtttatttgatgagtttggttttggataatttcttaattatataaataatgcatgtttattataaattttaaaaattcagatggatgaaaaggagagacagctaagctcattcataatcccattacttttcacaattcagactaaactgcccttaatttctctctgcatacagtatagaagtccacctcccccatactcttccataggagggtttcttctccctctcctttcattccctcagaatggagccaactaggaaaattcacaatgtgttctttgggggttcttgacagccccagaagcaccccaagatgggaagccaaagagaagagcaataaaagatgccttgtcagtttgtagaatcattatattatcaaataaagtttatcaaagaattgagtcatcaactttgttcaaaaggttcaaggttaggatatcaggatggtatgtattatgaatatgtgtattttaaatttcgttgaataaaatttgcataaataacagtatttttagtttttatttctatatctcatgaaatttaaaattagtagattgcttcttttactttaatatcaattaatattataaataatcaaatagctttaataatagaaaaatattttcacagtgatgcctctctttcagagtaacccttcaaagaatgtgcctgtatatttactaagttgcacaggtggttttgtttgatatctgtggttatgaagcattgaattaaaaaaaaacatataatggctgaaagatcccatttacaatagcaactaaaatataacatgtacagggaaaaagcctaataataaatactttaaaccaatataaagaaaatcgtaaaactataacttagagacatgaaaggaagtggagagacatatcatgttcattgatgagaatattagaaaatgttaatttctagaagttaacctatacatttaccatctgaatcaaaatacaaagattttttatagtttgacaaaatgattttaaaagtcaactgggaagaaaaaaatcataagaaaatgttggtgaaggccagttgtggtggcttgtgcctgtaatcccagcactttgggaggccgaggtgagcagatcacttgaggtcaggagttcgagaccagcctggccaagacggtgaaatcctgtctctacaaaaaaatacaaaaattagctgggcatggtggcaagcacgtgtagtcccagctacttgagaggctgaggcaggagactcacttgaacctgggaagcagaggttgcagtgagctgagatggcgccactgcactccagcctgggtgacagagcaagactctgtctaaaaaaaaaaaaaaaaaaaaaaaaaaaattggtgaagaataatgagatttttttttgccaaatattaaaagctgctactacagtattttattttgtctgtccatgtttttgtttttgttttgagatggagtctcgctctgtcaactggagtgcagtggtgcaatctcagctcactgcaacctctgcttcccgggttcaggtgattctcctgcctcagccttcagagtagctaggactacaggcgcaggccaccatgcctggctaatttttttgtatttttttagtagagacagggtttcaccatgttggccaggctggtcgcgaactcctggcctcaagctatccgcccgcctcggcctcccaaagcgctgagattacaggtgtgagccactgtgtccggccctacagtattttaaatggtaacttgatgcaagaataggcaagtcagtggaagaaagtagaaacctaaaaatacccccatgtgtgtatgcacatgtgtagagattgtcatttcaagtaccagtatttcagatatgaccagacaaaatggattgatccttgctgataattatagcacagggcagtaaataatttccaagtatttctcacggactggttccctccttagtctttatacttctcaccactttgctgcctcctccccaggctccgtcttttccctcatcccttctgggtccctccagaaagtcctctagctctcagaacatctcccaaattctttttggaaacaccagagtccattgaggcattttatttgtaagtatatattacatccctagaaaaagaattccaggattttccctcctatatgttttcatcttgcttcttcatggtccataatgccagctgaggtcgttagtacagtgaatccaaactggtgggataggaacaggttattctgccattttactagatctttgggttgcacatcaaatctgggatctggggctgatcactccacacttgtttaacctacctcaggttcacaacaattttcccagctctatgatcatcagtgatttcaaattcaccaatgtaaccatgcttcatcatcacagttagaaactggacagtaactttggagcacaacctaataagaacctggtgtttgcctctttttggtattgttgatgctctggatagcatcagccaggacattcatgcacaccattatggcagcatggagagatggcagaaagagcctaaattcttattgcttcattatgcaatcagtttagctctctccttttcctaacccctctctcatctaagttgaatcgtgcttaccctcatatatcacaattacaaaggaaaacgcctaagcaaaactgattccttcgctatgagatgttttttagtcctcatagatcaactaaccagcttaaactacagccagtttttaaaatagcgtttcttttctccccacaggacaaagaaatgaaaaatatttactctctgtagtaatcaaggaaatgcaaattaaagcaatcatgaatgacttttttcctcttatctaattggcaaagatggaaaaaaaataatcattatcctagtagagcaagggacacattcacacatggtagtgggagtataaattgttaaactgtttctggtcttgtgtatgtatcaaaagtgttattgtaggccgggcgcagtggctcatgcctgtaatcccagcactttgggaggccaaggcgggcggatcacgaggtcaggagatcgagactatcctggctaacacggtgaaaccccgtctctactaaaacaaatacaaaaaattagccgggcgtggtggcgggcgcctgtagtgccagctacttgggaggctggggcaggagaatggcatgaacccaggaggcggagctcgcagtgagccgagatgcaccactgcactccagcctgggcgacagagcaagactccgtctcaaaaaaaaaatgctattgtatataccccttgtcctagcaactcagcttgtaggaattttaccatacagataatcagagttgctcaccaagatgcatgatcacgttcatccaggctttatttctgatggtggaaaatgagtgctgccatactagggagtagactagaccattataataatgtttatagtagactaggcaactataaacattattttggagaagaatcctatttgacattggaaaatgttccttaggtgtgaaatggaaacttggtaaagtttttagagcctgtataaatgtgaaagtattttcattcatttatataaaaccacaccgagaatcaaataatagaatcaactgttcattaggtgtctacagtgtgtcttctgctgagtattaggtaggggtacattgaaagtataaatatattttttcttgttctttaggactttacactatcatggaactgttgtagggcttaaagatgtgcatttgttccttgcacacccagtaggtatagctataatcaatgggaagagcacaggacatagctagacagagatttcgatcttgtccctatcacatacttgtccactcacttagacaaattatttgaaaatgatgctgacctcatggggtggttataagtatgaagggaggcataacaaggactgcttcctatgatgcctcatgaataggaagtatgttagttcctttactttcccttccagaagtttctatttcctcagtataatatctgcagcaggtatattgggaaactgaactactgaatgaatgaatgaatgaatgagatactggatttaaaaatatgttataagccttaaagcattatgaaaatgttagctgttaatatttgcatagtttcattaatatgtataatatggcaaaattcatgtatacatatataggtgtatgtggggggagggggaggtgtttgtatgtgctaaatgttatggaccatatagagttgttatagaatgaaaagcaaaggaaggcattaatatggctggtaatcattgagggggcttccagggaaggtaggattggaatgaaaccttgaattaaggtaggttttgaaaatgaaaagcaatatatacaaaagtaaaaaagaaaatggtgtactcagggagtgataataagaccattctgcctagagaggaagattttcttgaaacatcagtggacaaggtaggtagaagaggcaaggtgtggccaagacaacaagaggccttacttatctagtaagaaatagaaaactactgtaagttctaagacaatatcgtgacattgcgttaccaacacatctatgtgttacaatatgtttgtagcgatgaactttgggaatggcagtgtaaacaaaaataaattttattttatatatgtcattgttttttccttccacagtatatagcctgaattttccatttagtggtaataacaatagcaagattgttttttaaatccttgtattctacataactgaatatttttggaatttgacttaaaaatatgcacacaaccctagcattgctgttttctgatgcttctttttgtgaaaacctaaagaaaaattatagtcaattttatatactcaatgttatttgatattactgttagcctactcttcctgtttctttccctgcagattttcaatgtgaagatgactgtcatgccctttataatttatgtctatatttcattgaaagaaaggagatttaaataacataacccttagcagtaaatcaactaataacttagttacaatgtattcactttcagtgttgtcttcctggaatttcctcttttcttatgttctttttcacatttttttacagtatggatggagcagatctgtgttttgaaatcgtaaagcgagctgacgctggttttgtgtacagtgaagctgtagccaggtatgtattgtatatctaatcaccagaggtcaagttgaaaataaaaaaagaaaatgacaaagacatcacatgacaaactgataaagagcatgctgctgctctttgctacagggaacatctctgttttagtatgtgttagtagaaccgatagtcactggaaatgcaaaataccgaacaatgagtttatctattaacatgggtttataggggccaggcacggtggctcacgcctgtaatcccagcactgtgggaggccaaggtagacagatcacaaggtcaggagatcgagatcatcctggccaacatggtgaaactccttctctactaaaaatacaaaaattagctgggcgtggtggcatgcacctgtagtcccagctactcggaaggctgacgcaggagaatcgtttgaacccaggaggtggaggttgcagtgagccgagattgcgctattgcactccagcttgggcaacaagagcgaaactcagtctcaaaataaataaataaataaaatgaaaacgtgggtttataatacaggcttacattttcagtactgctgtctttcccatttctgatgatttttgtacaggaagcggggatctaatagctcaggaaccatgtagaattctacttgggtttttttatttttgttttggcaaatctgcctcattagttcttcattttgccttttagtgatatcaaattatctcacaataattaaggaaaagtaaagaacagtaaaaggaagagaaataaaagcaccatttttaaaaatatatttgcttcaggccagtgtgagacctaccaatcaaatggcagctgttgttctaagtggagaagttgtttgtaaagacctaatgactcaaaataagaaggaaatatgggccgggcgcggtggctcatgcctgtaatcccagcactttgggaggccgaggcgggtagatcacgaggtcaggagatggagaccatcctggctaacacagtgaaaccccgtctctactaaaaatacaaaaattagccgggcgtggtggcgggagcctgtagtcccagctactcgggaggctgaggcaggagaatggcatgaacccgggaggcggagcttgcattgagcagagatcgtgccattgcactccagcctgggcgacagagcgagactccgtctcaaaaaaaaaaaaaaaagaagtaaatatgaaaaatcacaggagccatgcacgtgctgggccacttgcttatacatttagagcaacacagctttctgttttggttacattcaatcataattacccactcctgtaggttgcctttttaatacatggaatacagcatccctccttagtcaccagccatagtatgttgaagggttcaaactcacaaacatattaagtttttttttttttgcggggggtgcgggcggcgggggacggagtctcactgtgtcatccaggctggagtgcagtggcactatctcagctttctgcaacctctgcctcccaggttcaagtgattctcctgcctcagcctcccaagtagctgggattacaggatgcgccaccatgcccggctaatttttgtatttcttttaatagagatggggtttcaccatgttggccaggctgatcttgaactcctgacctcaagtgatccgcacgcctcaacctcccaaagtgcttggattgtaggcatgaactacctactgttcctagcctaggatttatgaaaactttttatcatttgaaaaacagttatattaaatgatttcctctgtcttaccatttcttttacaattatagcatcttagacaaacatagctggaaacaacttggagaccaccttaatacagctttgagctcagcatgacttgaatgtcttcaaattcattgccctgactccttctggctgaagagcaagggacctagtctcagggatggagcagccatggctatggcacaaaataaagaatatgctcaatgtgtggtcgctgtgtttttgtactgctggggctagggcgaaggagcaaatgaaagtttatgtgtgttctttaggcttctgatctatacgcggtagaactaaagctaaatattctcttttcttttgtgcaatgttctctaaagcacattccagggtttttttaaatcccatcttctattattttgagtttttattacaattttaaatttttattctttcttgtccctcaaaattttaaagcattctttcataccaaaaatagtcaatactagtgaaactcaatggaagaaggggatttttcccttcttgaaccacaataacacggggatacctggcaggtatgctgacaggattgatgtgaaaccagtaccacttttactctggtccccagtcatctttattgcttttccttaacttcaagcctatctctgccactgggctacatgtcaggataagcaggatggtagtgtgaagagatgatgtcatacaatgacatgacttgtggtctctcctaatcttgagatttatagaaaaggtagatgtttatacacatcaaaatgaaagcctattgatttttaaagccacctgtataagctgttaaaatggtgaaaggaactttccagagtggaccagaaaagagtagcattgggaccagtagatgacattgcaaagagagaggtttggaggcagtttattaaaggttcttcctctgaacaataaaaaaaagtaggcggggactcagaaagtattattatgtgtgtttgctattgcagaggatcaatgaccatgcaacaagggcgcgtagattcttccattggtttaatgacagatgacttctaatctttcttcgtcctctctgattctgtgatttattgttaggaaattcagcttgtatcagtattctagtgagaccgactgcaagaagactctgagacaccaagtaatcaaattgataatgttgtttttctccaactggctgagcttcaagaggagcagcaaagcatggcataaaataaaactgtgttcagtccttagtgcaacccaattagttattacctccatcctttcaggggtgatgagttgtggagtgagctaacacacaagatcagattatcaaatcaaactctcagagatcttcttaactagtaccaagctttactaaataatctcaaggatacaggcagtcagaaggctcaagtgaagcagagaagggaagggcagccccccacgtcacttcttactgcctcagaaatgcacctctggcccagaatagatgaggtttatactggggtttgtgggtttccacacacaaaggggagcattgcaaatatcttcattttacaccccagagatttggatagctccattgacattctccaggaagccatctgtgcctcagagatcccgtgttctacttaccatagtaatccttagccagagatatcctattaagggcatttcagagataaggtctcttctgcctagcaaatagcattaggcttttcacctgcattgacaagaatagcagactgaatcacctctcttctaccatgctgcacccctgaaatgcctccttccaaaggcagtaaatgcattgctggccagctttttccttccatggagttattatcttgctgatccttaggaaagataaagataaacaaatatattgctgagtttctctgaaagcacaggtctctatgatgcttcatgaagtgaagttttttgattaaaagtttagtcagcaacttcctagaacatgtgggcagattttagttcttgttttattctgcttgcacactttgacatgcattgcctcgcaggatcatgactgggagggtggagaaagatagttcagttctgttataacttgggaagaaaaacagttccactgtctccacacacgccgcaaagattctgctgtgtacatacgtttgggtcaagtaattgagtgttctcatatgcaaatgaaaaaagcctcattcattgagtttggttttgtgttatgagactttgagataggaattttctttaggttaaagataatttaggtggctgtctcagtgctttgtatccaaaatagttcattctgtgggtacaagctatgtccactttaactaatttaaatttacccagtatttccatgttgacatctagatggacaaataagctgttcctaaatctttgattgaacttaacaataataatattgtactaataatgtcttaacctttgtagcatggtttagagtttacaaagcactttgacaggtgtagtctcttagccatttcaaggggttacagatcttccaaagcctgatttgaaccagtaatgggccacaacaccaagttaacccctcatttgaacaaaacttatggccaggcgtggtggctcatgcctgtaatcccagcactttgggaggctgaggcaggctgatcacttgaggtcaggagtttgagaccatcctggccaacatggtgaaaccctgtctctactcaaaatacaaaaactagccaggcgtggtggcgcatatctgtaatcccagctacttgggaggctgaggcgggaaaatcgcttgaacccaggaggcagaggttgcagtgagccgagatcccaccattgcactccagcctgggagacaagagggaaactccatctcaaaaaataaaaataaaaaataaacaaaacttaattacaggctacaatggcccaagcaaagagtatatgagcacaaccccttatatgtgcatttgcaaagtaagataaattaaaacatcagagctaatgattacatgagcctagctctctggcttaaagccccgttgtaaggagcctgtgattagtacaggaacaaggcttgtgattagtacaggaacaaggcttgggtttgtttttgtttttgttttttctcctacctttcatttttaaaatggaacctttccaattaattgtaatacatgaaataatgcatatgctaactagagaaatattcctgtgagcttgattaaatggtatcatgccaaagagggaacttgatggaaatgtcttttaattgtaaagccaggatagggattttttttttttttttagtcctgagtcacatacacatgttcaaggtcacttgtatcagaaatataagatctggaaacaaaacaaaattctataaatattatacagtgaacagtgttaagtctattgcatttctgtcatgctggttgggaaggaaaagggaaaaaatgagaaaagaaggggaataggaagaaaagagacaaatatggagggaataaaatacagaaaatgaaacagatactcagagaaagagtaatagggcaattatagaagaactttagaaataggagaaggaggttctaaagtggtactgaatcaactgctcttgtcacacatggttgctagttaaccccattaccattttttaattcctgttctttaaaatgctgatttcttctttgttcttcacctgtgctccatgagggctcctcagctggccatgtaaggagtcaggctttctaggacatgtgcctagaattaactccactttgttcaagggagccccaactaaaacttgattatgttacaaaaagaaattgtccgataagggtggctcttccctcatttgtcctcacagctaaatagaagtaagatgaagagcatcttattatttgctggcagatcaaaggctcccactgcttgagtctgaatccttggggcagccctgagcactgtttacataacgcagtccagtttaagtagaattacctgagtattggggaaaaaaattgtcatgttttaagcttgaatttttagtttgcaaagcaaatttacttatgaactatgtgtaattcttttgacttagatagcttagaaaatatagagcatactatttcttcatgaagcccataaacttttgagtctgccaacattttcattattaagcctcactttacaccaatcctgtctgctcaaatcaaatgtgtccatggacagctaatatgagagtgggagttataaactaggagcactgtatattaagttttaaaataaaaattgtttacagtttttagatttcttttgttttttacagccattatatgagacagatactggaagctctacgctactgccatgataataacataattcacagggatgtgaaggtaagtcatttgttatcactaactttaatgtttgtgaagaaatactgatataacaatgataatcaagaattcttctttaatattgtcataaagaacatcttaattttacttctaagtaaaaatgtatttaactgctttgtatttgggaagtcattgtactaattcttactaggaacactataatttcaatttatttatttttactgaagtgttcatgcaatctaaaattgtattatttctcttttgccattgtgtgtgagagagaaatgaaaaatccaataaataggaaaaaccaaacaatatcctatactgagttaattgggggggaaattagaatttggtttatatagtaaaagttaatcataacatattttcataatattgcaatgcagaatagtcagcattgtatttttttgcagatagtttttaaatatagtatgaaatcataattatacatgtaatacgattttatgcttggaataccggtattatcattattcagtctttctgcctatttcatcccagtatcgggttaatgagaactctcagttcctggttctttaacggtgtcaagccaaacatagagggaggcaagaaatgagaccagtaggccttcctcctgatccctagcttctcccaaggcccagaatcactagggagcccctgaggtccctttgaccctgggctacacttttaagctctgatattttgtcactggcctttctctaacctccagcatgcacatacatagtgttccttccctcaagatatattattaaaggcctggcttcttcgatgtatttaatactttaaatgattaagaaaattaagtagagtttaattaaagtgtctataatgtttgggaaattttcacagaaatccttgtagttaaaagctgagggaaaacatgagcaattccaaaaccatctagtaaaatattttaatagcaaatgaaaatcactggagaaatatacaaaatacacattagtgtaaattagttgtaaaatatctcactcatccttttcagatgtgttaagaaaatgatattgttattatcagaactcaacaccgagcatctcaatgggtccccctttatgaaaaagtattctggccaagcccggtggctcatgcctataatcccagcactttgggaggccaaggcgggtggatcacctgaggtcaggagttcaagaccagcctggccaacatggtgaaaccccatctctactaaaaatacaaaaattagctgggcatggtggcacatgcctgtagtcccagctacttgggaggctgaggcaggagaatcgcttgaacccaggaggcacaggttgcagtgagccgagattgtgccactgcactccagcctgggcgacagagcgagactccgtctcaaaaaagtattcttcagttatccaaaaagaaataaaagtgtggaaaggtaaaaggcgggaaattgtcaactgtagtagtttgctgtgcagttattttgcattaattaatgtaagaaagttcatatgtagagagtaaaatatatctctttgtatatattctaaactatatacaagaaaaaaatgataatttaaaaacctaaaatgtgttcatgtaatagcattatgttaagaactgttttgctcaagaggcaattttattttgaatgaattattctcgaaagataattatatcaacatcatataataaacaatgattgacaatatattctactgtaatactttcaataatgtagtcagcttttgattaactggtatttgatatgacaacctaaacctaattaatatccaaaagtagataatttgacctcaccttttaatttaccttctgatttatttatttaacaaatatttgagtgcctactttatacagattactgtgcttggagccctaaaagtattatggtctcagtagggagataaggctcggtatctcttatctactgtagcagatcaacacatgccaaaacatagtgacttcaatcaataactgctgcttacttgctcacaattctgcagtttgggcagagcttgataggactgctcaattctgtttcacaggatgttggtgacgtagcgtggctagtttccacataggcttcactcatttttctgacatctcaactgaagtgactagaacagctgggagctggctgggcgctctttgcggtctctcattcaaaacgtctctctctctccacgtggccctatctccagcaagacagtgtcttagggctccaaaagagcaaaaatggaaggtgctaggcctcctgaagcaaactgacactgtgtcacatcttatgcatttcattagttgaaacatacttcacaaaaaggtcacaaggctagtctgagttcaaggggaagaaacatagattcatattttgattgatggagtgccagatatatacaaggatgggagaacttgttcgtggccacctttagaaagacaaataattattgtgcaaggtagaaggtgataagtatcattaaaagatgaggtcagagaagtttcctgggggaggtcacattggagcttgttcttgaatcatggggtagttatatggagacaaaaagacatttcaggcagaaggaacagtttgtgcaaaggcccaaaagtagtcttacgttggagtatgttagattagtttattatttctaaagtacatgctaaatagtttagaggaagcacgtagaaacatgccaaggaatgaaaaagaagtaattctcaaactgcaaataagtaagaagaaaccaccccaaaaattgccattgttcagttgggagacacactcaacacagagcacacgttaatgttgatattctttttttgtttgttttttgtttgtttgtttgttttgttttgtttgttttttgatacagggtctcgccctgtcacccaggctggagtgcagtggcgcaatctcggctcactgcaacctctgcctcctgggctcaagcaatcctcatgcctcagcctccagagtagctgggactataggcgtgcgccaccacacctggctaaattttttttgtagttttttgtagagacgaggtttcaccctgttgcccaggctgctcttgaactcctgggcttaagcaatcttcttacctcagcctcccaaagtgctgggattacaggcgtgagccaccgcgcccggtgttgatattctttatatttcagaagccgaaatccacacatttttacatgggtgaatagaatactcacatttagttaattgaaaatttttaatgttggtgtatttttcttaagacattcatccaaaagatatttattgagtgcctactgtgtggcaggcactgtcctaggaaccggagctacgtcagtgaagaaaacagacaaaaatcactgccctcatggagctgacattctagttcagggaggcaatactcagtaaacaaatgaactacatagtaggctagaatgtgaaaagtatcacagaaaaaactagagtggtcagaaggttagggagtgtccagagaagggcttgcttttgtaaatatggtggtcaaagtaggccacattgagatgatgatatctgagcaaggacttggaagagaggaagcgggctaatctgacagctgagggaagagcacttcagttaaaaggaacagccagtgcaaagaccgaaagacaggaacacaagtagcctgctcgaggaacagcaaggaggccggtgtggctgaggcaaaatgtgcaaagaggagagtaaaaaggagacaggagatgatcctgcctggctcagaccagagtagtagcagtggaggtagtaaaaaaaaaaaaaaaattagttagattcctgatatattttggagattatgccaataggatttcctaatatatctttggtaacgtaggcaaaacttagttttattcaagaccctgttacaggggtattccaacatagtggtcattgtaaaacttcaagaacaatacatttcacatgctaataatgtaaattttcacttggtttgatttgttaatatttttgccaataaagcaacctatgagcttttctttccattcagatatatattcagtgacttatctgtatgtagatttggtttgtatgtagatttttgtttctgcagttaaagtttttgtctaagttttctttccttatatttaataacgaaaacagaagagcattgcaatattttatttctctaagaaaaatttattttatcatctgtttcatctagccaagaatattctcattctctctctctctctcataattcttggcatatgatccaaaagcattacatttcccaaggatcctgttattatatttattaatacttttttctttacttttttacaaaaggtatttccttttgtaatcattgtaactgagtcttaaaaggattatttggttagatttgaatatatggtaccatgtaatctatttttgggaactgcttgctctgaagaagcagtttcacataaaactgcataaaaagcaatcatataatcctttgaaattcgagagatgtgtgaacatagtgctgggcctccccacagccacacttagtgacatatcaggctatattctttgctgtgggaggctgtcctgggaattgtaggatgctgctaagcatccttcacccactagatgccagtagcatctccccctagttgtgacaaccaaaaatgtctccaaacattgctaaatgtcccctggggcacaaaaattgtccctggttaaggcccactgtcataatagactgttataattctcaagatttgcctccctacaggtattaattaaggcatgcatataaatttctatttttttctgtcatcttcttccctttaattctactttttcttgtgaaagaatgtgaaaactttcattatgtttctggtatttttttttcttcctctcacccctaaattaaaagtactttagaaagaaatagcacagttgtcaaggtaaatgcaactcctggctctttgccttctttcatgggctctactaagcactgagagtttgtggaattttctcctctctcctaactcttgcaggcagccttagatcatgaggttgtggggagacttagttttagacctttctgtcactctgacctactcatgtataattctaataactgaagttgaagtgaaacagtttctctgagaatgcaaattgctacccacaatcactttctattctgaatggtgcctgtgcccagaaggtctgggtgctgtttttagttcttagaactgtgcaaaccccagtcacacacacactcagccagaggccagagtgtttctgagtgtgcttcctttaaatggttttccttgctaacctgtgtgaacacgcctggctgctttttggttcccttctggtctcagttctccttttacctatttaaggccagactttatgataaatttgtgtttatcatataacactggttggcatgacattgtggatttcttaaagcattccgtagtctcttgttctccgttactgatgtttcttttacacctgataccacaactccccaaagtttatcatgttgtatagagaaatttaaattctcataaaacaaaaacgtatttattctttatttattttatttatttatttattttttttgagacagagtctcactctgtcgcccaggctggagtgcagtggcgccatctcagctcactgcaagctcaacctcccaggtccacgccattctcctgcctcagcctcccgagtagctgggactacaggtgcccgccaccatgcccggctaatttttttgtatttttagtagagacggggtttcactgtgttagccaggatggtttcgatctcctgacctcatgatctgcccgcctcagcctcccaaagtgctgggattacaggcgtgagccaccgtgcccagccactattctttattattatattaacattggttaatcttctgcatttcttttataagattttttaacataatgtgcacgttcagttttaatgtggcattttaataattgtacttaggaagatctcatggattacatgattattataaatttatcttgtgtttctaactgctatacttctctttgcccagcctactcctacaaaaaaagaaatcaactccttggttttaagtttctcagcctgagcaacatagtaagaccctatctctctctctccttttttttttttttttttgagatggaatctcgctctgttgcccaggttggagtgcagtggcacggtctcagctcactgcaacctccacctcccacgttcaagcaattctcctgcctcagcctcctgagtagctgagattacaggcgcctgccactacgctcagctaattttttttatatatatattttttagtagagacagggtttcaccatgttggccaggctgatctcgaactcctgaccttgtgagccaccacgcctggccagtaagaccctatctctatcaaaaaataaaaattagccaggtgtgttggcacacacctgtggtcctagctactggagaggctgaggcaggaggattgcttgagcccaggaggttgaagctgtaatgagctgtgattgtatcactgcactccagcgtgggcaacagagtgagactccatctcaaaaaaaaaaaaaattcttttgcttattagaagtgaatccttttactgttcctctccttctgagccaggagtagcgtgtgtgatatagccagaggtttttctgtcaggtgcaactatagctgtagtaactcttcccagtgttatcaattccatttgagtgtaggggccatcagaggaaggtttgtggcattaggctgctggattgaaatgcttatgcttagcagattaccagtgttccctctgttctccctttgtggtttgccggcaggatttcctttcaccttgtcttcccagatttgcccgtaactcccaccctgacagagcacaaggccagtgataggcctagagtcctcagcaaattgaacagaatgggccatcttcctcttctatccagggagtagaaacttacttccctgttaagttgtttatcctaaattttgtctagtcttaatggtttgtgttcctgattatagtttgaaagctgccttaatgagagtatgtgtatgcctgttttctacagtttaagataaaatcttgttggcctttgagtcaaaatttgagattcctgaaaccccaaatttgtgtttgactgtaactcacacagacacattaaaaacactgtttttttgaaatccaaactttaaaatagggtaagttttgaaggtgattttaaaaccaggcacagtggcttgcacctataatctcaaaactttgggaggctgaagcgggaggatcgcttgagcccaggagttcaagaccagcctgggcaacatagcaagagcacatctctacaaaaaaaaaaaaaaaaatacaaaaattagccaggcatgatggcacacacctgtagtcctagctactcaggaggctgaggtggtgagatcacctgagcccaagagtttgaagctgcagtgagctatgatcaccactgtactccagcctggacgacagagacagaccctgtctccaaaaacagaagtgatattttaagtaaaatatttactatgccattaaatagccagttcttcaattacataaaaaaattcaacatgatttaaaatcaactgtttaggaaagcatctatggtgtaaagatatccatgatgataatgagctgagtatatagttcattcttcagtataggaaattaaaatgtgagtttatcagaatgagtaacttaaagagaaattgcatatctcttttcctgcctttttaaatgtaagaatctctagaaatattttttgtttaaagtagtggtagagctgtaaagtgattgttttttaaataattatttttagaagttgtattttttgggttttttgtttttgtttttgagacagggtctcgctttgtcacccaggcaggaatgcagtggtgcaatcatggctcacttcagcctcaacctcctgggctcaacagatcctcccacctcagcctcccaagtagctaggactagagacatgtgccaccatgtccagctaatttttctattttttgtagagacgtggtctcactatgttgatcaggctggtctcaaactcctgggctcaagtgatccccccacttcagccccctgaagtgctgggattacaggcatgagccactgtacctgactggaagttgtatttttttaaaactcctaagtccagtgagattattacatgcagtatagcttatgttaaacaaacattactgtcttagtcggatgagttttggtctcaaaactcatgtaagaataaaactacttagtctgggcacaatggcttgcccctgtaatcccaacactttgggaggccaagatgggcagattatttgagctcaggaattcgagaccaacctgggtaacatggcgaaaccccgtctctacaaaaaaataacaaaaattagccgggcatgatggtgggcacctgtggtcccagctattcagaaggctgaggtaggagaatcacttgaccccgggggggtggaggttgcagtgagccagatcacgccactgcactccagcttgggtgacagagtgagaccccatctcataaaaagaataaaactacttttgtaactgtggagaaatctgtgcatctcaggaactctccctgatggactttgagttactctatgatttacatgtctagaaatcactagattggacacttccatttacagctagcattcagggcggtcacctcaagttcccaaatctcctttgtctctgcacattaatgagccaaaaatccaattactactataaacgaattgatactcactgtaaatatttgaagccagaatgtgttcagacttttctcagaacattttcatgtctcagttaagcatcaaagtagaaaaggaaaaaaaaatttactgggtttttgtgtgtgtgtgtgtgtggttttttgtttgtttgttttgcccccggaataacctctggtgatttttgaacacatggctcttgggcaatgtactgtgaattgcttttacagctctaactcaggaacaaaacatgctatgagattaaagccttggaaggattacgtgaacttactttaaacttcattttggacactgaagtaattactatgtgaagaaaaaaaggagtctttaagcagtctctaacaaagtggcaagttactattaatggttgattttattcagctgtttttgtttggttatctgagaagagaatatcagtaccatggaagtagaaatagacaagaagtttatagctccaaagtgcttatgatctctttgggcagatagtacacgcttttttttttaatcataatatatgtacttattacagaatatagtcaccatcatttgtctactgacaagattacatgaaagaaaagaaattaacattaagaaatgcttatctttaaatgttcacttaaatattagaaaaaattggggtgatttacttaactatgcacatatacatacatacatacatatatatatatatatatatatatatttttttttttttttttttttttttttttttttgagacagagtctcactctgtcgcccaggctggagtgcaatggcatgatcttggctcactgcaacctccgcctcctgagttcaagtgattctcctgcctcagcctcccgagttcaagtgattcttctgcctcagcctcccaagtagctgggactacaggcacacaccaccacgcccagctaatttttgtatttttagtagaggtgggtttcgccatgttggccaggctagtctcgaactcctgacctcaggtgatctgcccacctcggcctcccagagtgctgggattacaggcatgagccaccgcacccagcccacttcaatattttcatcagtaaattagtatactttagagttgtggtgattaaaataatatatgtaaagcatataagtagaatgcttggcaaacagcaagtgcttactaagcgttagctactcataatagtaacagctgatttaataataggatctgtaaataagatagtattttctgctctacaaatgaagaaattaacacgtacagaggataagttaatttgcctaagattgtccagctaaataaaaagtagagccagattgaacccaagaagtataacttcagagatcaatctcttaactgcaatactattacactcccttattattcattcatttatttcacaaaaaattaactgccaggtactgtttgtcactaataacattatttatattgaatacagaagaaaatatgcacaatgtgatgaagatgggcatataatgacatagctttttactttgacaaagcctaatccaaatatttaagcatttttataagtatcatctgctttaaaaatatagtcaatgaatattgcttctccccaataacatgagccagataatttcaaataaataatatgtttataaaaccttggatttttttcactgtattattcatgcatttaggtaagatgtgaatgaggatatttcttatttatttttttacttatttttatttttttgttttgttttatgagacagagtctcgctctgcctcccaggctgtagtgcagtggcacgatctccgctcactgcaacctccgtcccgggctcaagcgattctcctgcctcagcctcccgagtagctgggattacaggcgcccaccaccatgtccagctgatttttgtatttttagtagagacagggtttcaccatgttgcccaggctggtcttgaactcctgacctcaaaatgatccacccacctcagcctcccaaagtgctgggattacaggcgtaagccactgtgcccagctacttatttttaaagattttaaaattaccaataaacactagccatagattgacccttgtattctaactaccagaaagcagacaagtcataaaccatttgcttctttatcctagtcatgaaataacgtgttctgaacagaagcactgacagttgagtttaaacagaaaacagcctgttagtttcatatgagtgggatcctttcaatatgcttaatttttgcttctgaaagtttctgccatctcaacgttcagtataactgttttttgagttttatgaatatatgtttatttatttttaaaaaccaaagagattttcttggtgattattgtcaaccaagctgtgacatgttaatgatgtagtttagtgtccctaataaagtcacatgaatgcttttcttaatattgtggggttttccattcaaaagtcaaccatatgattgcatatgtgctgaattagactttgtaaagagattatatagtgtcttcttgaatgttttatctaataaaagaaatataatggggtctgtgctacttctggccgaagcaagacaggtgagaatgttttttgtttctattaaataattcaattgctgacagttatctctttggtgtagaacataaaaaatgggtttaaaaatactataaggaaggaagcaaactattagtagaatctggatgaccaaaagatgtcttttcacagaactgtaagtcaaatctttctccataatggacgtacaggttcttatttttctcagatggcttacaaaagagtagtatgatgttagtactactaaaaaggaaaatccaataaatgtggttccaatgagacctgcaatctgagagatcatggctcctagttccatctgccgattgtagcataggctctcttctccttctgtagcctctatgactgagtagtatacggtaactggaatgattatgcccagtacaactccccatatgtaaatgcatagttttctagcaaagttgggctggcgaaattttttcagtaaatggccataaaatattttctcatagcatgaagtagtctcttgcgaggaatccttttgcattaaggtagcatagcggcttatggcaatccaacttaaaattaagagactgacaaacatacttgcatgcatggatagagttcccagaaaattgaccactctgcattgagcagattgatattcccattggaaacctttcaggaaatagatactcatgaaaggcatggcactgcacacaagtaagtttgcagtcacaaggtgtgacaggtagatgtgcgttgatgtttttttacctatttttgttaaaaatatccattgagagagagtgtttccaaaaacaccaacaatacaaaggaggatgtaaatgattggtaaagccatggaagagatcatagatggttgaatacatgttgtattgttgttcatttatgtcaggttttcttgaattttgtcacaggagctagaatagaattgcagatatttaatattaaaattatttttggtacagtatttaagctgaatagtttttaaaaaagaaaaacattgaattaaataaaatagtaacaaaaatgtattggatggaacgggaaagtatagatggcttcttaccttttctaatcacgattgtccggttgaaataaagacaaaaagttacttattgtgatggataatgcctttgtctgaaaaacaaaatttgatgtgaatagttacatgcctgggatttataattttacttagagaaatgtatagttcttagattgtaaaacaatttgtaagtgatgattgatttttcctagaaatataatttaaaaaattttaaggcacatgtaaccaattcatgttggccaaagtattacagaagtattttgcggccacaataatagagagttgactggtttttaattaccacattacttatatatagttttcaaaatggtgtctttttgtggctaggctaaaacactcctttataacctaatactattagaagagtctcttttcatatttcagaagttaactcagttctacatgaacaaaaattcaggcaagatcctgaattgaacagaagtatagcaaccaaggacagactccaaaatcccagggtcattaccaaagaatatttaaaatgtcctttcaaatatttaatgttaaactgtcatacttcaataaaagtttacacatgtatgtcaaaactgtagttacagccagatgtggtggctctgcacctgtagtctcagcactttgggaggctaaggtgggaggaatgcttgagaccaggatttcaagaacaccctggacaacatagcgagaccctgtctctataaaaaatacaaaaactagaccgggtatgttggctcatgcctgttatcccagcactttgggaggccaaggccagcctgggcaacatggtgaaaccatgtctctacagaaaaattagccaggcatcctggcatgtgcctggagtcccagctacttgggaggctgaggtttgaggatcagttgagcctaggagttcaaggctgcagtgagctatgatcattctactgcactccaggctgggtaacagaaagagaccctgtctcaaaaacaaacaaaaaaaaactgtagctgctatgcttgttggttagagtgtccttgtgtgtaatttgctatctgagtttttcagaggattttttttaaaggatatgatgttttaatcacaacataaatgctggtttttacttttttctgtcttatatttaaatctttctcgcttcaaagggtacacatgaagtgctgaagaatcatatacaaactgcttttattcttatttttctccttatttcctcacttctttcaggtgagaataacaaaagttactggattctggtcaaataagaaccatgatctctattcagaatgtgccatattctctgtgttcttcaccatagccttctgagcaccacattctccactctttcatgatctagagcaaggtttctcaatcttctttttaatcatgttctcttttgataaacataaaaactgtaccatacacaaccctttgaaattcttatatccccccagcccctcagggcaattttactctctacccccttcagaattatggtttgatttattttctgcatcttggattacagaaattggggttttttttcaaatatgatattataattttataataactttttaaaccaatccacacccaaagtcttgaaaacttgaggactgtgcagtgtctgtgggtttaaataacaagattcttaattaatgtttaccactgtctttataattttatttctttgctatttttatttagaaaacagtccatatgcttcattgtaagtttgtatctgaatctagtgcaacctgatgaattataatctggtttcagttagtgtagaccctggtataaatatataaaacctaatctgtaacttcaccagttcaaaaatcagtcagacagtgaaatgagccagtttatttaagaaaaaattatctgctcacagtaggttttgattttacataaggattggagcttccttttatgatgctgttaaagaaaagcagtagctcctaccttgtgcagataatgcatagtatactaaaaactgcaaaggtaatggtgcttctgtatgaatattaaatgcttccaaacaaaagggacatagacttctgcagaggctagctttatcagacagaagttgagtctctgtaggactctcagtgtagcagtcaacaactaggtcaccatctttaccttcccaaacttgtatctactatgtacatctccttcaaaaataaacttggatcataaaactactagataactattttccagaatttggaaagtactattaagaaatcaaataaaaattacatgttacagatgcaaaactggtctccagaaaatgtctctaagtctatattcccctcaggagaatgtctatctcaagtcactcatgcatacattttgtctctgctaatttgacaaatgaaaaaagttctacaactcttaacttcagttactaatgactgtctacatagttaatatgctgactgcctttcttaatgatcagctttcaaaatttaaaccattaggtcctgtttatttttatagagtttaatttttaagctaaaaatgaataataatcactcttacctgtatgagtagtttatgccaactaaggttatattgttcagggcagtgatgccaaatttcagacttaaaattctctgatcttcactcttccaatatctttagtcagtgtgaatagattcttgcatgacaccaactacagtgggaggaaaaggggaaattaaacagaatattgaagaaattcaatagttatggtcaatgtggcaactgcctcctcaaaaaaccctcatttctctatttctgtagtgggaggaagtggtgaacaatatacatattatacttccttatgattatttcatgaactagttacactccagtaacctttgtttgcacgattgactgaagttaagttcacaggtttaatcccccatggccagttttatatgacacagtgatagaaggagccactctgtagtaacccaatacaaatattggtgcaaactcgtttgtaaaattgtttgtggatggcttatttgcaatccatctttatcaaaaatagaaacaaaactcaaagttttcttataacttactagaatcaaatattatagagctaaaatagaacttcatgatcatctgtggactgagaccctttgttttaaagttgaagaagctgaggcccagaggaactcactgtaagcacagactgcacccagggttgggtcccagtttggttactaatgagttaacccactctgtttctaattgccctgcactatctccatttgtcaacataatacactgtttggggcatttcataatggatttggcaaatcctgggaagtgccaagtatgcctcagatcaaatgaatagttataaagaattgtgaaaccatgactagtctaaaacaataaaaattttaaaaataaaaaatagaattgtgaaaccaatttttttgttcaggattgtcgaatcagtctgtgacctactaactaaatgaaagctaagtgtgtacatctggggaggaagacttgcatcaagcactccctctcatccttgagtagttaaaccagtgggagtctgaaaaagagaacagaaatctaatttcatcaaacctgagcattttagttatcagtaaatcttcacttaaaatttacagaagtaccttgccatttctcataaacccgcaatgcttaccttatttcatgtttatttcataaattctctatgatgtttgctaatatttctctccaaaacaaaagtgagaactgcctaaagtgtccagattgtgttctgctgctgttcatctttgccttgccaccatttacttaagaacagtgactcatccagggttacatggccgttcattacagagtagtttggcttttagaattcccatcacttttacttcagtaatgtatcatgttccaggaaggaattacatagaacaaaaaacagttttaattaatttagagaagaacagaaatggaatgctatttctaagtgattgaaagatagttgtaatattatctgttcaggcataagcgtctttggtccgaaaaaagaacgctcttgttttcctccattgtctccaaactcagtaaatgataccatcactccttcagttattcaagccaaaaacttacgaatcatccttaattcctctttctttcacatctcacatctaatcaattgctggtactacagcttctactatcactaccatcattcattagccacatttcatgagagcttactatgtgccagatatctcgctatgtgccttacatccaagtcttatttggttttcacaacaccctgtgaaatgtctcattttaaaggtgaggaaaactgaaactcagaaagatctcataagttgcccaaggtcacacagccatctgtcctcacaggatggtgattggctcacctcaaagcaactaattcaagaacaagtccatagctgcaatgcctttttgtgatctagcctctgaagtcaacagtgtcacttctgcagtattctattggtcacacagagccagccctgcatcagtgtgggacgggtaaatatcaggaggtgatgatcactgggagccatcttggaaactggctatcacagatgtcaatcaaccgttgaaacaaaggaagagtcagaagtactgcttaaaaaccgttgtcagtccactggttgtttattggacaagcatacctggataggtgtaagttttgccagttcttacactattttggtttttaggtctatttttgttaaacagtgtaattcattcaacaaatacttattggagtttctactatgttcctagcagcatgtggaggtcacagaagtaggatgtttagtcacaagctaattgagggtctctggaaattgagcagattccacaagcaagccaagaatttagattaatatgtgatacagatttcaaatgctctgtgaattagagaagggcagaaacagtgactcaaagtggttctgaaaggctttgtgaaagcaaatggaaggaaagagaggagaacataacctagtaagtgacagttttgtgccaggtatgggacagagcattttatgactaagaaccctagagatgtgtggtgggagtcccattttacacgggaggaaattgaggctcaaagaggttaaatagcttgcctagaggaatacaattagtaaattagctttaaaatgacctcattctctgccttagaaagaaattattggttgttctagcaggtcaataagggtaccttatggtactcacaatagggtcatgttttaagtatttttaactttgttcagatagggtttcctgttctgatttatgtatttgtgtatcctgttctagacttgaggtagcagaaactgaccatggaagaaatcaagtccagtttttttctgtctttgaaaactctggactttgttaagcaaactattattccaacaatggcagtataaattctttaggattcagtgattttgagttccccaattgaaatatatgtaaattttattttcattcttctaagaaattaggaaatattgttacaattggtaaaaagagtaaatgtcagggaatactagattaataaagtatgttacaagtattctgtaaaagtggcccctttggacttttctcattcaaatcaccaatagttttctttggttctcattcatcttgcccatccgtctcttcaaggttccccttctattgtccaagtccaaatgctcttggcctaacagttctagttgattcctgtatcatctgccaaatattgatctcctaagtgttctgctgtcacccttaggatttacttccttgaggtgttagagttatgtcctacaattgaagttctgtcttgtattaattttcctgcttttgagatggatttgtgtatcaagtgtgttttttaatctggccccaaaattcatctggagtggttcagtgagagtgtttcaaagggcaggcatatacttacctggcagaggagataccatcatcaaagggcaggcatgtggacatttattttggcaatccatggtgggctatacatagcaaggggacatgagagctttcctgactcacatggattgttggggttagaattagggtcccttatcaatttccctcagagccagaacccagaggacacaggacagcttagtcattcctgaagccatgtgcttcatctagaaattattttaggctatccaaactagtgtttaaactggctgcaactggcctcttaagtactctcactaaccaatcaggagctcagggcattgggaggctggtatgcagaaagagaagacatgactaatttagtacacattagaatatcatattcaaaagataattatttctttaaatcaggggcagtggtaagtaagccttgtccagttcaacatacacccaagccagtggttatctttaggaggagtgagacacagtgcagttactcaaagctatggtttgttcaaggctcactgagccccctgccctctccaggaagtggtgtctggccacagccttgtttccagtcacactgttctcaggccctcaccgcctgccacaagcagctctgatcgtgggtgtcccacccttaatcagagtgtgaagaaaaacctctccttgttctgaagagctggtttctcagcaagcaatgggagcgtttctctcaagaattacttttaaaaacagcagaaaatacagtctgaagtttgtaaatttataataacacagaaaagttatcagcttttgtaaaaagtaaagcagaggttcctcttcgaagactttcctccccatttaattaggaataaatagtaacttctcttagaagtgaaatttattcaaagacctgtgctaacattcttaaatatctgctagccgtgataaagaaatcaatgtactttatgttcttagctcccacaatttagcctaaatatttgccctggcatgcttatactggtgcaagcaagcattgggtcatagcctgttcctcttccttatttgcaggtttttacttttctcagcattccacaagttacttcctccttcttttgttctcctctgcctttgccttttttaagaagttctaagttgctagccaatcgggacagatacagaatgcgaggtcccgttccagccaatggaaaccggacacagcagtagggtggacacgtcagcttataaatgaccctgtctcctttgttcagtgtactcttgtggcaaaactgctggcgagtgtaccctttctgcaggaagtaaaaatggccttgctgagtaaattaaatttatgttcaagtggtatttctttatggtaccggggaacaagcatttcaaacgcttttaagaaaagactaatgacaaaacagaaatggacttggtgagttgaaaaacacatacacaaactcaaagggcattttcttattagtttgcatttccttgtgcatccagtgaaccaactccccaggagttggatccatctctaaattccgctagtaacttcaccttcagtaaccgattgcagcacagctgctgctccaaactgtgggtgaccacccaggaattaaaggttcctcatctcccaaccctttcatcctttgtcttaccaaaccacatgtttccatgaacctgaaccagggccattccagcaaaccccacttcattgacactgagaaagagtagagacaggcttggcttcagctcacctccactagagcactcccactgatcacaaaacccacaccactacctcaaatgctaatagttcttaaagaattccaggaattggccttatgagataactaagattgcctcaggaaggaatgctgaacaattgatttacagccttgttgccacaggccacgccaccaggtggcccattactcaagataaccatagcaaccagatctgctgacctgctttgctcagcccagcctgcatacccttcccctgttaccagttcctgcactttgcctaataagaaagccctatgactcttttcagaaggaagcccgggaattctctctctcttgtgctgcctcccttttgtttgggcataagctccagtgaagctttgtctatgaaagcgcttttggcctcatatcaatttctattgcattgagagtccaagaacccatgatcggtaacaatgccaattgagggtagaaaaaagaaaaaaaatcacacacaaacccaaagtgctttttctattctctcattcaacaagagtctaaacagatgacctctgtgaccaaatgtgtggggatttctcccaatgaacaagcaagcaagcaattcagtggacaccagctgtgtgtcctctaattcagttctattctgacactatctacctggagatagcgtcagatcccacaggttgaaggctgagtccccaagacttcttcctaccttcagatgccagtggcaagccccaggttgtttcacctgtgcttctgaccgacaggctataaatcaaagatcccacagcccctctttgggtccaattaatttgctagagcagctcacagaattcagggaaatacgtttaccgatttattataaagtatattacaaaggatacagttgaagagatgcatacagtgaggtgtgggagaagagagggacgtggagcttccatgccctcctgggcgtgtcaccctccaggaacctccacatgtacagctatccagaagctccttgaaccctgtcattttggggttttatggggacttccttacacagccatgattgattaaagcactggctactgttgattaccttaaccttcagcccctctcccctctctggagggttgggagtagggctaaatgttccaaccttgtcatcctgccttggtctttcctatgaccagccccatcctgaagctacctaggagctgccagaccgcagtcacctcattagcatacaaaaagacatcactttggagtttttgaggattttaggggttgtatgccagacaacagacgaaagaccaaatatatatttcatagtatccagtccaccctctgtcttggatccctcacatcaaaaggatgtacaactcaaaagataccgccaaattactagaatctcattcaatcagtaataatcagtccagcccatcatattgtatgaatgtctcccaaggcgaggccactcaggtttgcaggcttccattcagtcttgtcagagtgctctcggcaaacatatagcttcaccctttacagcagctggtataattaagctaggagacagatatcatttcttgctctaagcctctttcaaggtattaatataatactgggtttctttcatttcataacccatttattctttactctcactactatttttccttatctctataaactcccaaacttttccacctttggatgggacaatagaatcagccactgtgcttatctagattgcaggcaacaatgctagtctagcaagtgctgccccctcagtccactcccattcatgttagaaataaattttcggtgccacaaagaagaatcaaatcagcactcccgcaaaaagttttctcagcaaggcaaattaacttccatagaagcgtgcgtctcgcgggtggagcaatggcgagagcacacagaacaaaggaaagcaggggtttttattcctaatgcaatgagtttctactactgtgtcctgtctccattggatggagctggaccacacaatcgaaactggtcttggttggctaatttgaagtgtgcagggagggggttacactggcgggaagggcagttttgggggtaagagctgttatggcaggaggggtaatttgcagagtgagtgactaagggcaacgagcaagaaacagctgtggactatagactggcgggaaggttgtttacttcagtcaggggcaaggagacatgaagaacaaggaagttgagattgagaacaaagaacaagggagttaacatgccaaacttttgaagagaaactgattgtatctgacattcagatagagtaaggttccataggcacagcagaacgagtgggctgtttttaccaccagggagtatagctgcatttattgttagccccaattttgccagatgggataaggcacaagccaccccttaggagtccaccccacaatcagacccttaggaattctgactcaaagtttaaaaacatagttacagtttcttacttaggaattgcccctgcttccagcacttgtagttgcagccctggtcctaggaccaatgcatcaggtaggggaaatgtaaaaaaaaagttgaggtgatgtgggaaagaaaaataaagagtgatcattataccagtgtactcctcccttagcaagaaatgcatagtcataccagcatccttccacacctcctcttcccggatacctcagaaaagcggagaaatctattgagtggggaaattcccttagccccactcatgttgaatgtgagcacacacttgcgaaggcaaataaggcagctcttcgtgctttcatctccctctgttttagacaaccagtgttttcattgcctgttccactctctatcaaaccgttactctgaggaagatatctctctgcccattgctgaacattataggctatataatgtgttcctgggtctgaagaagtgacagccatccaaatctgtgcaatatcttctgctctagcttttatggcactctgagcaaactattattctgagaagaatatctctgcccactgctggaacattatgggctgtaccgtgtgttctttggcctgaagaaatggtgttcagctctccaaatatgtgcaatatcttctgttctggcttttttatggtattctcatcattcacatcttccaccgggcaagcaaagcccagtccagaatcagtgtctactcctgtcaaaacccatttgtggcctcccagggctaccagcatcagcctcacttgccagcttgttcagggctttcccaccagggaaatctgccccacagccatgggcaatgtctgtctcttttgctggcagacagaacagtttttattggcattttgtgcctaagatggtgcaaaagaaacatgtctaaatgcagcctatctctgcactgttgcagtacccgtttatccactcatttcacagacccaggtggccacttcaagggagcacccagggttgtctgcttgtgatatcaatcactttctgaaccaggatcttttttttttttttttcaagtcagagttttgctcttgtctcctgggctggagtgcaatggcgcaatctcggctcgctgcaacctccgcctcctgagttcaagtgattctcttgcctcagcctcccaagtagctgggattacaggtgcgcaccaccatgcccagctaattattttgtatttttagtagagacggggtttcgccatgtcggccagggtggtctcaaactcctgacctcaggtgatccacccaccttggcctcccaaagcgctgggattacaggcatgagccaccacgtccagccaagaaaggagctcttctgatgggcattgacatgttctactttaatgcactcctcaaatttccatagggccattctccatatgggcatccctttaataaataggccaggtttccactgcccttctgcctgaccatgtggccaggccactgagtcagtaaaaaaatcaaacacaggggtttttgctattgttcatttctgcagaatgcaattcagccaccaagctaatttggtcttaccttctttgatcaagagtggcatccttccaaacaagattgttcaccttggaactgtcatttacacaccaagcaactctttgttggtcagttgagagctgtttacggggccctgtccaagtctcagtagaatcccgcagttcctcacacagttccagagtcagtcctaggggaaaagaggctccctgcatgagagtatttcctctttgcacttcccagggaggatgctcctgtataaaccatttccattttattatggaagtgttctgggcactgccatccccatttgaatgtttctctgacatcatgtgagaaagcatgggtatttcaggtgtcaagatcattttatgtccttcagtcataggggttaacttcagttaatgtcccatagcaaggtagtaaatacccccaagtggaaattctctactgcaaagtcccagtagttgtcactgggagatgctcacagacttctgagtaagccccagtaaacgctgacaaaggggtagcaaatggagaatttgtccctatgatattccagcttctattctacagattgtgggcttgggtaatcttactggtttgccatttagcatgttcaattaatattgctacaagggtgttttacaatacaaggtaagagaaacattccccagtcagacacaatatccccataatacagtcaagtgaaagagatacaaccacttcatgtaaagtgtgttcaaatgtaccaacttaccttaattttctcaatgcttactttcctaactgtagcctctattacgactttaccaacaggttttgagtttacagtactaggtaggggaagtgttccccacccagacataatatccagttccatcaaacattcaggtaaaggagacataacttctttacataaagcctgtttataaacattctaaatctcgtattcctaccaacccttactttctgtcccagtcccagaatttctcttcttcactcccagaccattttaccattttctccttagaaaaaagctttgaatccccagcagagggttgagccaagggaccttagcccttttgtcaatctttgtcttgattaacctgcctcaacactgctccaagtaattgttggtcagctttctcattgtaatctcttcctctcattttttcaatttctcctaactgggataaatacaccaaacctgtttggatcctcttaccgttaggagaacagcagaatctccctaccaaccttctatagtgatgacctttgttttaaccccatcgatttccactttattcatcccattttttaatagccctctaaagactctaccctgcttagatgagtcccatgactctcctttctttttcctcttagtttcaccccatcaatgttttcttcattcaccttatttctcaataaccatttagactttccaccttcctgggatgagtcctgtgactctcccctctgcctttccccagtctcttgttaattacgctcatgttttcattggtgcccatacaaaagaggctcccttagccatagcatttactacagccagagtaatggatgtattcagtgagtgaatatctcagtcatcataaagccagtcccacatggtctacataggaagcaaatgagctgctgcttcagggtacaccacttggcatttataggtgaaattggacagtccccttctcagggtaaacaggtccagtccaccacgctggccattcccttggaaataacctcctgtgtgtctggaaatctacctttccatctgtgattgttcaataatgaactgcaggtcctacctcaaccaaacatgctcttccactcttgagcatttaaaaccaaagaaactgctctgacagttccttcacagtataccctccagtttcaatagtttatcagttttaccctttccccacattgactacccttcttgataaccacaggttgtgtaactgtccagtgggttcatcttgcccgctgtctagacagagctgatttatcaatacagggaaattgcaatagaaaaaaagtaattcacgcagaaccagccgtgcaggagagcggagttttattattactcacatcagtctcccagaagactcggggatcagagattttaaggataatttggtgggtagtgggctgtgaatcaggagtgctgattggttggctctggaatgaaatcatagggagtcaaagctgtcctctcatgctgattcagttcctgggtagggggccacagaactggttggcaggtccaggtggggccatccagttgttagaaatgcaaatacctgaaaagatatctcaaaaggccaatcttaggttcacgatagtgatgtaagttgcaaatcttatgacctccagaataatggctggtaacatttagaattccagcccctctcatccgtacttggtggctggtggcctttcattcgttttacaagaacagtttagcttttgggaagggctattatttaaactataaattaaattccttcccaaggctagtttggcctatgcccagtaatggacaaggacagtttagaggttagaagcaagatggagttggttaggtctgatatttttcactgtcataatttccttagttacagttttgcaaaggcagtttcaatcgtaaaggtacttcagtgtccttgcataatttttccttgggggtcagctttgaggctagtggcctgggctcagacagacaaagtctaacctagcattctcctttaatttcatttagctattagagataaacaccaaagaatttagtatttcactttttcatattagtctgcataccctcatgcaaccagtgaaccaactccccgggagttgcatccatctctgaattccaccagtaacttttacctttagtagctgattgcagcacagctgcagctcaaaacagtgggaaaccacatggccacccaggaatcaaagattcctcatctcccacctttttgacgcaggatttttcttggccactttgccaatcagggacctccatggccagcaacgcccccctacctggcctttgcttggccatgggcctgctgaggcgtcaggcccactcaccccacctgtgctatggcttgtacctgcgttcagcagttcccaagctcctgtccttatccacgaagaatgaggatacgctgacaatttgaagggtgaggatgggtagggaagaattttattgagcagcagaacagctttcagcagagaggggacacgggtggcccccccacccctgcagtcgggtggtttgtctctctcagtgtggctgggtccatggtattttatggattcagaatggggcatgtgtgctgattggtttgtgagtatgcagaaaaggttaaagcgaagacaccactcaaaggtgggcacaacagtgtagaaaaccaattagggaagggtaggtatatgtaaaataggtgaggggcggggatcaatcagaggaaagcacaccaaacaggaagacaggttctcaatccagtccatggatttacccgggacatgtaggtaggctttaaactgtcttcagcttgaaggtcaatttcactgaggactcgcccctatctgtctaggcattttgtctgcctcctgctgctgtcactttcattctttctcttcccaaaccacatgtttctgtgagccaagtccattctagcaaaccctacctcactgaaaccaattcatagtttggaaggaaaacaaaactcacaaagtacttttctactctttcaacaacaattaacacagatgatttctgtgaccaaatgtgtggggatttctccccaaccaacaagcaagcaagcaattctgcagttgacaccagctaggtgtcctctaattcagttatgttctgacactatgtacctagagatagcatcagattccacaggttgagggcttagtccccaagactggcccccacctttagatgccaatggctagccccaggctgtgtcacctatgcttctgactgactagctataaatcagggatcccacggctccctctttgggcccaattaatttgctagagcgcctcacagaactcagggaaccagttacatatacccgtttattataaaggatacagatgaaaagatgcataatcctggggcacggagctttcctgtcctctctggacagaggcaccaccatctgggaaactccacaagttcagctatccagaaactctccgaacactgtccttttgcggttttatggaggcttcattatgtaggcatgattggttaaacgattggccattggagattaatttaaccttcagcccctctcccctccttggaggttggggatggggcttaatgtcccaaccctctaatcctgcctagtctttcaaggctaccagcctcatcctgaaactacctaagggttccagccatcagtcaaccattagcatacaaaaagacatcattctggagtttctaaggattttagcagttgtatgcctggaaagagggttgaagaccaaatatatattttatagtatcacagacctgatcatcaaagtttcactatccttcagctttggcttttggcttttcatataagcttgagtgtgctggctaaacattgtcttttaggaatgcacagcatagaaactctagcgacttcagtggcagtcataagaactggaatcatttcaggggtggtagttgaaaagcagacaggaaattagcaggtttagaataggggagaaactttagcattgaattacgtgaggcaaaaatatatttgagggacaaattttgaattttgacatcttcaaatcagtcaaacttggttcatattatgcttcagaactaaccattcttttctgtagattctttaaaaagccaaaagtagataaagatttctatgaataaagcagttgaggatagaattccaaaaataatgctgttccattgtatcaccccaggtacaaaacacacacacacacacacacacacacacacacacacacacacacacacacaaaatctataccctgggaaacagtgacttggattgcagtgagatttagcgaatttaaaaggcatcatatatcagtgcccagaattctccacttcactgtctctttctagggccaaggtttcctggccattttattaccaatcacttcttttgaatttctagatacaattgtcttaaggtgaagtcccctgctccatgtaacttcctgtccttaatcaaggggaaaaaaagagatagatgtcaagggaagagaaagaagaattgaatatctcatgtcttccctcctatacccattagtgtctgtattcattttctcttaagcgccccaagcatgaaagtcacaggtttctctgagaaccacatttagaaaattaataataataagtgacagccactgatctgcttttatatatatattcatataattttagaaatatctctgagatagattctattattactgtcactttctagatgatggatgtgggtccacagaggataacttgcctacagtgataaaactgctctattataaggtctagatttgaacccagatagtctgactttagagcccacattctttactgttttatatggactctcataatatatgataatactcaatagaatctagtttattgctttaaataaggagaccagctatccccaatgaccaaaaatatatctcatttatgtacttgtttccaattttcaatctcgagatttattaactcctgccaactctccactgtaaaggtaccctgttttcattgtaattgataagtaatctgaaggtgatattttaagactctatgagtatactgtgtttccctttcacccactggattttgacattcttcgatgattctcttcttgcctaaatcagctgtttccttggtggtggcatcttggtaatcttttggtgaatggatatattagatttgaagtagtccttttaagacatcttttggtgagtggatgtattacatttgaagtagtccttttaagacatcactctaaacaagtcttgttgttttatattatttctcaaacagcactgtatgtggcatagtttctaatattttcatgttgcctcttcttccctttcctctatcaaaagccagcctaaaaatgtatggttttaataaacctacaaataaagtattgaacttggaagtataagttctctagagttccagaaatatctggagaaaaaaaaaactggaaagaagaaacctgcgttaaattttataataacactgaaaaaagtctttaagagggtcacttttttaatagtgccttggccagcagagggtaatatattaccagccctagttaaaccacttttgctgacgcataaactgcccacattgcactattttccagctagaaacataaagcaatagaaaagtttggggattttttgaagctctaatacaacaataaatttcttttagtagctgaaaaccactttacacatgatagaaaaaaagtaattgtatagacaatggatttctgtccttaagatgaaagcccggtgccactcatctgcccttaatagggtatgtcctttagggatagtttttgttttgttttgtactagtgattatcacaagagttacttttgtaaagtattcacaactacagttatcctagtggtagaaagaaagtcttacatttcagtatgtgaaagtttttattactgtatcttttagtttttctttaactttttttaatcatagaaattgatggacatagttttaaaagtcaaataacactgaaaagcttgtaataaaaacatgttatgtctattaataaatgtaatttaaagtattttcacctaatgaagacagtataggagaaatcacctctatcctcgactatagtcacttcctcctgtcagtgtaacaacttacgctacatatcccttccacttaagtggtaattttttttttttttttttttttgagatggagtctcgctctgtcgccaggctggactgcagtggcgcgatctcggctcactgcaacctccaactccctggttcaagagattatcctgccttagcctcccgagtagctgggattacaggcacgcgccaccacgcccagctaatttttgtatttttagtagagacaggatttcaccatattggccaggatggtctcgatctcctgacttcgtgatccaccaacctcagcctcccaaagtgaagagatagcttataataaccattccctctttattcagctctcttcatcagggggagcatgtacttgtttttatctcctagaacaagtggtttgttactaaatcttcagcagctccactactccctgcccttcattggtttggaaggtacattctgtctctctctctttctctctctcgctctctcatgcacacacacaaagctttcaagtaaaataactcaaggcattgtcttttttgttaaattactatatttattgtcatctttttagaaatcagtgctacacatattcttcatttatattttttatgcatcatttatctattgctgcatacttaactacccctagacttggtggcttaacacaagaaccatttattcactctcaattctgcaatttgttctagactcagctgggtagttctgtttgtctcacctggtggtcattcatgcagcttagtcatctgtcagctcagctgaggctagctggttcaacatggcctcactcacgtgtctggagcatcacctggaagagttgagcaggctgtgcccctctctccatgtgatctttcatcctgggcttctttacaatgtgatggtctcaggttccaagagggcaaaactggaagctgcaaggtctcttaaggccttattcaaatgtcatacaatgtctaccacattttattggtcaaagcaagtcttaatacctgcccagattcaactgggaaagtagactccacctctggatgagaagagtggccaggaattgggggcaatttttaatctaacacatttccttggatgtgctttcaactttaatgttctaactagacttgttatattttctccttgaaatgcagtgaattggctctttctttagggattactatagtatgtgtatctcagagttcgtagtttcctgggtaatattcctaaaagaaaaggaaattttgctttgtgagagatacccaccctgtcccactttggtcttggagctgtcatgttgttttggttgtttcttgtattaaaaggtatattcagtgtgccatgaatccagctgggtacagtggcacttgcctgtggtccctactacgtgggagactgaggcaggaaaatcgcttgagcccaggagtttgaggctacagtgaactatgatcgtgccactgcactccagcctaggtgacagagtgggactgtgtctctaaaaaaaagtatatgtgtatatgtatatataatatgccatgaatccatgatgtttcctttgtgctttttatcttctataaatcctctccctttaccttctctttccagaatattaatctaacttttcaataaaaccagaagaaaagtctgttgctcttgcttcccaatagctagtttgatcctgagagctggataagttcattgacatcttcaataccagagcttaaaaggatgtagaaagatgattagtctagcatggtggggtagctttccctcctaccatgcttattccctcctaccattattcaaggtttcattattttcaggatcataaatgtcaaactactgggccatgagacttgcattcacttacttagctgcatcctctccctacttgccacatctttttggaaccctgtaatcagtccccacaagagctgaccctgtgtgttcctgtgtttttcaagtttcactagccacaaaggggaactgaatatgaacatgcatgcaaacctcaccagttccctttgcagccagctgaaagttatttttcatgtagaggaaacagtgtttttcttttgagaacaaactgaatttccacacaaatatgaagtgtttcatcttctgacagttcagaggacccaagagaagagggcaccaaattgtgagaaaggccattaaaagagaaactaggaaaacaaagagacaaactgaattggggaagagagaggtgctgctgagtacaggaaaggaaaaaagcagaccacggggaggggtgccggggtgctagaaagtctcaataagtaatggcacacaggacaaggcaggaaatgtaggaaggaactgtctgcaaagggcctataatagctatgccagcagtattaatggaaggcattaagaacttttggtttagaaatttgctgttggacaaaatttcaaaatataccacatttacgtgattactgggcctgcctgagttcatgctatggagccaggtttagatgaaggtgccttgtcctcacttcagaatgcaatatggtgacctgtttggtgtctctgattagacggagaaaaaccaagaatcagatatgtattaacatctcttctaattttttttttttagaagatctctgtcacccaggcttgagtgcagtaacatgatcgtagttcactgtagcctcaaactcctgggctcaagtgatcctcccacctcagtctcctgagtagctgggactacaggcacatgccaccatgcccagttaattttttaatattttgtagagactgcttcgctatgttgcccaggctggtctggaactcctgagctcaagcaatcctcccacctcagcctcccagaatgctgggattacaggcatgagccactgtgcctggcccaacatttcttctaatggcatcctgccaggtgccctcacactctcctccttacttgctcaagtttcagagtatggttctgattagcataaaatacaatggatctgttacctctcctgtcctggacattgctattattagtgaaagctgaggctgaataaaataactctttctgagttacttcccccacctcccttgatccagatcaacttccactatgtatcttcctagttctgatgtttaccctcagcttctagccattccattttatgtattttctctgcctttcccttggcatttgggtatttagataccatatattgcatgtttctacttggccaggtacatttatttactcattgagtcctcctaacaaccctatgagttaggtactactataattcctgttttcttagtagaggaaatagagcttacccaatgttacattgtaagtgatggcagcagaaataactcaggcagtctgactgcatcattcacccttttaaccagtcttttatgctgcctctcagtttgttatttaataatgcttaatattattgggataagaaaacctattggattcagccttaccataattcttgccatggccttaatgatgggaccataataatccgtatacattggccaagatcaatcccctggactgtgttggatgggcaataccaacatttttctagcactttttttcttctaattttccctcatctcctagtgaacagccaattctttctgtagatatgctaatgcatttaatcaggtcatctcctggtctaagagactttctgtctctgaagttgttttacatatttgtactcaggtatttggattttgtagttgaactcttagaaaacatttctattttcatgttctcaaggaacacctgatttcgactcctctatactatttataactgaaataccaagctatctaattataagataatttcatctgcaagttctttagcttggtccttgaggaatgcataagtgccagtgtttatttcaatttattgattagaaaaatttttagctttgcttctagtgtctgacaaaagaaaccataagcaaagtaaaagacaagtgcatagtgttagaagttatttgcaaactatataaataacaaaggatttagaacccagaatatataaagaactacttcaacaattttttaaaaagaaaaaggaaaaaaaaagataagcaactcattaggggaaaagggagggggaggggtatagatatgaataggccattcacccaagaagaaaactgaatgagcaaaaagtatatgaaatgatgcttcatttcactagtaatcagggaagtgcaaattaaaaccacaatgagataccatttcatacctaccagattggcaaaaattagtaaatctgataaaaccaagtgttggtaaggttgtgggtaaacaggaactcatttctgccttgtagtgagatgggcatataaattggtaaaatcactttggaaagcaatttgtcaaaactgagataagctgaaaatgtacatacccttacaaccaagcatttctgcttttaggtgttagccataaacttcacacatgggcattgggtatacaaaagaattcacttgagcatggtttcaattagtggaaaaagtggaaaccaccaaattgcccattgttaggggaaatggagaaatgaaccattgtttattcatgcagtaaaacactacatcagtgaaaatgaatgaacaagacctacatgagtctacatagataaacaaaatttgagtgaaaagagttacaaagaatgtaatagtaagataccatttgtgtaaatttttaaaagaaaaagtgcatattgttatgcatatgtatgttgtaaaagcacaaaaatatacgtcagagtgatatacaccaacttcaggaaagaggtttcctcagggaaggatgtgaagtgagctttaatatatctaacattttggatgatgtatacgggtatgaaaaaacttttaagtaaaacgaaaatgttaacatcttttcaattggggtgatgggtacttagctgcctgttatgttgtgtttttccatttttgtatgtttgaaacgttttataactaaaaactatttatatgtgaaattaccaaaaaagaatataagtgtaacagttaactgttgctcccaaaaaacttgcatgacttattaaagcaaaaagagattccatgtatcatcaacacctgtatccaaaccataattagaaggcctttccatcttctgatggttctttatgcatttcatgggccagaagcaaaactaataagggtaggatgctctaatttgattccattttttttcttctattcaacctgtatgagtttgttctggattatcgtacatgtttcagagagagcttccagagtatataaatgtgtgatggttagaagactagttttaaagattgttttttgtttttgtttttgtttttgttttgagacagagtctcactctttcatcaggctggagtgcagtggtgcaatctcagctcactgcaacctccacctgccaggttcaagcgattctcctgcctcagcctcccgagtagctgggactacaggtgcgtgccaccacacccagctaatttttgtatttttagtagagacggggtttcaccatgttggccaggatggtgtcgatctcttgacctcgtgatctgcccgccttggcctcccaaagtgctggaattacaggcgtgagccaccacgcctggcaaagattttgtttctttggcatcacacaattatgatgagtggtaagcagaaatttttgcccccaatacatattaatggcaatttatgtttttttattttattgtaatttatttatttatttatgtttttgagacgaagttttgctcttgttgcccaggctggagtacaatgacacaatctcagctcaccacaacctccgcctcccgggttcaagcgattctcctgcctcagcctcccgagtagctgggattacaggcatgcgccaccacgcctggctaattttgtatttttagtagagacggggtttctccatgttggtcaggctcgtcttgaactcctgacctcaggtgatccacccaccttggcctcccaaagtgctgggattacaggcgtgagccaccgtgcccggcaaagattttgttttttttgacatcatacaattttgatgagtggtaagcagaaatttttacccccaatacatattaatggcaatttatgttttttaaaataaaagacatctcagcaatcaccattgtgcttggacagaactaaacaaaagtgaaaagcattagcagagacaatgtcagtagaatggaagtctaccaacttgcatccctacatatgtaaaatacagttgctgcttacatcacaatgccatgaagattaactgatgataatgcatgggaagcacctagaacagtgaagggcacataaataaacaaatgttactttgcttcccattcccttgcatgtgaacttgaagtggggaaataaaaggaaaaatagaagtttcgaacaaacttactacctcctttccagttctgtgctcactgttaccatccccaaccagctctccaagtcttcatctgaaaacatggactgactgaggcactatggcagccactcagctgggccatgtagctatgacagaggacactacatcatccaacatgggaatgccgcatagtttatctctcgtctgagttgacataattcagattatattccgagtttcaaatcttttcttccgattaaaaatacccctacaagcctctttacaagtgaagtttgtttgttggtggctgaaataaaaggctctccagtaaatgtcatatctgttgtgaatatttttcctgctttgtacttttgcttcagtttttatggtttgggacaaagaatctaaatttttaagtcaaatctatgaatttttccctatagttatttctattattttgtttgaaagttctttcccatctacagatgaactagtcattttttaatcttttatggtctcattatttacacttaattcttgagtgtccttataaattttggggtatgataaaaggtaaggctgtaaattggccttttattttaaataggcacagcactattatttattaatccatcccttccttcctgatgctttttgtgatgtttcctatatatgcagtgattttctctgagggaggagaatgtatgggggtcacctgagctttgcaaaaacacacttaaccccacctttgcaagattccagcacatcttgactaacaggaaccttttttttttttttttttttttttgagacggagtctcactctgtcgcccaggttggagtgcagtggtgcaatctcagtggggcatggtggctcaatgcctgtaatcccagcactttggaaggcaaaggcgggcggatcacctgaggtcaggagttccagaccagcctggccaacatggcaaaaccctgtctccactaaaaatacaaaaattagccaggcatggtggcacgcacctgtaatcccagctactccaaaggctgaggcagaagaattgcttgaacccaggaggcagaggttgcagtgagccaagattgcaccactgcactccagcctgggtgacagagtgagaccctgtctcaaaaaaaaaaaaaaaaaagtcatatacgtattttgtacttttctcatatatcatctaggatctgcttagacatgtgtattcagttccacagataagtttatccttgtgtctgctccccagtgttatccttactgaaggataagaatatattttaatatctgataaagtattatattttgaaaacctaaaaaataattagcccattaacatgttgctgcagcatccaggttgcttgttgggagaactctcttcatattgcttttcttttgtgggataactttcagtaagtctttcgttcaaatagttatattacctctacttttatgtcagcaggaataaagaatccattttttaaagttgaaaataaaactgtactggaagaggattgtctttttctactgacctaatcttagaaattcaaccaccatcaaacctggctctatacagcatacttttctaaaactaacagcaatattcaacactgaggtctcactctgacagccagacaattcattttgcccatatttggttttgcatgtatgagatgttatttagaaagctgttctgaaggtctttgcaaggtaaagatacgtatatacttctgaatttccttttcctgtatgcttctagaactaaaccttgggttaggagaggtaggaactgtttcctgcttgcaaatactaatgcttagtaagaaatgaaagattatatgtcataagtagccttaactttggtaagacagtagcatattttttctaaaaatttagaaaccttctcaggattcaagttactctaaggcatgttatcagatttctctcagtaagcaatctgttataaatagacagattgatttatatcaaaatgtattttattccaaataatatagcaataattaattgagtatactttaaaattttcttaagaatgccattgtgcagagctttatagtaatcatctagtataatgagacagcttctagaactatgagtgtatttatattcattttaatgtcccttaaaagtgataataattgataatataatttcaccaaactgtatacaatgagatatgtaagatgtttaccagtaatgtaaaataaatttttaagtttgaggacatgaaggaaaatagaagttttcataacttaaaaccatacaaacagaaatgctaaatttcatttagatggtatgtgttaacattgtcagggcaaagtaattaatataattttgtcacctttttctgaccctctaatttttctgcaaatttcagtatttatcctcaaatattacttatttttaaaatatacttttgctttgacttattctttattcagttaattatatttgcgggcacttattgaaatatagttaactggccgggcgcggtggctcatgcctgtaatcccagcactttgggaggccaaggtgggtggatcacttgaggtcaggagttcgagaccagcctggccaacatggtgaaatcccgtctctactaaaaatacaaaacagccggtcatggtggcgggcgcctgtaatcctagctacccgggaggctgaagcaggagaatcacttgaacccgggagacagaggttgcagtgagctaagatcacgccactgtactccaacctgggcaacagagtgagactccatctcaaaaaatatatctatatatagttaactgagcactgtatacaagccaaatctcattaaaataaactcagttctgatcaaaatcttcatggtcattcacattgatttctcagccaatggcctaccttaagttttaagaagtattctgactctaaaaaaattttatacaccatgatagaaactttcagatgagtccttggagtttgtcctaagatgcttttacataaattcagtcaataacattcaggttctgtgtatgaccaaagaactggacaaatgctggccaaactttcaagaatgtttgcctaatgacaccccctagattgcaactgtatggtgttctatacagctatattcaaatggactaggaaaaaagctaattactcccaactttttttcttgtaagcaccccttccttccctttctccctatcttattcatccgtccattcttcttaattattcaataaatgtgtattgatctcctatagccaagaaacatactaagctccagggaggcaatgacgaacaagactaagaccgctttcttttagagcttgctgtcctgttattttttaatgtacatgaaaattgcagagtttgctccttttaattctaatttgcaggtttttattgttgtaaagtatttcaaatacccaggagtttaccaaaaataatataatcacgtgcctactacctagatttaagacattaacattttgccatatttgcttcaaatttctccagatataaccattaagttggtatgtatcttgtatatattatcatacatgttttgtatctttattttatatgtattgatccataagaatgtggtattgttttctaccaggcgcggtggctcatgcctgtaatcccagcactttgggaggctgaggcaggtggatcaccctgaggtcaggagttcgagaccagcctggccaacatatgaaaccccgtctctactaaaaatccaaaaagtagccgggcgtggtggcatgcgcctgtaatcccagctactcgggaggctgagacaggagaatcacttgaacgtgggaggtggaggttgcagtgagccaagatcaggccactgcactccagcctgggcaataagagtgaaactctgtctcaaaaaaaaaaaagaatgtggtattgttttatgtttttatattttacataaatgatttcatgcagtacatacccttttgcaattttgtggggttttttttactcaacattatatttgagatatacccatgttgatgcatgtgagtgtagttcatttcattgcatcgctacatgatattccatttcgtgagtaaaccagttcacttctccatgcctttgctgttatgtccttatttccagttgtttcgtattatgaatgttagttcactgagcatcattacatgtttcttgtgtacgtatttgaatgattctgtaagatgtataccttgtagatgacttgctggatcacagaatatgcatgttcaatgttactttatcaaactgtggctgaaatgaccctattgtttataaacctgttttaagtaaggtgtggttttaagacctattgctaggctattgaatcgttagcttatctgttaatttttactatacagtatttaaattctttccctttttatctaagcagtgatagatagtgggtgatctcattttttaattaggattttattaattatcttttcatctgttatagagatttaggcataaatgaatacagtggcaaattatacaagattttaaaatgataaatgaacatatattttctgacacattgtcagttcccaaatcatttacttttaaacacacttcaaattagtatcaagtgcttgattttaataactactttagtcacttgagaaactatggcactttaattattttgctgttagagccataaatttcacttaacttcataatctatgttaagagtattagcttaaaaatgtattttgaaaagattttacatacagatttaaaagttagtaccttgaaatggtttacagttaagcaaatgaaatatcacaaatacaagcagagctttgagatctgagttttgtaaatgctagaactttgtttcctaattttttagttcttcaaagaattaagaggctgcattatataattcattttagtatgtttacctcaagtacttttagaactagactgtattttcactgccacagatgtatcatgcagggagtatcctggtttaaattctgaagtgctttcactcctacttggttcaccttgaaatcgtctaaaaagaagttggcacattattttgcgaatgttactggacatcaggaaatacatgactggatctaagcaactattgaaagatgagagaaccagcatgatctcattggttttgtgaacaatttctttccagtagcaagatgatacatttagctgtgaagaaatgtagatgaatcgaaaggcatgatagggaacaaaacatatagtaaaaatgataagtacaataaaggagttacgagctgtagtggcatatttaccagaattaggaaattttgacctccttttagaaatcctcaatagattcttcccaatcttaatatatgaaaggattattagtaagaaaattagccagaacattaccacaagaatgaagttaaaaatggcttctccttttgcgttatgcttatctctgtaatggaaacacattgtggaattatgccctcctttcttaagtgttaaaataatcatagttaggaatccaccaagagcaagcatccatactatacaacagacataaatactttgtttggttgttattgccttccgttgctgtatagaccgattaatttttatatagcgatccaaactgatgaatccaagcaaaataatgctaatgtacatgttcatataaaacagtgttcccacaaccttgcacagaatcacacctagtgtccacttgttttggttaatatgatacattattcggaaagggaggcagaagatgagtaggaggtctgcaatggctacgttaagtagataaatttgaatggaatttcttttacggtgaatacccagaaatacatagagggcgattatgttcccaaccagtcccacgatgaaaataacagagtaggatgtggttaacacagtagatagcaatttttcatccatgggacaggtagtaacatttggtgttgctgagaagttttgtggcggttggtcgctatgattggttataaagcgcattctgtgggaggagtaaggccagctgctgactgaagttgtcgtcattgttatggtatgacttctcattgtcttctgtggagatcaaaaagtgaaagtgctaaatgacatattcctcatgtgtagttcttatgtcttcagatttttcctacaacggaatgccaaacattgagtcatttgctattttaataacagttactttaactaaaagtgtaaataataggctgggcttcccagcacacgcctatggtcctagctactcgggaggctacagcagaaggattgcttgaacccaggagttcaaggctgtagtgagctataattgagccactgcactccagcctgggcaacagaacaagaccccatctctttaaaaaaaaaaaaaaaaaaaagacagtgtaaataataaatgatttattttcagacattgcgagaaactttacttttatcctactgtatgtagtaacattattgtatcattaaacaagcagcacatagtgtggtatctcatggagtttcatgctctaacctttcctgtggccatggcctacattgaagttctgtttcatgtattatattaaaataactcaatttatgagatcatcttctcttagggaagttcttatgggaatacagatggtggtgaagagaaatgacagctcatatttctcaaagatgagcatcagtttctctaaaggtatgtacagccataagagagctgggcccactgctggccctgcccagcttcagaaccacttcctgccttgactttttccctcatatgtggcattcattcattttgacatgtattgctacatggcgtgtgacttgtggtggtctcattctataagtgggaataaagaagaggatcctaaatttcttttcagcctaagaccaaggtaggggtcttagggcatgcaattaacataatagactaagagaatacagcacctgcaaggttacacagactcttgtatcactggacaggagaaaaaagtaaccaaacaaaaccaagttagctggcagctgccagttagccactcctaacctagaagcatagagtaataacgtagatgggaaacagcatgtgcaatccaagattttgaaagtaacctgaccaaagcttaaatgtgccctgggttcaataatttgagacttgctagaaccttcgaagagatagtgtttgaattctacttgtttgtggcagcagagaatatttgcaaagctacttattattggcccattgactgctgtaaagagcttagtctgagagctggtcataacaagtaaagaaagcatttctggaggtctcatcacattcctctcatagagtgactgccctatttctctacagcagccacttagcagggttaacataaagatgcccagagcaaggttctcaaaatcagacccaactaacttgtgaccaagggcaaataacttaatcttttctatgccttagttttctcatttgtgaaaatgaaaaatgcataagaagaacttaatcctggcacatagtgactgcttaataaaagttagctttaataaacaccttttgattaatctcattttagtaaatatctcacacttggctaagtactgtgtgggaaaggaaggtgaataagacagagaccctattagtaaacattttggaggagtggacattcaaaccctgactgctaccatgcaaagtggatttgaattacataaattaagtccctgatttgatcttatacacagagaaaaatagcctttcttaaagctctacacataatttgattaaaaacaaagcattttggtagagggtaacattaagatttaaaatgttgtaaagttggggagcattgattccacagaagaggaactggctggtgaagaggaagttatgtaatccctggtaagagcctgtttccagaattcaggaaagtggagggagaaaggaagggagcggggaaggactgagtctagtctgtcatgtgtctcaactgcaggaagacaaatttcagaaagtttatagaaaggtataggcatgtttcttgtgatctaagattctggtttttgtttgtttgtttgttttgttttgtttttgagacagagttttgctcttgtcacccaggctagagtgcaatggcgtgatctcggctcactgcaacctccgccccctggcttcaagcgattctcctgcctcagcctcccgagtagctgggattacaggcgcccgccaccatgcccggctaatttttgtatttttagtagagatggggtttcaccacgttggccaggctggtctcgaactcctgacctcaggtgatctgcccacttcggcctcccaaagtgctggaattacaggtgtgagccactatgcccaacctgtgatctaagattctaaaaggaaagggcaatctagaaagaatgtcaggctaccaaaaatgaaactgataatgcaacctgcattaccaggaaaaggaaaagggtgtctgtagaggaaccacctatattgtgtggttatgtagggagctctcataggttcagggaattgaggcacaagaagtaatgtgattttgagagctcaagtagctgaaatgacgtgaaaaactcacctgtgagtagttattttggattttttttcttctctcatgttagaatttaagttccattaggattaagaaccaagtcaattttgttcggctctctgtacctaatgcttagcataataaatattattaaatcaaagagggaatttagtagaaatgtatatgaagttctacatgtggatattaaaagcagctgtacaagtacaggaagagctttagctgcattaacaaacacaattgcaattgctctatcactagcgtagtgtggtggcaacgaaaaacccatctttagttgaattcctagatacgtgatgtctgaaatgaaaattgttactactatgctgcttctgtcccaggctggtagggtctcacctggaatgcagtgtttgatccacagcagcacacttagaaaaggccatggaccaaatggagagaagaactcaaatcatgtcaaagaagcaagttgaaggaaataggcacgttaccctggagatgagaatgctttacaaagccatagagaaaagggtttcactttgttatatgtgtcttcacaaagcaaaacaagaaccaatgatagaaattgcagagacagatgttgcctccttttaaggaaatcatttttttctaatgaaatgatctctcttgggaggcaatataaggatcttaccactggagatttttgagactaccaccaattgggttctttgtagaagggattatcagtggttctcaatcctggctgcatattagaatcctcttgagggttttttaaagataccagtgcttggctccttccccagatattctgatttaattggtctggaatgggtttcaggcactggtttcctttaaaagctccttaggggattttaatgtgcagtcagaattgaactcttaagctagatggccaaaccattaactaatatttatttagtactttctgtgtaccagacactgtgttaaacacatttatattacttcctttacataattcttgcaatactctgtgaggtaggtatcacaaaagaggtaatgaaagatcaaaaggttggccaggtacagtggctcacgcctgtaatcccaacactttgggagactgaggctggagaatcacttgagaccaggagttcaagaccagcctgccagccaaggcaacatagcatgaacctgtctctaaaataaaaaaaggaagaaagaaagaaagttcaagaggttatgatctttactcttggccacacaactctttttttttttttttttttttttttgagacagagtctcactctgtcacccaggctggagtgcaatggcatggtctcagctcactgcaacctccgcctcccgagttcaagcagttctcctgcctcagcctcccaagtagctgggaccacatccagctaatttttgtatttttagtagagacggagtttcactatgttggccaggctggtcttgaactcctgacctcattttccgcccgcctctgcctcctaaagtgctggggttacaggcgtgagccaccgcacccggcaggccacacaactcttaaatgacagtgcccaagttaggactcagatctgacttttagagcccatgatgcttttcaccaaatctcactccttatcacatagggtcagcattttctttattaatattgagttctatcagcagtattttgacatgattcctttaacatacactttaacaattttaagaacaggttatgccatctagctttacttctttggaaagggtattaatcttatttgctatgtccattattataaggaagtaaatccagagtttacagaatcacaaatcattcatcagaatgattgccactacccacagagcatatctttttaaacttctagacccgatagccataatcaagatgtctccagaaagctgttagcacaaagcacatatcctgaaaccatttgcctcagctctaatctgcaaataaaataagtaatagttggacaaatctgtcagtaagcatttctggttttgctttagtcttcagtttaaagagcataaagcaaagccagtgcatttgtttatgttataatagtggccatcatttagaactatgtattagacagctagcatacaattattgattcacaaattgacagctgagcgccatggttcatgcctgtgatcccagcactttgggaggctgaagtgggaggatcacttgagttcaggagttctagaccagcctgggcaagatggtgaaaccctgtctctacaaaaagtataaaaattagcgggtatggtgacgtgcgcctatagtcccagctactcgagaggctaaggtgggaggatcgcttgagcctgggaagcagaggttgcagtgatcctagatcactccactgtactccagcctgggtgacggagtaagaccttgtctcaaaaaaaaagaacataaaaaaaaaaaaaattggccgggagcagtggttcatgcctgtaatcccagcactttgggaggccgaggcaggcaaatcactggagtccaggaattcgagaccagcctggccaacatagcgaaaccctgcctctactaaaaaataccaaaaaaaaaaaaaaaaattagcagggcgtggtggcacgcacctgtagtcccagctactccggaggctgaggctggagaattgcttgaacccgggagacagaggctgcagtgagctgtgttcatgccactgtactctagcctgggcaacagagcgagagtctgtctcaaaaaaaaattttttttttaattaaaaatcacaattacattctgttttaaacttggtgactgtttttttttctcctttgaagttggttagtacattacaatgtcattcactatataaggctatttactgatattttttaaactacctgtttgatatgttaagaattgcttgtgaagacaagaaacaaaccactgtgtttacataggggattaatttcccagtgggcattacttgtgacccatgtgctatattgaagtggtcacaatagttttgtaatagtagatagtgttttttaaatgttgttacttggcaaatcctattcacaagttcaaaaacctagtattagtgcattgtacccccgcaccaccacctactcctgcagttttttttcaactggctcatgtaggagtactggacccagagggcaggacccaacagattccactgtgactccagatgagcagaagcttttaaaatgcagtttgggtatgtttgtgaaaatatcacattgctatgttgaaatacatacctatttggtaatagtcgcaacctttcaccgtttttagtttgacttgataatgactgaatctattcagggcatgcttcaaaattgcattaactgctgtataaaaaatgaaaattgaaaacatattactttggaaataatactattaatagtgtgttaggttttgttacaaatttaactgtgtccctagaaacacattttaaaaaattattatttgaactaaagcatattttgctttctctcttatctaatattcaccttatttacttctgaaacaccaaacttaaatgttatatggtctggtaatactataaaatagtaataatataataaagaaaagacagtaatttaaaatagggagacagcataacttaaagtcaataagttataatttataatacattagaaataaaatgtattgcatatgaaaataacttttaattcatgcaagtagatctgcaaaatcttgatggcagtatccaaatgcagtatcaacaatgtgactatattgacagtaggagcttaaataccttgaatgtcttaaagtacttaaagtaactaaaaagacagtctcatttgaaatcaaggcagaggtgtcattcaagcaatttactcagtagttctaaaagcgaataactgctgacattagagtagccttatcaccatgaatcacgtttcactttgaatgttcagataatcaaattttagctgaaataaaggttcatttatgtagccgaaatcaagaaatactcacagttcaggttcgcctgaagtaaaaggagcagaaccccaagcttccctagacactgagactcgtcttggttgtgtcagctgggctcttccatccggtcgtggtgcaattggttggggttctcttcttttttatgttcatatgtggtggtagggttttttttttccccctctttttttttttcttttttcggtatgacaactctcagattccttttgaaaatattaaaaagccctactaccatggaacaactttaagctcaaccaacactgaactttaggaaattatttatatcttctttatgaataccttccaacttgacaattgtggaatgttttcctccccccgctcaaaatttaaaagttttataaattctaagcagaaatatgtattttctgtgttttgtaagaaatgatacataatatgctatatggactttcaaagcacaagcactgaatttctgtttcttaagttttcatctgtacattattttagcatattttcatgtattcctttaagacctttgctaaaacaaacttgtattattaggactagatgagatttctgatggtgttctccccttttgatcactatgataaactctcccgagcaaattaaaacatcacctgtattttaagcgaaataatgatgggattctgcagtcttggttttgatcctagtccaaaatttaaccactatctgtccatctatgtaactgctggccctgcagtttagtgttatttccctttttttgttgtcatttgaaatgaagaagttagtttttattctccccataattgttatcctgcagcttgtttgcactaaatatttgactcattgggctgtatctaacattctaattatttctgggtacactcttctgaacattatattctccagagctttttgtttgttataaatatgatttatgggacaggatatttttaaattaatagaataaaaatgttttgtagctcttacttccccttagaacctctgagaaggaaggtggttgctgtattagtcctgcaatattgttgtattggcaggattttattttattgtggtacaatatgtaacattaaatttaccatcttaacttttttttttttttttttttttgagacggagtttcgctcttgttgcccaggcgacaagagattgtacaatggcacaatctcggctcactgcagcctccacctcccaggttcaagcgattctcctgcctcagcctcccaagtagctgggattacagacatgcaccaccatgcccggctaattttgtatttttaatagagacagggttttgccatgttggccaggctagtttcaaactcctgacctcaggtggtccacccacctcagcctcccaaagtgctgggattacaggtgtgagccattgcgcccagccccatcttaaccatttttaagtatacaattcaatagtgttaagtatattcacattgttgtgcaacagtttctagaagtttttcatcgtgcaaaactaaaactcttcaccactaaacgatttctctcctctccccctgcccttgacaatcatgattctttatgtttcattgatttggactactttggacacttcatatgagtggaatcacacagtatttgtccttttgtgacatgtttatttcacttggtgtcatatcctcgaggttcatctgcgttgcagcatgttacaggatttccttcttttatcaaactgcattatattccactgtatatgcaccacattttccctatgcattcatctgttgatggatttttgggttgcttccacctcttgactaatgtgaataatgctgcagtgaacatgagtatgcatatatctcttcaagatcctagcaggaattttttaatgactaaataggcatttaactacgtgcattctatttcatataatctagcatgaatatatttttttctatattattttcctacacctaagacaacccttttcaaaacactaattgttttaatcttcagtttcctcatattgtgaccacattttctcctcaatgtgagtcagcacagctaccaccagatttgagtataatctttttctagttctttctttatataagctttttcctgttcattctgaacattctggtttgtctctgcgttcttagctcattttcgatatgtcctcttcccttcacgcttcctctttctcttgttgggattataaggtatttatattaagatagaagtagaaaagaacaaatgtatacgcttgtttggtgccatctattactgatatcactgttctctttaaatcccaaccctggttaaattcagctcaccacctactccaggcctgaaccttgccatgtaaaatgaggactgctggatacaaacactcaatgatgctgattggtctcacttcaaattcatgactacaaacctcaagtgggcccctgggctgccaacagtcctagtatatttccttagtccagtggttctcaaaacaggggtcccaaacgagttgcgtcaacaccactcagaagcttgttagaaatgtatgttcttagctgggcatggtggcgtacgcctgtagttccagctacttgggaggctgagatgggaggagcacttgagcctgagagtttgagtctagcctgggcaacatagcaaaaccttgtccctaaaaaaaaaaaaaaaaagaaagaaagaaaaggccaggtgtggtggctcacgcctgtaatcccagcatgttgggagaccgaggcgggcagatcacctgagggtcaggagttcgagaccagcctgaccaacatggtgaaaccccatctctactaaaaacacaaaaattagctgggtatggtggcacgcacctgtaatcccagctactcaggaggctgaggcaggagaatcgcttgaacccgggaggcagaggttgcagtgagccaagattgcaccattgcactccagcctgggtgacagagcgagactccgtttcaaataaaaaaagaaaaaaaatgcatgttcctgacttcatcccagacctgtgagccagaaattctggggatggggctcagcagcctgtgtgattctgatgctaaggtttgaggaccactgcttaatcagttcattcttctattccttgaaaatactttttcacacctgtactcttctcagactgccaggaacccctctccttcctcactcccacctggtgatcactttttatttcactgagaaaatagaatcactcagaagagaattttattgtcttccagtgtccacctctgctagtatatacaaatgtctctctaagaaacaaaagccgggcgcagttcttcatgcttgtaatcccagcactttggccagctgaggtgggcagatcccttgagctcaggaattcgagagtagcctgggcaacatggcgaaaacctgtctttaccaaaaactacaaaaattagccgggtgtggtggcacatacctgtagtcccagctactcaggaagctgaggcaagagggtggcttaagccccaggaggtggaggctgcagtaagccatgattgtgccactgcactctagcctgggtgacagtgagaccctgtctcaaaataaataaaataaaaaatttaaaaacctccacaaaaaagctctaggtactactatggaattacctgtagaatatattgttatgtggaaattttgaatatttgtacatattttcttatttttaaaaaactgaaggataaactgaaaactgataaaaatagttaccaatggggaagaaaagattgggagtgggggaagagtgcaaaagctagacctctctgaatagtatctgttttacagtttgtactttagaacctatgtacatgttttatacaattaaaacaccaaattaaggcaaaatctagttgaaacaaatgaacctcactctattgcaaagtgaaagcataaccacaaggagaattatttttggtaacttttaaaatagggtaggggtttttgttttgtttttacgtaattttagacttatagaaaagttatgagaacaagtacgaggattctagataccttttactcagattctctatgttaacattttttccttcatttgtttaatccttctcaatctctcactcttatccatttatgtatttcctaaaaatagggaattcctttacatagctgcagtacagttatcaaaatcagttaatttatgttgacctaatatcattatgtattctacagaccttgttaaaatttcatcagttgtcctagtaaatatcctttataacaaaaataaaaacaaaccgggcacagtggctcacacctgtaatcccagcactttgggaggatgaggcgggcggatcacttgaggccaggagttcgagaccagcctggccaacatgccaaaacactgtctctaccaaaaatgcaaaaaattagtcaggcatggtggcacgctcctgtaatcctagctacttgggaggctgaggcacgagaatcgcttgaactcgggaggtggaggttgcagtgagcagagatcatgccactgcactccagcctgggtgacaaagtgagaccctgtctcgaaaatatatatatattaaaaacaagatctatctttttagtctcctttaatcactttaacctggaactgtatttgaagaatataggccagttactttctagaatgtccctctttgggtttgcccagggttccttcatgattagatctcgttatgtactttggcaggaataccacagcagtgttgccaagttctcaatgcatcatatcaggaagcacatgctatcaatcagtcccattagaagcagtgttaacttcgctagtttctgctgggtttctcccttgtaaaattactagtttcctgtttgtaattaataagtatgctgtagggagatatttagagatcacataaatatcttaccactcttcaaacttccactcacaagttagcatccttgatgattcttacctgaatcagttacgataatgaaaactgacagattccagcatttcttctacatttaattgattttctacttaaagcttttcctccttccccattcatgtatttgtttatttatttacatcagcatagactcatggattctttacccagtagtaaaatgctattttgaccgggcatacctagtgggatatatcttaaggacaaaaagaaccacaaaatcttaaacagcattcagtggtgttgttattgataatgtaggtattactattattttaaaactttcacacacacatacacacacattctgaagcacaaagcaaatgagtaattatgttagtatcattaggtaccaagattacagttgacccttgaacaacatggggattggggtactaatccccgcacagttgaaaatccatgcataacttttgactcccccaaaacttaactactcctggaagccttaccaataacatagttgattaacacatattttgtgttatatgcatcaagggagcctcaagtgatcctcaagtgatcctcccacctcgaccttccaaagcactgggatcataggcatgagccaccactcccagccggtttgataattatagaaagaggtttggctttaaaaatgtcaaaatagcaggatgcagtggcacatgcctatagtcccagctactcaggaatctgaggcaggaggtttgcttgaacccaggagttctgggatgtggtgcattatgccaatcaggtgtccacatgaagtttggcatcaatatgatctcccgggaggggggtaccaccaacttgcttaaggaggggtgtgaactggcccaggttgtcagcggagcaggtcaaaactcccgtgctgatcagtagtgggattgtgcctgtgaatagccactgcgctccagcctgggcaacagggcgagactcccacctctgaaaataaattaaaattaaataatgtcaacataacaggaggatcagtttttgtcagcaaagaggcagcagatgagttctcagatgccattcagaaaagtattgaagaggagcaatatctgcctgaacaggctgttaatatggatgaaaagtgccctattctggaaagaaaatgccacagagaacatctattaataaggaacagaagcaagcaccaagatttagggcaggaagggatacactaactctaataagcatagtcctgatataattccaactgcatttgcacaaaacagtagagtcagcctatctgcctcacttgaggtcaggagtttgagatgagcctgggcaacataacgagacactctaaccccccaaaaaatgtttttaattagccaggcatggtggcacacacttgtagtgccagcttctctggagactgaggcaggaggatcgcttgagcccaggagttcaaggctacagtaagctatgattgcaccaactgcactccagcctgggtgacagagtgagaccctgtctcttaaaaaaaaaaaaaaaatttatcaaactgtcttttgccaccattgcattctccagcttttagatccttcattttttttttttttttttttttttttttcctgagacagtctcattctgtcacccaggctggagtgcagtgtcagcctcctgggtttaagcaattttaccgcctcagcctcctgagtagctggaactacaggcacgcgctaccatgctgggctaatttttgtatttttagtagagataaggtttcgccatgctgcccatgctggtctcaaagtcctccactcaagtaatctgcccaccgcagcctcccagagtactgggattataggcatgagccaccacacctgaccccttcaccttctttttgctttaagttgctatttcgctttttctcaaattatgttagaatctataggtatgtcttttttatacccacataaaagctgcattttcaatactacttaaaaaggtatttcacaaaaagtgcaagattttagcacctactggtgttagctgcaggagtagcttcatgaatttcctttcctttttttttttttttttttttacaatggtccttatgttggattcatttatcttgagatggcagccaattgcagttgcagacctcaatctacaatacatatcaagcaattcagctttttctttttttttttaagatggagtctcgctcttatcacccaggctggagtgcagtggtgcaatctcggctcactacaacctccgcctcccaggttcaagcagttctcccacctcagcctactcagtagctgggatttacaggcgcctgccaccatgcccggctaatttttgtgtttttagtaaagatggggtttcaccatgttggccaggctggtctcgaactcctgacctcaggtgatccacctgcctcagcctacctttttcttgtaatgtcatgactttcctctgtttcttaggagcacttctagcatcaccaatggcactttttatggatcctatggtttaaggtattgcactaaacacagtgaaaataatatgagaactgtgagattacttttactgtgatatgcaatttattggagagatgaactgctcaagcaaagataagtagcatcacacaacatattaggtgaatactcgcaagacttgagctcactgcaacagcaacaggagggagctgtgaaattattacagtagtataatatgtactacagttaattttatggttatgatttaatattgcattctttgtatttgttcacatttctcttgactgaatggcaccgtttacagtctgtgtaggtgtaagttttgataaattttaactctttataatagatttgtgtacatttttatagtactaaataataaaatagtatctaaatatgttttatgcatttatgatatagctttttcttaattttttattccagaagtcatccttcacctttttcttaatttttaaaatagttctaggcaacatggttggtccacgagttttttcaaattgttacgaatctccaaaaaaaactttcaatatattttgttgaaaacaatccatgtataagtggacccacacagttcaaacccatgttcaaaagtgaactatacttgccaaatcaaagaattaaagtaaaaatgctataattgaataggaagaaatattagcttgaacttgtggtttatttatttattttttttttttgagaccgagtttcgctcttgttgcccaggctggagtgcaatggcatgatctcggcttaccgcaacctccacctcccaggttcaagcgattctcctgcctcagcctcccaagtagctgggattacaggcttctgccaccacacccagctaattttgtatttttagtagagacggggtttctccatgttggtcaggctggtcttgaactcccgacaggtgatcctcccgcctcggccttccaaattgctgagattacagacgtgagccaccacgcccagcatggtttatttttctcctaaaaatgcattcttttttcagcactgtccactgaaaagccaaagtaataataacccagtaaaaataatatgcctagtacccacatcatggatttatttatatattttattttatttttatttttattattattatttttgagacagagtctcgctttgtcgccaggctggagtgcaatggcgcgatcttggctcactgcaacctccgcctcctgggttcaagcgattctcctgcctcagcctcctgagtagctgggactataggcgcatgccaccacgcccagcaaatttttgtatttttagtagagttagggcttcaccatgttggccaggatggtctcaatctcttgacctcttgatccgcccacctcggcttcccaaagtgctgagattacaggcatgagtcgctgcgtccagccaattttttttttttttttgagacaaggtcttactctgtcacccaggctggagtgcagtggtgcaatctcagctcactgggttcaagtgaagctactgcctcagcctctcgagtagctggaattacaggcatgtgccgccacgcccagctaatttttgtatttttagtagggacaaggttggccgggctggtcttgaactcctgacctcaagttatccacccaccttggcctcccaaagtgctgggattacaggcatgagccaccgcacctggcccacatcatggatttaaatcgttttttgcactaaaaagaaacagggctacttagagaaatggctgattccagatctggggcaagaaatggacatgacaagcctggaacatcatcttgtgactgaaagcaaggaagttatcagacttctggagtcttacaaaaatacagaagaactgacttaaaggggctcccactggcccaaaatgggacaatttgagcacaaaaatttgtaaaggcagcaactgattaaaacacattaaatatataaaaatctgtaagttcataataattaaaaaaaaaacacctcatcagtcacctttggaggttgcctagaaactaacttggtattctggaaataaattataacagctttattcataatatccaaaaactagaaatagcctaaatgtctgtcaacaggagaatggacaaactgatatattcatacaatgcaatacttacggcagtagtaaaaagaaatgaactactgatcacaacaaaatgaatgaatctcagaacatgctgaatgacagaagccttacataaaagaatacatacttacggttttgtgtctatcaagttctaatataggcaaaacaaacctatggtgaaaaaaatatcagagtagtggtttgcactgggggagatggcagcagagattgaatgggaaggggatgagggagggaggtttgtgggataatgaatttttttagggatttgggttacacaaatgtatgcagttcatcaaaactctaatggtacgcttttgtgcatttcacagtatatacattttttaccttaagcataactttattttttttttactttttatagaagttttaagagacagggtcttgctgtcacccacgcaggggtgcagtggcacaactgcagttcactgcaatcttaagctcccaggctccagtgatcctcctacctcaagttactggtcccaagttactgggaccacaggtgcacgccaccaaaactggcttttttttttttttaagtagaggcataattttaaacaaatattaaatttcaatgatatgtgtgctaaggtgtattaaaaagtaagatggatagaaggataaagagatagatatttgataaagcaaatgtaacaatatttaattgtagaatctaggtggctctttacaatataattctttcaattttctatatgtttgatagttttcataacaaaatgttgaagaaaacctccattttggcacctctaattatgggtctaggcatcaacatctgctaacatcattgagtgaaaagttgatggtgaatcttataatgatgggtcaggcagacaacacctgaacccactgctcaatcctgtcactaaaagtaggatagccaggtgctatgttcttcctgttgcaatacaatagatatatcacctatgaagtattagtgcataaaactaaaattgaatctgaatctaatcaagattctagatctaactacaaatttacaggaaatacaggagagtaaaaaacattaaataataccatgtaggtaccattagtcaagtacagattgtgggggatttcacaggaaaaattacctagtatcttaacaaatcaatggcatgaacattggaaaaaaaaaagcataaggaaggggatctgttacagagtaagagacactcacaagacatagtcatcaaatgcaatgtacagaccttggatcctgtctagaaccaaccaaccgtaataagacctttcttctttttttagtctgttctactccttcaagttattggtagagaaaagacatttttgagacaatcaaggaaaactgaatgtggactgagtattagatgatactaaagaagtattgctcattttgttggacttaataatgatattatggttatttttaagtcctgtgttagaaatactgaactattaacaggttaaattacatttatgttaaaatacttctggggaaaaaaagtaaacagttggggatagatgaagcaaaaatgaaagaatgtccttgtttttgggtttttcgtttgtttgtttttgttttatttttgcctggagacgggcaagttgcccatacatcccagcaggccaggggaggagctgaaagaatgtcagtaattgccaaagctgggtgatagatacatggaagtttattaatctattttctccacttgtaaatgttaaaaagaggcatcctcagcttcacactttcttctacatcccatttctccatttttactacagtaagactgtgaaagatatctgtatttactgtcactacatcatctcctcccattctctcctgaacctggtccaatggggatttttgcctccatcgtgccaccaaaaccactcttatcaaggtcaccagtaacttccaaattgccaaatctaatggtcagttctcagttctcattttaaatgacctttgtaacattgatgactactaatcattcctacttgaaaaagtttcttcacttgacttccggataccaaactgattttcctcctgcttcactgtctagaccttgttttctttgctagattttttcttctgacttcagatattggcgtgcaccaggactcaatcctctgactcttctctatgatttcctaagcaatttcattccttaccatggctgtaaatatcatctgtgtactgttgattcccaaatttacacctctaatcccagcttccccttaatgtcatcttataaaatctcaaactcaatacgtatgagaccaaattcttttttttttttttttcatttttctataaaatagagatggggttttgccatgttgcccaggctggtctgaaactcctgggctcaagcaatcttcccgccttggctccccaaagtgctaggattacaggtgtgagccaccgcacccagcctgaaaccaaattcttgatccaccttacaaactcctccctcagtgttccctgtttcagtaaatggcatcttcattttcactcagttgctcagaccagaaaactaattgttataattgacttgtgtctttctctcacgctcatatccagtagcaattcctgtcagctttacctttagaacataaactgaatttgactacttctcatcatctctgcttctgtcactctagtctagtccaagtcaccatcttctcttgcctgtgcaactgcagtagcctcttaattggtctcctttttccctgtttcttcacaatctcctcacacagcagccagagtgatccttttaaaacctaaaactgatgatagtactcccctgttcaaaaccttatggtgatttcccatctcgctcaacataaaacccagagttcggagagcaggccagagcccaggcccggcccagcggcgcccgccaggtagacccaggcgaggccgcgtgccggcgcgaggggagcccactgcgggaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttttaggagcccgtaggtcatcttggagggtcgtctcaagtattgaacaaaagacggaaggtgctgagaaaaaacagcagatggctcgagaatacagagagaaagttgatacggagctaagagatatctgcaatgatgtactgtttcttttggaaaagttcttgatccccagtgcttcacaagcagagagcaaagtcttctctttgaaaatgaaaggagattactaccattacttggcagaggttgccactggtgatgacaagaaagggattgtggatcagtcacaacaagcataccaagaagcttttgaaatcagcaaaaaggaaatgcaaccaacacatcctatcagaccaggtctggcccttaacttctctgtgttctattatgagattctgaactccccagagaaagcctgctctcttgcaaagacagcttttgatgaagccattgctgaacttgatacattaattgaagagtcatacaaagacagcatgctaataatgcaattactgagagacaacttgacattgtggacatcagatacccaaggagacgaagctgaagcaggagaaggaggggaaaattaaccggccttccaacttttgtgtgcctcattctaaaatttacacagtagaccatttgtcatccatgctgtcccacaaagttttttatttacgatttatgacaggtttatgttacttctatttgaatttctatgtttcccatgtggttttcatgtttaatattaggggagtagagccagttaacatttagggagttacctgttttcatcttgaggtggccaatatggggatgtggaatttttatacaagttataaatgtttggcatagtacttttggtacattgtggcttcacaagggccagggtaaaactgcttccctgtccaagcaaagaaaactgcctacatattggtttgtcctggtggggaataaaagggatcattggttccagtcacaggtgtagtaattgtgggtactttaaggtttggagcacttacaaggctgtggtagaaacataccccatggataccacatattaaaccatgtatatctgtggaatactcaatctcaatgtgcacacctttgactacaactgcagaagtgttcctttagacaaagttgtgacccattttactctggataagggcagaaacggttcacattccattatttgtaaagttacctgctgttagctttcattatttttgctacactcattttatttgtatctaaatgttttaggcaacctaagaacaaatgtaaaagtaaagatgcaggaaaaatgaattgcttggtattcattacttcatctgtatcaagcacagcagtaaaacaaaaacccatgtatttaactttttttttttaggttttttgcttttgtgattttttttttgatacttgcctaacatgcatgtgctgtataacaatccaagcataattgttaagaacacatgtattaaattcatgtaagtggaataaaagttttatgaatggacttttcaactactttctctacagcttttcatgtaaattagtcttttggttctgaaacttctctaaaggaaattgtacattttttgaaatttattccttattccctcttggcagctaatgggcttttaccaagtttaaacacaaaatttatcataacaacaaaaatactactaatataactactgtttccatgtcccgtgatcccctctcttcctccccaccctgaaaaaaatgagttccaatttttttgggagaggggagattgattagaaaaaaatgtaatatgttccatttaaaattttggcgtatggcattttctaacttaggaagccacaatgttcttggcccgtcatgacattgggtagcattaactataagttttgtgcttccaaatcactttttggtttttaagaatttcttgatactcttatagtctgccttcaattttgatcctttattctatttgtcaggtgcacaagattaccttccttttttagccttctgtcttgtcaccaaccattcctacttggtggccatgtacttggaaaaaggccgcatgacctttctggctccactcagtgtctaaggcaccctgcttcctttgcttgcatcccacagactatttccctcatcctatttactgcagcaaatctctccttagttgatgagattgtgtttatctccctttaaaaccctgcctatcctgaatggtttgtcattgtctgcctttaaaatccttcctctttcttcctcctctgttctctaaataatgatggggctaagttatacccaaagctcactttacaaaatatttcctcagtactttgcagaaaacaccaaacaaaaatgccattttaaaagaggtatattttttcttttagaatgtaagctcctcaagagcagggacaatgttttctgtatgttctgttgtgcctagtacactgtaaatgctcaataaatattgatgatgggaggcaaaaaaaaaaaaaaaaaaaaaaacacccagagttctcaccacagtttcaaggccctacacctttgatcatccctcagatcacatttcccaccgctctgccccttgctctcatgcctttccagacacactgggcttccttcttcttctccaaacaaccctccttattcctgtgggcctttgtattggctgttcttctcatctggaacttgcttccatgtggcttgctttttcacttcgttctggtctctgttcagatattacccattagagaggccttctctgaccccaactaaaatagcaattccctagtccccatccctataacacctccttaccagcttaattttacttcctaacaagtaatactacctggctttacattctgttaatttgcatttatggctctatttgctttcttaaattcaactctttaggccaggcacagtggctcatgcctgtaatctgggcactttgggaggccaaggtgagaggatcacttgagaccaggagttcaagaccagcctgggcaacatatcaagacccctcatctctttttaaacataaattaatttaacttaattaagttcacattttataacttgtcttaaggattcaagaatgactgaatctacacagaggagaattatataaattcccttgtaacattaacttaagcctaaacatcatcaacatactattaagggcatacagaactttggagttctgatttcagcttctactccttcctaaggtgataacagttacacagccatggccagaagaccctgttggagtctagtttgcacttttttcttctgtatcatgttcattcttttctaggcttgctcacttgctgtgtcccatactggaatcatgctaggggtattgccatcttagtctgttgtcattgttctctctttgaaccaacagaaagttctaactaacagcagtctatcagttgatttcggtagaggtttgcctgctctcccatagactcttcttgctactttgtgtcatgctgtggtttgctcactattcatttctacacttgccttccttctttctctggctctcacatacacacttgtatttcctggctcatctctgtttgtgctagactattggaaaagtctttaaacttctttggacagaaagaataacttccaaagtagaatcctgatgctcccattgggcagagtaaggattcctcccacctgtgtgtcatcatcaaacacaggtgtaccagctcagtatgattgcaccctttttttatacctattatgttggctaaaactgaacaaaaactgtgtccttttatgaatgagaaaatataggagagaatttttaaaaaccttttgtcttctatgactaaagagacttgctttttttactagcccctgttttgagagccggtcagatgtagttttagtcatattggggaggacagtgtttaagcagataccagagctccccattatgaaattctttcctgacaccagccccaactaggtcccagtaagaaatagatgcagaggacaacatcctacaaaggaaaccctcattgttatcacaaagcatatgatataaaggagccctggtcaagcaggataccccttggggagaggatgtctttgccctggactaggaatcaggcaagtggttttctttccccttctcctttttcacctcccacccccacagagaggaaaagcagatccagagaagacatgcccaggaagagcgttgaagtccctgggaacaaggcttaattaaaatcattaaatctgacccatccatgtagtactccttggcttaagggtggaatgaataaagcaaagaaaagaggactgggcagggtggagaaagaaagggccatggctatcccctaacaaccaggatacaatggctctgtaggtaaaatcagaggtttcaagaaacattttggaagtgtaaaatatattttttcctaaagaaatctagactgtcactcaaaggaagacaatattgcatagtaaggcaaaaaaaatgtatctgtgtttcttgaacatccatgcttccttagtaattcttagcactgtactctaaccttacaagcaaataatacctaaagaacattggatggaacaggtatgtatttggagaaatcagccagacgtgagaatatgacaaataattcaagcatccagaataatttagaagtttttaatgtgtttctctattatcatgttatctaattttatgtaaactgcattgttcatcttcaatgaatccttatcttcgggtttgttttttgtttgtttgttcgtctgtttttcttttcagccccactgtgttctccttgcctcaaaagaaaactcggcacctgttaaacttggaggctttggggtagctattcaattaggggagtctggacttgtagctggaggtaagactgctttaaaaaaaaaaaattcttcaaaacctggtcacttgcgactggtataaaactttcaagctacatattagcccaacctcagtgtttcatacctcattccaccccaccccaactcccaaaaagcatcatcagatagtttttaatttaataactctgtagtcataactagaatcttagtcccttaagaatagactcttttttctctttgtacctccagtacttaagagactgtacaagattaaaacagtgttcagagaaaataagtttgaggcatagtgccttttaaagttgaactggccaaatgaagtcaaatctaaaatgtgtagattagccacttcctggtttacactgatggctaatttttaatttcatactgtttgcctttttccatttatcaaagaatcctgctcaagccatcagcctgtatattagcaaagaataagcagatgtgaatgcaggctgattttattattagccaaagcaaaacataatttttaaattcccatgtcagaataaaaagaaaaaagttacaaattatataatcttgcacagcacatttcatataactcaattccttatagctagaacatcaagcagtaacaacatagaccatcttcagaaaaatgagccataggtcatagttgtaatttttttttttttctttcagacaatgtcttgctctgtcacccaggctggagcgcacagtggcacgatcatggcacactgcactgcacccttgaccttccaggctcaagtgatcctcccacctcaacctcccaagtagctaggatcataggcgtgtgccaccatacctagcaaactttttttatttttagtagaggcaaggtctcactacattgcccaggctggtctcaaactcctgggcctaagcagtcctcctgcctcagcctcccaaagtgctgggattacaggtgtaagccactgcacccagccaatagttgtattctttaaataattttttcaccacagtgccctctaaaattaaattacattcaaattttcttttagtttcacattcttttccagttaatcatttccaataatatgcaaaactgcaagctgagtatagtttcaaagaatgctaattttttcccctaatttaaaactttctgttagtgattggaagactgaccaaagggtcaggtagtaaagcacagtttaatcatagaatctcaggactccaaagggccttaacttctccagtcttgtaactaatgattgaattcttccataatattcccaagaaaagattgagttctggtattaaacctcagagagcaaagtagtcactacatcccaagacagttcatttcatttttggataactccttaagtattaaaaagctcatctttgcatctttctgtaacttctacccagtcatcctaatcctgacttttgaaaccactctgaacaattttcatccttccgtatgataaccgttcatctgtttgtagacaactaccatgtccccctaggtcttatccaagttaacttccctagggtgatttggccattcttcatataaactggttcaaaatctcttcagtatccacaaagtacagggcctgaactgaacactctaactacaggtagtacagtacagccgatccagtgcacagtagcattgggctatcacttttttgtgttctgggccttaaatttccctcgagttccccaaattgcattagctttttggacaactacatagcactgatggttcatactgatcttgtaatcaagtgaaaatcctaaattattttttaaacaaatgtcactgttaagctaactctctcaattctggtacttatacagatcatttctatgttaagactacgtaattataacaaataatttctgatgattatattaccaaggttaatgggatgaaatgaaatgaatttattttatatgttatatactggccatatataatgactttgtttctgttgctctggatctatatcctgttggtatttagaatgtcatgttcttcgtattttattgtacatcttgactgggggggaaaatagatgcattatgtttacctggacattttctccatattaatctttttctaaagtccatgaacctttcacctaaattgtttatttttaaagctaattttgaactcccccccaccgcccaccgctggtatgtcagtattcaaaatgtatttttctccatgcttctagaattaaaatacttcctgatggtcaaaatattgtcatttcttagcacacctttttttgtattcttgaaataactgaatgttacgttttaaaaaatagaatatgaataaattagagataaattatttctcttagaaaaagcttttctgctgtttaaggtacttttgaaattttggtaattaaggttgggcacggtggctcatgcctctaattccagcactttgggaggctgaggcgggcagattgagcccaggagttcaagaccagcctgggcaacatggcgaaaccccatttctccaaaaagatgcaaaaattagccaggcatggtgacaagagcctgtattcccagctacatgggaggatcgcttgaacccgggaggcagaggctgcagtgagctgagatcgcaccactgccctccagcctgagcaacagagcaagaccctatctcaaaaaaaaaaagaaagaaattccgtcaatcatttaattatttatcaactttaaagcagaaagccattttcctgtcagtttgaaatcccagtccctagtcctccaaatagaaaggaattcatttctttatatgttgcatatagtaaaaatcatttaaacatatttacactccccctacctgaaactcagctatttaggaaacttacttatccagaatacaactagaaacctagaaaataactacaatagcagcaaaattattcctacccttaaaaatccactcatgctcctcacaattgagcatctaaagacactctctaaggctgacttgctcccatgttttaaaaagttgtatagattcgtgttccttcataccttgcacatgctattccttctagttggagtgccttttgttattttatctatctggttaactcctactgttctggaaggctgagctaacaattatctcctctttaaagcaggcttaccttcaccatcccgagttggatagccctattccttctctctatattcccataactatctgggctacatacctccatgtagcattggatgcagggacttacatcaaagactgtgatttgtaagagtaagggggaccatggctgagggtatctaggacctagcaagcacttaggaaattgctattaaatgaaataaactggttgctagtcaggttctagttaatagcagattataaaagcaacaaattaggagaacgcagaactaaagcatagtgagagaaaagaaataaaagcctgacaaaaatatatatgatatatactgagcagacaccaaaacttggaaagcgcaacagcctttcaatatgaaagaaatcaactcttgcatacctctgaagttcctgagggtgctttctgttctacagcctaggtctttaatcagtatctacaatgacaactctgagtcatcaagaaaaggttaaattatgagcagcattctgtgtaaaagaagtcaggaaattgtagaaagccatacaaaattatttaactaaggtgggcactgtgactcacacctgtaatcccagctacttgagaggccaaggcagaaggatcgcttgagcccaggagtttgagactagcctggggaaaatagtgagactctgcaaaaaaattattaaaacaaaaaggattgtgcgcataaagattcaaatcacaatgtatttaaaaatgtagctattcagaacaattctccccctgagattctggtaggaaggttttattgtattatcaaaatatataatatttaaatatttgtccaaaatatctcaaactgccatttaatttagtttgctaatttgtttccttttcttaaaattttgtggtcaaagtcctaaaagtcaagaagaagtatcagcaaaaacaaggatttttaggaagttggtgtatattaaagattaactccagtcctttttaccttctactgatttacatgaaataaaagagccttcctctacattctttctaccatggtttttcccctatcatctgtgagcaaattattgaaccaaacaacaggcatcttcccgaagattgaacactaattctccagaattgggtagtcttcgtctagctaaatggagagaaccttctcaggatggctgggactggccatggtcgctctgattattcccaagttaaggcccccattttgagtggcttggcccaggaagtggtaggagtcaagttgagtttcaaagcatcatccaaactgtcagcaggtacctaactggtaccctggtaccaattgaatgatactggtttcccctactcctgctagctcctgtccatcagaacaaggctaattctccagtggcccctccctgtccaggctattaatgaagtatggaaggcttagttcccatccctgcagcttcttcgtgttacttgaggaagcaaaatggggcaatacagaaataaaagtatttctctagccaggtccttctagtcaatagttttcactgatctatcgtacattttaaatgaaaatattttcactactggaaccctgaacttaagcttttctattatggggggaggaagggaaaccatatgatctgcagcaaaggtacatcctgatacacaagctaagagctcttttatctttctgcatcccaactgagtttcataatcatgaacagaacttgatatattctctctagctgaaccagaagatctctaaggtcttttaaaaccacagttctgagttctagataaagtattgcacaatcttcaaactaaaaattatcttgaactcagtatgatgaaagagagagacagagggaggaagggaggtggctgggcttgcatatatctagaagagctgccaagtctagtgggcagtgccccatcccacagtgatcttcctgccgggtacaagcctttcattccacaatagaagacttcttttgggatactgagttaaagatagttatgaatgtgcaaacagctagtatcagattccttacagaaagctaatttttgatagagaaacaaaagaaaactctttaaagaagatgaaagtcaaagaggattgaatgggaggagcttcataattttgcttttgtttatgccatatatttgctctcattctcttcatatgttaatgttaggaggaagctaaaaactcctactataacaaaatattactaactattgttaattgctataattaacccataaaatcaactgaacaggatttcagagtcaaattcatatttcaaataacagttctcagcatttggtttcattggggaatttccatttggcagtcaagtcatcttttttccaccgatttttttctcatgacttcctgccccctcctctcctttcccctgcctctgcctctgcccagggtaggcctcccaactctttcctggacagctacaggctctgcctgttgactctttcacctgcctctgctctatatatttggtgactttcaaccatgtgaaaattagaaaatttaaacttcttcatgaggtaagaaccacataaatacctactacgtagcatgcagaattcaatagggagtgccagtgtacaagacagaatacctattctgggctcaatgttttcaggaagcaattagataagtaatttttttcacctatgtgaacttgattttatggagaggtggaggagtggtgagagtatatgtattggtaaactttttatttggattgttattgttctattatttttagttttcaagtgaaaatcccattttatgtaaacatttttccttaatgttgttttaaatgtaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataaggtaatgcatcatgaacattttctttttccattgagattaatttatcctgaaaaatgtttttttgaagttactgtctgtctttgcccactaattgactgccaggtagttaccccatcagagaaaaggtctttgcttacatcattgatccagtggccttggtaggcaacataggcctcaagtaaatttctgagtcattgtcagctgagctatcaccctggtgaagaaaacatttatgaaccttctttgtgtaatttgagaaaggggcttcatttttaaagccttctgcttaatttgtaaagttaaaatggaatttcatccaggtataattttagtcattctttatcttaattttaaatttaggccagcacagctgaaaacatttgccatttacattccaggataaactgaaatgccaggatgacaactgcatttcatgatacaatatagaggcatttcagtgtggcttaaacattcctattcttctttggctattaggtgttggcagcctcatgtactatcacagacttgtgattagtaaatcattactttaactagtaaaaaattgaaaattcattactgactttatgaatagcgatatcacaaacacctaaggacttcttggaaataagtaagcttaaagttgatttcactaccccagcttttagactcctttgccctgtcccacaaggtacgactgacagtgactaggaggctgggcatgggaagcatggggatgtgtgtgtctgggtatcaggttaaggctgtttaagttggggaaattctttttcctctcattattactgaaactcatactttctattcaacctcatcactgtttcattttcagccatgactgacaacataaaaccaaaaacatgtgtatgtaacactggactctaaaactatgaggcccctaaagttttctcttcaattcctcggtaatgttagaattttatatgggacttggaaaaataaaatttaaaaagaagaaaagtaaagtggttccagagttacagtcttatccttttaagccataactgaagtttatggagatgagaatggtatatacttttgttggtttatttacctcactcaccatcagtttatgagtgcatataagtttgtcttttgttttagttagtttaagatatataccaaaactctgttaacagagaaagatgttttcagtgtagcatattctgctcctcccagagtcagctggccactggggaataaaatcaatacttaccaggtaactaaatgtctcaggaaactgcttgtaagtagtcatccctcttcaatccagggaagttgtaagttgctctcaggaatgcacagccaaattctggttgaatttagccaagtgaaatcacagatactaacgttttaaaagaaacatgattagtgatacatcagcataataataatactagcaataatgatagctaactcaggcatagcacatagcatagcatactttacataagtaaagtgcttagaatagtttaattcatttaaccctcacagcaacttgtgaggtaggtaccatataataataatcccccacctgcgtttttgagttataggcatttgctaataatagaattcttcctttgtgtttgttcagttgttaacttcctagtttccaaggcaatgtgcttcattccaacagactctggtattttatttcgtctatttttaaaacattgaatagttatttttgtttcttggtaaaaagacttagactattcacatatgtgcaaaaattaagtcatttaaaaattccctcttcctagtattatagtaagtcagatggatggtggcagctacatcataatttttttttgtacctggggtttgaagctttgaggttaataatttatttacttttttacttggctaacctcacctctcatttatcttcaggactttccttacaaaaagcctaggttttcaccaccttagtttgaagtatagatccatctctaccatctatgatgaatctcggcctttttcttttagtatactgtcatatgattctgtcagcatttatttttctatcttttattatcaaaaatttcgaacaaaaatagtagagagaatagtataatgagctcccagcttcagtaacacagacaatcttgttttatctgtattcaacatattattacattattttaaagcagatctcagctgggctcacttgagctcaggagctcaagaccagcctgggcaacatagggagacctggtctctacaaagagtacaaaaattagccaagtgtggtggcacacacttgtaatttcagctacttggaaggctgaggtggcaggattacctaagcctgggaggtcaaggctgcaatgagccatgatcacaccactgcacttcagcctgggcagcagagcaagaccctgtcttcccaaaaaaaaaaaaaaaatagatttcaaaaaaattatttcatcaccttggtggttcttttttgagacagagtcttgctctgtcacccaggctggagtgcagtggcacgatcttggctcactgcaacctccccctcccaagttcaggtgattctcgtgactcagcctcccgagtagctgggattacaggcgcatgcaccacgacacccagccaatttttgtatttttagtagagacgggggtttcaccatgttggccaagctggtctcaaactcctggcctcaagtgatccacctgcctcggcctcccaaagtgctggaattacagctgtgagccaccgcacccggccacatttcatcaccctaatggttctgagcaaaagaactattaacaaaattcttgatctctatggatattttaaagaaaagtttgatgacaccttttaaatgcagtactttttttttctttttttacctccagcagttgcaaatgtgagaccacattagaaaatactgtttcactggagtatatgctaacacttaacctcaattaacttctttgtaaagggcaaaaatatatttcccaaaccatatataagaagtgtaatgtcatatcattattacagataaccagttagtatatacacagcaagattctaagctgctatgggtttggtattcaaataagtaagattgttttatagccttattttgttcccccgtatagattcaatctccccaatttgttttagctactcttctcagctgaaggaatagaaaatcctgtgttggactgtcttgtaaaaaggacaagggagtatccttctaaacctctactcatttcagaaatcttaccacccctttcagatgatttctcaaccactttgtcaaggaaaaattattcagactttaaagagcacattcgctccaggatagggagaggaaacaagtctacccaagccctgtctaatcacttacctcatttcaaactggtcagttgaccacaatttcactaggatgaaaagtgtgggatttcatccctcccaaagtgtgggattacaggcatgagccactgtgcccggctggataatgataattaaacagccttatggcattagtcttaatgggatttgacaagcagaagtggctactatttgaaattctgcctgttggggggaaaaatgaagcacacttcaattttaagggctatccccaacataaagacacttttcactccccatcttcaagtacaaagtctcacattagtcagagctaatgctagcccttgctcaaattgtgatgattcatttatactgcagtgcaagtactgcagtttcatttggctttaaaatgttgtggagtttattcttcatctttcttccttagaaggtgatgtaggtctctgcctgttaaagccatggctttgcttgaaggtcctggcactgggtagctcacataaactcaccccatcagtaaacctgttgatattgaacaaggaatgagaccctactctgtctctgtctcctttccccacttgccttcccaaccccatgccctaaccactctgatttttttttaaatgattctgggtctcagacatatcccttttcccaggagccttctagcacttggctcacagatccacagcctttctcataagtcctgtgtcttttgaacaattcataattatttttgtttgattttaatcaatataccatgtggcttagttgtctcatctctaaaagagacaaaagtaacttcactgaggacagtattcaagcaaatctgttattctgtgggacctacggtagtagaatactttttcctaaacaccgaagttgatatgcagtgaccaaaatatcctattaaaaactttgcacagttcacaattattgctaacctcgattttttaaaacatatcttaaaaatatttctttaaaaattttaagttttattttagttctttctggatcgatgtattctagtctccctagctaaggatctaaagatagaaactggaataatgaacattctagtcttcaattattgaaaatattatcacttacataacaagaatatgggtatggaatatttactaacacaaattcttatgtagtaaagaacaacagaagaattgcatttgtccttttcttagaatgcaagcctttagaatcaaatttctgttctttgctctcagaattttattcacattgaagcaatataggaatattaaataatagtgaatgttaatgtctcatttaaggtaactatgtagttttcctttcctcctcctcagatgaatccaaggcagtggagccatatctctgaaagtgccaaagacctagtacgtcgcatgctgatgctggatccagctgaaaggatcactgtttatgaagcactgaatcacccatggcttaaggtacatgagcattcacaggtcaccttctacactttgtctgaacacttccagtgacaggaatgcgttgctctatgagatggtcctttttaccttttcttttttctgagcagttttcattagtttttttcatcttgtttgctgttcctgcacatcatctgtgaacatctgaatagaagacataccatttgagtgtcatgcagctatcagagggtaaaaaacaggattaagacagaatatatcaggggaaggcctcttttttctctgccaacatgtgttccaaagatatgcaacatcaacaactgaagtaataccatgttataataaattaactatctttattttgggtgtgactgtgtgctttatagcattaactatttttcagtagatactaggtataaattttctgtcttaggaaaacggcaggtttttttttttttttttagacaaggtctgacaacattgcccaggctggagtacagtggcaccatctctactcactgcaacctctgctcctgggctcaatcgatcctcccactttaacctccccagtagctgggagcacaggcatgcagtaccacacctggctaatttttgtattttttgtagagatgggggtttcaccatgtcgcccaggcttgtctcaaactcctggactcgagcgatctgcccgcctcagcttcccaaagtgctgggattacaggcatgagccactgcgcccagccaaaaggcagattttaaaagttcattttatatcccatcttgccagtgagtattaaggaaaattataacttgggacagcagtgaaacagtactttttgattaaaacattatacagcccaataattccaggcaattttcattttagatgttagaaagactaacgcttggagaggttaagaatttgcgccaagttggccgggtgcggtggctcatgcctgtaatctcagcactttgggaggccaaggtgggtggatcacaaggtcaggagtttgagaccagcctggccaatatgatgaaaccccatctctactaaaagtacaaaaattagcctagcgtggtggcgggcgcctgtagccccagctactgaggaggctgaagcaggagaatagcttgaacccgggaggcagaggttgcagtgagccaagatcgtgtcactatactccagcctgggtgacagagcgagtctccgtctcccaaaaaaaaaaaaagaatttgcaccaagtcacagaagttgtcagtggtgaaaccaggattctaattcagcctaccactaccctttgattttgcactagatcctatccctttttatttgaccacattgacccaacaacttcctcccttcctgcatcatcagagttctctctctgttggatctaacatgctataggttatttgtattatgcacactcttatatagacataataccttctcctgaccctacaaccccctccaggttttgcccctattctttgcttcccttgacagcaactcctgaaaagagttgtatagactactcacattgtccagtttcccattcctttcccatgaacccagtctagtcaatatcacaatcttatttattccactaaaacagctctggtcaagtcactactgaccttcatgttgctaagtccagtgttcaaatcccagggcttcttcttggcctgtcagcaacatttgacatccatccttctgaaacactgtcttctctgggcttctggaacacctgctctcttggttgtccttctacctcctggctgctccttctcagatcctactgattcttcctcatctcccctctcccacctcttcacactggaatgccataggcctccatccttgctcctcctctttttctctgttgaagctgaaaaaactcaaactgctctcacaccacacagcaacaatcaatacagaagacttctgtgaccagaagtgtggagatttcttcccaccaacaagcaagcaatcaactctgcagcagactgcagctgggtgtcctcccaactaaattcaaacactatctacctggagatagcatcagatcccacagattgagggctcagtcccacaaccctcacctcttcagacaccagtcataagtccaggccgctgaaacttctgccaaccaactacaaattggggacaccacagcctcttcctctttggggttggttaatttgctacagcagctcacagaattcagggaaacatttacttatgtttaccggtttgttacaagagatattacaaagaatatagataaagagatgcacaggacaagttacaggagaggaggggagcagagcttccataccctccccaggcacaacaccttccaggaacctccatgtgtacagctattcaaaagctccccaaatcctgtccttttggggttttatggaggccttattactataggcatgattgattaaaccatcggccattggtgatcaacttaacctttggtacctctcccctacccagagattgaggggtggggctgaaagtcccaaccctctaatcctgcctgggtctttgtgaccccatcctgaagctgcctagaggctgccagccatcagacatctttggcgtttctaaggattttaggagttgtatgccaggaaatgagctagaggaccaaatatatatttcacagtatacctctggtcttcaaacctggattccttacattaaaaaaatataggccaatgtggtgaaaccccatctctactaaaaatataaaaattagctgggtgtggtggcaggtgcctgtaatcccagctacttgggaggctgaggcaggagaatcgcttgaacccaggaggcagaggttgcagtgagccaagatcacgccatagcactccagcctgggctacaagagcgaaactctgtctcaaacaaacaaaaaaaaaagaaatataaaagaatatataattcaaaagacactgccacattactagaatctcattcaggcattgataattagttcagtccatcatcataatgtatgaataggtctcccagcatgaggccactcaggtttgcaggctttccattgatcttgccaggttctaaaagcaggaatggtcttggtttcaccgtttcagacacctgatataattgagctaagaaacagtatcctttcttgctctgagtctctttcaaggtgttaatgtaatgtgataatggatttccctgaattcataacacatttatttattcctttactctcagctgttaattttttcctcactttattaataacctttggaagaaacattagaatcaacatcgtgctggtctagatggcagacagcaatattagtctagtaattacctcctcctcagtccactcccatgcagggagactaaggttacataggtgccaatttagtggaccgtttttaccaccaggcaatatagctgcattcacaattaacccgttttgcacaacccacccccatcaggtccttaggaattctgacacaaggtttaaaaacatagttacaatttcttgtttaggaatcatccctggttctaacactggtagttatggctctggtcctagaaccactgcatagggaggggcagggggagtttagatgatatgggaaagaaggaaagaaaaaagtatagtcattatatcagcatactcccctcttgtcaagaattgcatagtcataacagcatcctctaccaccccccttccccagatcaatcagaaaaacgaaagaatatctagtggggacactcctttagccccactcatgttgagtgtgagtacacactggtaaaggcaagtaagccagcccttcctgctttcatctccccctgttttagacaaccaatgttttcattgcccattttagtctctatcaaactattactctgagaagaatatctctgcccactgctggaacattatgggctgtaccgtgtgttctttggcctaaagaaatggtgttcagctctccaaatatgtgcaatatcttctgttctggcttttttatggtattctcatcattcacatcttccaccgggcaagcaaagcccagtccagaatcagtgtctactcctgtcaaaacccatctgtggcctcccagggttaccagcatcagcctcacttgccagcttgttcagggctttcccaccagggaaatctgccccacagccatgggcagtgtctgtctcttttgctggcagacagaacagttcttattggcattttgtgcctgaaatgatacaaaagaaacctgtctagatgcagcccatctctgcactgttgcagtacccgtttatccactcatttgatggacccaggtggccacctcgagggagcacacagggttctctgcttgtcaatgtcaatcattttccaaacccagaaagaggctcttatgatgggcatcaacatattctacttattgcacccctcaaatttccatagggccattctccatatgggcatccctttaataaataggccaggtttccactgcccttctgcctgaccatgtgaccaggccactggtgactgtccatgagtcagtaaaaaaccaaacacgggagcttttgttattgttcatttcttcagaatgcaattcaactgccaagctaatgtgatcttaccttctttgatcaagagtggcatccttccaaacaggatgctgtcgattcaccttggaactgtcatccacacaccaagcagctcttcgttggtcagttgagagctgttcacggggccctgtccaagtgtcagtagaatcccacagttcctcacacagttccagagtcagtcctaggggaaaagaggctccctgcttgaggatgtttcctccttgcacttcccggagaggatgttcctgcataaaccatttccattttattatggaactattctgggcgctgccatccccatttgaatgtttctctgacatcatgtgagaaagcatgggtatttcaggtgtcaagatcattttatgtccttcagtcattagggatagtttcagttaatgtcccatagcaaggtagtaaatgcaccgagatggaaattctctagtgcaaagtcctagtggttgtcactgggagatgctcacagactttggccataagccccagtaaacatcctgcaaagggcgagcagatggagaatttgtccctaccagcactccagcttctcaactccacactgtgtgagctcaagcaatcttactggtgcctagttagcgtgtccaattaatatttctcgaagtgcagatttacatttcttctgttttacaatactgggtaggggaagtgttctccacccagtcataattatccagttccataaaacatttaggtaaaggagacataacttatttatgtatatcctgtttaaacattccaaatctcatactcctatcaaccctcacttttaccctttcttgtttaaaaaaaaaaaaaaaaaatgttgagtccccaacagcaggttgagccaagggaccttgccccttttgtcagtctttgtattgattaacctgcctcaacattaccccaagtaactgttggtcagctttctcactgtaatctctgccttctgactttttcaatttctccaaactggggtgaatacagcaaacctgtttggaatcccttaacattgggagaacagcagaagctccctaccaacctttgatagtattatattgagatctttgttttaaccccatcgatttccactttattcatctcatttctttttatttcttttttatttttttgagacagagtcttgccctgtcacccaggctggagtgcagtggcgcaatctcagctcactgcaacctccgcctcccaggttcaagccattctcctgcctcagcttcccgagtagctgcgattacaggtgcccgccaccatgcctggctaatttttttgtatttttattagagagggggtttcaccatgtttgccaggatgctctcaaactcctgagctcaggtgatccacccgcctcggcctcccaaagtgctgggattacagatgtgagccacagcatccggccctattcttcccatttcttattagccctctaaagattccaccctgctgggatgagtcccatgattctcctctttcttttttctcttagtttcaccccatcactgttttcttcattcaccttatttattaataaccatttaaactttccaccttcctgggatgagtcctgtgactctcctctctgcctttccccagtcttttgttaattacgctcatgttttcattggtgcccatacaaaagaggctccctcagccatagcatttactacagccagagtaatggatgtattcagtgagtgaatatctcagtcatcataaagccagtcccacatggcctgcataggaaccaaatgagccgcttcacctggggtactccacttggcattgataggtagagttggacagtctctaccttctcagggtgtacagaccttacagtggcttttattccattcactaggctgactgttccctcaggaataactccctgtgtgtctggatcacattatacccattgttgattgttcagtagtgagctgtgggtcctgcatcaacccaaacatgcctgtccactctgcagcatttaaaaccaaagaaagtgccctaaattagttattctcacaatccattttagtaaaggattttcagtaaactgatgataccaatctatgaaatgagacaatttcttcacactgtaccctctggtttcagtagtttcttggttttgcccttccctcacatcaactaccttcgtggtaaccacaggtcgtagaggtactgtcatccctgtataatttttcctttgggggtcagcttgaaggctagtggcctgggctcagatagactgaaatctgagcttggtctagcatcaaggcctcatccagcatttgtttcatttctgttcagctattacagacaaccaccaccaagggagtgaatatttcatctttttcttactagtttgcatatccttatgcatccagtgaaccaactccctgagttggatccatctctaaattccactggtaacttttacctttagcaattgattgcgacacagttgcagctccaaaccatggaagaccacgataatgaaccaggaatcaaaggttcctcatctcccaccctttcattctttctcttcccaaaccacatatttctgtgagccagggccgttctagcaaaccctacttcactgacactaactgaaggtggaaaaactcagaactgttttcctctgctctcgcaccacacaacaacaacaatcaacacacaagacttctttcaccaaatgtgtggggatttctccccattaagaagcaagtaatcagccctgctgctgggtattctctaattcaattctgacactatagtatcacatcccacagtttgagggcttggtccccaaggcctccccttcccaccctttcagacaccagtcacaagtccaggcctccagaatgtcagactgactggctacaaatcagagatcctacacctgctctttgggttccattaatttgttagatcagctcacagaagtcagggaaacacttttaccattgtgttataaagaaaattacaaaggatacagatgaagagatgcattgatggaggtataggggtgaagtgggaagcttccatgccctctgtggatgcaccaccctccaggaacctccatgtgtgcagctatccggaaactccctgaaccctgtccttttgggtttctatggaggcttcattaccattgaccattggaggtcaactcaaccttcagcccctctcccctccctggaggttgggggtggggccaaaagtcccaaccctctcatccctccttggtctttcctgtgaccacccctcatcctgcaactgcctaggggctgccagccatcagtcagtcattggcatacaaagatagcccttacgccattctaaggattttaggaattgtattccaggaaacggagctgtagaccaaatatatatttcaaaatatcacgtccatctacactccggcccttggagagctcatctagttttgatggctttaaatgctatctgtacaacaatgactcctgaatccaggcctctccccctaggtattctttcttaattctgtatacagtttggctccctgacacttgactcatgtcaccccttcctactctccctgcttactccattcccatcatatcagcctccttgctgttcttcagactgcaggcacatttcacctcagcacctttatatgacccttccctagaatactcttccctcagatatcatggcttgttccctcaccatcttcaggtctttgcttaggtatcagcttcttagtaagaccttccctgaccaccctatttaaaatgtgggggaaggaatgccaccagtattccctatcccccttcccctcccttatctttctccatagcatctgtcaccctaagacatacctatatgttacttatatgtttattgtctgtctaggtcataaaatataagctgcataagtctagggatttttggctcttggttcacttctgtctagcacctagaatgtatctggcatgcagtaggtgctcaatgaatattaatgatttaatcaatgaatgaatgttcgttgtattataccatgctacttcctcagattatgcaaaacaataaaatattttaaaagtagattaataatgtatcttaaggtgatgacatggaatagtattacaggacaattttgagatttcagtggatcttgattctccttaagaatattacttctcagcctgggcaacatagggaaatcccgtctctacaaaaataaaaattaaaaaattagccaagcgtggtggtgcgcacctgcagtcccagtgactcaggagcctgaggtgggaggactgctacttcaaaaatatgcattcacctctctgatactcagtgctagttattcctgatttcccctagaaaagagtagtgaacaatttttagatactttctttgttttgttttgttttttatttgtttgttttgccctcccagatatataatgaacactttagaggtaattcctatttctcctttacttttctcactttctccataacggggatcttttgttcattcaaagctggtttaaatgccaaataacaatgaaaatggcaggcattttagtcatttttcaaatctcttagaaggtggtttaacattataccatacctacttacagtgctttcaaagcttatcttggctaatagcatatttatttttggaaacctttgttcctgccaatgattatagttctcgttctaagtaatttgagcttaatacataataaatttctagcacaagaaagacaaaaaatgtcagtaacttaaatgaaaaagtttaagacggctctttgagctgagtatcgcatgccatgtctaaacaacagtttaacttcactacttatgtcatctgaagatggaaaaactcaattagaatgttatccagctggtaagagcaggcttatgttatatttcagtatttgtccatgtgtatttataaatcattactgtggatgtaagaggtatttttttagaatggttgaaatttaaatatgaaaaacacctggataccttgcaaattgaagaaataaaatgatactggttgcagtggcttgagcctatagttgtctcagctacttgagaggctgagtaagtaattactgagtaattactctaagtaattagagtaaggtgggaggattacttgagcccaggagtgaaaggctgcagtgagctacgaccatgccactgtactccaacctgggagacagagcaaaaccctgtctccacaaaaagaaaaaaaaaaacaaataagatgaagaaaaactttgtaatgaaggctacccaaagtcataataccattgctttgtgtcaaaaacaaaaaaaaacaaaaaaaaaccacaaaaaccaggcatgatgccatgcacctatagtcccagctatataattttttaaagttcacagccactgcaaaacatgccaaattgtaaagaccatcgatgctaggaagaaactgcatcaactaacgagcaaaataaccagctaacatcataatgacaggatcaaattcacacataacaatattaaccttaaatgtaaatgggctaaatgctccaattaaaaaacacagactggcaaattggataaagagtcaagacccatcagtgtgctgtattcaggagacacatctcacatgcagagacacacataggctcaaaataaagggatggaggaagatctaccaagcaaatggaaaacaaaaaaaaagcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacctagattcaaaaagcaggtccttagagacctaaaaagagacttagactcccacacaataataatgggagactttaacaccccactgtcaatatcagacagatcaacgagagaaaaagttaacaaggatatccaggaattgaactcagctctgcaccaagcagacctaatagacatctacagaactctccaccccaaatcaacagaatacacattcttctcagcaccacattgcacattccaaaattgaccacacagttggaagtaaagcactcctcagcaaatgtaaaagaacagaaattataacaaactgtctctcagaccagtgcaatcaaactagaactcaggatgaagaaactcactcaaaactgctcaactacatggaaactgaacatcctgctcctgaatgactactgggtacataacaaaatgaaggcagaaataaagatgttctttgaagccaatgagaacaaagacacaacatactagaatctctgggacacatttaaagcagggtgtagtgggaaatttatagcactaaatgcccacaagagaaagcaagaaagatctaaaattgacaccctaacatcacaattgaaagagaactagagaaacaagagcaaacacaattcaaaagctagcagaaggcaagaaataactaagatcagagcagaactgaaggaaatagagacacaaaaaacccttcaaaaaaataaatgaatccaggagctggttttttgaaaagatcaacaaaattgatacaccgctagcaagactaataagaaaagagagaagaatcaaatagacgcaataaaaaatgataaaggggatatcaccaccaatcccacagaaatacaaactaccatcagagaatactataaacacctctactcaaataaactagaaaatctagaagaaatggataaattcctggacacatacaccctcccaagactaaaccaggaagaagttgaatccctgaatagaccaataacaggctctgaaattgaggcaataattaatagcctaccaagcaaaaaagtccaggaccagatggattcacagcccaattctaccagaggtacaaggaggagctggtaccattccttctgaaactattccaatcaatagaaaaagagggaatcctccctaactcattttatgaggtcagcatcatcctgataccaaagcctggcagagacacaacaaaaaaaaggagaattttagaccaatatctatcgggggacttgccccgataatcacgtaggttcttttctatttttcttaagcgtcggccggcatgataaataaagggacagagtacaaaagagagaaattttaaagctgggcatccaggggagacgtcacacgttggtaggatctgtgatgcctttcgagccacaaaaactagcaagtttttattagggattttcaaaaggggagggagtatgcgaataggtgtgggtgacagacatcaagtacttaacagggtaatagaatattacaaggcaagtggaggcagggcgagatcacaggaccacaggactgaggcgaaattaaaattgctaatgaagtttcaggcactattgtcattgataacatcttatcaggagacagggttttgagatcaactggtctgactaaaatctattaggcgggaatttcctcttcctaataagcctgggagtgctatgggagactggagtctatcttacctctgcaatcttgaccataagagacaggtacgcctcggggtgggcgggggccagttcaaagacttactcctaggtgcgcattctctttctcagggacgttccatgctgagaaaaagaattcagcgatatttctcccatttgcttttgaaagaagagaaatatggctctgttctgcctggctctccagcagtcagagtttaaggttatctctcgtattccttgaacaattgctgttatcctgttcttttttcaaggtgcctacatttcatgttgctcaaacacacatgctgtacaatttgtgcagttaatgcaattattacagggtcctaaggtgacatagccttaggctgacaggattaagagattaaagacaggcataggaaatcacaagggtattgattggggaagtgataagtgtctatgaaatctttacaatttatgtttagagattgcagtaaagacaggcataagaaattacaaaagtattaatttggggaactaataaatgtctataaactcttcacaatccacgtttttctgccatggtttcagccggtccttctgtttggggtctctgacttcctgcaacatctctccctttctttttatataaatgtgccatggcgatgaaggcttgttcgttctctcgattttgacgcaggattctttgactggtccagcacactaaaaacaaaccgattaaacagagaaacttaattctaaaatttactacagtggagcccccaataggcttaatctaagtcgtggggtttaatctataaagattttctgccacctgatctaacgcctcagctccaggcagaatggataagtgagcttgagaggcttcaaaaatttgtttctttaattatgtctaatgataaattatcttctttacctagaaggtgtcctttgactttttcctatgaattatcagtctcattataggaatacggggtgatgcagaaatccgaagtattccaatcgcactgcatttgcaatgcgatgttcgagactcactacttgatctctaagccaaataacagactgtcttaaatcattaatttgatttgccaatttttgatcgatgccttgttgagaattccacatttgggtggaattggcttgccaatcattaacaaaatgagccctttgaatagattggtgtaatgccattctagcagtggtggccattgcagtgacagtaattaggcctatgataacagcaattaaagtgaaaacaaatctcttagatctttttttagaattcgctgtagcacttcattaattaaatgtattgagggggaggatacctaaggtctaggtaaagttaccggaacctagattccttcttgagctcgaaccaacattacacttttcctggagtcaaaatgggagttaatacaagtgtatagatgacaattgatgcatcggacggtttgattattcgtctaaattttgatatttcctactaacagtgtgtaaggaggcttaacacaactctgtatgggaatagtcaggttggaggtaagtaaagcagaatgtctgggtctacgttgatactgagagagtgggatggtaatgggaacaacagtcgaaatagttttcttttcctatactggcagtccagacatggcaatagccaatttttaaagttctgggtgttctgggctcagaatggggagtatcatacgaggcctgggggtgggtaatgcctttatcttcctattttaagagaaagaatgagctgatcctcgtatgcacagtagaatgatgattctcattctcctgataagaagtaaaataagtagcctccaggcattcctttccaccagaggagcaattgttttttaaatagccttttggtgcctagtctattactagaccatatgagtcattttttagtattactgcatgtgagttaacacagtcttcctaaattaaagttttagatgggccctcaaaatttttagggcatggttttcctgcaggtttatattgaaagtatggggtatctcctattactcctcctttcatttgttttaaaggagaaagggagagaccagagactaaatgtcctgttttatctgtagctgatgtttccggaagataagcagcctagacttgagttcgtagatggatgcaactaggtgcatgtccgaggcacagaggggggtatttataacctatggtaacattaaatgcagtgccttcttctcctggttgagcagggcaacggtcatctgtggctctaggcatccacacactatcgttagtgtagatttctgcaggagcatctatctaggtgagaggtcgaataagtggaggaaaaggcacataagcctaataagaataattatgtgtagcaggtaaatcagtgtgagaggaaactggtgagacagaaagtataaggaggagaatcattaaataaaacctagtgtaagcgagattgagtgctgaaggaggaagagaagaacagagggatgttattttcaggctaatagaaatggtgagatttttaggtttgtaaggagaaaaagaaaagtaatcaggagaagtgggattagttagatgggtctccattgccttcagggaggattgatttacacctattgtgatttgatgtgcctgtttctgaggaatcagcacagatctcatcatatctgaaggcagtctctgacacagacgtcttttctctgtggttttgattgtcagtattcacctgaagcttgagtcttctggtgggtacttagacaggggattgatgatctcctggtgaaacacaagcatatcctcttcctcatgttataattgtgccaggttcctaggtattggtttgggagtttttccataacactggcttgccttcgtttaaggaaaattttttgcctgtataatggcattcggctgcagttagagtattatctttaggaacatttaaaaaatttaaagtaaacaatgccaaatgtaattgggagtggggagttgttaaatcatgttttggttgttcagactgttgggacaattgggtttttaaagtgcgattgtaagggattctagtagtaggatctgtgatgcctttcaagccacaaaaactagcaagtttttattaaggattttcaaaagaggaaggagtgtgcgaataggtgtaggtgacagacatcaagtacttaacagggtaatagaatattacaaggcaagtggaggcaaggcgagatcacaggaccacaggactgaggcgaatttaaaattgctaatgaagtttcaggcactattgtcattgataacatcttatcaggagacaaggttttgagatcaactggtctgactaaaatttattaggcaagaatttcctcttcctaatgagcctaagagcctataggagactagagtctatcttacctctgcaatcttgaccataagagacaagtacgcctcaagggggccagttcaaagacttactcctaggtgcgcattctctttctcaaggacgttccatgctgagaaaaagaattcagcgatatttctcccatttgcttttgaaagaagagaaatatggctctgttctgcctggctcaccagcagtcagagtttaaggttatctctcgtattccttgaacaattgctgttatcctgttctttttttgaggtgcctacatttcatattgctcaaacacacatgctgtacaatttgtgcagttaatgcaattattacaaggtcctaaggtgacatacatctttctcggctgacaggattaagagattaaagtaaagacaggcataggaaatcacaaaggtattgattaaagaagtgataagtgtctatgaaatctttacaatttatgtttaaagattgcagtaaagacaggcataagaaattacaaaagtattaatttgaggaactaataaatgtctataaaatcttcataatccacgttcttctgccatagtttcagccagtccttctgtttaaggtctctgacttcctgcaacaaatatccctgatgaacatcaatgcaaaaatcctcaataaaatactggtaaaccgaatacagcagcacatcaaaaagcttatccaccacgatcaagtcagcttcatccctgggatgcaaggctggttcaacatatgcaaatcaataaacataatccatcatataaacagaaccaacaacaaaaaccacatgattacctcaatagatgcagaaaaggcctttgacaaaattcaacagcgcttcatgctaaaaactctcaataaactaggtattgatggaacttatctcaaaatagtaagagctatttatgacaaacccacagccaatatcatactgaatgggcaaaaactggaagcattccctttgaaaactggcacaagacaggaatgccctctctcaccactcctattcaacatagtgttggaagttctggccagggcaatcaggcaagagaaagaaataaaaggtattcgattaggaaaagaggaagtcaaattgtccctgtttgcagatgacatgattgtatatttagaaaaccccatcatctcagcccaaaatctccttaagctgataagcaacttcagcaaagtctcaggatacaaaatcaatgtgcaaaaatcacaagcattcctatacaccaataacagacaaatagagagccaaatcatgagtgaactcccattcacaattgcttcaaagagaataaaatacctaggaatccaacttacaaaggatgtgaaggacctcttcaaggagagctacaaaccactgctcaatgaaataaatgaggacacaaacaaatggaagaatattccatgcttatggataggaagaatcaatatcatgaaaatggccatactgcccaaagtaatttatagattcaatgccatccccatcaagctaccaatgactttcttcacagaattggaaaaactactttaaagttcacatggacccaaaaaagagcccgcattgccaagacaatcaatcctaagcaaaaagaacaaagctggaggcatcacactacctgacttcaaactatactacaaggctacagtaaccaaaacagcatggtactggtaccaaaacagcatggtactcgtaccaaaacagagatatagaccaatggaacagaacagagccctcagaaataataccacacaactacaaccatctgatctttgacaaacctgagaaaaacaagcaatggggaaaggattccctatttaataaatggtgctgggaaaactgggtagccatatgtagaaagctgaaactggatcccttccttacaccttatacaaaaattaattcaagatggattaaagacttaaatgttagacctaaaaccataaaaaccctagaagaaagcctagacagtaccattcaggacataggcatgggcaaggacttcatgactaaaacaccaaaagtaatggcaacaaaatccaaaattgacaaatgggatctaattaagctaaagagcttctgcacagcaaaataaactactgtcagagtgaacaggcaacctacagaatgggagaaaatttttacaatctacccatctgacaaagggctaatatccagaatctacaaagaacttaaacaaatttacaagaaaaaaatcaaacaaccccatcaaaaagtgggtgaaggatatgaacagacacttctcaaaagaagacatttatgcagccaacagacacctgaaaaaatgctcatcatcactggccatcagagaaatgcaaatcaaaaccataatgagataccatctcacaccagttagaatggcaatcattaaaaagtcaggaaacaacaggtgctggagaggatgtggagaaataggaaaacttttacactgttggtgggactgtaaactagttcaaccattgtggaagacagtatggcaattcctcaaggatctagaaccagaaataccatttgacccagccgtcccattactgggtatataaccaaaggattataaatcatgctgctataaagacacatgcacacgtctgtttattacagcactattcacaatagcaaagacttggaaccaacccaaatgtccatcattgatagactggattaagaaaatgtggcgcatatacaccatggaatactatgcaaccttaaaaaagggtgagttcatgtcctttgcagggacatggatgaagctggaaaccatcattctcagcaaactatcagaaggacagaaaaccaaacaccacatgttctcactcataggtgggatttgaacaatgagaacacttggacacagggtggggaacatcacacactggggcctgtcgtcgggtcgggggaggggagagggatagcattaggagatatacctaatgtaaatgacgagttaatgggtgcagcacaccaacatggcacatgtatactataagtaacaaacctgcacgttgtgcacatgtaccctagaacttaaagtataataaaaaaaactataacatgaaaaaaataaataaaagtaaagttttttaattaaaaaaaagataggaattatttctttgataaaaccaccaaaaaaaagttctattcacttatttcacatcaaaaaagaatttgagtgttagaccaagtaatatgttaatgtcttatgactgttaaatgatacctatttaacacctttatctctctgaattaatgatacttggtgtgaatatttattccaacaaaagtaggccatctaagattatattttcctcacagatggttgagctcttctcacaccctctatagccttaatatatagactgtaaagtatactgtcattttaaaaaaagtgaaaaggatatttatatcaggctaatcaatttgaattttgggtaatgaacacaccaattacccgtgttttccaaatctcatgtgcacaagggactatgaatcatgtacttcattaaagtgcaaggcacattactattgaattttttctgaattcatattacattattattattagtgtcaggagatactatttaattcagaaaaaacagcctggacaacatggtgaaactccgtctctactaaaaatacaaaaattagccgggcgtgatagcgcatgcctgtaatcccagctacttgggaggctgaggcacgagaatagcttgaactgagaatgtggaggttgcagtgagccaagatcatgctactgcactccagcctgggcaacaagagtgagtctctgtctcaaaaaaaaaaaaaaaaaaaaaaaaagacgagataccttaacagacttttttttaaatcttgtgattttactagcttagaaaataattgatatcataattgaagcataattttatttaaaaaaatacattttgactctgtcctcacctctctttccacatcaccttagtgaatggtgagcagaaaaggtgtttgctaaaaatagagttcacagtcagatatgtagtaaacttaaacatatttgcaatatgtaaagaattctcaaaactcaataataagaaaacatacaaacaacccaattcaaaatgagaaaagatttgaacagatacttcaacaaagaagataatacagatggcagataagcacaggaaaagatgttcatcattagtcattaggggaatgcaaattaatgccacaatgagatacctgtaaacatgttttacagtggctaaaatcaaaaagactgaccataccaattgttgacaaagatatagaacaatggaggccaggtgcggtggctcacacctgtaatcccagcactttgagaggccaagacaggcagatcacaaggtcaggagatcgagaccagcctggccaatatggtgaaaccccatctctactaaatatgtaaaaattagccaggcgtggtggcaggcgcctgtagtcccagctactcaggaggctgaggcagaagaatcgcttgaacccaggaggcagaagttgcagtgagccgagatcatgccactgccctccagcctaggcgacagagcaagactccatttcaaaaaaaaaaagaacaatggaaactcataacactgttagtaggaacgtaaaatggtataaccactttggaaaacagtttggcagtttcttaaaagttaaacatactcctatcatatagcccaggcattctactccttagtatttacctaagaaaaatgaaacacatcttcatacaaagacattaatattcatagcaactttatgtgtaatagccaaaaaatggaaacaactcagggtccatcagcaggtgaaaggataaattatgatacatgcatacaatggaataccactcagtgttaaaaaggaatgaactattgatacatgcaacaacatggatagattcaaaatcattatgctatatgaaagaagctggacaataatgagcacatactatatgattcaatttatataaaagtctagaaaatgcaaactaagtgacagaaagtagatcagtggctgactggggatggggatgggggctacaaaagggcatgaagatacttttgagcatgatggatgtgttcattatcttgatcatggtaatggttttatggttgtaaatatatgtcaaaacttatcaaattgtacattttaaatgtgcagcttattgtatgtaattatacctcagaaaagctttttggagaaaacaaaaaaatatatattcagagtctatctctctttcaccctttttattatttccagctggtttcatccaccatcatctttcacctggattactgtaaaagcctcctaactagtcttcccgctttttttttttttttaaaccctcatctccttccaatctattctcggcaaaactactaatgtttatttacagttcagggttgaaggctgggcgtggtggctcgcgcctgtaatccgagcactttgggaggccaaggcaggcagatcacgaggccaagagatcaagaccatcctgcccaacatggtgaaaccccgtctctactaaaaatacaaaaattagctgggcgtggtggtgcacacctgtagtcccagctactcgggaggctgaggcaggagatttgcttgaacctgagaggcagaggttgcagtgagccgagattgcgccactgcattccagcctggcgacagagtgagactccatctcaaaaaaaaaaaaaaaaagttgagggttgaaaatttacctattagttctgtaattgctctggcttggatatcttgtactgtgttgaataaaagtgagggaaaacaagaaaaattacctattgaatacagtgttcactatttgaatgatgggcacactagaagccaaacctcactgttatgcaatataaccatatagcaaacctgcatatgtaaccccagaatctataaaaataaagtcagatcatgtcactctagctcaagaccctccactggcttcctctcctactcagaataaaagccaaaggcccgcatggcctaccccagccttgtcatctctctgatctgacccgctattctccttgaccccttcacatcacttcacacacattggtctcctggctacttcttgaaaattccaaacatactccctccattgggcctttgcattggttattttctctgcctagaccactccctcacctcttctaaatgtcactttctccattgggcctactctgaccacccaatttgtttttgtttttgttttttagaaatggggtcatgctctgttgcccaggctggagtgcagttgcagtcatggctcactgcagccctgacctcatgggttgaagcaatcctcagcctcccaagtagctgggattacaggtgcatgccaccacgcctggctaattttttaattttttcatagagacaggttcttgctagatcttgaactcctagcctcaagtgatcctcccatctcagcctcccaaagtgctgggattacaggtatgagccaccacacccagccaaccaccctattttaaatatcaaggtacccaatccctcttacctgctttacttttttgccttattccatagtacttttgacatactctacaatttaccttttttgtgttttctcatcttcttgcactagaatatgatctacatgagggctggaatctttgttggttttcctcatgtatgccaaatgcataggacaatgcctggcatataatcagctcttgaaatatttatgaaattaatgagtgcttatagcatatgaatcctcaagatacattggcaaattagagtaggaccaaagtggggagaagagtaagaagaggtttaaaatacacatgagggaccaggcacagtggctcacacctgtaatcccagcactttgggaggccaaggtgggaggaccccgtgtgagtccaggagttcaagaccagcctgggcaacatggcaaaaccccatctctacaaaaaatacaaaacttagccaggcatggtggcacttgcctgtagtcccagctactcaggaggctgaggtgggaggattgcctgagccagggaggtcgaggctgtggtgagccaggatctcaccactgcactccagcctgggcgacagaatgagaccctgtctctaaaaatatataaataaataatgggggattcatttatttttgagacagggtcttaacgctgtcacctaagctgcagtacaatggtgagatcctagctcaccacagcctcaacctcccaggctccaacaatcttcctgcctcagcctcccaaagtgctgggattacaggtgtgagccaccacacctggcttgcagtgagctatgatcagcccactacactctagcctgggcaacagaggaagaccctgtctcaaaaaaaaaaaaaaaaaaaaaaaaaaaaaaaagcgtgtcctaattagaagagtctgtaattgttatagtccatgacaacgtagaatgctgaatcagttgtggaattgatttttcaaatgcttgttttacctggcaaatcatgtcaaaggtaacctgaggccaggcagagtggcttacacctgtaaatcccagcactctgggaggccgaggcggaaggatcgcttgagctcaggagtttgagaccaacctgggcaacatagcaatactccttctctattaaaaaaaataaaattagccaggctggtgcacttatatcccagctactcaggaggctgaggtgggaggatcactttgagcccaggggtttgaggctgcagtgaggtatgattgtgccactgcacgccaacctgggcgacagagtgaaaccctgtctcaaaaaaaaaaaagtaacaatgcctttataataattacgatttgttattttagccacatagccatatatatgaaatttacgtgacctattatttcagccctttattgctgaaaatgaaatattattttattactatcagtttaaccttaatatccctcatttcagattgcttaccagtatcatggaataaaatctccaatctaaaattcaatctgagttttatatttaagaattttagctttattatttgttttagattaagcttctgcacttttttaaacggttatatatgttcattatctttcatcttacataggagcgggatcgttacgcctacaagattcatcttccagaaacagtagagcagctgaggaaattcaatgcaaggaggaaactaaaggtaaattaaacaaatcagcaaaaaagccaaacagatatagttaatgatcatgtttttattctattttggtgcccataaatatgtactaatgctggccattgtttttgttgtagctaaattctcatttccaaaaattaccaccacttcaataagattttggctttttaaattatttaaggtagtatatcagtatgagtctgaacaataaattataatagaagattagttgtattttagatttgtcttaaatttatagcagagatatattattatccattattattgaatatgaatctagaccatgttttttcaaacttaaatattttgacaaatgtatgtttagttcaatggaaataactttgaattagaattggaattaggggccgggtgtggtggcttatgcctgtaatcccagcactttgggaggccgaggcgggcggattgcctgaggtcaggagttcaagaccagcctggctaacatggtgaaaccccgtctctactaaaaatacaaaaattagctgggcctggtggcaggcgcctataatcccagctactcgggaggctgaggcaggagaattgcttgaacttgggaggtggaggttgcagtgagctgagatcacaccattgcactccagcttaggcaacaagagcaagacttcatctcaaaaaaaaaaaaaaaaaaaaaaaagaattggaactaggattgaacaactatcagaaagcagtaaataaaatcttacactaccttgatctactagaaaatattttcagctcagatcacttttctcaccttctttattcttcctaggtgtctttctccctcttactactctccctatcctccacctcaccaaaaaaaaaaaaaaaaaagaagaagaagaaaagaaaactggtaatcaccccatatggggagtccatttgactttaaaaggttctgaaaaagaccagacataaagtaatggaatcttttcagcactgagagaaaatgctgagagaccatcccccacccaaccctccagagtaacaaagggaaattgattatcttaacttcttagaattaatttatgtttgacttacttttgatactgaaaaatgttaactgttctctaagtggttgattagatagtagtcttccttagtcacatgactcctgccaactataaaacttttcttcttaagtattttcagatatgccataaattctaataataccattttatttttcaacccctgaaattagtgaattattatgtataactctagacttataaaaacatttatatgaattttgaggaaactattaggctacaatattatcctatagacctgaaacttttaacatggtacccactggccacatgcagctatttaaatttaaattaattaaaattaaataaaattaaaaggtcagtttcccagtcacactagcacatttcaagtgctcagtaaccacagttggctagtggctactatattagacagcacagatgtagcttgggacatttccatcattacagaaggatctattcaaccatgctactatagaacaagggaaatattaacatatcattgttggtgttgattattcccattttagcctttcttctcactgattttgcagtcaagggttcaaagtgactcttctctatttgctttaaaaatccttggccaaaataattattaatgataagccattattgagatggtagccaaagaagtttcccaaaacttttattctttttgccttgatatccacctaaacctgtgtagcctacaaataaaaaactcttttattattcaaagtgaaatttggtcaactgtttttgaagttagtttcctccccaaagaaactattattacacttttttgtcaacttttctataagtcattctaaacctaattgctttggcctcatgtgacattacgctgtatggggttgaacctttcattgcccaaatacaaacatttcaccagagagcttgggcttgccccatcacaagaaacacatgctgtacttctcccggggccacagaatcagacttgggcctaaaatagccaaagtggtgactaagattcatttggacagggccaagctgtcaaaacagagaggggtcatgtggatttaccacatccccttgcagggctatttaaagttttaagacccaccaaacaacctagaactaggaacatcagcagggtcattagtgaatgtgtttggcttctgataaggctgtattcttttgagtagttcagccaccttgttaaaacatgttacacctaccatcctcaaggaactaattcccattctgcctcttcagtggacttctagaacagagattgcaacttccttggctttcagagtccaccacacactttattttcacacaactaggtgctcatcctacccagacactattcttaacctcctcagtggtgggtgacagtttaatttgtaatgactcccttggaagtgattaaaagggagttcacagaaagcggtagaaaattacttttgtggccaggcacagtgtttcacacctgtaatcctagtacatttggaggccaaggcgggcaaatcgcttgagctcaggagttcaagaccagcctgggcaacatggtgaaaccccgtctctacaaaatatacaaaaattaaccaagtgtggtggctgtgcatgcctgtaatcccagctattgggggcctgaggcaagaggatcacttgagcctgggaggcggaggttgcagtgagccaagatcacgccactgcactccagcctgggtgacaaagtgagaccttgtctcaaaaaaaaaaagagaaaaaagaaagaaagaaaattactttggtaacttagtcatgatggaatgatggaaaatgtattttccccattttggttaccacatgtttcatgtgtcgagttttttcctcctaattcatactaagctctggaattgtaatacttcattaaaaaaaaataaaaaaaaagaatcctctagataacaatactttctttaataaactacatcgttctgagcacagaactgaatatgaggacattttctcaaactgaatattaggatacatgagacagactgcatgatctccaggctgtgtggaaaatctgtgctctgtggtctggggcttttgagggggcacacctgtactctaaccctggctgtcatctactgaaggaggtactgaggaaagtggtaactgttgttatctgaggatgtctatccagagaagagactcaggagggaatgtattctgaagtcatccctattgcttcttcaattatttctacccctagaaagcaaattccccacagtgaagtgtgttgaagaaattctatacaaatagaagcaatattctatgtttgggtaagtttattgcagtccatttaagaaatggtgagtcgagtccacgtgattcagttaagaggataaaatcatttatttcctatatatacagaaagcaaggatttctaataactttctacagtttttctttattattattattatttttttttttttttttgagagagtcttactccatcacccaggcttagagtgcagtggcgcaatctcggctcactgcagcctccgcctcccaggttcaagtgattatcctgcctcagcctcccaagtagctgggactacaggcaccaccacatccagctaatttttgtatttttagtagagacgggatttcaccatgttggccaggctggctttgtactcctgacctcaagtgatccgcccgcctcggcctcccaaagtgctgggattacaggcataagccaccgcgcccagcctttattaattttgcaaattgcaaaagtattctctgacttactgattggtcacttgtgttcctgaactgtgcataactacgaaaggtttgtttaggagtgccattttctaatactgtataaagctgtactatccagtacagtagtaaatagccatatgtaactgtttacatttcaattttaataaattaatattaaataaaaagtaaaatttggttgctctgttgcgctagcacctttcaaatgctcaataccacgtgtgactgatggctactgtattagacagcacaggtttagaaaatttccttcatcacagatagttctattgtatggtattgctatagagtcttggtaactgcagagtaatgcttatacataagcagcactttttgataggtcaaccaggaagctataatagatattttttggcaattttctttctgttagttcaacaaaaactaacttaaagatttatcaaagacctttgtaccgtaatgaaacccagcatttacatacagtcctctctgtagtaagggtttgtacaaaggcagtaaattgagatagcagtcgttgtgggcttcagctaatcagagcattaaatctggtatccaaaaggtaacctttgagcctgagcaacataaggagaccccggctctacaaaaataaaaaatttgccgggtgtggttgcacacgcctgtggtcccagctacttggaaggctgaggtgggaggatcacttgagcctgggaggtcaaggctgcagtgagctgtgatcacaccactgcactccagcctgagtgacagagtaagactctgtctcaaaaataagcggggtggggaccttaattctaaaaactgaaaacttattctggtatgagcagttccgcaaatattctggtatgaacagttccacaaataataagtgaagtgattttgatcttacatattgattttacaaatcaattaatttgtgattttttttaagaaatacatatataggccaggcacggtggctcacgcctataatcccagcactttgagaggctgaggcgggcggatcacctgaggtcaggagttcgagaccagcctgaccaacatggagaaacgccatctctactaaaaaaaatacaaaattagctgggcatggtggcacatgtttgtaatcccagctactcgggaggctgaggcaggagaattgcttgaacctgggaggcggaggttgcagtgagccaaggttgcaccattgcactccagcctgggcaacaagagcgaaattctatctcaaaacaaaaaaagaaaagaaatacatatatagatatatgttgttttttcttttttaattgagacagggtctcactctgttgcccaggctggtctcaaactcctggactgaagcaatcctcccaccttggcctcccaaagtgctgggattacaagtgtgagccaccatgtcccaccagtttatgattctgaaatgtagaatatattacttcctgttgggcaatagattttgaaaattatgtacatttaagaccatctctataaaatacttttacatagacccaaaagaatttctaagatatctattctgtgcaattactcttaaatataactatatctagtacacttacaagtctcatttttcattttctctagagaaaatactgcagcctcttttagtcatatatcctgactgaaaattatgaaattaaaggttttagacctatgtttaggttatgtttgagtattatatatgtataggctatgctgactaaactgaatgataactctggttttggctatatggagacatatcaaaagttctgatttaattaatcatctcacctaattatcatctaggacctaattattaagtataatcaacccaaattctttaacatctctaccttgaaatgattttcttgacttttggtcatctctgttcagcctcaacctctccaaattctccaccctttttagggcttttgagttcagtcgtctgaattctaataggatgattatctttcaaatttctttgtcacactcctattggtatgttctggtgatacactttctcccctcagtatatttccctgttcactcaggaatatgactatatattaccttgttatttaggtacaaagccaattattctatatctgatacttgtatattttgtatttagatgttttaaaatgtaccctcctgccatgactgtgtattgccttgttatttaggtacaaaaccaattattttatatccaatacttgtgtattttgtatttaaggtttaaaaatgtacccttctgccattgtgcctatcaaacttcatgatgcgtgtttctgagctcaggaaataccaaaaagggagtattcggtttttggtttttgtcttcaagtcagcaatacatctttgttcagctcttgtgttcctcaataactttgttccctccttaagtgcattcagtagttaaacttagcagaaatctgacctaaccattttcttgttttccacttccttaaatgccacacagaatcatctagccagaagcataccattttgatgtttgacatattgacatttcaagaaaactataattatgattaagaattatttctagttcttaactacaaattaaaaacttgtggtgctctttttctctgaatttataatctgccttctcctttctaggttaatttgcttgatagaaaattacaactttaatattatttatcttaacagattgtgaatagtctaattaactcaaaagtattatgtttcgcccttaaaagatactaaattataccttctaaattaaagcaggtagaaaacttctttgtcaagggtttaataaaccagaaagtttgaagaactacttgtataaaatctgattttttaattgttgtattacattattgctatcgatgagcaatattacattattagcaatcagtagcaataatgtaatacaggggttggcaaactatgacctgggggtcaaatccaacccactgcctattcttgtatataaagttttattagaacatagcaaagtacattaatttgcatattgtccatggctgctttcacactacagtggtagaactgagtagttgcaaaagagatcatatgacctttagagcctaaaatacttactgtctgattatttacagaaaaaaaattgctgacccctagtatagtagaaatccttgaactggggagagtagtcattgaatgtcaattatgtctactcttcattatgtctctaagttgacagagaccttaacaggttgctaagcctctctggacctcagttttctcgtctgcaaaatgagtcccttagaatgaataatctctaaggttgattctcaaactaataaaattatatgaatccgtgacctatttcagaatgatgttgctgttttacataatggcttgcattgaatatttaaaccatctatagtcactgggttcagacaactaaatattaggtggggcaccatggcttacacctgtaatcccagcactttgggaggctgaggccgtaagagtgcttgagccccagagtttgagactagcctgagcaatatagtgagactcagtttctattatttaaaaaaaaaacaaactacgtaaacaaaactgctagtcataagacagataaatttaaagcatactactattgtttcaaaagcatttgcatctcagggctcttttagatactgttttcctagtagtataggtatttattacagatctttgacaatagtagcaagaacaggccttgaagcgtataactaacatcttaagaaatacagttgtacttcatttggaaataaaaataaagcatctctaaaagcctagtttccgtgtgtgggaaacgtgatttgatatataaaaattccattcccacccagcttttaggaaacatgtataatacgtaaagtaaaataagtttttataaaaagaagaactcaacattcactactgttttttcaacatggtaactataattctgcataagaacctttcatgcgtaactttagactttcagaaatctcaaaagttacctggaatgttaacatcaatatcacttctctctttttgcccttccctttctacagtaagtaaactttgtggaaatatattttattaatgttttctggccaggcgcagtggctcacaccagtaatcccagcactttgggaggccgaggtgggtggatcacttgagcgcaggagttcaggaccagcctgggcaacatggtgaaaccccatctctacaaaaaaatacaaaagttagccaggcatggtggcacacgcctgtagtcccagctacttgggagactgagatgggaggatcacttgagcctgagaggttgagactgcaaagagccgagattgtgccattgcactccagcctgggcaacagagcgagaccctgtctcaaaaaaataataataatgttctcatattagcagatacctaaacacaaacaagttttatctttccagaaaaattcaagagttaatatttaaaatttagacttagactacttaggtgatttgataaactaactaaatgagtgattctacatagaccagcaaaaggctgtgctcatgttctagatctttattagtagagttagtaatgatatgcacttacagaatgctttacaatttgcaaagcactttcattaatacattatgacttttgccaatcctgtaagataagtccattttaatattctttttttttcttttttgagacggagtttcacttttgttgcccaggctggagtgcaatggcacgatctcggctcaccgcaacctctgcctcccgggttcaagcaattctcctgcctcagcctcccaagtagctgaaattacaggcatgcgccaccatgccgggctaattttctgtatttttagtagagacggggtttctccgtgttggtcaggctgatctcaaactcccgacctcaggtgttccacccgcctcggcctcccaaagtgctgggattgcaggcgtgagccaccgcgtccagcccgttttcatattcttactttacagataagaaagcctagagaggttaaatgatttactcccaaataccacatgttctcccttataagtgggaactaagctatgggtacacagaggcatgcagagtagtataatggacactagagactcagaataggggagggtggaggggcaagggatagaaaatcacctgttgggtacactgtacactactcagaagacagattcactaaaagcccacacttcactactgtaccatttatccatgtaaccaaaaaccacttgtacccctaaagctgtttaaataaaaaataaaataaatatgatttactgaagcagtaactcccaacatttttccactctacagtcctaagggatgtcatgcactcaaatggcagtgatttccaactaggaataaggggaggctatgcatatagcttaaaagagtcatatgtagttgattctgttgtgtggcctgatggagaattactatacaaaagtaagacattgtcattgttaaaacaaaaagagggaaaaaagattttaaaaagaaaaatgacacataatcctaccacccagagataattaataacattctggtgtatatgcagtcttttatatccatattaacttttttacccaaaaatgagattataatatacattgattttaaacctttttcatgtaattaatcacagacatcttttcattccactaaacacccttctacaacatcattttataataactgcagaatattccatcctgtgttacatgtttgaattcaagatgtaagtggtttcatatacttctacaattcccgattagtgttattctggtatatgcatatgtaatttatttcaaggaatctgaaataatttaaaaactacctctcttctagccatcatctcctatatatttgacttaatggataatccttaagataaataatttgttaaataacttatttatatttgtgtatttgttttaataatctattttttcatctctttgttttagggtgcagtactagccgctgtgtcaagtcacaaattcaactcattctatggggatccccctgaagagttaccagatttctccgaagaccctacctcctcaggtaattggataattcacttattcacctgtgtgggtcatttggcatttacatccattctctcccattgtgaataaacttttcctgtgcatttagttaaatcctccaacggattctaaggaagtttgtcagcaaccaaatcctgtctacatgtgtcttgttccttttcattttaataccaaagttgctttctcctgtggctccaaaaccaacacttcatttttttttcttttcacctcagtaatacttcttcccctttccacactctagacccagcattgcactccatccaatccaacatcctagtcagtcttttgggatctttctgattaccttctctctcaacaaaaacttctaatataagcttttccccaggtcagtcgtattagatcagactgtgggcagcactgctttgaatggaatctttcagtgtagagctgtcttgtgagttatctcctgaaacagttaccaagttcttctttctgtataaaaatctataacacggccaggcatggtggctcatgcctgtaatcccagcactttgggaggccaaggcaggcagatcacctcaggtcaggagttcgagaccagcctggccaacatggcaaaaccccatctctgcaaaaacacaaaaatacaaaaaaaaaaaaaaaaaaaaaaaaaagccaggcgtgctggcctgcgcctgtagtcccagctacttgggaggctgaggcaggagaatcacttgacccgggaggcggaggttgcagtgatccgagatcatgccactgcactccagcctgggcgataatgcgagactccatctcaaaaaaagaaaaaaaaaatctgtaacacatgcatacaagtatccaaaggggaagaacacagaagagttatttgttttgatgaactgtatataagtacccctgaaacaacctgccagtgttcacaaaatcattttataagccagtgcagtggtgtgcatgtgtagtcatagctactcaggaggctgaggcacccggctcagggggatcacctgagctcaggagtttgaggatgcagtgagctgtgatcacaccactgctctccaacctggacaacaaaatgagacctcgcctcttaaaaattaagagataaaaggccaggcacagtggctcacgcctgtaatcccagcactttgggaggccgaggcgggcagatgatgaggtcaggagatcaagaccatcctggctaacacggtgaaaacctgtctctactagaaatacacaaaaattagccgggcgtggtggtgggcacctgtagtcccagctactcgggtggctgaggcaggagactggcgtgaacccggcaggcagagcttgcagtgagccgagatcacgccactgcactccagcctgggcgacagagtgagactccgtctcaaaaaaaaaaaaaaaaaaaaattaagagataaaaaaataaaaaaccaaaaccattttataaaatgctcagatttccatcttaccagtgtaatattctcaagaatcatttactaaaaacccatagggtccatttatatgtatatgtaaatgcgtgtgtgtgtgtgttctaaatttttatttatgcattttttatttacttaactcctgaatcatgtgtcctctggcctcagctttttttctttctttcattagagccactccatatttgtcatctttgatttttgtactcttggactagcttcatcaatattcatatattaccactgggactgaggccctgggcccttcctaaagcctgaggtttctgtcccacagttagtaatataggaagaattaatgtgctaatgcttctttcctgttggtaccatgagcatctgtcagtatttatgcttctcctctcctctgtttatacatgtgtgtgcacctacacattcacatacacacacacacaatttcttaccaattagtatgtgcttgtaccttgtgcaaaatgacaagatcttgaggtgatggataccccatttaccatgatgtgatcattatgcccatatcaaaatgtctcctgtaccccataaatgtatactatgtacccacaaaaatttagaacttttttaaaatgacaagatcaactttcccattccagcagttatacagttcctcattttgacctttaccaattaggatgtgaatcttcctcttttgagtgaaggtgatttccaaaaacattcagaaatgggaatcttagagaagagactgaggagaaagccttgccatttttctcttgtgctgacttggtcattatccagagcccttcccacatgaaaggcagggatctagttgtgtttataggtgtggtccccagtgcttcttattgtttcacgtctgtcttttcttccactccattttgttccctccacctgtaacttcttttgttagctgaaacctctgtcttctctcctcacactcagattacagtggaccctatttaaggggagtggatccagtaatggtttgtattgtcatactgtggctgtatgatataatcacatgcttataatatatttaggataaatctctttgagattttaggtcaagatctctactaccattttcatctttagaaatggagctaaaggctgggcatggtggctcatgcctgtaatcccaacagtttcagaagccaaggcaggaggattgcttgagcctaagagtttgtgaccagcctgggcaacatagggagaccctctactttgtaagaagtcaaaatattagccaagcgtggtagcacacacctgtggtcccagctactagggaggctgaggcaggaggatcacttgagcccaagaggtcaaggctgcagtaagccgtgagtgcatcactgtactcaaaactggatgacagaacaaaactctgtctcaaaaaaaagaaaaggggccaggcacagtggctcatgcctgtaatcccagcactttgggaggccgaggtgggtggatcacttgaggtcaggagtttgagaccagcctggccaacatggtgaaacccccatctctactaaaaatacaaaaattagccaggcatgatggccacgcgcctgtaatccacctgaggcaagagaattgcttgaacccaggacacggaggttgcaatgagccgagatcgtgccactgcactccagcctgggtgacagagcaagactccatctcaaaaacaaaaggaaaggaaaataaaaagagtaatactctatgcatttaggaaaatatgaatatttaaaataacagtttaaaaacttgtcatctaataagaagtcaaacatgtttaggtatattgtttacgatgtaaaacaatttttctataaatgataattttctattttgattattgaaattcatacattatgcatttactagaattcatttaatcttatgatgaactgtgtattgcttgaagtggggctgggcacggtggatcactcctgtaatcccagtactttgggaggtggaagtgggtggatcacttgaggtcaggagttcgagaccagcctggccaaaatggcgaaaccccgtctctactaaaaatacaaaaattagctgggcgtgatggcatgtgcctgtagtcctagctaccaggagggtagggagccagggctgaggtaggaggatcacttgagcccaggaggcagagtttgcaatgagctgagattgcaccactgtactccagcctgggtggtagagtgagaccccatctcaaaaaaaaaaaaaaaaaatcaatgttgaaatattcttttctcatatttcaaatcaagtaattcagaatcagaacccaacgtttgatgtctgaaatcccaaacagttccagtgattgtactcatggaacatgagggctcactttggggtcagctgggggaccatgcttctggtggctcatgtagtgggccgaactgtggcttgataacctgcttgttctaaaatcatactgtttgttgtttgtccatatgctgccttcctcctaggacttctagcagcagaaagtaggtatccctttgttttcctttaaggtgtatcttttatgcaaaagtgtttggctttgcatggttcgtaatcagcttgactttttccttggctgtttgtgtgtagttgtttaagtattaattttaacactgcctggtcataaaattaaaacttggatatattgatttttgaggcattgttgcacaaacaatattaagttctcacttctttcataagaggaaaaaagacagtgttaaaatttcaacggcatttaatacttcacatctgaatttcacatacgaatacattaattctggggaaagagtaacatttattttagagtttgctttcaagaaaactttcagggtaagtgaatttttctttgacaattacatcacctgtaagtggtctttattgcttcctgttactgagtccattttcagtttatttggacctgtgaaataaattctgaaatcatatctcttaacaacttttaccatcagatagaacatttataaggaataatgtaatagctagattttaattacaaaggggcataatttgagtttgggagaaaattaaaatgtaagaaatgtacacacagttgagtacatgtaaaactgaggcaatctgaataagatgggtggattgtatcaatgtcagtattctggttatgataatatactatcgttttgtaaaatgttaccaatgggggaactgagcaaagaatacaagggatctctctgtattatttcttacaagtgcatgtgaatctacaattatctcaataaaaattctaattaaaaaaataaacctttacctcaaagataaatgagaaagcctgggtactaatgattgaattcattttcacattttcttacattagttatctgtagctcaaattgcagctgatttaatataaatcttatagtatattagttacctattgttgggtaatgaattaccttaaaacagcagttgtcatctcacagttcctgtgggtcaggaatctgggcgtggcttagctgtgtgcctctggctcaagatctctcatgagattgtggtccagtgctgctatctcaccggaaggcacaactgcaggaggaatcctcttccaagctcactcacatggttgttgccaggcttcggttccttactggctgtggtcctcttcacagggctggctgttcacagcatggcagctcacttcccagcacgaaagataaaagaggggggcaaaagtgagagacagtgcccaagactgaagacacagtctttacagcctaatctcatagtgacgtcttatcacttctgcactattctgttcattagaaatgagtcagtaagtccagcctgcactccaggggaggggactgattacacaaggctggaaataccaggagaccaggttactggggcccatcttagaggctgcccaccacgtacaaattaataactattaaaatgtaagattcttcccgtctagatttagcgctcctcttttttttttttttaaatcagccaacctgtcatgttatttgagaatgggcatcttggatgtatcagtagtgattttccttagttgtaaagctttacacgagtgggtacttaatagcagaatgttattaaagtactttgaaaaatctgtgctcgaagatgtttctatatggaagcataaactattttaataatcataatggcattagagattataacatctatacgctgacagaatacatatgcagagtttacttcctttaataaatttcaaggtatctgtaccataatccacatatggagaatctaaagcatgtatcaccatatgtaagttctcataacttgagttggatatggcacagatgcttatgtccaaaatacagtttccattacaggattcattattgcttataacttgattgataacaaagaatttgctttgtgcagtgggaataaaaagtgttgaacagggtgtggtgatagagggaagagattggctgcaaagggacaagagagaacttttttgaagtgatgacagtgtacacttaaatggcgacttttaacttaaaacagtataccttagtaagcagattttttttaaaaagtattgtgcttgcaaggaggggctttgattgagtaggtgataatgtgtgtgtgtagtaatacaatgtattaattgatcgctaatataatagaaaaggtattgattactcttagaagaagctaggctaggttcagattctagatttgctcagtgatgctgagtttcatagctatacattgtaaattaagaaatacacacacattgagaatttaatgtgttattttgtgaaaatctgagaagcaggaatgggatttaatgatctcaactgtcatccatctgaaaaacctaacttgtgattttaaataagatggcatactgccttccactattcccttttaaaaacaggaaatgtccctgcttttatctttatgaagttttatttatgaataaagtttgtactatttaaaaaaaaaagaaatacacaaatctttattgaaacaattacagtgaaaacttgggtatatcaaaactcattgaatggtacacttaagatttgtgtatttcattctatgtaaattttacctcagagagaaaaataagcattgcaatctttgctgaagtctttaagggtgaagtgtactaatgctggccactgccatttaatttgaaatgaatgaaaaatacgtgaactgatggatagatgggtagacatgtgataaagcaaatacagcaaactgtcaacatatgtaggatctaggtggtgggcacgattctttcaaactttctgtatgtttgaagcttttcgtagtaaaatgtaaggggaaaaacttttaagacatactcagcctactttaacactgagaactttttagtctaaacatttgactgtttatttttctgtcctccttttggtttatttttacttggtcaacctttttatgagacttccactctcgtaatgagattattctagactcaaagcttttattgaccttaaaagcatatttctctttaaagaaatagaaacattttttaaacagttgacatatttatgctttttttgactattatttcataatagtagcagaaaacttttgaaaaacttgtttgtactggtgagattatttgaaaaagtagaagtattcaaagttaaaatgtgcaggccagtcatggtggctcatgccttgccagcactttgagaggctggggtgggaggattgcttgaggccaggagattgagatcagcctgcacaacatagtgagatcccatctctatttaaaaaaaaaaaaagtatgattataaacctgatttttagatacaaactttattgccaaatgaattatgaaaacaaaatactattctgaaggcagggcattatagtatctaataagttcatgaatgtggaagtttggaccaagggctaggaaaaaaccttatatggtaaatcaaattgagattaaagagagaacagaaattaggcatcacgcctgtaatcccagcactttgggaggccaaggcgggtggatcacgaggtcaggagtttgagaccatcctggctaacacggtgaaaccccctctctactaaaaatacaaaaaaaaaattagccaggtgtggtggcgggtgcccgtagtcccagctactcgggaggctgaggcaggagaatggcatgaacccaggaggcggagcttgcagtgagccgagatcacaccaccgccctccagcctgggcgacagagtgagactctgtctcaaaaaaaaaaaaaaaaaaagaaattggacatcacctcattaccaaatgcaaatcattctgatgcattgctgaggataaaacatgattttgtgggtgggggacagtctattatggaaggaacactgaattaggagtgagacctgggttctaggatttgatcttctgcttattgcctgtggcccttggaaaggttatttaaccctactgagcctctggtttttcaaatataaaaacacttgctgaccaagcatggtggctcaatgcctataatcccagcactttgggaggctgaggcgggaggattgcttgagcccaggaatttgagaatagcctgggcaacagagagagacccccaactctacaaaaaactttttaaaaaattagccaggcatggtagcgtgcctgtagtcccacctgtttggaaggctgaggtggaaggattgctcaagcccagaaggtcgaggctgcagtgagccaggatcacgccactacactccagcctaggcaacagagcaagatcctgtctcaaaacaaaaaaaacacttgcctgcagagacagggttattgtggaatcacataaggtagtaagtataaaagcactttggaaattataagctgttaatacaaatataagtattaaaataatttcaaatgtggctttaaggaaacagtactataaaagaaattgttttctgtggttaagtctttctcatactttgttttcaattcttcagaatttactcagaaaaaaatcattttaatcaggccattttatgaagtgtcttggtacaaaggactctgcaaagtacaccccagaatacagaggtaaataggatacctacagtcctgccgttaaatcaactgccctctgaggtgaacttgtgtactttttattgattgattttgttttcaagatagttacaagtttattcagaggttttataggaaaaacagcctttttagtctttgagaaaaatagttattttatatgtgacagtattgatcttcaaaatgaaaactagtaacatcttaattagcatgtgctgcatgtgttatattaataatcactactgcctcggggtttaaaatctaaaacaaatagcaatggagaagcccgagaagtgtctttgtgtctatttatatcttataatgaattgaaacaccatgggatttttagatggttggtactgaactacagatatcaattatacacacatctatccaaccaagaatgtgttctgtggttctgtttgtcatacccaaagaaagaaataacggaactagaacaggtgttaatggaaggtgttaaaataatcaagggtgaagacagattttgaggttaagccaaaaatatgtatttattccatttgaaaagatgaaggagaaatggaataaaaactctaatttttctacctaattacagaaacttaaaaataggggcacttttcagagcttgaaatagacaacttgagtacaactagggaagtgcttcttttcatgattgagaacccatcaagttaatcatatttgggtacaagataagactataaatcagttcagaagaggtgacagatccaaggaggtttaatagacctgttggaattgtggctcttgcctactttaaatgcctgctaacagatgcctttgtgctttccagcaaagtatctgctggtcctgtcaacacagctttgatcctgtgtgggggtggtgaattcctgctcatccacctctctgcggctccccaactcctccctaggcagcctgtgtgtcagtttgtttttacctcttctataccgtttacttcagggtataatatgcctacttcacacaccagtctgagagccccttcctcagggccggtgatcatatctctgatttctctgaagcccttgcctagtacctagcaaaaagcaggaatattcaataaagattttggggccaggcgctgtggctcacgccagtaatcccaacactttgggaggcctaggcaggcggatcactcgaggtcaggagttcaagaccagcctggccaacatggtgaaaccccgtctctactaaaaacacaaaaaattagctgggtgtggtggtgtgtgcctgtaatcccagctacttggaaggctgaagcaggagaattgcttgaacccaggaggcggaggttgcagtgagctgaaatcatgccactgtatgccagcctgggcaactgagtgaaactctgtctcaggaaaaaaaaaaaaaaaagattttggttattgtctgacccaatagggcattgttcaagttcttttccaacctccatattcatgcataaaccacacaacttcttgttgaaggtttcctgtatgtttcctagcatagcctattagtgtagtaagttaggcaaaacatagactttgaagccaaacaaacccaggattgagtcctggctccaccatttactagttatgcccttccatgaaccttctgaagctcagttccctatctagaaggtgggataatatatctgccttactgtgttgtcctgaggatgttcctggaacataataaacactcaagaattgggagctgctgttagtgtttccttaagtacttaattcagtgcatactttgtagatattataaaatgaataaaataaagagctgccttaaggaccttacagctaagggaaaaaaagagtgaacaagcacgcacataagtaactcatggagtgcgctggtggtacaggaatggcatggagcacttgggaagttcacagaccaacaaatgatacatccctggtctggtacagccaaaattgcttcctggtcttgagactgaccatcttagtattcacttgataaaaggttgtttttgctttaatcttatattattaataaactgctacataaactgtatatcagcatgagcaatgctggtaaaaggccgagcacagtggctcaggcctgtagtcccggcactttgggaggctgaggcaggcggatcacttgagcccaggagttcgagaccagcctggccgacatggtgaaaccccgtctctactaaaaatacaaaaattagctgggcgtggtaacctgtagtcccagctgcttgggtggctgaggcacgagaatcgcttgaacccaggaggcagaggttgcagtgagctgagatcatgccgttgtactccagtctgggtgacagagtgagactctgtctcaaaaaaaaagaaaaaaaaaactcagtaagatttcagtaagataactgagtgaagatgataattaggtttctgtggtatcagctgaattttttaatatacaaaaaaggcacttgattagtatttttgttattgtggtttcataagtccagaagtttagaactggctttagtaacttgataaacctagcatcatttaattctgttgttgatgacatgctggggtcaggggttcagtgggacatttgggactaatttcttcacatcatctcttgctttccaaggctttcagtaaaggatgaagagaaaattggcttttaactaatttccagattttttgatggaggggggggcactctgaacaaagtaaatcctgagaagatcaggtagaaggaagtggattgggttaatacctctttaggaataacagaggagatgaggactgatttctgccatttatctcttttatcccacttaatatccacttaatgttttcagtgaaaggataccaatagcctggcaggcataattcaaaatttaatattatccagccgggcatggtggctcacacctgtaatcccagcactttgggagctcaaggcagaaggatcgctttagctcaggagtccaagaccagcctgggcaacatgacaaaaccccatctctataaaaaatacaaaacttagatgggtgtagtggtcccagctactctgggggctgaggtgggaggatcacttgagcacaggaggtcgaggttgcagtgagccgagattgtgccactgcactccaacctgggcaacagagcaagaccctgcctcagaaaaaaaaattatccaggccaggcgcagtggctcacgcctgtaatcccagcactttgggaggccaaggcgggcagatcacgaggttaggagtttgagaccaacctgaccaacatggtgaaaccccgtctctactaaaaatacaaaattagctgggcgtgttggcacgcacctgtaatccccgctactcaggatgctgaggcaggagaatcgcttgaacctgggaggcagaggttacagtgagccaagatcatgccactacactccagcctgggcaacagaacgagactctatctcaaaaaaaaaaaaaaaaattatccatagttccttcaacagacgaatggtcaaacaaactggtacatccacacaacaacctggatgaagccccagataattatgctaagtgaaaaaatgcagtcccaaaaggttacatactgtatgatttcatttattctttttattttattttattttattttttaatttttagagggactcctccttgcagaccagggctaccccataggcagtatgcccagaataggagcctcatttattatcaaaatgacaaaattgtagaaatggagaacagatgagtagttgccacaggttaggaggggatagggtaggaggggaatgagcatggctataaaaaggcagtatgagggatccttgtggtaatggaatgttttatagctcgactgtatcaatgtcaatatccaggttgtgatattgtactacagttttgcaagatgttactattggaggaaactgggtaaagggcacatgagacctttatgttattttcttttacaactgcatgtgaatctacaattatctcaaaataaaaagtcaaattttaaaaaatagctacagtaatttccacgtggacagccacacagtatgtggcttaagacccaaatctttaacataattaaatagagctacaaaaatcagtagcttatatagcattttgttttgttttgctattgtagaaaaacttggaaagtatggataagaacagaatgaaatagaaataggacagtaaagataacaactgtaacacttttgctgtgtttcattctgttttttgtttttccggagtttgcatatatgttttgtttggttttttatcgtaactgggaatatacagtttatttagttttgcattctgctttcttgaattcttttttttttttttttttttaattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaagaggatcccaaggcagaagaatttttcttagtacagaacaaaatgaaaagtctcccatgtctacttctttctacacagacacggcaaccatccgatttctcaatcttttccccacctttcccccctttccattccacaaaaccgccattgtcatcatggcctgttctcaatgagctgttgggtacacctcccagacggggtggtggccgggcagaggggctcctcacttcccagtaggggcggccgggcagaggcgcccctcacctcccagacggggcagctggccaggcggggggctgacccccccacctccctcccggacggggcggctggccaggcagaggggctcctcacttcccagtaggggcggccaggcagaggcgcccctcacctcccggatggggcggctggccgggcggggggctgacccccccacctccctcccggacggggcggctggccaggcagaggggctcctcacttcccagtaggggcggccaggcagaggcgcccctcagcttccagacggggcggctggccgggcggggggttgacccccccccacctccctcccggacggggtggctggccgggcggggagctgacccccccacctccctcccggacggggcggctggccgggcgggggtctgacccccccacctccctcccggacggggcggctggccgggcagaggggctcctcacttcccagtaggggcggctgggcagaggcgcccctcacctcccggacggggcggctggccgggcggggggctgacccccacctccttcccggacggggtggctgccgggcggagacgctcctcacttcccagatggggtggctgccgggcggaggggctcctcacttctcagacggggcggctgccgggcggaggggctcctcacttctcagacggggcggttgccgggcggagggtctcctcacttctcagacggggcggctgggcagagacgctcctcacctcccagacggggcggcggggcagaggcgctccccacatctcagacgatgggcggccaggcagagacgctcctcacttcctagatgggatggcggcggggcagagatgctcctcactttccagactgggcaagccaggcagaggggctcctcacgtcccagacgatgggcagccaggcagagacgctcctcacttcccagacggggtggcggccgggcagaggctgcactctcggcactttgggaggccaaggcaggcggctgggaggtggaggttgtagcgagccgagatcacgccactgcactccagcctgggcaccattgagcactgagtgaaccagactccatctgcaatcccggcacctcgggaggccgaggctggcggatcactcgcggttaggagctggagaccagcccggccaacacagcgaaaccccgtctccaccaaaaaaatacgaaaaccagtcaggcgtggcggcgcgcgcctgcaatcgcaggcactcggcaggctaaggcaggagaatcaggcagggaggttgcagtgagccgagttggcagcagtacagtccagcttcggctcggcatcagagggagaccgtggaaagagagggagagggagaccgtggggagagggagagggagagagagagggagagggagagagagagggagagggagagagagagggagagggagagagagagggagagggagagggagagggagagctgctttcttgaattctatatcatgaagatttctctgtgtctttgaaattcttcaaaaacaattttcatttggctacatattccattatatggatattctataacctacgtaatcatcctctattagatttattttccattttgtatgataatatcattatatataaatcttccatttttttccttaaggtgggtttttgtaaatggaattactaaatcgaagtgcatgaacatttttaaggctttttgatatatgttaccagattgctttctggaaaagtggtactgatatatattctcaccaataattgcatgagaatggataaggtctaagtcaggaagaattagaaacagagttctggagcataaagatttttatctttatcaaaaatataatttctcaaccacagcactactgacattttgggccagataattctttgttgtgggggctgtcctgggtattgtaggatgtttagcagcatccctgacctctacccactagatagcaatagctgccctcccgctgtagttgtaacaaccaaaaatatctctaaacattgggaaatgtccacctgggtaacaaaattgcccctggttgagaaccactgatccaaagacttaaatgtgcaatgagacacttattcttagagtttctctactgtgtactaatgttctgaagcttagctccttggagctctttttttgtggagtatatatgtgtattctgcatattgcctgcaatgtaaaagaggctgatcttttttttaaggctgtgtaaatggctttgttactcctcattgtgtatctttccctactgacatctgcctggtttcctggttatgagaagaaacttaaagtgatggcacttccatttgctttgccctacaaaaatgatttgccttgaaatttaatatggtatttggaagtgtcagtcagcgtccctatactttgtctttatcttctgagtaagaagggtaagagtaaaacagaatgagaatgactttggatctcttgagtctgtatgtaaaggaaaaaaaaaggagtggactgggatttttgttaactaaagttcaagtcttaaaaactaagaagcctattttaagcagcaggagttcccagttgaaggtctgttccctgtatctacagctggctttaccttcagttcttgatggaatgcacctgggtaaaaggccaacctcgtttctataatatttcagaacatcttggagtcctgaaacccatactctcttcctgacataaaacttgctgtgtccagatcttctagtgcttaggttatacttgataaatttcattaattcaaagaagataagctgcagtttcctctgaaaaatgaagagcacacaaatacattaataagaacatgaactctctgaaaatactgtgtccttaaattatatgaaactcatttaagtctatccttcagtaaagacactagcctttgaagttctgatatgaattcattgttcttaagtgtaagatttaggtttaaaaagttagtttgacattgactttctatactggctgtttcttttctgtttgtcccccttaggagcagtctcacaggtgctggacagcctggaagagattcatgcgcttacagactgcagtgaaaaggacctagattttctacacagtgttttccaggatcagcatcttcacacactactagatgtaagtctgtctttttattattcttcttttttggtgaattgaatattggccgggcacggtggctcatgcctgtagtccaagcactttgggaggcagaggcgggcgtatcaggaggtcaggagactgagaccatcctggccaacatggtgaaacgtggtctctactaaaaatacaaaaattagccaggtgtggtggcgcatgcctgtagtcccagttaggactgagctgaggaggcggaggcacaagaatcacttgaacccgggaggcggaggctgcactgagccaagatcacaccactgcactccagcctgggtgacaaagcaagactctgtctcaaaaaaaaaaaaaaagaaattgaatatttagcatacctttttactttacatgaattctcagatgtctatcataacaattcttttcagttgccttaagcctatgagaaatgtgggaaatcatccatcaaaaattcatgattgaaatacagtatatggccgggcaccgtggctcatgcctgtaatcccagcactttgggaggccaaggcgggtggatcacctgaggtcaggagttcgagaccagcctgaccaacatggggaaaccccatctctactaaaaatacaaaattagccagttgtggtggtgcatgcctgtaatcctggctactcgggaggctgaggcaggagaatcgcttgaacccaggaggcagaggttgcagtgagccgagatcgctccattgcactccagcctgggcaacaagagcgaaactccatctcaaaaacaaagaaaaaagaaatacagtatatgtacagtacaaatgcaacagagcctagcaggctacaatgggaaaaaatttatatatctttatatttataaattatatgtacataatgcatgcaagtggtatgtgagttttaaaaaagagtagagtacaatcctactttactgaattatcttgtatttctgttaaaagaatccattgaggttagctgtgattactttttattgctttgcacattactttaaaacattatacctccagcatgagtataggagagagaaaagcaaatgagatactttgcaataggctgtattcccacacacatttcatatttaacattgttttgttccatagattcaatgtcttctccttaaaacataagcatatactccatctttaaatattacaggctccactgacagcagactgggatacaaaggaaaaaacagaagctgaccattttcatttcagtcacattttaagtaaaatacctttcttagagaacttggttcacttcagcaatgaaaactcttgggtggtttcgatggtatttgaacatgttagtctttttacaagaaaaatcttcccttaatgagagaatcatacttgctttggggtgcctagaactgtttggtgctgaataattcaccatatgatgtaaatgaagctaaagcaaaatttcccagaatgtgttctacagagcatggctctgggaggttgctatgggtgttgccatggtgggagggggaagtagatcttaaatttattggttaaattatttattgactaaataagtttgggaaatgctacattctttagtctttttatacagatccacaatgggtgttggtatattgatagctctgagatgatctaaagcaaagaaacctttttaactttctttatcagcatttctcaaactaatttgggcacagaacttttattcacaatcctgttgagttctgttttgatgaggaccagtttgggaaaagctcagctaagagtgtttgttgcattatgcttcagctttacactaaatgcagccgtaggtatctaacagttgcttctttccccaaatgtggtcagttcaaattaattatcagattttcatggctagtttggcctttgtatatagtgtacatattaattagggctgactaactgttataacatgtgattctaaaatttgagtggcttaacagaatagaagtttacttcttgctcacttcacagtccaatgcaggtagatgagggaggtcttttccacaccgtcattcagagacccaggcctcttccactaggtcacactgctatttcccagggtcttggaatcttctactgtatcctttgtacctagccagcaaatgagagaagagagaacatggagaatcttgcagggtcaagcttggaaatgggtttatctcacattctttggcaactgctagtcacgtgctcacctggatgtgagagctgaggaacgtagtttagaaatgtgctcaggaagataaggaattgggtcttctctttagtgtaatttatcttaagtagtatctattcactgtcattgctgcagaaagttttcacaattgtgtatttcccactgaagtttataccctttactagaactagttagtgcaatatttagaaaaggctacagcagtgtgtggagattttgtttattttattgtggtcagtgcttaggtcattgccaggtagatttactgaccttcttttgaatcaaggactttttgtaacaaagactttttgtaatttaaacactgagagaagcccaaattggtttcaaagttgtattttttcttactgatatagcaaggtatctgagcacatcaagcttgagattgcaggggagaagcaggaacattactggcttacacaaggaaaggggcagctattcagacacgaataactgctgcactgtttggtataaattgtcacaatttcagaagagattcttagatgttagtgagaaaaacatacttaactttcctttgcatttgtttacattataaagaagtatctgccttattggcatctgccctgtcagtgcaggtcaatttgaaagaggagctgttggactgaaaatgaaccatgcctattaaaaaggtgcagtataagaccaggagtagtggctcacacctgtaatcccagcactttgggaggtcattgtgggaggatcacttgagcccaggagctcaagaccagcctgggcaacaaagcaagaccccatctctacaaaaaatttaaaaagcagctgggcatggtggtgtatgcctgtggtcccagctactccagaggctgaggctgaaggatcacctgagcccaggaattcaagggtgcagtgagccatgatcacactactgcactccaacctgggcaacaaagtgagactctatctctaaaaaaaaaaaaaaggtgcagtatcttctgaattttgtaaacaggtgccatacatgagctccagtcaaattaatgactatgaggccgagccctggacaatatttgcatgcatgtggttctgaatctccaaactgagctatttctaaatgaaagtttaggccaggtacggtgactcacgcctgtaatcccagcactttgggaggccaaggcgggcggattacctgaggtcaggagttcgagaccagcctgaccaacatggtgaaacccatctctactaaaaatacaaaaatgtggtgggcacccataatcccaggtacttaggaggctgaggcaggagaatcacttgaacccaggaggtggagattgcagtgagccgagatcgtgccactgcactctagcctggtcaacagagcgagactccgtctcaaaaatgaatgaatgaatgaatgaatgaatgaatgaatgaaagcttaatcatcatgaatgaaataaaccatcattagaatgtgccctcataccctacatcccataaataaggcttattaagctcatttcacagctaacaggctacattttaataatataatcaatgaagaattcaagtgactgccatatagagaaatctaatcatttaaaaaattttaatatttaaatgtttgtggtatacattaaggaagaaaaatggctatgacgaactcttgaggagcagctgttaaaatgttggattttcagtctgggtgcagtggctcacttctataatctcagcactttgggaggccgaggcgggaggatcacttgaggtcaggtgtttgagaccagcctggccaacatggtaaaaccctgtctttactaaaaatacaaaaattagctaggcatggtggcgcatgcctgtagtcccagctacttgggaggctgaggcaggaggatcacttgaacgcaggaggtggacgtagcagtgagctaagatcacaccactgcacggtagcctgggagacagagcaaaactctgtcaaaaaaaattgggcctttcatttttctttcttcccatgttccacataccatggttgatttggaattgttttattttgcagaatcaaaacgaattcttctgcctttttttgtttgttgtttgttttttgtttaagacagggctctcccaggctggctcactgtagccttgaccttctgagctcaagcaccctcctacctcaaccacccaagtatctggaccacaggtgcaccaccacactcagcccttttttttttttgaagagacaggtctcaccatgtttgcccaggctaccaggctagtctcaaactcttgggctcaagcagttctcctgcctcggcctcccaaagtgctgagattacaggcatgagtcattgccccagcatgaattcctttttaaggattccaagtagggacacccagggggcatagttttatggaccatgaattaattaaggctaattaatcccactgagccattttaggaaatatctttaccatttttatgttatttctgttaactcaataacattctaaatagctaggtatgaagccataattttaaggctgacaaaaagaaacaggattaagttcctaagaaaaactaaagattatctatgacttctttattttttctagtcatgttcttaaaataataacaagctcaaaatttgaagaagcattattagaatttgtttacaggaaacaaaactgccaaactgaaacatttacattaaaatggagaagtactgtgattctactgaaagggaaatgctttctgaaaacctttgaatttgagtaaaacacatttagtttaatctgtagttagaaactgatacagaaaactctaaatatttgctatccaagtggttccagcctggcacacatatgcagcttctcattttgtgggaagaaatacagaggcatgaggaactgcttggtccagcttgttgcagtatgcctgtatttaaaaattaaaagcactggtgctaagatgatcttcgtatgaaatgtatagatcaattagtaaagtacaatttgacattagtttgctaggactgccataacaaagtaccacaagttgtgtggcttaaaacaacagaaattgattgtctcatagttctggaggctggaaagtcctaaatcaaggcattggcaggggcatgctccctccaaaggatccagggaagaatccttccttgtcttttccagtttctggtggttgcctgcaatccttgtcattccttgacttgtagatgcatcattccagtctctttttccgtcatcacatgtcattctctgtgcgtgtgtgtctgtgtatttacatggccttcttagaaggacaccagtcattggacaccctaatctagtatgacatcatcttaattaattacatctataaagacacttatttccaaataaggtcacattctgaggttctgggtaaacataaattttgagtgagggacaatattcaccccagtacagcatggaaaactgatttaaccctgaattaattcttcacgtgtgagtgcaaattacacaaatctaatataaaataatgaaatgttaccctgtcatccattaattatgctttattgggaattggtgttaaagtgttatttatgtcttgtaatgatattttgaatcagttatggattggaatttgtatgtgatacattggaaggtcagtgggtgggtgagtttttgatggactgaaaagccatgttttttggattaaaaacattttacaaatattatttggtagtagttttcagtcttctcagtttctagtataaattttcctattaaaataataaatgtttagtttgtaaatcaccagtgttacaaaacattgttaaatgacacatctctctgccaaactttgacaactaagttttaaacattaactggccatctgtcatacctctgaacagctgttagcatttgttacgcactgctgtttccatagtaaatgcccccacctaattaagattatttttgtaagaagtcttaaaattgtggtttctgaaaatataatgggtgattagattaatatagcaatttattgatgaatttttaaaattgcagtagcaattaatttaggagtctttataatattaatttataagtagacttttataatagacttagtaacttttaaatattgcattagcaattaactgatacttggaatctttcatattttgtatggccaacatctttattataattttttaccgtttagggagagttagcatttttccatctggcctggagttagccatggaaaactacaattcttgatttactatttcgcttttttgagatgacattaaattagtagccatatttagaagagcttatttttagaactcagaagtttcctaaaggaaaaagatggaacttctacaataatctggagataatgtttttgagcaatttggggtctgagaagtaagttaaatacaatgttaggtttggatatttaaagagattgccaatcaggaaatgccaaagctaagtttcccaagaatttgtagtccagccaatttgcatttaaatgtctagaataataaagcctatctgaggaccttcagaggatgagctactagtaatttctcagggccccatccagtcttaagagtcagctttggcaattatgaaaccagctgcacagtgggcccctgcccagtggtggtggtctttgtgcttcttgcctcctggggctgtagactgaagcgcattgctgttccctttgaatttgagtgtctctccactgttttctaactggaggggcaaaacctcccatatctgtttctctccatgtattgaagtagtattgtcagtgtaaaagtacggcatgaaacaaaatacctgaaagctagaaataccatatgtcgtgaatattctcaaagtatttttccttctttcttaatgtaaataaatgtcaataaacttagcaaaaaaaaaaaaaaaaagccgctaagcatatggttctttgttaagcagcaatagaaaactgatagaaccaggaacaagatgaggattgtccactccccacttctattcaccattgtcccagagactctggccagtgcagctaagacaagaaaaagaaattcagggcatgaagattggaaaggaagaagtaatatcatcctttcccagagttgttatcttgcatgtagaaaatactaaggaatccacaaaaaatctaatagcattataggcaagcttagcaaggtcacaagataccagattaatatacacacattatctaaatttctatatgtgagcaaaaaataacccaaaaataaaattaaagaaatattcacaatattataaaaagaataaaataggaataaattgaacaaaaaaaatgtaggatttgtatactgaaaactaaaaaatgctatgaaagaaagatctaaataaatgagcagagatatactgttggattggaggacttaatattgttaagatggcgcttttctccacattgatctatagattcagtgcagtccctatcaacatcccagtaggatttctttgtagaagtcaacaaggtgatcctaaaatttatataaaaatgccaaaacaattttgaaaaagaaaaaaattggataactgatttcaaaacttactataaggctacaataatcaaaatagtatggtgttggcataaggatagatatacagatcactgaaacaaaaaagagtccagaaataaaccctcacctttatggtcaatttattttcaacaagattgccaatgcaattacatggaaagggggatagtctttttttttcaaatggtcctggagcagttggagatccatatgcaagaaatgaacttagaccctgtctcataccatacacaaaagaaaattgcctcaaaatggatcatagattcactttaagagcttaaaactataaaacttttaaaagaatataggaataaatcttcattaccttgggttaggcaaagagttcttagatgtgacacaagggaatttggggggattacggaaatgttcttaagctggattgagatggtggttgtacaactatataaatttactatcatcccactagatttcacagggccattacactaaattaaaatttagctttgtggctaagaatttaccactgattcaaaaatactaaatatggttttttctcccaagaactgttttattaaccagcgtgtagttgtgccttatggaagaagtccaaattgtgttttttgtttgaaaatgttatgaattacataactttatagattttcaatatggaagacaccttagagcaacttattttagttcattccttctacattcaagtacatatttgccatttccaaaaattcacagctttttgatacttttttaacatcaattttttggtcttttttgttgtggcaagatatatataacataaaatttgccacttgcaccatgtttaagtgtacagttcaatgacattaagtatattcacattgttatacaaccatcatcactatccatctccagaactctttcatctttcccaactaaatgtctgtacccattaaatactgactcccattcacccctctccttagcccctggcaaccacccttctactttctgtccctatgaatttgactactctaggtaccacgtatataagtgaaattatccagtatttgcccttttgtgtctggcttatttcatttagcatgatatcttcaaggttcatccatgttgtagcatgtgttagaattttcttcctttttaaggctgaataatattccatcgtgtgtgtatagtacattttgtttgtctactcatccaatattgatgttttgtggttgataattatgtactaggaaaaaccaaattctcagaataaggctgtctaatcgtagggaattctgcctcgttccatctccacacaattactctttctaggatgcaagttaaatcttatgctatacatcttcgtgaaggaatgtgtgatttccactgaaagtattaatgactacggaagtccctccaattcccttatttgttcagataaattacttcttaaagcagggtttagaatttactctagaataccaagaataatgaatcagcttgtcaccagtatcagtgttacccactgagtgccattctctttttatgacaccatgatcaactttaccaaaaggcaaaggaatttgcagaaagccttctaagtacaataagcactgattcttctttatgctatgctcaaggaaaggaggggtttccccctagaaaggaatgtgatatgctcagttaaagaatgttcgatggagtggcttgcagcattcataatccaagaacatagctgttttcttctctttgtggcccttcaaacatgatctcataaaactcttctgccagactgcctttgtgctattctctttaaatttttcatgacagaaattcatttttgctacagctacaccaagtacaaatgcttggtgtttacctatgcaaaataaaaaaggtagcaaaagccaaaaataattaaataaaatattatctgacacacctaatgtaacataaatgttaccttttaaagcagcacattaataattgtatgttcatttaatgtaaatatcatttaactcttgtagttgcttaagaagagccaagctaggaaatgtgattttaacactttaaaaaaatagaaaggaaattaatatcatagtgaaaatttctcatagttgggcaagctcttgtatctgatactaaaaagtaccgtatttcagaagattttattaaaacaagataaaatctgcctatattatatcatgtaactggtttttttcctcatgctttcttttgctcaagaataggcattatgatttgtgttttacagggcttaattttagagttatttgaccacttgaaaaaggcatagagaacagtcaagctaggtcatctgaggccagtgtttgagtttctcagaaatagctgccaactgaccagaaatctgccacactggcctatgttgttaggccaccaaaggcacagtcttcttggattgaactaggaggtcaagcaagtcttaatttcttgaattcaaaaataaatccctgtaagtgcgatgttctaataggattagaacaaaagcagccctgtatacagacaaataaaacctaaacaaaacaagggcctccttagaggttcttttgctgtcaggatccaaaggatttttgcagctttttcaggaaatcttgtactggcccagatgtactgattttttaattgccttttttgctgacagaagaaaactttaataatggatttagagcagcgtattactaggccagctgcactccttcttgcaccttcaagtaaggatatattccccatcatgattttactaaaacttgatttaagttagcatttcactgctaagctattaaactaaagctttcccggaacacctaactcaagagcatccaggaacattcttcttggccattaaatacagtaagcagttgtccattacatgtccatcttcaacttgagttatgtagtacaaactgggccatggtattgggagcagccctgaaccttagtccagggaaaatctaaattccagggtggaactcttgctccttgatttcagtcactagatttaggaatttacacactttttaagatgagaaacaaatttagtgtaagatttgtaaaattttcaaaatgaatgaaatgaaatcttcaaatgaattcccttcaaatgaatggagtttgctatctccatgcagatagtcatctgtatgactattatttgagtgctttcaactatttaaaataaattgatttttagcaattttgtagaatataaaatttcaagaaaaacaatttttggtgcaggtaggataggcattctttgcacgtcaaaaaagaaaaatggcctgagtgattttgatttctttttgtaacttgtaatatcccaatgatacagaattgtgtttagatttgtaagaaggacaggttatagaagttcttccagccgggtgccatggctcacgcctgtaatcctaacacgttgggaggccgaggtgggtggatcacctgaggtcaggagttcaagaccagcctgtccaacatggtgaatccccgtctctactaaaaataaaataaaatacaaaaattagccgggagtggtggtgcgtgcctgtaatcccatctactcaggaggctaaggcaggagaattgcttgaacccaggaggcggaggttgcagtaagccaagatcgtgccattgcactccatcctaggcaacacagcaagaccccgtctcaaaaaaaagaaaaaagaaaaaaacttcttcctagtgtttaattgtagctccttaagtttttgaaaatgccattttaaattttgcaatgtttctttcacacttacgttgcccatcatgcaatctttaggccactgctaaatacactgctcttctccaagcttgaactacatgatgtttaatgatgccaaggatctttgaaaggactctgtgtgtgtgtgtgtgtgtgtgtgtgtgtcagggcctcagtctgtcactccggctggagtgcggtcatgcaatcatagcacattgcaacttcgaccttccaggctcaggcaatcctcccacctcagcccttcaagtagctgggattacaggagtgcgccaccacacctggctaatttttgtattttttgtagagacgaggtttccacatgtggcccaggctggtctcaaacacctagcctcaagcagtctgcccaccttggcctcccaaggtgctgggatgacagatgcaagccactgcacctggcctcaacaagtttatatgtaaacttgagcaagaaaaatagatttttagatcttacaaagttttctgtgatctccaacttcagaaaatcagttccagtacagtaattgaatatcagttctctgtgtttcagtattaaatcagctttccctaatattttgctcaatttcaaatgtatatgagaaaatacctgttatgtattgatggctgatctgctcagttcactgaaaagatgtgacattgaaactttgttcctatttacccacgtaattcacagaaactgaagaaagttcttaataagatagtcagtgtttccagaacaagttatttcaatggtcattattgctacacagtgtaattccgtgcacactgttattatctgttttattaggatcatcacagacacattcattaaatattttgcagctaaatatttgattcttgcaaactttcattcttttccagcaggaaacttcttcagtatctataaagtaagtgataagatgatggttgctaatgaacatcaatgttctttgcaaccctacaagcctatgcctacagtatagttgcaaaagttatcaacttgtctgaaacagtatacattctggtccttagatttggttttctctgtgcaaaaaaagttagtgggacatacaactcagtgataattattttatagcttcttaccatgcattccattttaaatgttgatcttgataaatactgcacataaactatgagcaaaacacaggtttctatttgataactaagaaatcagaagataatgtgatataatgagtatgataaaaaatgaaacttgatttagtgctttgaatgtaaataaaaggtgacatattaactgattttatcatctttatgtttgaaagtacaatctcaggagatttgaatttaatatcactaccaagtttattctgcttcatttgaaaacccatgtcaaatgtagaatgtgttctctttatggaactgtggcgacacttcctaagacagaaagatgaatgaagcgtgtcggtgtaggtatgtgtggtcatatctgactcagtaccagagatttgcagagagcaggcctatctgtgagacaatatgagacagtctgtttcccttgcagctgttcacatttccttgttttgccctggtgttgtgtgtacatgttttttgttttttgttttttttaataaaaagtgctgaatttgggtaatgataatttcattagaaaaagagagtaaacagtaacagattcattcttgttttccctctagggataatttattaacattcttccttctctcttcctcccccttcacacctcagctttacaaatacacctgataccttcaaatttcaggaaagcaaatagcaaaaggaaatacattttgtcattccaatataacttgaatttaagcttctagagcagggattcacaaactatggccctcaggccaaatccagctggccacctgtttttgtaaataaagttttattggaacacagccatgctcattcatttatggattattaacagccgccctcatacaacacaacagggtttagtggctgtgacagagatcatatggcctgcaaagcctaaaatatttcctatcttgccaggataggattaggatcctgatattctttttttttttttttttgagacagagtctcactctgttgcccaggctggagtgcagtggtgtgatctcggctcaccttaacctccacctctcgggttcaagcgatcctcctgcctcagctaccttagtagctgggactacaggcatgcaccaccacacccagctcatttttgtatttttagtagagatggggtttcatcatgttggccaggctagtctcgaactcctcacctcaggtgagaatcctgacattctttaacatggcaaggcttgtaattgagtagctaatagttttcaaatcatattgagtgtatttttccctgcagcctataaatagaattttttacagcttttttcccaagtatttgccaaagatatctccctggcacaaggcattgtgtattactgaattctagtaacaagctgaggagatctggatgagagaaaggacagcatatcagcagggcagggtcaggtccctgctactctggctgtatgaccctgaccatgacagttcacctgactggaactcagcttttgactttttaaaatggaggagttgaatcatgttgacatctaagatctcctcttttttttatttttatttttttggtaccccaaacagagtctcattctgtcacccaggctggagtgcagtggcacaatcacagctcactcatcctgggctcagggaaccctcctacctccccatcttgagtagctgggactacaggcaatcaccaccacacccagcaaatttttttatttttttgtagagacagagtctcactatcttgccgaggttggtcttgaattcctgggcttaagtgatcttcctacctcgtatggcctccccaagtgctgggattacaggcatgaaccaccacacccagccctaaggtctcttttaccttgaaagttgtataaagtaagtcagacttaaaagatacaaaagaaagaattaaatatagtcaaaacacatttcttaattttgagggaaagtttttaactgcacatgcaggatcgaagagaaataatatctggttcctaaagaaacaagctgaaataaatattcctggtgtgtttattttatgttactctgaattttttttaaatctatttacaatttctatgtactagtccaaatataatacttattttttctagaggaagcatttcttaaacactactatgtactcagcctcacgctaggggctattacctaatgtcagagaacccgagtctggtcgtgggaaagaaaaagaaccacttaaacagcatgttctataatgtacctcagacattcagttccctcttggctgttgatgcccttggtgtggcagacaccccagtgttggctctgtcctgagttgcagacgtgtggtttctgcatcgtcagtatactcagcacctggtctcagaaacgttctcgtcccctgcccccaggggttaccacatagctttttacttctgagtcctcttgtcctcctgggcagggctgtatccagatggctccagccaggctaccttctgcagtgtctccttgactcatgggaaacacacacatgcttaactcaacatacactacaagcatggcctgccccaggcggcctccagtcatgaaagaggcaggcaccagtctctttttgcttaggaccccaaatgctacatgtcaagctgccccaaggactctctctcacacagagatcctttctagtgtaccaaggtgggcctataagttgctacaattcagcaagcatccctccagagaatgagatagtgagctcttctggctggcacctccagtgtctaatgcgtggttcttttggggcatctaccatccttcactttgtatgagggagggtgcaatcccctctcctttcctcccgaacaagaaggagaagggaataatcaaatacttgctcttcttagtcctgtgactcctacaaatcccagacttctgcctctataggcagaatgaggggtcctggggtgaatatggaagggccattttgactgcctttcagcaagcccaggagaagtggtctagcagctttatagcaggttcagtgccatttacttcctcttggccttagctttgggctttagctgaaagtccaagactactggtaaggtcccaagtaacattttatatattctttatatatgatagaatggggggtgggtaaagggtaagaaagacaagctgcagtcttcctttgttctcaaaacccagctacctttcatttgccccagaccttgacaaaactctacctagatttgaaatttgagtcctgcatatctttgcaggcagcatataatatgcagatgacccatgagaatgagaaatccaaaagcactatgtttctaactactgtttttaaacacttcaatgttacatcgcattcgaacttttttccattgatgactttttatttacctgctttgccatatttctcaaatgctttgtatatgctatggatatcactaaagtattttgagtctctaagacaaaaatgtagaaattggtgggggaaatgaaggttgacatattatgcatatacatcaagatactttccaacttcgggttgcccactgagatcattgccagttgttattgctggggaccaaactacttactctctggtctccaaagggttgaatccttcatacatttctgggcctttggttatacagatttttggaatttgtgagctctttgaagacagaaactcatctttttcatctctgtatccctagtacatagaaccccacattttagtacctagtaagacttcaataaatattgagtggatgggtatgtggatgaaccaacaaagggtcacttctctctgacagtgacaaaatgagcccattcctcactccctcctgcttcagttcttacttgcccttttggttgatgagccagcagccgagattcacagtgtattctttgccacatggacaccatcctctctatcctgtggctgccttgagaggtgcagtttctaggacttgagagctgcagtttttagaagaagcagagcccaatgcccccacctcaggtagaagccccaccttttaattccttcccattgtatctgcctttcatattaagcatcccacctccccctcatcctgccactacttccactgaactttaggtgagttgaatttaatttaagtgattgaactggatcagaccagaccaaaggcgtggaaaaaaatttggtctgagtattttccttggagcagtgcctcaaaagagattccaggcacttgtgtgccacctatgaagttgtatggatagaacagcggttctcacttgaccactctgtgcctcatttttctcatcttaaagtgagaatagtaggggtaaccaactgcgtaggattgtttgaggttaagtgaatgagtatatgttaagagcttagactagtaactatcatctagtaagtgctcaataaaagtaatattgttgctattagtagtagtactattagtactctcaaaagttagcactggacataagattttcaaatacctaaggagtttattaaagcacagatttctggacctccttcttaaattctgatgttgtaggtctggaggggggtccaggaatctatgttccataagtactacatctgattcggccacacgttcttaagaaattacagatataagacctaaggaactgtatatgacatagtaagaccaggtcaaaaattatctccaatttggggagttgtgggattattttttctttgtgagaaaaattgatgtgcatttattaaatgtttaaatagaaacgaaccataatcatagttgaaaatgttggaaataatagtccttgatcaagaaaaaggcaaaacttacagtttatcatggaattagacattataaagtgatggtgctatcaacttgtaaagcctcaaattaaatttgctttttttctcaaacaggtttgagattttttttttttttttttcgagacaaagtcttgctctgtcacccaggctagagtgcagtgatgcgatcatagctcactgcagccttgaccttctgagtagctgggaatacaggcatatgccaccatgcctggctaatttttgtatttcttttgcagagacagggttttgccatgctgcccaggctgttctccaactcctgggctcaagcaatctgcctgcctcagcgtcccaaagtgctggaattacaggtgtgagccactgcacccagccgggtttgagattttataaaaatatttttatgtattcacttagattatttaaactttgcttgataatattatgacacgtcagggggtgactaaatgtgtttttaaagtgttatgtatttttttaattgtgataggaacacttaacatgagctctaccctctcaacaaatcttaaagtgcacaatacagtattgttggctgggcacggtggctcacgcctgtaattccagcgctttgggaggccgaggcgggcggatcacaaggttaggaattagagaccagcctggccaacatggtgaaaccccgtctctacttaaaatacaaaaaaattagctgggcgtggtggcacgcgcctgtgatcccagctactcaggaggctgaggcaggagaatcgctcgaaccgaggaggcagaggctgcagtgagccgagattgagccactggactccagcctgggagacaaagcgagactccgcctcaaaaaaaaaacaaagtgcacaatacagtattgttaatgatagacacaatgttgtacagcagatcactagaacttattcatcttgcaaatgtaatgtagtgtgtgtgtatatgtgtgttttatggtttcttagtttttttggttttgcattttgtttgggtttgggtggtggttttttgttgttttactattttttattgcatgcatgcagtgcaattcatttctataggctagtctggaaacctaatcactatttataacattatttttctgggaaaatatgatcccagttacaacattgacatttctttagagatagaaagcattcagaagatggagactgcccacatatattttacagggatttgggcaaacttttgtggacgagccacaaatcaccatttccctaaaatgttaatataatgttttaaatagagcagcattttactagtctacttatactatttatttaatctctgatttagtagtgctttcttaattaatacatcatttaaaaaattgtccctgctctatcttcacattgcttttgttaggcatttttatgtatgatgtggcccaaatatttataagtcataaaaatttatcttgcattagtataagcaaatctgactataatctgaagaatgtttatagtcagtatttgacttctcaactagcattggtgtacagagtaggtgaagaaaaaaaaaagaataaaaccgaccacgaaaatccccacctgttttagagaagttaggaaataaaagtgttcacaacagccgaggtcatctttaacttttcacttttcaaagcagactgttgactatgaaacactttatttgaggtagaaattaatattttaattgtatttctaaaataattaaatgtatgttcttcagaaagctgaactttggatcatttaggtttgtggaattttagaaatatatttagtttctttcttttttttttttttttttttttttggagacggaatctcgctctgtcgcccaggctggagtgcaatggtgtgatctcggcccactgcaaccttcacctctcaggttcaagcaattctcctgcctcagcctcccgagtagttggggttacaggcgcccaccactatgcccggcaaattttttttgtatttttagtagagacggggttttgccatgttggtcaggctgttcttgaactcctgacctcaggtgatccgcccaccttggcctcccaaagttctggcattataggcatgagccatcgctcccagcgtatatttgctttcttttcagtgtcttctccactctgaattggcagagtcaaaagaaaaaaagtttatgtccttgacttcctgctgaaggataccagcactgattctgttaatgaacagccctagtaaaacaaccataagcctttgtgagaacattccttcctagaaggagttgggtttgccctttcccaagatttaggtttctgtgaaaattcttccagacgtgccttggccagaaagcattctttcattttactccgtgtagacgtgccttggccagaaagcattctttcattttactctgtattcatgctattgaaagttgcttctgtcagaggaaacaaacactgtgattgaggaaatattgatgaattttaaatgacaaggaaattgccacattgacagaattttggtccatctatttaaagatgattttttgaaaagatatgcataagactcatattctgacaagtttcacagaacaattcagaggttattaccaagaggatcccactgaaatcatcagcctgcctttttaaaagaaaaatattgtttagtgaaataataaatatgaagctctgatttttagcaaagaattgtgagtgtttactggattttcttctttgctttttagctgtatgacaaaattaacacaaagtcttcaccacaaatcaggaatcctccaagcgatgcagtacagagagccaaagaggtaagtgatatattttatagaagtatttggcatcatcatatttgccacctttattgaagacatttctgttgcacattaagaggcagtttccctggagtcacaatttgactcattatattcagatttagtatttctaagtttattactgaacatacagaaaagaaaaaagatctctgcagcaatattgcctagatttctagttctggttctgcgatgtaaacttgaatacattaccatcaattttacttctctttttctgttttttaaaaaagcaagttattttacaacacttggtggaaatagacatgctataaaaatttgagttgctttttgaaggtggtaatgtttgaaagttaattaaatttctgtagcaattaaatatactgagttcaaagaagtcatttttgtaaattgtcaaggtatgtggctatatctgtcacaaacttttaaaaacctatttatgatagaaatacaacattgcagaaagtttggaaaataaaaatagatccataatctcatcaccctaacacagtagtttccatttttatatatcgttttctagtcactctccatttgcatataaatttttttatagttgtaatcaaaatgtgtcttttttaacctaccgttatataataagcatatttccatgtttctacttgatctttacaaatataacttctaatgactgcaatatttttctttgctgttattaaagtataacatattagcaattctcccattgttagacacatgggtttttttttttttcattttttgatcatgtcagtctttgtgcaaataaacatttttcttttagaaaaattatttcttataaagtgaaattactatgtgaaagactatgaaggacataatcccttccctaccagattttagacagaaagtctgtactggaagatggtgtacgttcactgagaaatgagacccatgcagtggaggctgcccggcctgcccacttggtcaggactagcttggaggggttgtctctgacttcaccaccaagggctcatagaagggaattaagatatcgctgatagaggcatgaatcaccaccctgtcttcacaatacgcagatagaagcagagagactctggggacaattctttggctcaactggacagtgaaaacctgctggtttccccctaaccctgcttaggtggaaataccacacctctgtatttaaaaataaactaggagaggagcaaggacccagagagagtatgtggttttgtcctctcatttcactaatagagaaactcggagcataaaatacaccaaggataattggtttatcatcttgaaacaatatgaattaacagcataaccagcactctaatgaacagggtattcggataagaaagctctgtcatttttgcttgtttgtttgttcttccctgaggcagtagttgagtagcacagaacattctagttatgatgctaaaatctaaggctcgggccatgtgacctcacaacatccccctcctgccccagtaggaagcttttgtatggttttcacaggttgaggtgagagtcctcctggatggatggtggtatgatcctgccatccagttgtgccaaagcaatcctttattggcttaatggttggaattcagttgagtgtaatgcaaacctctgaatccagccatatgcagttagaatagcagcaggtgtttactcagaaaaagaacagaggctttttcatgggttcatgtcccataaataacttacacaggtaaactccatcctggtggtaaaggagaactttttaaaacaattttatttgaaaacaatcaattttacctgtgcagaaaaatgttaatgactaattagtgaagaaaatttgagtggaaagagaaaataaggctttaaaaaattgttctcttaggctccctggcatttaaccctaagagccattagcagaggcatgactttctctgtgtgggcagatgactatggggaaaaacattgatccggcaggcatttttgcattttctacattacttaaagaaaaattacttgtgtattcttaattaagtagtctaattaattagttctgttcttgaaatcgtttctatttgtgcctgtgtcattttgacatttctaaagggaattggcagtgctgttaatataaaagaaaacttcttattaactttttgtccatattgatttttatggtgagtttggaaaaggatattcagagatactcttccgttaagtttcataaatctgtaataaatatatgttgcagccttgtcattttgctttatatttttcaataaccttttaggttatagttgacagacttttagaacaatttgcttcatttttattaccatcaatactgttcttctatgtattaataacatttgaataaaatgaaaagtttttcaaaataattgttttgcctgccataaaaatccactcataatttttaacttaaaagaatttaacattttgtaaatcttgtgtcatgtttgtattattgtatatcttgtttattttttaggtattggaagaaatttcatgttaccctgagaataacgacgcaaaggaactaaagcgtattttaacacaacctcatttcatggtaagtaataattaaacttccatagaactgaaacctcactttcaaaagaagtttttaaactaccctcataaaatgtagccagcttcatctcatgcatttttatccatatcatatgagactattaagattacaataccaggtaataccaaatattttaagactgttttgtttactttgtgtcacaactgtaaagatactcttggtgaagtggcttttcagggactgtactcatcagacaagggattttctttcttatggggtagtcctttagtcactggaactgtttatgttacttaaaccacaaagaactaaaattagagacagttttcaataataaggaatcgtctgaatctaggtgatatattggaagaattacatctcttttgacaatgcaaaactgctgcactttcttggttcatttctactatatggaaaatggggataacacctgtatttagccaaatataaagctaaatagctaaacaaagctcaaagctcaaaatagataagatactttgctgtggaaaaaggtccatgcttatctacctaactgcaatacaaaaacacaattacagatggaaattcatgttgaatataccattttaaaagcattagccacatcagtttatgtgaaaaatatgtgaaaagtggaaaatttacctcactgccctttgggagaaaatctgacttaaaagccttgttcttataactactattacagatgatactttgaatttttatttatttatttacttttgagatggagtctcaccctgtcacccagggtggagtgcagtggcgcgatctcagctcactgcaatctccgccttccaggttcaagcaattctcctgcctaagcctcccgagtagctgggattgcaggcgtgcaccacgacacctggataatttttgtatttttagtagagacgaggtttcactatgttggccaggctggtctagaactcctgaccttacctcctgcctcagcctctcaaagtgctgggattacaggcatgagccaccatgcctggccacaggtgacacttttaaaataatagtaacagtataatatgtgtatcaaagcaattacctgtgagttattatatatatgctgttttatgatagtgtttctttttttctttttcttttttttttttttttgagacggagtttcgcactgtcgcccaggctggagtgcagtggcgcaatctcggctcactgcaagctcagcctcccgggctcacgccattctcctgcctcagcctcctgagcagctaggactacaggtgcccgccaccacgcctggctaatttttttgtatttttagtagagacggggtttcactgtgttaaccaggatagtcttgatctcctgacctcgtgatctgcccgcctcagcctcccaaagtgctgggattacaggcgtaagccaccgtgcctggccctttatgatagtgtttctaaacttttaaccaagttattgaaataaagtttttttcctaaaagtaactacctggaaagaagcaattaccatattcatccttcctaactctcccacccaagcattaaaggctgaattcaagtataatccttgagagtatttgactttattctatggtaacagcactgtccagtgaaatacaattaggatacaggttctaatgcctgtagatgagtgcatttttacaacctaggtgtataaacacagaacttcgttcaaatctcacctcttttatcaaggtatcttgtaacctctctacccttctcttgaactttctcttctctaactcttttccacttgtttgtattcacctgcataacattctaatgcttgctggcctgccagagcaggtctcttcccagtgaatgagccagggcaatttttctttgtccttccatatcccagcccagttttgttgttctcattgagcttatctcatttagtcattgtgattatctctatttcacagagcaggagaataaagaaactatatgctttattaataatcctcaaatgtgatgaatcacaaatatctgcagttaaattaccgttaatattaccttgttcactgtttcatgcatatgtgctgtgtttccccagattataattcattcccttttagacagcatgtcttctatagcaggggtctccaacccctgggccactgaccagtacccatccgtggcctgttaggaaccaggccacacaacaggaggtgagcagcaggccagccagcattaccacctgtgtccccctcctgtcagatcagcctaggcattaggtcctcataggagtgggaaccctattgtgaactgcgcatgcgagggatctaggttgcatactccttatgagaatctaatgcctgataatctgaggtggaacggtttcatcccaaaactattccccgacctctatcccccacccccacccaccctgccatccgtggaaaaattgtcttccacaaaatgggtccctggtgccaaaaaggttggggaccactgttctatattataaaagtggttaaagatgtgaattcagatgacctggggttgaactccatccttgccaccgtaactttatgaactctgactctgagtcaacctcgtggagtcagaataagaattaagtagctgatatatctactgtgcgtagcacaatgcttgacatatgcttagtgcctaatagatgttatctgatacctattattagttgctccatagtatctatcatgtatagggcacatagtaagttatcagtaaaacattgaatagattaggaacctgcccgtttgcagataggttaggctctccttggctgactgctctgtgcagtgttccatagctagaaacagatatataataaattttggaccaggcacagtggctcacgcctgtaatcccagcattttggaaggccaaggcaggaggattgcttgaacccaggagtcaaagaccagcaacattgggagaccccatctctacaaaaaattaaaaataaactagccagacatggtggcacatgcctgtagtcccagctacttaggaggctgaggtgggaggatcacatgagcctgggaggtcaaggctgaagtgagccatgatggcaccactgcacttcagcctgggcaacagagcgagaccctgtctcaaaaagtaaaaaatgccaggaactgtggctcacgcttataatcccagcactttgggaggctgaggaatgagagtcatttgaggtcaggagttcaagaccagcctggccaacatggtgaaaccccatctctactaaaaatacaaaaaaaaaaaaaaaatagcctggcgtggtagcacacacctgtagtcccagctacttgagaggctgaggcacaagaatcacctgaacccaggagacagaggtttcagtgaggcgagatcacgcctctgcactccagcctgggtgagagtgagactctgtctcaaaaaaaaaataaaaaatgaatttggacagacatgtctttctataaattgctaagtaaactcagctcaattcagagaatgatatagggccgtatgagaccaatagatctttcagatttgaagtaagctaaataaattaacatatacccaaataggagccttttttttcatcaaaatcattacggctcatatagcccattgtatgacagcttatctgtcttctaagtctcgatatgttttgcttttctgaagtcagagagaagttaatatgtgcattgctattagtaaacattttcagaaataataagtaatttttataatttattgaatacctagctaggtgcttaaaagacattttcattcatttatcaaataagtaaatgcctactgtatgccaggcacactatgccaggcactaaggacctagtaatgaataagacaaacaagatccctgccctcatggaacttccactctagtggaggtggggtgggaggacaggtaggagaggtagaggtagacaatgagcaagtaagctaacaagataatttcatatggcaataataactatgaagaaatgaaaggataatggtgcagagattatagtaaagtgggagctgctttagataggggaaagcccctctgaggagtagacatttgggctgagactcctttgaggaagagcaaatgcaaaggcccagagacaggaaagagctttgtagattcaaggagcagaagtcctttgtggctgagatacagttaacaagggagagagtggtacttcctgtaccaagagaggtcagcagaggccagaccaatttatttatttttttaatatataaaataaggccaggcatggtggctcacgcctgtaatcccagcattctgggaggccaaggtggacggatcacgaggtcaggagttcgagaccagcctggccaacatggtgaaacctgtctctactaaaaacacaaaaattagccaggcatggtggtgggcgcctgtagtcccagctactcaggaggctgaggcaggagaatctcttgaacgcaggaggcagaggttgcagtgagttgggatcgcaccactgcactccagcctgggagacagagcgagactccatctaaaaataaaataaaaaatataaataaataaaagccttccaggccattgtaaggagtctgcagttttctcctgattgcagtaggatgacactaagtgatggcacgcaggaaaatatctaatctgtgccttgctggagctgatgtgtagagaacggactgtaggggggataagagtttagggagaccaattggaaggctgttgtgagaggttgtagaggcttggagaaaggtgaggatggtagaacatgggcagatggggtttctgtgttggagatggttacatacaagaggacttgctgatggttgggatgtaagctggtgtaattaaacccatttcacaattccgagaggaaattgtgccctaacaaggtaaagagacttgcttaaggtcactcaccaatcagtggcctcaatgaggttcaagccagatcctgctagcgccaaagcctatgctcctaaaagtcagttgatttataatgctaatcagatttctaataaatttaagttgagctcattggtcattcctaaataagcttttgtgtagataatatcttatgtgggaaatataattctgagatatatatatatatatatactatattaaataagcttttaaatgctggggctttctatcttataagcgtttttaaaatcatggcttcaaaatcttggtatttttaaagaaatattaatagctaaggggaaatatgttaatacttacaatttttttattatgccaaggtttgggagttattcttggcatatttataatttcacacttatttgctcagtcatccgaatttttctttgctttctgattattataacatgaggatttaacattgaattacccaacactgaaaatccagatacttgtagatatttacagtaactaaaggaagaggaaataagggtaaatttaaacgactttaaaattctgtgttttttttttttaagagacggggtcttgctctattgcctagataggagtgcagtgacaccttcttagctcactgtagccttcaactcctgggcaaagcaatccttctgcctcagcctcccaagtagctgggactacaggcatgcaccaccatgcctgtctacttttttttattttttgtagagacgggggtctcactttgttgcccagactggtcttgaactcctgagctcaaacagtcctctttccttggcatcccaaagtgctgggattacaagcatgagctaccacacctggcctaaaatctgtatctttagaggtcatcataaaagaatattatctcactgattacttttttagttattccatttgaaaggctgactttttaaaaagaatatttcctttgcttattgcagctgtaaaatatgaaacattaaatagtcagattttttccactctagtctgatgttgttagttgtcttatacatatccttactatagtacaaaaagtgaaagtgtttttttcctattacacgattgttacgtagttaaaactgacagctatttcagcttagtgacaactgctcactcatacgtcttaacatatttgaagaaaaatgttcaaattttggtttccctattttttattttatatactcttttaagcttttaaaaagatagtctgtaagtggccccctttttctgtttggatatgaattagagctttaggttaagtttcgttttgtggtagcaatcatttacagtgccaaattgtggttaatatcgagtatgaccttatttggtgacatcatttaagcatttttcttttagagtccagtttgagtattattttatgattgtgggcttaatccttccttgtaaataatgcattaaatacaaatgtttgcttatataatttaaaagaatgagtagaggcctgtaatcccagcactttgggaggccggggtgagtgaattgcatgagctcaggagttcaagatcagcctgggcaacatgatgaaaccccgtgtctacaaaaaatacaagaatgatctgggtgtggtggcacatgcctgtggtcccagctacttgggaggctgaggtagaaggttcacttgagcccaagaggtcaaggctgcagtgatatgacgaacataattttagcaaatgaaatgttccagtttttatgttactgatttttgctttttgccctaaatcttggtttcttatgtgaccacaattaaatcagaaaaagagggatttgcccacataggacagcctctatacttgggctcaggagtaccagtacaaggtgcagttagggcactggtgaggaagccaaggtccccagggccatcatggagcactactttcaagctatatattgcttagtgccccttggtgctcctcacccaaatcccagtttagaccagccttctgagattgtgaaaatatctgccatttccattagaaactcaactgtgtataatgctcaaagcatattctttactggtaacaaatcagcattatcttctttatgattttaccagattgttaccttttttttttgcctcgtatgcatgcctttaaaattaaatagccaagtcatgacttttttaagccttttaataaaataacttaatttcagatgctatgagttattatttttaaagcaattttaactgcatttcattatctgcagatattaccgcacagatcccaaattaaaatagaaccaaatttatagttagcacataagaaaatataatctttgtataaagctccagacattttgatagctgtagattctctttgaaatagaaatgttcaaatatttatgcttaatagaaagggtttattatgatggcacaaaaagtgtggtgagtagaaggacattcttttttagggaaacaagggacattttattgttgaagttcaccaagctgacaaatagagatgtcagttcaaagaaatcactttctctttgttaataggctttgcaaaaagaagtcataataataattctcaacttattttttatttaaacaagtgctccaaaaaatataatgaacaaaaaaatttaacatatttagagtttgagttccatatcatacgtgatattttggaagattacgtttttaaggtacatctgtgtgtatttttttctttttctaaatcatatgctataaattattttcatcctttgggttatataaaagcgtcattgtaaatgccattgatgaaagatacttgctcaatactccaattattgcactatttctttttaaatttgtttcaattctaagccccagcacaaatttgccaactctatttatagatgattcttttagctaaattacttgaaattgtaccgtctaccttcatttgaacaagttagttgataacacctctgacccagataatcatcaaacacatctcttcattgattcactcatttattcacttacgttttaaaaaatctatttatcatgattgtcacaaaaaaattgagatagttggatgtcgatattacacactttatgttctctttagatgaatgatacctttgagaggaaaagaatgagatatgtttatagaataaatttgtcagccccatgtctacaaagaaaacatttaaaaattagccaggtgtggtggcatgcacctgtggtcccagctacacagaaggctgcaaaggaaggatcgcttgagcccaggagatgaagcctgcagtgagctgagatctcaccactgcactgcaccctgggtgacagagtgagaccctgtctcaaaataaataaataaataaaataaatttctgctgaaatagtaatgttattaataatttttttcttcataaaacactaggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatggtaagtaggaagagaaagttttcaatactctcataagatcccagcatgagttatatcaactaacttcaacctatgctactaggagttggggagggaaggaagacatggatagttttaaagaaatcagtttccagatcttcagttcccccctgcccttcttttctagaattgttctgcctgaaactgtcttaggcattccggttctctttctcacctctcctttcacaattgcccttcaaccaaaaaaaggggaacatactgtaacattcctccagggtgtaaaaacctctggggcagcaaagaaagggacaatttgaaatattggtattggtattgagaaagtgaatgtctagtaacattgtaaaaatcatccttttataaatcttatagttttcagatcttttgccttcaacaaaattagaggaagattaattcagggggcattcaaagaattgagtaacactgctgaaataaatttcttccactcccagctacctacttaatatgaatcaatttactcagtgcttgggagtagagctggaagagaattgatgctgaaccttgcctccattctcatagaattctcgtagactgagaagatcaaggaaaggctccttgatgttaactgaacagagcaaggggagtgaggggaagcaggggaatactattcagcaaaccaaatagcacatgtgtaaacctggtagtaaaaaggctcttatcatagtttcccaatggaaagaaggcaccatggctgaactgcagacagcaaggtgagtggctggaacagaatcatacaagtgttggaagacatgttaaggattatgttcattatcttaaaaacaatgggaggctattgaagactttcaagcagggggataatattagatttttgttttagaaatatcactctagagaatgtatgagaggggtcaagagtggatgtacagaaaccagttaagaggctgttattgcagcagtgcagggcagatatgatggaactctgaacttgagggatggatgtcaagatggaaagaagtgaacacatttaagaaataatgaaagagtaggtaatatcagtaagccttaacaatggattgacagtagaactgagggagaagcaaagatcaagcacagcccttaagctttagtcttctaaaactgaatggacgttgagacagggaacattggataagttccaagttggaggagaaaccatatctttagaagaggaaaaaaattcaaatttatgcattcatatctttttcctcagaacatagaaaagggatattaggatatagaaaaacaaattacctacttctgaaagttgccttttagattaagggaaaagttatagcagtgactctatgaccatgatttttggagagccctcagcttagacatttctggtcctaatcctcatttagtaatctttgccagttatacaatattatcttgcagcacatggggggcatgcagatcacctcaccccttctggtactatccaggcaactctttggcttaagagcataggctacagcaggttttgggtgtcttgggcaaatcacttcatgtcagtggacctcagttggctcatctctaaaagcatagttgactaaatgaatgatccccaagatcccacctagctctgaaagtctaatattccattcattcattttatatattcattcatttattcaccaaatatttttgaagtccctactaagtgcaaatcactcttattagatgccagtgatctattgtcagataagacactgccccttactagagctcacgttccacagggctggctacattaaacaagtaaatttgtagcttagcacggtttacttaacaagcccagttatgacagagctggagaggagagaaagctgtgttggagaggcaggaaggtgtgatgttcagccaggcaaagcaggcaagaaggtagaagggaccacaagaaggaggcctcagagtgtcttgggatcattaagttctcaagcagtccagtgacagctgcttgattgtttgtgtgaagactcactacatagaaacatagactgaattggcccggtgcagtggctcacacctgtaatcccagcactttgggaggacgaggcgggtggatcacgaggtcaggagttcgagaccagcgtggccaatatggtgaaaccccatctctactaaaaatacaaaaattagccaggtgtggtggtgggtgcctgtaatcctagctactcaggaggctgaggcagaagaatcgcttgaacccgggaggcggaggttgcagtgagccgagatcgcgccactgcactccagcctgggcagcagagtgagactccgtttcaaaaaaaaaagaaaagaaaagaaaagaaaaaagaaacatagactgaataaaagcataaaactacatccctgagttactttttcagaaagcgtaaaatggtcttgagtctcccctaaaagtctccttccaaaagcttttctgtcttcgatgatcctagtgaagatgtatatttcttctccttttgatgggtttccatgaaaacaggaattattttatgtgaaatataaaatatatattttcaataatagagtgtcaatctctaatgcatttaatacaactttatttgctttcttagttgtcttattcaaagcattatgttactgtgcaggatattcctatatgatctgttttgtttttcagaccctctgcaatgtgtccattcctcaagggtgacatactcctgttacacacctctgttttcccatttgtagcatcatactcataatttttttttttattgattggaattcccatagttgcaagtgacaaaaatcaagcttgaactagcttacaaaatagaggaaaggcttatataaacagggaaaggccaggagtataactttcctaatatctcccctcaagctggtaggttcaggagtaggcacctaacccaagctatgccaatgccttccctagaatttgtgaacttgggaacagagagaaagtgaatcagttcctctctacagagaaatgtttgggacctacagaataataaatgttaactacagttggtttgaggtgaacttctcctggccatgggagaccctttttgtctcatttgctactgtacctagcagagtgcctgcctcatagtaaattcacgttaatgttagttgaatgaatacatacatctattagtttcaagggtggaagctgtattgtactatcatttcccttatgaaattagatttgacttacacactaatttacagcatttttccaggaacacttttcttagtaaccatacaagctgattgaatgtacaagttggaaatgaaacttgaatattacaattgaatcttaggactggaaatattttgataaaccagtttttcacattgctcacctaccacttctgaaaactgcaaaataggaacaatgcaaagttatagtttgtggagtggtacaaattaagtttagagtataaagtctcagatatttttatcaagctttctgacagtgttattctctagtgaaaaataaaagacacagtccctacccttaactgtctcaaattcaaggccactttccagcaagggagcctgttaaaaagtacagatttccgggctccattcgaggcctcctgagcttaaatctaaagagtgggtttaagagtcagcattatttaaaatttccctgtgtgattcttaggattaaccagatctagtgcaaaaaatatgtttatgaatgcttgttttttttaatagtggataatcagaaaacaaaaagtaatccactctgtagaatagtattctggcattaaatgtgactatagaactttcatttctgtccaagatagagtaactgggaccagatttatcctctcatttgaaacaacccaacatataaaaaacaaaatatcatgaaagaacagttttcaagacattagacatcaggcaactaaggacagtgatctcttgtgagacaggaaacaaggtgacccatatgaatgccccaccatgctgccttgagagagtttccaggccacagcacagggaggggaactaaggcagagtaggcagactccctaaattgaggggacagagctgagagtctggggtgaccaaagcaactagagttcataggacagagtactgaagaggagagagctgcacacagacagaacctcagatctgcagaggatctccctcaagtattcagcagagtatcgatcagtgcatgtctaataggaaattccccaacactgagaaactccccaacactctccactttggatggaaaaaaaaaccatccaaaaggattggaaggaacagcgcctgcactacctgttcccaccagtcagactagaaaaatttctaattcatggctcattgtgtagagcgctcagggaagtcttatctctgtaatgagaagtaattagccccaaactgacaactgctccagacctgcctaatggatcatgaacgcaagacccaaaggatcaaactatgtccgagtaactgatctaagtctcagaacaaaacataagaatatttttaggaatacaaaaacatcaactatgcaacaaattcacaatgtctgacatctaatcaaagattactaggcatgtaaaaagaccagaaagtgtgacctataatatggagaataatcaatcaaaaatgacatagaactgacagataatagaattagcaggaaaatacactatgggattaatggcagattagacatttcagaagagattagtgaacttgaagacagagcaataaaaactatcaaaaatgaaacacagcaagaaaaagaatttttaaagatgaaaagagcatcactgagccgtgggacaacttcagtcagcctaatacatggttaattggagttcatgaagaagagaggaaaagaaagaagaaatgtttgaagaaataacgcctgaaaacattccaaacttgatgaaaactataaacccacagatccaaacaccatggcaaaccccaagcacaagaaacatgaagaaaacaataccaagctacatcataatcaaactgcttagaacctatgacaaagagaaaatctgagaaacagaccaaaaaaaaacaaaaaaaaaaagaaagaaattgggagacagaggtaggagaattgcttgaccctggtaggtggaggttggagtgagccaagacatcatgccaccgcactccagcctgggtgacagagcgagactccatctcaaaaaaaaaaaaaaaaagaaaaaagaaattttacacacagaggaacaaacataaggatgacatcaatgtcttatcggaagcagtacaaacaagaacagtgtcataaagtactaaaaacaaacatttctcaacttagaattctaaaccaagcagaagtatctttcaagaacaagaaggcaaaataaaaatgtcttcagacataccaaaactgaaagaattcagcagacccacactataagacccacagtatatttaggacattcttcaggcagaaggaaaacgataacagattgaaatctgaatctacaaaaagggaataaagagcactggaaatgatagctatatgggtaaatctataagttctttttcttattacttcaatctcttataattggcaatttaaacaaaaataacaatgtgttttagagtttatagtatatggaaaaataaaatgtatgacaacagtagcacaaaggtcaggaagaaagacatagaagtactatatactattgtaaggctcttatatgatgtaggggggataagggttatatgtgaagtggtataatatcacttgaaggtacactgacaagttaaagatagatgctataaaccctaatgcaaccactaaaacaacaaaatgaagagttgtgagagaaaacacaggagagaaaacagaataaaaaataatacaaagaaaggcagaaaaagataacagaacaggtggaacaaatagaagtcaaatagcaagaatatatatttataccagactgtatcaatcatcatgttctgcttgtaaaacatgcacttcatacacaaagaatagtttcaaagtaaaaaggtagaagccaggtttggtggtgcatgcctgtagttccagctacttgggaggctgaggcaggaggatcacttgagcccaggagttcgaggatgcagtgggctatgattgcaccactgtgctccgcctgggtgacagtgtgagacttcatctcttaaaaaaaaaaaaaaaagtaagaagatagaaaaagatatactgtgataacattaatcaaaaggtagctggagtagctttattgatatcaaaatatattctcagaccacactgggattaaattagacatgaataacagagagagataaatcgccaagtacttgaaaattaaataacacaattctaagtaacccatgaattaaagaggaaatcaaaagggaaattaagaagtattttgtaatgaattaaaatgaaccacagtatgtcagaatttgcaggatgccactaaagcagtacttagggagaaatatgtaccattaaacacctatattagaaaagaagaaacatctcaaatcaatgacttcagcttataccttaaaagtaactaggacaaaatggagtaaattaaacccaaaatgagtagaagagaagaaataataaagatcaaagtagaaattaatgaaatagaaagcagaaagcaatagagtatcaataaaacagaaaatactttttctttggaaagatcagactgatcaggaaaaatggctatacaatcacggggaaaaaaaacatgaattaccaacatcaggcatgagagaaggggcatcactacagagtctacagatataaaaaggatgataaagaaataaacagatttatgccaataaattcaacaacttagataaaatggaaaaattccctgggagacagaaactactaaagcttatttaagaaggaataaactgaattgccctatactatctgaaaattgaatttgtagttaaaaactattcctcaaagaaaactccaggtcaagatggcttcactggtaaattctgtcaaacatacaatggagaaataataccaattctatacaaactcttttcaaaacattgaaaaaaaaggaatttttcccagctcatcctagaaagccagcattgccctgataccaaaaccagttaagacattacaaagaaagaaaactatagactagtattcctcatgaatgtagatgtaaaaattctaaacaaagtcttagcaaagcaaatccaacaatatatgaaaaggttaatatgttctcacttcagcagcacatatactaaaatataaacagtacagaaaatattatcatggcctctgtataaggatgacatacaaatgcatgaagtgttccagatctttaaaatatatatatgttatgatcaaatggtgattaacccaggaatacagctttacttataatagcccaaaccaggaaacaattcagtgggtgagtggataaactgatatgtccatacaatggaataccactcagcaagaacaaagaacaaactactgatacatgcaacatcatggtggaatctcaaaataattatgctgagtgaaaaaaacaacaaaaaagagttcatactgtatgatttcatttatgtacagtgcaaacaaatctgtagtcagcaaaagttgactgtatcagcctttggtcgacaactatattatcagctttttgattgtcacattagtagttgcttagggatgtggtggggagggtatggagggatgggagaatattaccaacgagcatgaggaaacttttgggaatgatagatatatcactatcctgattgtggccatagtttcatacatatgtcaaacttatcaaattgtacactttaaatatgtgtatgtcaattatatatcaatgaaaactgtttttaaaaataataggcaacattaaaaatggagcaacagggaaaataatcataattagaagatttaaaagcactatcggccaggcatggtgactcacacctgtaatgccagcactttgggaggccaaagcaggtggatcacttgaggtcggcagtttgaaaacagcctggccaacatagtgaaccatctctttccttaccctcgtctctactaaaaatacaaaaattagcttggcatggtggcaggcacctttaatcccagctactcaggaggctgaagcaggagaatcacttgaaccctggaggtggaggtagcagtaagctgtgattgtgccactgcactccagcctgggtgacagagtctcaaaaaaaaaaaaaaaaaaaagaaaaaagaaaagaaaagaaaatagtgtgttaaaagcattatataaaatatatgtatatagcaatcaaaaaatcaaaaatagtatttttgtcatggagcaattttgtgtgcgtggcatactggatggtcttctccattttccatattttctttaattttttttaactggtaattaaaattatctaccgcaaaatcacaaatattaagagaagcactgtcatagtaattctacttttgctgaactttttattttttttttaacagggaatcactttaaaaatgaatgaactaaatcattgtattgttgcaagaattatgcatgggggcatgattcacaggcaaggtaagtttcatatatatttctttctttgccttccttaattttttttccctgtagcctagtgaagaaaatgtttttgtttgttttgtttttgagatggggtctctcactatgttgcccagactggtcttgagctcctaagtgcaagcaatcctcccgtctcagctttccacaggtgcatgccatcacacccagctaagaaagtataaaggatacatataaagaatcttttaaaatcatctttgattttaatcattattggcctccattgtttcttattcatctgcacaggctccagcatgtagataatgaagggagaatatattagagttctgttagccagagcatctctgtattagattactacttacggggaccacgggagataaagcaaataattacactgggcctcacgatgtaggagagacatctgttctagagtaaaagatatatgtaaataaataaccatttaagaagtgttctctcattcatttaggaattagatatgctatttataaattaggacatcatagagttaaataatacaaaaattaaatggtaagagatgtcaaatcgatgattaaattattaatacctgccatggtgagtgcagtcattctgtggagagaattcactaagaactggaatagacaaagaatgatgtgggggttttttttgagacaaggtctggctcagtcacccaggctgtgcaatggcacaatcttggctcactgcaacctctcctcccgggctcaagcaatcctcccacctcagcctcctgagtagctgggaccacaggtgcacaccaccatgcctggctaacttttgatatttttgtagagatgggcttttaccatgttgcccaggctggtctccaattcttgaacccaagcaatctgcctgcctcctcccaaagtgctgggattataggcatgagctaccttgcccagctcgaagaatgattttttaagaaggtgcatcttcagttaactctcaaggatgggcagggtttggatatgtggatttaggctttttctttgaaaggattgagttatatgcactagtatttagaggatgttccaaaaatgattcttctggcagactctctgtctttgagatagggttatttttgtacttaacacctctttccttacccccagagagcgagaagtaacactctaagcattttagtgccttattctcctcttgagaataagaggagatcactgtgtacacaacatgatgtctggcatcattgctgctttcagaggaatccttgtaggcgtagagggtgtacagcactcccacaggaggatatttggttttagattccagtatgtgttttttgtttgctatttttaataatttttatatgttcagtaaagccacaacatcattctttcttttttttttcttttcttttttgttttttattatactttaacttctagggtacatgtgcacaatgtgcaggtttgatacataggtatacatgtgccatgttggtttgctgcacccatcaactcatcatttacattaggtatttctcctaatgctatccctcccccagccccccaccccctgacaggccccagtgtgtgatgttccccgccctgtgtccaagtgatctcattgttcagttcccacctatgagtgagaacatacggtgtttggttttctgtccttgtgatagtttgctgagaatgatggtttccagcttcatccatgtccctgcaaaggacatgaactcatccttttttatggctgcatagtattccctggtgtatatgtgccacattttcttaatccagtctatcaatgatggacatttgggttggtcccaagtctttgctattgtaaatagtgctgcaataaacatacgtgtgcatgtgtctttatagtagcatgatttataatcctttaggtatatactcagtaatgacatggctgggtcaaatggtaattctagttctagatccttgaggaatcgccacactgtcttccacagtggttgaactagtttacagtcccaccaacagtgtaaaagtgttcctatttctccacatcctctccagcacctgttgtttcctgacattttaatgattgccattctaactggtgtgagatggtatctcattgtggttttgatttgcatttctctgatgaccagtgatgatgagcattttttcaggtgtctgttggctgcatggatatcttcttttgagaaatatctgttcaaatcctttgctcactttttgatggggttctttgtttttttcttgtaaatttgtttgagttctttgtagattctggatattagccctttgtcagatgggtagattgcaaaaattctctcccattctgtaggttgcctgttcactctgatggtagtttcttttgccatgcagaagctctttagtttaattagatcccattagtctattttggcttttgttgccattgcttttggtgttttagtcatgaagtccttgcccatgcctatgtcctgaatggtattgcctaggttttcttccagggtttttatggttttaggtctaacatttaagtctttaatccatcttgaattagtttttgtataaggtgtaaggaagggatccagtttcagctttctacatatggctacccagttttcccagcaccatttattaaatagagaatcctttccccatttcatgtttttgtcaggtttgtcaaagatcagatggttgtagatgtgtggcattatttctgaggcctctgttctgttccatttgtctatatctctgttttggtacgagtaccatgctgttttggttactgtagcctcatagtatagtttgaagtcaggtagtgtgatgcctccagctttgttctttttgcttaggattgtcttggcaatgcgggctcttttttgggtccatgtgaactttaaagtagttttttttccaattctgtgaagaaagtcattggtagttttatggggatggcattgaatctataaattactttgggcagtatagccattttcatgatattgattcttcctatccatgagcatggaatattcttccatttgtttgtgtcctcatttatttcgttgagcaatggtttgtagttctccttgaagaggtccttcacatcccttgtaagttggattcttaggtattttattctctttgtagcaattgtgaatgggagttcactcatgatttggctctctatttgtctgttattggtgtataggaatgcttgtgatttttgcacattgattttgtatcctgagactttgctgaagttgcttatcagcttaaggagattttgggctgagacaatggggttttctaaatatatagtcatgtcatctgcaaacagggacagtttgacttcctcatttcctaatcaaataccttttatttctttctcttgcctgattgccctggccagaacttccaacactatgttgaataggagtggtgagagacggcatccttgtcttgtgccagttttcaaagggaatgcttccagtttttgcccattcagtatgatattggctgtgggtttgtcataaatagctcttattattttgagatacgttccatcaatacctagcttattctgagtttttagcatgaagggccattgaattttgttgaaggccttttctgcatctgttgagataatcatgtggtttttgtcgttggttctgtttatatgatggattacgtttattgatttgcgtatgttaaccagccttgcatcccagggatgaagctgacttgatcgtgttggataagttttttgatgagctgctggattcgacgttccagtattttatggaggattttcgtatcaatgttcatcaggggtattggtctaaaattctgtttttttgttgtgtctctgccaggctttggtatcaggatgatgttggcctcataaaatgagttagaaaggattccctcttttctgttgattggaatagtttcagaaggaatggtaccagctcctctttgtacctccggtagaattcggctgtgaatccgtctggtcctggactttttttggttggtaggctattaattattgcctcaatttcacggcctgttattggtctattcagagattcaacttcttcctggtttagtcttgggagaatgtaggtgtccaggaattcatccattttttctagattttctagtttatttgcatagaggtgtttatagtattctctgatggtagtttgtatttctgtgggatcggtggtgatatcccgtttatcatttttaattgcatctatttgattcttctctcttttcttctttattagtcttgctagcggtctatcaatttttttggtcttttcagaaaaaccggctcctggattcattgatattttgaagggttttttgtgtctctatctccttcagttctgctctgatcttagttatttcatgccttccgctagcttttgaatttgtttgctcttgcttctctagttcttttaatcgtgatgctagggtgtcgattttagatctttcttgctttctcttgtgggcatttagtgctataaatttccctctacacactgctttaaatgtgtcccagagattctggtacgttgtgtctttgttctcattggtttcaaagaacatctttatttcagccttcatttcgttatttacccagtagtcaatcaggagcaagttgttcagtttccatgtagttgagcggttttgaatgagtttcttaatcctgagttctaatttgattgctctgtggtctgagagacagtttgttgtgatttttgttcttttacatttgctgaggagtgctttacttccaattatgtggtcaattttagaataagtgcagtgtggtgctgagaagaatatatattctgttgattttgggtggagggttctgtagatgtctattaggtccacttgttgcagagctgagttcaggtcctggatgtccttgttaaccttctgtctcattgatctgtctaatattgacagcaggaaacatcattatttctttaacttctctttgttatattactgcactggctaggaccggcagtctttcaaggagtggtatagtagacatcccgtcctattcttgtttttaaacggaatctaaagttagccgggcatggtggcgctcacctatagtcccagctactcaggaagctgaggtgggaggattgcttgagcccaggagttcgaggctgtagtgagctatgatcacgccactgtactcacctgggtgtcggagagagaccttgtctctagaaaaaaatgtttttttaaaaaggaacctttccaatatttcttcattaagaataatgtagatttttagtacatgccttttattagggctaaagaagttcctttatattcttagttgctgagcattttaattgtgaatgggttttgaatttaatcaaatgctctttcagaatctgctgagatgatcatttgtttttttccttttatctgttaatgtggtgaatgtcttttaaagatttcctaatgataaactacccttgcatttctcagataaactcagcttagtcattacatattatcttttttatgtactgcccgactgtctgctaatgttttgtttataagatctcagtatgtgcatttatgagtgagactggcccgtagttaattttcctctcttgtatttctctgattttagtttcaaagttatatctacttcacacaatgacttggagagtattccctcttcagttctccgagagattttatataatattggaatgatttgtgtcttgaaagtttggcaggacttgcctgtaaagtatcacagcctagtgttttggtttttagttttaagaaagttttgtttttgttttttaacaactgcttcaatttctttaacattaaaaggccatccaggctttctatttcttgagtgagttttggtaaattacattttcctaaaaaaaaataagttttaaaatattgcagagagcttcttcatagtattctctcatctttttattctctgccatctttgtcattatgcccctgttcatttctaatattgtttatttgtgcctactctttttttcttgatcaaccttgccagaggtttgttcagaaacccactctgggtttggttcattctcttcattatatgtttattttctgtttcattgttttatgacctaatttttattatctcctttttttttaactttctattggttttggctaactttacaaatttgacacatagttcatttatttccagtcttttttttttttttttttttttttgagacagggtcttgctccatcggccaggctggaatgcagtagcataatcatagctcactgcaacctcgaactcctgggctcaagtaatcctcctgtctcagactcctgagttaggactacaggcaaccacactcagctaatttttttaatactttgtagagatagagtcttgctttattgcccaggttggtctcaaactcctggcctctagtgatcttctcgcctcactcagcctccgaaaacactgaggttatagacatgagccaccatgcccagccttcttttcttttctttttttttttttttttttttttttgagatggagtctcgctctgtcgcccaggctggagtgcaatggtgcaacctctgcttccgggttcaagcgattctcctgcctcagcctcccaagtagcggggattacaggtgcccaccaccacgcacagctaatttttatattttagtagagacggggtttcaccatattggccaggctggtctcaaactcctgacctcatgagctgcccacctcagcctcccaaagtgctgggattacaagtggaagccaccatgcctggcccagccttcttttctaatatgtgcctttaagactaaactctccctctaagtactgtcttaatgtatcccaccagttttgacatgacgcatttttataactcagttctaagtatttttatatttctattatgatatttttcattgacctatattatttataattgtctgttacttttcacacttaacaggattttctgtatatctttttgtaatttacttctaacttaattacattgtggtcagagaatgtagtctgtatgacaccatttctttgaggtttgttgagacttgctttatggcatagcactttaatcgtttttataaatggcccacgtgtacttaagatgaatgtttattctttaattgttgcatgcagaggtatctttttgtaatgaagccaggtcagtgtgtacatttctgcacaatttataaataaggaagcaacattgtaaataacactctaagcattggttcttggtcatttctttctagctgaagtattacaagatgctgaaatgccaaccaaaagattaaattatctttaacagaatttgctgttgtgtagatattatcatgtcacaactcttggaaaattgacaaccttcgtatcatatctggtagataacgatagcagccaacactgtcatggtgcttggtatgtgccaagaacagttctaagccttctgcatttattaaatttgtttagttcttaaaacaatcctatgagatgggtactattttcatctccattttacaaatgtgaaaactgaggtatggagagtttcagtaatttacccaagatcttaaagctagtaagcaaggaagctggaatttgaacccaggcagtctggatccagaagccatacttttaaaccactatacataccacctctctcagaaaaatagatttctgcagccatccatcaaaactgtgccttccacaagtagatatatctgttttgatgaggttactacatgagttaaataattctgctgcaaccaaacttgtacctgcctctgaaatattggccctcaatattcaacttagtttttaaaaattacattgatgcctctggattttgttactatgaaagcatatatcatttcatgtttataatgttatataatttcttaggtacacttcatgttggtgatgaaattcgagaaatcaatggcatcagtgtggctaaccaaacagtggaacaactgcaaaaaatgcttgtaagtaaatgaaagtttttcctttcctaaaattgacttttactttgttagcttgtttttaaatatacaaataaggagtattcttctgtaatcagagaatttctggtaccatatttatgtggacttgaacttatataacattcataaaactgacaactagaaaaatgttgaaatacaatagagtttacaaacattttgcctgtctttagcagtgtgggctttaacactctccttttatcctttatctcctgtttcttaccaagcagatgattaaagaaaaccttttcagtgtttgtacatgtgaactagtttctcactgacctcaactctcctgacatcagcagtgtcagaaacctctttcctgttgagctgagtcatagccagctgtcgtggatttctctacagcatagaagggaggaaagccacggtagaccaggccatttttgaccatacatatccaaaatctgtattcaaattaggctttggattttttaaaaaggcaaaatgacagcctttgcctatgttcattgtcatagcaagcagacagaggtgtttggggcctctgatcccttttcccactgcagtgtagtagcacccaggttatgaatacctattaagtatgaaataagcttcacagactcaccaaacatttttttttcttttttttgagacggagttttgctcttgttgcccaggctggagtgcaatggcgtgatctcagctcactgcaacctctgccccccgagttcaagggattctcctgcctcagcctcccaagtagctgggattacaggcatgcgctaccacaccctgctaatgtttgcatttttagtagagacggggtttctccatgttggccaggctggtctcgaactcccgacctcaggtgatccaccagccttggcctcccaaagtaccgggatgacaggtgtgagccaccactcccagcccaaaatttttttttaaaaaaaagccaaaattaataagcaaaaagtggctgggtgcggtggctcatgcctgtaatcccagcactttgggaggccaaggtgggtgaatcacctgaagtcgggagtttgagaccagcctggccaacatggtgaaaccccgtctctactaaaaatacaaacattagcaaggcatggtggcgcgtgcctataatcccagctacccgggaggctgaggcaggagaatcactggaacctggaaggcagagtttgcagtgagccgagatggtgccactgcactgcagcctggatgacagagcgagactctgtctcaaaaaaataaataaataaaaaatttttaaaagtaaaaagcatattctatggggtacaccattataatgtggcatactcaatgtaatttttatgtaattacctagtctattgtctaattcaatgtatattcacttttgaaaggcatgtcacttagaaagttttgtattcacatctataaaaaggtgaccattgaagatctgtgagaccattgctgtatgagcaaaaggcaattggctgctgggcttttcccaggaacttactctactgttaactcgagcagtccctgcttcatgactacatttcattttccggctatgtgctctcagatggcttgtgctaattgcccccatgtgttttgagtggcttcttacatggttttgtgaacaattgtttgtaagaaaacttttctttctttcccaccaccccccctccagagggaaatgcgggggagtattaccttcaagattgtgccaagttaccgcactcagtcttcgtcctgtgaggtaatgactctaacaaaccacccccatctgctctgagttcttaactaactgtctgctgatggctgtatgtttttgctttctgggaaattgtttctgcctgtgctgttagatcactgcacaccaattttacaacaaagataacggaacagagtaggtcccatccacctactcagccctgcttccatgtggatctcctcagcactttgaactttttgcaggctgaaatctgagcaaaatgtagagaagttaca

SEQ ID NO: 1185 - DNA, 28508 bp, mus musculus
ttattatcatttattatttattagccagaggtcttaggtgagatcaaattcaatcattataatttatatttcaatatactgcttaacttcatgataggcaatgttctaggtgctcctcacatgtgaaattttaatatttttactgcaactctggaggtaagtactattattataccaattctacagatgaaaaagccaaggaatagcatgcttgaatcacttgcccaagatgccatgtttagatagtggtacagtggggattcgaacgcgggagctcaggtttcaaagtctgtgctctttacatatgcagctaaagagtcagacaagaaccaaaaggagatggagaatagagggtagaaagggcacaggttcaaggtgaaaggtcagaaactgcaaattcggagtttgggttggtctagcagcttaaaggcgtcatcatgaactgttcacctaagtaagttaagctcctgtttgagaatgactgataagcttgcaagccaacttacaaacaaactggggaaatgttccaatagatgactaagtcttttaggtctttttacctgtgtttttcggtctctataccagattagtcgcctggctctcccaaacagaccggccaactgacgtagtcgcgaaacggttaatgtcgaggcgggggcgggggaggcggaaataaagagagcggaagcaaagaggattgtgggagctccgttgtgcgtcgcttaagtgagggcggcggatgggcgaaggtccggtgactgcgactgtcgctgctttctgaggccacaggaaaggggccgtcggtcgccgccatgacagcgagcgaggcggaggtttgtagcacttcttatgggctgagggcgtagacacatcctgcttccagcctagcaggcaaacgggaacggaagtgataggggatcagaagttgcgaggggatgaggagtaggggaaactgacaagcggacggacccggcggcgagaattgatggcgtagctgtaggattaaggggcgtgtcaactgtgttgtgtgtgttgacactgagatgtgtgaatcccctcattatttttagctggggacaggcggggtctatgggggagggggcggacggatgaatggaggataaaatcagggcgaaaacgtgttgtctgctgggcaccagtacatctgagtcacatctcagcaggatgattttattggaaagatctaggtccctggtttcagattctgctattgatgcgttgattgatttcccttaccaaaataccaagtacctgctctgtgctgggtactgcactagaggctccggatgaggaaaggaattaggctttttcctcgacatttacagcctgccggttgctatctgcatttggagacaggctattacaatacaaggagacagagatagatcctgtgttatgaaaatctattgggtgccaccgaactcatctgggagttgagatctgggacggctctttgatgcggtgatttaacatatattttgaagacaaaataagcagggcaaaaacgaagtgcaattttcctccaagcaccttccctccctgttgaggtgaactggagaactgagtagcatttaaggcccaaaattagtgtatttctttttttttttctttctttctttcttttttttttttttgataaggagtctctctacttctgtcgcccaggctggaatgcagtggcgtgatctccgctcactgcaacctccgtctgccgggttcaagtgattctcctgcctcagcctcccgggttgctgggattagaggcacccaccaccactcccggctaatttttatatttttatatttttagtagagacggggttttaccatgttggccaggttggcctcgaactcctgacctcaagtgatccgcctgcctcggcctcccaaagtgctggtattacaggcatgagccaccgcgcccggtccccacaactagtttatttctggtaagagcatttgcccatcacaatgggacttccaggcgcctctggaagaatcagtcttacgtgagtgcaaagcctgcaagctctgggtaggactacgatggaggtgctagttacttggttttccagcaaactcggttcacagcagggaattgtgcacccaccagaaatcctaagcaatatttctctgaacaagaaaagaagcctctttgtttaccagagaaacaacagtatagcagtctaagtcagtggctctcaaactttcctgtgaatcagaatcagatggagcgtttcttaaaaccaagattgctaggtcccatccacagagttgcccctacagttggtcaggagtggacccccgaatttacatttctaactagttcccaggagatgctgatactcctggacatggggccatacttggagaactataggtctaaacggagctgacaataaattggaaagaatatctcctggaatctcttagaacccgggaggcagaggttgcagtgagccaagattgcgccactgcactccagcctgggcaacagagtgagactctgtctcaaaaaaaaaaaaagaatatctcccctagggaaggctaggcacactcctaaacgtcaggcatgtctgaattcagacacagtagatatgaaataaaatggacttatttgacactgcttagaaaatctttttatttttatatttgtataattttattgtatatttacaaattgtatacatttatagagttcaaagtggtattttatatatatacaatgtagaatgattaaatcaaggtaaataacatattcatcacctaaaattttatctttttttacacaaaaatgactcaacatggaatttaatagtttttttgtggtgctaacatttgaaatgtactcttagctcttttggaatatgaaattttgaaatatcaccaccattctattctctgtgtttgtgggttccattgttttagattccacatacaagtgagaacatgaagtatttgtctttctgtgcctggcttatttcacttagcataatgttctccaggctcatcaatggacagattttcctgatttttgaagactgaataatatttcattgtgtatgtatagcacatttgctttatctgttcatccactgatggacacttaggttgatcccataacttggctattgtgataaatcctgcaatgaacataagagtacagatatctcttcgacatactgatttcaaattctttggatatatacccagaagtgggattgctggatcatatagtaattctatttttagttttttgaggaacctccatacagttttccataatggctgtactaatttatattcccaccaacaatgtatagggttgccttttctccatatcctggcctgttatctttcacctttttgataatagccattctggaaggtgtgagataatatatcattgtgattttaatttgcatgtccctagcgattagtgatgttgagcattttttcttatgcctgttggccatttgtgtgtcttcatttgagaaatgtctattcgggtcctttgtccatttgttaatcaggttgtctttttgctacttagtcatttgagtcccttatatattttggacattaacaccttattagaagtagggcttgcaaatattttctcccaatctgtaggctgtctctcccctctgttaattgttttctttgctgtgcggaaacattttagttcgatgtaattccatttgtctagttttgcttttgttatttgagcttttggggtcaaaccccaaaattcattgcccagaccagtgtcctgtagtttcttccctaggttttcttcttgtagtgttatggtctcaggtcatatatttaagtctttaataaaatggatgtgtttttgttgtttgtatgttttggatggtcgagcaaaggtcatcttcctgaactaaacaaagcaaattgtttttctccattgtacttgtcacagtgacttataccataaattgtttaaaaacacaaagtagcagttttctattcaaatcccttgctgatttttatatattcaagtagttgtttacagtggagttcacacctccactgtatcaacaacgaaaaatgaagtgttcctaatttctggtaataaattatgtttgaggttaaaaattaaaaagacaatgtgacaagctaattgacagacaaagattagtataagaagtcagaattggtaggtagttccacccccaccaataaaactctccctttagaagaaatacagttattcactgcatagtggcattttggtcaacgatggaccacatatattatggtagtcccagaagattataatggagcatatatagaaacctgatatacagcacttgatattggcattgcagatcagttgcggtaatgattgatgttcattattggtactggaacattttgttttccatatgagaaaaaaaaaatatatatatatatatacacacactctaggtttgtgtaagtacagtctatgatgttctcacaatgaaattgcctaacgatggatttctcagaatatattcctgttgctatgcaaggtgtgactgaaatcattttatttactctagaacacagaatcagaaatctcattttgttacagcttaatttgaagccttcctttagggggtggccctaaacagactcctggagggtggcagtccacagttatacctcccgttcaaaccccctcccatgaccctgaaaaaggctaggacacattttcagaaatttcactaatcattctagactcttgtcaatgcttcatcccaaatctcgctaggccagttacaaaacaaaataaatgaaaccccaaaccaaacactcagacacacataaaaagacaaccaaaaagtccatacaaactggcctgagtctattgtgagtctttgtaggggccagcaaggtgctagaatggccagtgccttggatgtttcagaaatctgttctcaggctgggcgcggtggctcacgcctgtaatcccagcactttaggaggccgaggcaggtggatcacctgaggtcaggagttcaagaccagcctggtcaacatggtgaaaccctgtctctactaaaaatacaaaaattagctggacgtggtggcaggtgcctgtaatcccaggtactcaggaggctgaggcaggagaatcgcttgaacctgggaggcagaggttgcagtgagccgagatcgcgccattgtactccagcctgggcggcaagagcgaaccaagaaaatgtggcacatatacaccatggaatactatgcagccataaaaaatgatgagttcatgtcctttgtagggacatggatgaagctggaaaccatcattctcagcaaactattgcaaggacaaaaaaccaaacaccgcatgttctcactcacaggtgggaattgaacattgagaacatatggacacaggaaggggaacatcacacaccagagcctgtcatggggtggggggaggggggagggatagcattaggagatatacctaatgctaaatgacgagttaatgggtgcagcacaccaacatggcacatgtatacatatgtaacaaacctgcacgttgtgcacatgtaccctaaaacttaaagtataataaaaaacaacacgaaacaaaaaaaacagaaaagaaatctgttctctatcatgtccatattccaaaggagtcagcgagacaaccacatatgactcctgaaaattaatcaacttttgcacgtgattggtgagcctctcacttaatgcttgtgcacttaccctgcacctccacagtagtcctcatctgtctaaatccacacctagtcttacaggtagtgttattttccgtgaaatgtgaggagataaaacaaacttatgtaagtttgaactctgtagctccatttcctaaatgatgcctgagtagtaatgatttaattttgttgcatgaacattcagtatctcagggaccctgagagtggacagatggttgtgaaggagaattttgggctatgggtgtcaaagcagcaaacgcgattactccagaattcaagttcagatgggattgttcccagtccatattttctgtgtgctacagctgattccttaaactaaactttaaatcaatatgtgtctctgacctgaagtggggtggggattctggtctggcactgaactactaggttatggaggtcggttttttctttggaatggtttttctgagggtaagagtccttgcatcaagtgagtgagaactgtaaaggagaggaggaaaagggtaatgataatgtcacgtttttgctttgcaaaataagattaggagaaaaatgaagaacacactaggaggaggaggaggaggtggcagaaataggattgtgaatctgggatctgcaactgagatgtcctatgcctacctattgcttttcccaaagcagaggcttaagcaccctgtgtgtgaagccagatttcctttaggtcctgtgactgtgctggggacagggcagctgttgccattgttattggaataacctttctgcacttgataaggtgataaggaggaaacctgggggaccagatctcatatacacatatatttaagatatatatatataactttaggggcattttaatagcttctggcagtctaaggatttatataattgtctgccaaaactgcagtgtaaaagagccaaatcgaaagtctgactgaaagctagaattcaggggatgggaagtgacctctgctaggaacgagttttcttatgcgaggtccttagaggagtcgtcactgccctctagcccaagaccaccaggaacacacctgtggttgaacaggttgggttgattgctcagtgcattacatggagggagagcgcacaccatgggcgctgtggtgcttctctgttggagggtgtcagaaaggacttattacgggatttgaatctgtgttaggtgaatttggggaagatttaaagaagtgaggctttgccctggattggactctgttaggaaatgggaataattctgtgattgtgtatcttaatgactcttatccagaaggaggctaattggtaaagtagcaccggtcactgttagcaaggatagcagagtgtttggtcatttttatggcttagtcaaagttcatgttttgtttcttcagatacagttatgaggtggtcttgcttttttattggtcactgtggtcacatattggccttgtctgatagtggcagtttatgaaattgttatgttcatcgggagaacaccaaggcccagctgtgagtgccaagccagttgccacatgtcagtggttgctttttttcctccagagtgatcagcactgggtccagcagcttattggaggccagatttcctggccatttatagcagataaatagtcagatatgctgaacaggaaagcttggggctggatgtggatgaaagcatttggttaccttcttttttttttttttttcttttttgagacagagtcttgctctgtcacccagactggagtgcagtggtgcgatctcagctcactgcagcctccgcctcctgggttcaagtgatcctcctgcctcagcctcccaagtagctgggactacaggtgtgtgccactacacctggctaatttttgtatttttaatgaagatggagttttgccatcttggccaggctggtctcgaactcctgacctcaagtgatcctcccgcctcggactcccaaagtattgagattacaggaatgagccactgtgcccagccctctggttactatctaacagagcttaggagcctcagttaaaatattagtctcctgaggtggtttttccctaaaaaatcagatcaaagtatacttaagcaggagaagtacatgggagaaagtggcagattgtatttttcagagatggccaccgtagtacctgtcatcccacactctcttctgtaatgtgaccttgccacccttccattgagaagtagggtcaaatgtctcctctcctttgaatctgggccaactttgattatattaaccaatagaatagggggcagtgaaactgtgacttctgaggctaggttatgagaggcagtgtagcttctggctcacctgcagtgacattcacctttagagccctgagctgccatgtacaaagtctgattaccctgaggctgccatactgttagaaggcccaggcctatggtaaggccacctataggtcctctgatcaacagccctagccgaggttccagctaatagccaacatttaccagtagcctgtaaatgaaaactcctaaaggattacggcccccagccttctggttttcccaggtgaggccccagacattatgaagtagaaacaagctatctctgctccatgatgtctcaattcttaaaccacagaatcctagaacaaagtaaaatggttgtttaatgccactaaatttggattggtttattacgaagcaatagtaattcaaacagaggtggggagtttggttaacataaaaggattgaagtaaaaggagcaaggaaggcaaatagttggtagagaagaaacaggctggtacacaaagcattttgctttgctgctgatgaggggctttttgatcccagagacttcagagtggacagaagtggacagtagaggggaaaatgggaagataatttatccattatgctaaatgaaactgctgtggataaatgaaaaatctatagataattgtgcctccttttaaaataagatcttgaactatttattttttaactgaacatcttgattaaaactaacagaagtgtgtggagttttttgtaagtaaaaagtagtaataatattaacagtggccaactattcagtgagtaacaagatttttttttcttttttgttattatactttaagtactggggtacatgtgcacaacgtgcaggtttgttacataggtatacatgtgacatgttggtttgctgcacctatcagctcatcatttacattaggtatttctcctaatgctatccctcccccgtcctcctaccccatgacaggcccctgtgtgtgatgttccccttcctgtgtccaagtgttctcaatgttcagttcccacctatgagtgagaacatgcagtgtttggttttttgtccttgtgatagtttgctgagaatgatgatttccagcttcatccatgtctctacaaaggacatgaactcatccttttttatggctgcatagtattccacggtgtatatgtgccacattttctttttattattattatactttaagtttcagggtacatgtgcacaacgtgcgggtttgttacatatgtatacatgtgccatgctggtgtgctgcacccattaactcgtcatttagcattaggtatatctcctaatgctatccctcccccctcctcccaccctacaacagtccccagagtgtgatgttccccttcctgtgtccatgtgttctcattgttcaattcccacctatgagtgagaacatgcggtgtttgattttttgtccttgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacgtgtgcacgtgtctttatagcagcatgatttatagtcctttgggtgtatacccagtaatgagatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgctattctaactggtgtgagatagtatctcattgtggttttgatttgcatttctctgatggccagtgatggtgagcagtttttcatgtgtcttttggctgcatcaatgtcttcttttgagaagtgtctgttcatgtcctttgcccactttttgatggggttgtttgtttttttcttgtaaatttgtttgagttcattgtacattctggatattagccctttgtcagatgagtaggttgcaaaaattttctcccgttttgtaggttgcctgttcactctgatggtagtttcttttgctgtgcagaagctctttagttaaattagatcccatttgtcaattttggcttttgttgccattgtttttggtgttttagacatgaagttcttgcccatgcctatgtcctgaatggtaatgcctaggttttctagggtttttatggttttaggtctaacgtttaagtctttaatccatcttgaattaatttttgtataaggtgtaaggaagggatccagtttcagctttctacatatggctagccagttttcccagcaccatttattaaatagggaatcccttccccattgcttgtttttctcaggtttgccagagatcagatagttgtagatatgcggcgttatttctgagggctctgttctgttccattgatctatatctctgttttggtaccagtaccatgctgttttggttactttagccttgtagtatagtttgaagtgaggtagtgtgatgcctccagctttgttcttttggcttaggattgacttggcaatgcaggctcttttttggttccatatgaactttgaagtagttttttccaattctgtgaagaaagtcattggtagcttgatggggatggcattgaatctataaattaccttgggctgtatggccattttcacgatattgattcttcctacccatgagcatggaatgttcttccatttgtttgtatcctcttttatttccttgagcagtggtttgtagttctccttgaagaggtccttcacgtcccttgtaagttggattcctaggtattttattctctttgaagcaattgtgaatgggagttcactcatgatttggctctctgtctgttattggtgtataagaatgcttgtgatttttgtacattgattttgtatcctgagactttgctgaagctgcttatcagcttaaggagatttggggctgagacgatggggttttctagatatacaatcatgtcatctgcaaacagggacaatttgacttcctcttttcctaactgaataccctttatttccttctcctgcctaattgccctggccagaacttccaacactatgttgaataggagtggtgagagagggcatccttgtcttgtgctggttttcaaagggaatgcttccagtttttgcccagtcagtgtgatattggctgtgggtttgtcataaatagctcttattattttgagatatgttccatcaatacctagtttattgagaggttttagcatgaagggctgttgaattttgttaaaggccttttctgcatctattgagataatcgtggtttttgtcgttttttctgttcatgtgatgggttatgtttattgatttgcatatggtgaaccagccttgcatcccagggatgaagccgacttgattgtagtggacaagctttttgatgtgctgctggattcggtatgccagcattttattgaggattttcacattgatgttcatcagggatattggtctgaaattctctttttgttgtgtctctgccaggtttttgtatcaggatgatgctggcctcataaaatgagttaggcaggattccctctttttctgttgtttggaatagtttcagaaggaatggtacccggtcctctttgtacctctggtagaatttggctgtgaatccgtctggtcctgaacttattttggttggtaggctattaattactgcctcaatttcagaacctgttattggtctattcagagattctacttcttcctggtttggtcttgggaaggtgtatgtgtgcaggaattcatccatttcttctagattttctagtttatttgcatagaagtgtttatagtattctctgatggtagtttgtagttctgtgggatcggtggtgatatcccctttatcattttttatttcgtctatttgattcttctcttttcttctttattagtctggctagtggtctatgtattctgttgatcttttcaaaaaaccagctcctgggttcattgatttttttgaaggggttttcatgtctctatctccttcagttctgctctgatcttagttatttcttgtcttctgctagcttttgaatttgtttgttcttgcttctctagttcttttaattgtgatattagggtgttgattttaatcttcctgctttctcttgtgggcatttagtgctataaatttccctctacacactgctttaaatgtgtcccagagattctgatacgttgtgtctttgttctcattggtttcaaagaacatctttatttctgccttcattttgttatttacctggtagtcattcaggagcaggttgtttagtttccatgtatttgtgtggttttgagtgagtttcttaattctgacttatgatttgattgcactgtagtctgagagacagtttgttgtgatttctgttcttttacatttgctgaggagtgttttacttccaactatgtggtcaatcttagaatatgtgtgatgtagtgctgagaagaatgtatattctgttgatttggggtggagagttctgtagatgtctgttagccctgcttggtccagagctgagttcaagtcctggatatccttgttaattttctgtctcgttgatctaatattgacagggggtgttaaagtctcccactattattgtgtcagagtctaaatctctttgtaggtctctaagaacttgctttatgaatctaggtgctcctgtattgggtgcatgtatatttaggatagttagctcttcttgttgcattgatccctttaccattatataatggccttctttgtctcttttgatctttttataaacaactcaagataattggctgaaaatagttagtgagacttccccaaaggctcgtcagcataggcaactacaatattaaatcttgttactctgatttccagcaagatggccgaataggaacagctctggtctgcagctcccagcgagatcgatgcagaaggccagtgattctgcatttccaactcaggtaaaccgggtctggagtggacctctactgcttaagatctgttttatcagagactaggattgcaacccctgcttttttttgctttccatttgcttggtagatcttcctccatccctttattttgagcctatgtgtgtctttgcacattagatgggtctcgtgaatacagtacactgatgggtcttggctctttatccaatttgccagtcttgtcttttaatttgagcatgtagcccatttacgttcaaggttaatattgttatatgtgaattttatcctgtcattatgatgctaactggttattttgcccgttagttgatgcagtttcttcatagcgtcgatggtcttacaatttgtcatgtttttgcagtggctggtaccggttgttcctttccatgtttagtggttccttcaggagctcttgtaaggcaggcctgatggtgacaaaatctctcagcatttgcttgtctgtaaaggcttttatttctccttcacttatgaagcttagtttggctggatatgaaattctgggttgaaaatttttgtctttaagaatgttgaatattggcccccactctcttctggcttgcagggtttctggcaagagttttgctgttagtctgatgggcttccctttgtgggtaacctgacctttctctctggctgcccttaacattttttccttcatttcaaccttggtgaatgtgatgattatgtgtcttagggttcttcttgaggaatatctctgtggtgttctctgtatttcctgaatttgaatgttggcctgccttgctaggttggggaagttctcctggataatatcctgcagagtgttttccaacttcgttccattctccccgtcactttcaggtacaccaatcaaacgtagatttggtcttttcacatagtcccatatttcttggaggctttgttcttttcttttcactcttttttctctaatcttgtcttcttgctttatttcattaagttgatcttcaatcactgatatcctttcttcctcttgatttatttggctattgaaacttgtgtatgcttcacgaagttctcatactgtgtttttcagctccatcaggtcatttatattcttctctacactgggtattctagttagcaattcgtctaaccttttttcaaggttcttagcttccttgcattgggttagaacatgctcctttagcttggaggagttcgttattacccaccttctgaagcctacttctgtcagtttgtcaaactcattctctgtccagttttcttccctgctggtgaggagttgtgatcctttgaaggagaagaggcgttctggtttttggaattttcagcctttctgcgctggtttctccccatctttgtggttttatctacctttggtctttgacgttcgtgacctaccgatggggttttggtgtgggagtcctttctgttgatgttgatggaattcctttctttgttagttttcattctaacaagtcagttggagtttactggaggtccactccagaccctgtttgcctcagttggaaatgcagaaatcacccgccttcttttttttttttttttttttgagatggagtctcgctctgtcgcccaggctggagtgcagtggtgcaatctcggctcaccgtaagttccgcctcccaggttgacgccattctcttgcttcagcctcccgagtagctgggactacaggcgcctgccaccatgcccagttaattttttttttttgtagttttagtagagacagggtttcaccatgttagccaggatggtctccatctcctgacctcgagaaatcacccgccctctgcctcggtcttgttgggagctgcagaccagagcttttcctgtttggctatcttgccggaaatcagagtaacaagatttaatattgtagttgcctatgctgacgagcctttgaggaactctcactaatcattttcagccaattatctcgagttgtttataaaaaacgatttctactttgctttggttatgtgaatgtttgcctcagtatatcttatttgaggtgtttaacatatgacacgtggctagcgttagtgttgaaactgtgaagacgtttagctgttcaatcttccttggtaatagtacttagttatcagagattgaaaagacatttgctcatctctgtctcattgtgtgagaggaaaacacagtgttatttccaatgacatgtatggaagtttcattcttttaatctggcagaaactggttcagttttttttgaaacagggtctcactgtgttgacagttggagtgcaacagtgagatcatggctcactgcagcctcaactcccaggctcaaacaatcctcccacctcagcctcccaaatagctgggactacaggagactgccaccatgcccagctaatttttgtgttttttgtacagacagggtttaaccatgttgcccaggctgatcctgaacctttttcttttaaaagactagtcaagcatagtagtgagaaggctggttcacttttaaagtctccatatgtggccacattttagattttatatacatcaatagtttttgctgggtaacctattctatctgtaggtaagaatggaagtcctaggactgggtgtggtggctcacacctgtaatcccagcaatttgggaggccaaggcaggtgggtcgcttgagcccagtagttggagaccagcctgggcaacatggtgaaaccctgtctctacagaaaattcaaaaattagccaggcgtggtggtgcatgcctgtggtcccagctactcgggaggctgaggtgggaggatcgcttgagctgaggcggtggagactgcagtgagctatgatcactccagcctgggtgacagagtgagactctatctggaaaaaaagagtagtagaagtccttgtactgttggaattgtttaatcagtgagcattcagagatattggttataaatgttgagtatggctaccaactgaccacatggttatgggccaaggtacaaaatgtctgagtcacttgttttattgtaaaaattcatgtgaatgtctaaggttttgaagatttacacctgtgttttctaggagttttacatttttctttcctatgcctttgttttgttttcaggtaagtttggcatgtggtgtaaagtaggagcccagctttgttttccaggcgcatatccagttgtcccagcagctggatttcacagcttactgcgattgcgaggcttctggttttcaaggctatcactgagcaaaagagagggggatgtgaatagggcaagttaaaaggccacaaagatcagtgttcttgctaagattcagttgttttcttgaataaatgctccttagatcgctgcaagcttttgggtaatttccagaatattgaaaaacttgattttaacaatttttgccaatattctctttgctgatttgaggagcagattttttggaggttcttactctgccattctgaaaatgcctactcataagtttctgttttgcctggggcataatcagatctccgtatgaaataataattttgatatatgtgtatatttgggtcagaacttcttagcggtgggcaggatttggactgaccaaaaaaaatgcttaaggtggccttctcctgtctcttcaggactctaaaagactgtcctgggtggaggctgggctgtgttcacaagcaggccagtgggtgagaactatgggcagccagtgagaccatgtcatttttgtccctgccagactgtttctgtgctcatagacatatgaaaacatctggagatacgtttgagctcatttttttccccagagatggacttccaatttcctctactgtttatggtattccccagaaaatttgttagacttggacctctcctttagaatgaatttgggagagaccaatgttaaagggggtaattggagagaccagggaaggcttcttgcaggagctatgagttttaacctagttctacagagtgagcaagaggtgattagttgaagaaaataggtggtaagaagtagttcaatttaacacaagccatggagattatatgtaattaaatcccctcactgaaccaatgcaagaataaaagccaggcttatccctgggagaaagccagaaactatgctgtgatacacacacacacacacacacacacacacggaatcctgtctctacaaaaaagacaaaaattatcagggtgtggtggcacatgcctgtagtcccagctgcttgggaggctgaggtgggaagattgcttcttgagcttgggaggtccaggtggcactgagccttgatcccactactacactccagcctggggaacagagtgagactctgtctcaaaataaataaataaataaggaggggaggctgtatatcatagtcataaaaaattcaagacctgatgtcagacaacttaagttcaaatgccagatcttctgcttattggctgtgtgaccctgggaaacttactttatctctttggtcctattatatttgtaaaatgggaatatctacctgcttcacaggtttggtgagaagtttaaatgagagaatgcatcaatagtgcaaagcacaatgtcttgcatagagtgtttactaaaagccacattttattttatttatttttattttatttatctgtttatttatgtatttatttatttattgagacagagtcttgctctgtcgccaggctggagtgcagtggcacaatctcggctcactgcaacctccgcctcctgggttcaagcagttctcctgcctcagtctccctagtagctgggagtacaggcacacaccaccacacccagctaatttttgtatttttagtagagatggggttttgccatgttggccaggatggtctcgatctcttgaccttgtgatctgcccgccttggcctctcaaagtgctgggattacaggcatgagccactgcacccagcctatctttatttttttgagatggagtttctcactctgttgtctaggctggagtgcagtggtgcaatcttggctcactgcaacctccacctcccaggttctagcaattctcctacctcagcctcgcaagtagctgggattacaggcatgtgccaccacgcccagctaattttgtagttttagtagagacagggtttcaccatgttggacaggctggtgttgaactcctggcctcaagtgattcactgggctcagtctcccagagtgctgggattacaggcgtgagccactgcgcctagccaatttttatttttgagacagggtcttactctgtcagccaggctggagtgcagtggtaccatttcagctcactgcaactgatagggaaggggaaagggaagtactgggaagggaagagcatgatccctttaaatgatatggaaggagggaagagtgtggtccctggctaggcctctacccccgggcctatgcccatggacctgggtgaggacaggcatttttgttttcctgcccaaatgttgcatttcccaagaccaccctggcctgccataccaccatcctgtgcctataaaaaccccgagacgctagcaggcagacacacatgtggctgggcattgagaggagcacatcagtggaggaacacacaggtggctggatgtggagaggaacgcatcgacagttaccagcacgccggcaggccattgagcggcagaacgacacggagtttggctagggcagtcagaaaaaacctgggccgcaagcagcctgactccagaggaaaaccatctcccttctggttcccccgtctactgagagctacttccacttaataaaatcttgaactcattctccaagcccacgtgtgatctgattcctccagtacaccaaggcaagaactccaggatacagaaagctctctgtccttgcaataaggcaggggtcgaattgagctaacacaagctgcctacaggcagctaaactaaaagaacaccctgtaacacacgcccactggggcttcagctgtaaacattcacccctagacactgccgtggggctcccagcccatctgtatgctcccatagaggtttgagcagtggggcactgaagaagtgagctacaccccccattgcacaccctgcaaggggtacgagagaacttttcctttttcacaacctctgcctcctgggcttaagtgatcctaacatctcagcctccccagtaactggaagtacgggcacgtcaccatgcctggctaaattttgttttttttttgtagagacgccgtctccctgttactcaggctggtctcaaactcctggcctcaagcaatcttcctgcctcagcctcccaaagtgctgggattacaggcgtgaaccactatgctggctggtgggcagccacatgttaaatctctgagtctagccataaatccaaatatcaaatgcacaaagcctaaaaaccgtgtgagtgtggtcaaaatagaaactttttgaatgcgttctgaaatttatttctgttctgttcacttttagaatttggtagcatcttgaaaatgccaacttgtctccatcatgttaggaagaatcatatggagtgttttgttttttttggtctatatttgagacagaacatctgtgaacaaaaggtctctgaaaaggagactggaagaaagagacttccagtgaacagttgcaaacccaggagtcacagcctccagtgtaaaacaaaagtacatttataacgaaggattgaagcatggttagttctgattggtcaatgcagctgagttctggttggtccatatagcatagccctgattggtcaacacagctgagctctgattggctgaggaagatgagctctgattggttggttcagggaagcactgaaagtctgaaagataaaagagtgcaggttttcagggaactcagagtatgtgtgtgacccctagtcggcaaatggctcgttggctttattttacatttaggcccagtgagctgctcaagatccatcttgaaggattggctttttcaggtttatgtttgttcacacatgaaaggaggagcactcactttggggcttggggggtgcagggctacagtagaggcagggatcaagcagagcgtatctccaggggttaggtgagattcagagggatggagtcaagttcctgatcagctaaacctcctactaggagattctactacctgaacttttatctccttgaatttgggaggtacaaggtttttatttattgaatcatcaaacatgcattgaggcgggggttacagtagtttgtttgtttgtttgcttgtttttaactattgcatgagttctggacccagggcaggcttgaatctgagctctagcatttcctggctgtgtgactatggacaatttacccaacctttctgttcctcttttgcttcatctgtaacacgaggataatcatattatctacctcactgagttgtgagcattaaatgggataatacagatacagtattcagtgctcaacaaatattaaatattataataattattttatagtggttggaaatatggctattttaattctctgtgtacatgtttaattctttacatggtcaactggttttgttcatcattgtttctcctctgcctgtctgttctaggtacgacacttacaaatttgttgggtgcatgaatgaatgcgtacaggtaaacatttataatacaatgagaggtgctataatagagcttgagtacaagacactttgcaggacatggagaaggatatgattaactttgagcagttccgaaacagttcactgagcgaggctgttcccttctagaattttcacagtgcagtgggctgtcagagcaaactgcactggggaattaagtaaagggatgctagatagccaccaggtggcgatattgcagaaggattcaagtagcggaggaaaggagcagccctcttccagccaggagtccatgttcctgtccacgtcagattttttctcctgtccacgaaagttcaagctgtgatttctttccctttgttctgatggtcttggagcactgccgttcctgcccaaggctgttttggagctgcctagtgctccagccattctgtcattaccagacagaggacagaaatgatgctgtttccagttcttcagttgttgggcttctaattcttacatcactgacctgccgtttcctctgctatgcctcccatgatggagttaaaggggtgaggggagaagcaaaactgacatcttttgagacttccggcactatgtcagacatatatacatatataatatgtatgcatattatatacatatataatgtgtatgcatattgtatacatatataatgtgtgtgttatatgtaacataaatacataattatatattttgatatgtgagttgtgagccattttatatagtgggaagctgaggctcagagaagggcatcttttcagtattcaaataaaattctctagttaatcaaagttggtatcagatattggagatacaaagattaggaagatgtggttcctacccctaagtcttgtgctcctgtaatactctgtgggtgtgtctatcacaggacttattgcatcatgttattagtggttatttatatgtctgtcttctcagatagatggtaaattccttaaaaggcagcagccatttcaagcattcctcatacttagcataggctccagtacatagtagatatttaactactgtgaggcacagaataattgtgtctgattgagcagtgggaactagtgaagagtttcaagcagggcagtgacatgatgagtttttcgctggaggtgggtaacaggttgcccattggattggagcagtgagtggaggcaggcagggaggtgactgtggcagagtctgtgctagaggggatttaggccagaacgagggcaatggcagtgagtatggagagaagacaggttggagagttattgaggacatgaattaggatttggtcgtttcttagatgtggagatcgaagaattccaggcttgggtgatggtggtgccagcaacaggttcagagtaaagaggggaagtgggtttggggtgggaaacacgagttcggttttggacatgctgaggttgaggtgtctattcagggggtgtgatatatcaggatgtgtgaaaccaaaactcaggaaagaggttaggagtgaaaatctggggatcatgaagctgtcggtggagcttagaagcttgccaggggatgccatcactcaggggcaggacatgcagtgaaacaggaagtgggctaaggatggaacctgggaaccttgacacagatgggctgaagaatgagaaacccatgagaaagatggaaaaagaatagccagggagattggaagcaaaccaggagggtgtggtgccacagcagccaagggaggaaagagttcaggagggagggaacacgggagtggttagtactttagaggcaggtaggaagttgaaggtagagagtaattcagtgtggctgggctttggggcatcatggaggagtggcaggagatgagcccagaaagtccattcgggctcttatgcaaggaaccttggtcaccaggctaaggagttaaggctttattttgtaggaaaggaagaatcattgaagggtttccaataggagtaacatggtcagatcaaggtgtttcagaaaggtcaggctgaggcaatgtggaggacgctgtggaggaggcagtgactcattgaagtgatggaaagtggcttttgggctgtgaaagaaggcacagtcttccaagatctttagtaggtaaaattgagacgccttgaaaatggtagttaacactcattgagcactgttctaagtgcttacgtgaatgatcttaattctcacaacccacctatgaggtacattaacatcattttatgcctaaggaaacaggaacagagagataaagtaatatgctgaacagaactagtaagtggcagagcctagattcaaactcaggtggtttggctctaacccacactcttaacttcagtgttgttttgccttgattagatgtggggagtgagggggttgtcagttagcatcaggttcagctgtgagttattagccatccaaaataacttatggactttctgtcctatcgtctccaccgtgtgacacttgtcctctggtcattgcatttatgtttcaagcagtaaaatactgggtagggggaaggggagaacagatgttggggaacaacagaagtctctgctgtaagagaaatcccaggacactgacatttgcgtggaggatgatattgccacacattgaagtggcaaccacaggaaacctgttagacctttatcatttgacagtttcttttcccagaatccttcctttgccttggaaatgaacccctctgtgactctggtgtgctgctcctctcctgtctagccattcagtgctcatgagagcttccaatcatagtacctgtctccctggccacagttgattcgattggttgaggtgtggcatgtggtctaggtcaggacaatcagaatgtttttcttcaatttttaaaaatttaattgagggaaaatattgcctcttggttttgtggcacagctaggagatgtgtggccagaagctgctggtggccctttttacagccacggggaggaaacttgtttcagagaatgaagtgaacttacaggaggagcaattgaaagattcctgttcatgttcgagtctctgattgtacttgtccttgaggctcatctacttatgattatgtgaaacttcgggtaaattgactctgtggcccaaatggtgtttctattacttggaatcagtaaagtcctaattaaatctgtgttcaaataggtaattctggaatcaatgcagatgtgtttagggtttctgtgtgtgctgggggtcatagtaaatagtaaccagaagcagggaggcaatttttgagactgttttaatggtctacatgaaaaacaataagaatctgaactaagacagtgtcggtgggtgctgtaggtcctggccaggcttgccactcccagtctcttctaccttctagactgtgaaccagccacccacctctatagggtgctcatctttacatggttgcagtacagctggtaactattcattatgagcatattttcctctgtgtccttgggaatcattataatagctggttaaaaattcctgtctgctaattctaacatgtcagtcatctcagggtcagtcttcattgattgccttttttctttggtataggttacatttttctgtttcccataggaaacgtgttcaatcattttgacttttctcaaaacaatgttcagtcattttgacttgtctcctggctattgcagaggacatgttctagagaatctggattccattatatccctctgaaaagtattgacatttttgtttcagcagcatttaacttgactaaactcaaattccatgctctgtctccctcatggcaggcagcaactgaagtctctagtcagttcttttagccttatacagactgtttggagactgtcccatgaatgcataattcagaggtcagccagtgatttggtagagtttatacacagaattcagggctctgcctatctggctctctccattccaagattttatccccacagttttcagctgctgtggaaactctgaactctgtcctcttgtcttcaagtcagtaaggttcacccatcagggaattgattggggcctaccctgtggttcaaagtcttaaaaatgggaatctcatttagttctgatctcttcttttaaatgtagattctcctccagtttctgcctgccttgggttgcttgtcaatacttgcaggtaattaaaaaaaaattttgtccagggtgtatagttgttacatctgaaggaggatggatttgataggagctatttggtcatttactagaagccagaatctgtctggtcactgtgatgtaacctgtggtgtgtgtagccacgatgtgctggcaatgtattaagaaattatacacaatctggatgtgagatccagatgatgaggcttgataaaggcagtttttataatcacactaaatgcaattgatgtttcaggacggcatgttcaggggcataaggagcttgattagccagtaagcccccagttggggcttcccaggaactgaagtaacctcaccctagaggttaccgaaaggcaacatgccattgctaccaacttgagtgcctctccccatgtggagtttaactcattaaatatctcctatcctgatatctctggatcacctctgctttacaaaaaaatgtgtttgagtgtattatagtaaatgttaatttctatatggtttacagatcagaatgatgaactgagacccccatctagtcctctgccagagacctagtatttaggatggagaggaatagataaattgacaagctttttagcaagttgaatggtcggggatcagtgacagattgtattcagtataataggagagatggtagagttaaggatgacgtccaagtttcagccttgtgcatctaggcgggtggtaaatacaggagagaaaacacaaggaagagagcacgtgtaaggaagacgaattaagctttggctgtttgaagtacccgctggacatctaggtgagtacatgagattctggatcactggagagaagtctgggatggcgatatatattgaggaatcaccagtagataagtgatagatgaggctataggtgtagttgatataactaggtagcatatacagagtgagaagagaactgatagcaaaacccagtagataaggggagagcctaagaaataagtcactttaggagactgaagaaaagacaaggaaaggtgatatacagaagctaggggaggagaatttcaagaaggaatttagtggtcaatagggtccaattccaaaaacaaaaacaaaaaacaagcaaaacaagtactgacaggcatctattggatttaacaactaagaggtctgtctttacctcaaagattacaatttcaatggagtgatgaggaatgcagtggtttgaggagtacatgggggcggtagtctgtaacatgtggctcctatcaaccaagcctccaagtaactgtacctctgtgtagtccccctactgctcaatctggtgggccctgtacaaaagtttaactgaaagaatgcagggaattaatgctgcttgacttccaaggataggttgtaagaatcctgtaacttttgccttggtcttttggatccctcaggaaccatgtaagaagtctgactgccctgctggagaaatcaaatggagaggtcaagagacaacatggagagagaacgcacagcccagctgagcccagctttccagttatccccaccaatgcgccacacatatgacggaagtcattttggtccctccaaaacaacctagccagccagctggataccactgagtgacctcagtagatgccacgtgggacaggagaattctctagtgagctttgcccacattccttacccacacagtcatgagtataattaaatgattattgttttaagccccaagttttggggtggtttattacacagcagtatataactggaacattgggcactgaagtagtggaaaccatacatgcacgttatatttccgttaaacttggaaagggaaagatctgatggagtgggaggatcacataagatcaagggagaatttttatgaagatgacagagacttgggagtgtgcatatgctgatggggaagagttaggagaaagagaatgttgaagataggggagagaggagatggctgatgcatgaggtttatgagaaggtaagggaagggatgagatgcaaaattctgctggacagactgatcttgcttacaaggatagtgggatgcttcgccttgtaaaacaggaagtgtctgcccacctcctgttctttaaaaatgtcaagcatatccatgtactagagtcgagagaatatatgaaggttagttggacagtactggatctcctaagaattgtttgactgaagccctttctctggattgctgactcaacccaggctggagttaagtgattggaatccacaccctcggaccagaatccaagttaccttctgctaaagccatacatacacattaaaaccacacttccacagagtcagcttgtctgggctcaatgggctctcaaaataatacagggttccattacctctgacccagaggttctctccaagagaaagagctgttgatgttacaattctgcctgtcactgtccctgttatagcagggagtgcgtactggattagtactccccagaaggatgtatggtcagttggattggtggtggatggcagtttgtaccaaaacgtcacttgaacttcacctttgacagctgcagacttccgcgtgctgataaggaattaaagaaagtggaaatgcaatgcagtccaagataaactactttacaaaactttgtcttatggaaaatcacaaacatacacaaagttagactagtaaaatgaatccccatatacttatcatccagcttcaacaattacagtgtctgctcatcatttgaatggcacacacacacacacacacacacacacacacacatacatttgtgtggatatatatgtgtttgtagttttatatatataaataaaactacatatatatttatatatatagttgattcttatatatataaatgtagttatatatatatacatatataaaaagtttattattattattcacagatttcatatttgcaagttcacttacttcagacttatctataaccccaaatcgatacttgcagtgctttcaatagtcattcatagacctgcacagagtggcaaaacaatttagttgtcaggcactcagtgttcccagctgaggttagaaaaggcaatgttcttgtttctgctctcatactgtaagcaagtgttcttttcgtagtcgatctagtgccatatttttgtggcttttttggtgattttgctgtttaaaatgtcccccaatcatagtgctgaagtactgcctagtgtttctaagagccagaaggcagtgatgtgccctgtagaggaaaatacatgtgttagataggcttccatcaggcatgagttataacgctgtctgctgtgagttcaatgttaataaatcagcaacacagtacatccagaaaaaggaataggaaaggcttgccagtctatatgtgaagacgctctgtatggtgctaaaataacatctttagtgtgtgatgaaggtatg

SEQ ID NO: 1186 - skipped

SEQ ID NO: 1187 - DNA, 21314 bp, mus musculus
ttattatcatttattatttattagccagaggtcttaggtgagatcaaattcaatcattataatttatatttcaatatactgcttaacttcatgataggcaatgttctaggtgctcctcacatgtgaaattttaatatttttactgcaactctggaggtaagtactattattataccaattctacagatgaaaaagccaaggaatagcatgcttgaatcacttgcccaagatgccatgtttagatagtggtacagtggggattcgaacgcgggagctcaggtttcaaagtctgtgctctttacatatgcagctaaagagtcagacaagaaccaaaaggagatggagaatagagggtagaaagggcacaggttcaaggtgaaaggtcagaaactgcaaattcggagtttgggttggtctagcagcttaaaggcgtcatcatgaactgttcacctaagtaagttaagctcctgtttgagaatgactgataagcttgcaagccaacttacaaacaaactggggaaatgttccaatagatgactaagtcttttaggtctttttacctgtgtttttcggtctctataccagattagtcgcctggctctcccaaacagaccggccaactgacgtagtcgcgaaacggttaatgtcgaggcgggggcgggggaggcggaaataaagagagcggaagcaaagaggattgtgggagctccgttgtgcgtcgcttaagtgagggcggcggatgggcgaaggtccggtgactgcgactgtcgctgctttctgaggccacaggaaaggggccgtcggtcgccgccatgacagcgagcgaggcggaggtttgtagcacttcttatgggctgagggcgtagacacatcctgcttccagcctagcaggcaaacgggaacggaagtgataggggatcagaagttgcgaggggatgaggagtaggggaaactgacaagcggacggacccggcggcgagaattgatggcgtagctgtaggattaaggggcgtgtcaactgtgttgtgtgtgttgacactgagatgtgtgaatcccctcattatttttagctggggacaggcggggtctatgggggagggggcggacggatgaatggaggataaaatcagggcgaaaacgtgttgtctgctgggcaccagtacatctgagtcacatctcagcaggatgattttattggaaagatctaggtccctggtttcagattctgctattgatgcgttgattgatttcccttaccaaaataccaagtacctgctctgtgctgggtactgcactagaggctccggatgaggaaaggaattaggctttttcctcgacatttacagcctgccggttgctatctgcatttggagacaggctattacaatacaaggagacagagatagatcctgtgttatgaaaatctattgggtgccaccgaactcatctgggagttgagatctgggacggctctttgatgcggtgatttaacatatattttgaagacaaaataagcagggcaaaaacgaagtgcaattttcctccaagcaccttccctccctgttgaggtgaactggagaactgagtagcatttaaggcccaaaattagtgtatttctttttttttttctttctttctttcttttttttttttttgataaggagtctctctacttctgtcgcccaggctggaatgcagtggcgtgatctccgctcactgcaacctccgtctgccgggttcaagtgattctcctgcctcagcctcccgggttgctgggattagaggcacccaccaccactcccggctaatttttatatttttatatttttagtagagacggggttttaccatgttggccaggttggcctcgaactcctgacctcaagtgatccgcctgcctcggcctcccaaagtgctggtattacaggcatgagccaccgcgcccggtccccacaactagtttatttctggtaagagcatttgcccatcacaatgggacttccaggcgcctctggaagaatcagtcttacgtgagtgcaaagcctgcaagctctgggtaggactacgatggaggtgctagttacttggttttccagcaaactcggttcacagcagggaattgtgcacccaccagaaatcctaagcaatatttctctgaacaagaaaagaagcctctttgtttaccagagaaacaacagtatagcagtctaagtcagtggctctcaaactttcctgtgaatcagaatcagatggagcgtttcttaaaaccaagattgctaggtcccatccacagagttgcccctacagttggtcaggagtggacccccgaatttacatttctaactagttcccaggagatgctgatactcctggacatggggccatacttggagaactataggtctaaacggagctgacaataaattggaaagaatatctcctggaatctcttagaacccgggaggcagaggttgcagtgagccaagattgcgccactgcactccagcctgggcaacagagtgagactctgtctcaaaaaaaaaaaaagaatatctcccctagggaaggctaggcacactcctaaacgtcaggcatgtctgaattcagacacagtagatatgaaataaaatggacttatttgacactgcttagaaaatctttttatttttatatttgtataattttattgtatatttacaaattgtatacatttatagagttcaaagtggtattttatatatatacaatgtagaatgattaaatcaaggtaaataacatattcatcacctaaaattttatctttttttacacaaaaatgactcaacatggaatttaatagtttttttgtggtgctaacatttgaaatgtactcttagctcttttggaatatgaaattttgaaatatcaccaccattctattctctgtgtttgtgggttccattgttttagattccacatacaagtgagaacatgaagtatttgtctttctgtgcctggcttatttcacttagcataatgttctccaggctcatcaatggacagattttcctgatttttgaagactgaataatatttcattgtgtatgtatagcacatttgctttatctgttcatccactgatggacacttaggttgatcccataacttggctattgtgataaatcctgcaatgaacataagagtacagatatctcttcgacatactgatttcaaattctttggatatatacccagaagtgggattgctggatcatatagtaattctatttttagttttttgaggaacctccatacagttttccataatggctgtactaatttatattcccaccaacaatgtatagggttgccttttctccatatcctggcctgttatctttcacctttttgataatagccattctggaaggtgtgagataatatatcattgtgattttaatttgcatgtccctagcgattagtgatgttgagcattttttcttatgcctgttggccatttgtgtgtcttcatttgagaaatgtctattcgggtcctttgtccatttgttaatcaggttgtctttttgctacttagtcatttgagtcccttatatattttggacattaacaccttattagaagtagggcttgcaaatattttctcccaatctgtaggctgtctctcccctctgttaattgttttctttgctgtgcggaaacattttagttcgatgtaattccatttgtctagttttgcttttgttatttgagcttttggggtcaaaccccaaaattcattgcccagaccagtgtcctgtagtttcttccctaggttttcttcttgtagtgttatggtctcaggtcatatatttaagtctttaataaaatggatgtgtttttgttgtttgtatgttttggatggtcgagcaaaggtcatcttcctgaactaaacaaagcaaattgtttttctccattgtacttgtcacagtgacttataccataaattgtttaaaaacacaaagtagcagttttctattcaaatcccttgctgatttttatatattcaagtagttgtttacagtggagttcacacctccactgtatcaacaacgaaaaatgaagtgttcctaatttctggtaataaattatgtttgaggttaaaaattaaaaagacaatgtgacaagctaattgacagacaaagattagtataagaagtcagaattggtaggtagttccacccccaccaataaaactctccctttagaagaaatacagttattcactgcatagtggcattttggtcaacgatggaccacatatattatggtagtcccagaagattataatggagcatatatagaaacctgatatacagcacttgatattggcattgcagatcagttgcggtaatgattgatgttcattattggtactggaacattttgttttccatatgagaaaaaaaaaatatatatatatatatacacacactctaggtttgtgtaagtacagtctatgatgttctcacaatgaaattgcctaacgatggatttctcagaatatattcctgttgctatgcaaggtgtgactgaaatcattttatttactctagaacacagaatcagaaatctcattttgttacagcttaatttgaagccttcctttagggggtggccctaaacagactcctggagggtggcagtccacagttatacctcccgttcaaaccccctcccatgaccctgaaaaaggctaggacacattttcagaaatttcactaatcattctagactcttgtcaatgcttcatcccaaatctcgctaggccagttacaaaacaaaataaatgaaaccccaaaccaaacactcagacacacataaaaagacaaccaaaaagtccatacaaactggcctgagtctattgtgagtctttgtaggggccagcaaggtgctagaatggccagtgccttggatgtttcagaaatctgttctcaggctgggcgcggtggctcacgcctgtaatcccagcactttaggaggccgaggcaggtggatcacctgaggtcaggagttcaagaccagcctggtcaacatggtgaaaccctgtctctactaaaaatacaaaaattagctggacgtggtggcaggtgcctgtaatcccaggtactcaggaggctgaggcaggagaatcgcttgaacctgggaggcagaggttgcagtgagccgagatcgcgccattgtactccagcctgggcggcaagagcgaaccaagaaaatgtggcacatatacaccatggaatactatgcagccataaaaaatgatgagttcatgtcctttgtagggacatggatgaagctggaaaccatcattctcagcaaactattgcaaggacaaaaaaccaaacaccgcatgttctcactcacaggtgggaattgaacattgagaacatatggacacaggaaggggaacatcacacaccagagcctgtcatggggtggggggaggggggagggatagcattaggagatatacctaatgctaaatgacgagttaatgggtgcagcacaccaacatggcacatgtatacatatgtaacaaacctgcacgttgtgcacatgtaccctaaaacttaaagtataataaaaaacaacacgaaacaaaaaaaacagaaaagaaatctgttctctatcatgtccatattccaaaggagtcagcgagacaaccacatatgactcctgaaaattaatcaacttttgcacgtgattggtgagcctctcacttaatgcttgtgcacttaccctgcacctccacagtagtcctcatctgtctaaatccacacctagtcttacaggtagtgttattttccgtgaaatgtgaggagataaaacaaacttatgtaagtttgaactctgtagctccatttcctaaatgatgcctgagtagtaatgatttaattttgttgcatgaacattcagtatctcagggaccctgagagtggacagatggttgtgaaggagaattttgggctatgggtgtcaaagcagcaaacgcgattactccagaattcaagttcagatgggattgttcccagtccatattttctgtgtgctacagctgattccttaaactaaactttaaatcaatatgtgtctctgacctgaagtggggtggggattctggtctggcactgaactactaggttatggaggtcggttttttctttggaatggtttttctgagggtaagagtccttgcatcaagtgagtgagaactgtaaaggagaggaggaaaagggtaatgataatgtcacgtttttgctttgcaaaataagattaggagaaaaatgaagaacacactaggaggaggaggaggaggtggcagaaataggattgtgaatctgggatctgcaactgagatgtcctatgcctacctattgcttttcccaaagcagaggcttaagcaccctgtgtgtgaagccagatttcctttaggtcctgtgactgtgctggggacagggcagctgttgccattgttattggaataacctttctgcacttgataaggtgataaggaggaaacctgggggaccagatctcatatacacatatatttaagatatatatatataactttaggggcattttaatagcttctggcagtctaaggatttatataattgtctgccaaaactgcagtgtaaaagagccaaatcgaaagtctgactgaaagctagaattcaggggatgggaagtgacctctgctaggaacgagttttcttatgcgaggtccttagaggagtcgtcactgccctctagcccaagaccaccaggaacacacctgtggttgaacaggttgggttgattgctcagtgcattacatggagggagagcgcacaccatgggcgctgtggtgcttctctgttggagggtgtcagaaaggacttattacgggatttgaatctgtgttaggtgaatttggggaagatttaaagaagtgaggctttgccctggattggactctgttaggaaatgggaataattctgtgattgtgtatcttaatgactcttatccagaaggaggctaattggtaaagtagcaccggtcactgttagcaaggatagcagagtgtttggtcatttttatggcttagtcaaagttcatgttttgtttcttcagatacagttatgaggtggtcttgcttttttattggtcactgtggtcacatattggccttgtctgatagtggcagtttatgaaattgttatgttcatcgggagaacaccaaggcccagctgtgagtgccaagccagttgccacatgtcagtggttgctttttttcctccagagtgatcagcactgggtccagcagcttattggaggccagatttcctggccatttatagcagataaatagtcagatatgctgaacaggaaagcttggggctggatgtggatgaaagcatttggttaccttcttttttttttttttttcttttttgagacagagtcttgctctgtcacccagactggagtgcagtggtgcgatctcagctcactgcagcctccgcctcctgggttcaagtgatcctcctgcctcagcctcccaagtagctgggactacaggtgtgtgccactacacctggctaatttttgtatttttaatgaagatggagttttgccatcttggccaggctggtctcgaactcctgacctcaagtgatcctcccgcctcggactcccaaagtattgagattacaggaatgagccactgtgcccagccctctggttactatctaacagagcttaggagcctcagttaaaatattagtctcctgaggtggtttttccctaaaaaatcagatcaaagtatacttaagcaggagaagtacatgggagaaagtggcagattgtatttttcagagatggccaccgtagtacctgtcatcccacactctcttctgtaatgtgaccttgccacccttccattgagaagtagggtcaaatgtctcctctcctttgaatctgggccaactttgattatattaaccaatagaatagggggcagtgaaactgtgacttctgaggctaggttatgagaggcagtgtagcttctggctcacctgcagtgacattcacctttagagccctgagctgccatgtacaaagtctgattaccctgaggctgccatactgttagaaggcccaggcctatggtaaggccacctataggtcctctgatcaacagccctagccgaggttccagctaatagccaacatttaccagtagcctgtaaatgaaaactcctaaaggattacggcccccagccttctggttttcccaggtgaggccccagacattatgaagtagaaacaagctatctctgctccatgatgtctcaattcttaaaccacagaatcctagaacaaagtaaaatggttgtttaatgccactaaatttggattggtttattacgaagcaatagtaattcaaacagaggtggggagtttggttaacataaaaggattgaagtaaaaggagcaaggaaggcaaatagttggtagagaagaaacaggctggtacacaaagcattttgctttgctgctgatgaggggctttttgatcccagagacttcagagtggacagaagtggacagtagaggggaaaatgggaagataatttatccattatgctaaatgaaactgctgtggataaatgaaaaatctatagataattgtgcctccttttaaaataagatcttgaactatttattttttaactgaacatcttgattaaaactaacagaagtgtgtggagttttttgtaagtaaaaagtagtaataatattaacagtggccaactattcagtgagtaacaagatttttttttcttttttgttattatactttaagtactggggtacatgtgcacaacgtgcaggtttgttacataggtatacatgtgacatgttggtttgctgcacctatcagctcatcatttacattaggtatttctcctaatgctatccctcccccgtcctcctaccccatgacaggcccctgtgtgtgatgttccccttcctgtgtccaagtgttctcaatgttcagttcccacctatgagtgagaacatgcagtgtttggttttttgtccttgtgatagtttgctgagaatgatgatttccagcttcatccatgtctctacaaaggacatgaactcatccttttttatggctgcatagtattccacggtgtatatgtgccacattttctttttattattattatactttaagtttcagggtacatgtgcacaacgtgcgggtttgttacatatgtatacatgtgccatgctggtgtgctgcacccattaactcgtcatttagcattaggtatatctcctaatgctatccctcccccctcctcccaccctacaacagtccccagagtgtgatgttccccttcctgtgtccatgtgttctcattgttcaattcccacctatgagtgagaacatgcggtgtttgattttttgtccttgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacgtgtgcacgtgtctttatagcagcatgatttatagtcctttgggtgtatacccagtaatgagatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgctattctaactggtgtgagatagtatctcattgtggttttgatttgcatttctctgatggccagtgatggtgagcagtttttcatgtgtcttttggctgcatcaatgtcttcttttgagaagtgtctgttcatgtcctttgcccactttttgatggggttgtttgtttttttcttgtaaatttgtttgagttcattgtacattctggatattagccctttgtcagatgagtaggttgcaaaaattttctcccgttttgtaggttgcctgttcactctgatggtagtttcttttgctgtgcagaagctctttagttaaattagatcccatttgtcaattttggcttttgttgccattgtttttggtgttttagacatgaagttcttgcccatgcctatgtcctgaatggtaatgcctaggttttctagggtttttatggttttaggtctaacgtttaagtctttaatccatcttgaattaatttttgtataaggtgtaaggaagggatccagtttcagctttctacatatggctagccagttttcccagcaccatttattaaatagggaatcccttccccattgcttgtttttctcaggtttgccagagatcagatagttgtagatatgcggcgttatttctgagggctctgttctgttccattgatctatatctctgttttggtaccagtaccatgctgttttggttactttagccttgtagtatagtttgaagtgaggtagtgtgatgcctccagctttgttcttttggcttaggattgacttggcaatgcaggctcttttttggttccatatgaactttgaagtagttttttccaattctgtgaagaaagtcattggtagcttgatggggatggcattgaatctataaattaccttgggctgtatggccattttcacgatattgattcttcctacccatgagcatggaatgttcttccatttgtttgtatcctcttttatttccttgagcagtggtttgtagttctccttgaagaggtccttcacgtcccttgtaagttggattcctaggtattttattctctttgaagcaattgtgaatgggagttcactcatgatttggctctctgtctgttattggtgtataagaatgcttgtgatttttgtacattgattttgtatcctgagactttgctgaagctgcttatcagcttaaggagatttggggctgagacgatggggttttctagatatacaatcatgtcatctgcaaacagggacaatttgacttcctcttttcctaactgaataccctttatttccttctcctgcctaattgccctggccagaacttccaacactatgttgaataggagtggtgagagagggcatccttgtcttgtgctggttttcaaagggaatgcttccagtttttgcccagtcagtgtgatattggctgtgggtttgtcataaatagctcttattattttgagatatgttccatcaatacctagtttattgagaggttttagcatgaagggctgttgaattttgttaaaggccttttctgcatctattgagataatcgtggtttttgtcgttttttctgttcatgtgatgggttatgtttattgatttgcatatggtgaaccagccttgcatcccagggatgaagccgacttgattgtagtggacaagctttttgatgtgctgctggattcggtatgccagcattttattgaggattttcacattgatgttcatcagggatattggtctgaaattctctttttgttgtgtctctgccaggtttttgtatcaggatgatgctggcctcataaaatgagttaggcaggattccctctttttctgttgtttggaatagtttcagaaggaatggtacccggtcctctttgtacctctggtagaatttggctgtgaatccgtctggtcctgaacttattttggttggtaggctattaattactgcctcaatttcagaacctgttattggtctattcagagattctacttcttcctggtttggtcttgggaaggtgtatgtgtgcaggaattcatccatttcttctagattttctagtttatttgcatagaagtgtttatagtattctctgatggtagtttgtagttctgtgggatcggtggtgatatcccctttatcattttttatttcgtctatttgattcttctcttttcttctttattagtctggctagtggtctatgtattctgttgatcttttcaaaaaaccagctcctgggttcattgatttttttgaaggggttttcatgtctctatctccttcagttctgctctgatcttagttatttcttgtcttctgctagcttttgaatttgtttgttcttgcttctctagttcttttaattgtgatattagggtgttgattttaatcttcctgctttctcttgtgggcatttagtgctataaatttccctctacacactgctttaaatgtgtcccagagattctgatacgttgtgtctttgttctcattggtttcaaagaacatctttatttctgccttcattttgttatttacctggtagtcattcaggagcaggttgtttagtttccatgtatttgtgtggttttgagtgagtttcttaattctgacttatgatttgattgcactgtagtctgagagacagtttgttgtgatttctgttcttttacatttgctgaggagtgttttacttccaactatgtggtcaatcttagaatatgtgtgatgtagtgctgagaagaatgtatattctgttgatttggggtggagagttctgtagatgtctgttagccctgcttggtccagagctgagttcaagtcctggatatccttgttaattttctgtctcgttgatctaatattgacagggggtgttaaagtctcccactattattgtgtcagagtctaaatctctttgtaggtctctaagaacttgctttatgaatctaggtgctcctgtattgggtgcatgtatatttaggatagttagctcttcttgttgcattgatccctttaccattatataatggccttctttgtctcttttgatctttttataaacaactcaagataattggctgaaaatagttagtgagacttccccaaaggctcgtcagcataggcaactacaatattaaatcttgttactctgatttccagcaagatggccgaataggaacagctctggtctgcagctcccagcgagatcgatgcagaaggccagtgattctgcatttccaactcaggtaaaccgggtctggagtggacctctactgcttaagatctgttttatcagagactaggattgcaacccctgcttttttttgctttccatttgcttggtagatcttcctccatccctttattttgagcctatgtgtgtctttgcacattagatgggtctcgtgaatacagtacactgatgggtcttggctctttatccaatttgccagtcttgtcttttaatttgagcatgtagcccatttacgttcaaggttaatattgttatatgtgaattttatcctgtcattatgatgctaactggttattttgcccgttagttgatgcagtttcttcatagcgtcgatggtcttacaatttgtcatgtttttgcagtggctggtaccggttgttcctttccatgtttagtggttccttcaggagctcttgtaaggcaggcctgatggtgacaaaatctctcagcatttgcttgtctgtaaaggcttttatttctccttcacttatgaagcttagtttggctggatatgaaattctgggttgaaaatttttgtctttaagaatgttgaatattggcccccactctcttctggcttgcagggtttctggcaagagttttgctgttagtctgatgggcttccctttgtgggtaacctgacctttctctctggctgcccttaacattttttccttcatttcaaccttggtgaatgtgatgattatgtgtcttagggttcttcttgaggaatatctctgtggtgttctctgtatttcctgaatttgaatgttggcctgccttgctaggttggggaagttctcctggataatatcctgcagagtgttttccaacttcgttccattctccccgtcactttcaggtacaccaatcaaacgtagatttggtcttttcacatagtcccatatttcttggaggctttgttcttttcttttcactcttttttctctaatcttgtcttcttgctttatttcattaagttgatcttcaatcactgatatcctttcttcctcttgatttatttggctattgaaacttgtgtatgcttcacgaagttctcatactgtgtttttcagctccatcaggtcatttatattcttctctacactgggtattctagttagcaattcgtctaaccttttttcaaggttcttagcttccttgcattgggttagaacatgctcctttagcttggaggagttcgttattacccaccttctgaagcctacttctgtcagtttgtcaaactcattctctgtccagttttcttccctgctggtgaggagttgtgatcctttgaaggagaagaggcgttctggtttttggaattttcagcctttctgcgctggtttctccccatctttgtggttttatctacctttggtctttgacgttcgtgacctaccgatggggttttggtgtgggagtcctttctgttgatgttgatggaattcctttctttgttagttttcattctaacaagtcagttggagtttactggaggtccactccagaccctgtttgcctcagttggaaatgcagaaatcacccgccttcttttttttttttttttttttgagatggagtctcgctctgtcgcccaggctggagtgcagtggtgcaatctcggctcaccgtaagttccgcctcccaggttgacgccattctcttgcttcagcctcccgagtagctgggactacaggcgcctgccaccatgcccagttaattttttttttttgtagttttagtagagacagggtttcaccatgttagccaggatggtctccatctcctgacctcgagaaatcacccgccctctgcctcggtcttgttgggagctgcagaccagagcttttcctgtttggctatcttgccggaaatcagagtaacaagatttaatattgtagttgcctatgctgacgagcctttgaggaactctcactaatcattttcagccaattatctcgagttgtttataaaaaacgatttctactttgctttggttatgtgaatgtttgcctcagtatatcttatttgaggtgtttaacatatgacacgtggctagcgttagtgttgaaactgtgaagacgtttagctgttcaatcttccttggtaatagtacttagttatcagagattgaaaagacatttgctcatctctgtctcattgtgtgagaggaaaacacagtgttatttccaatgacatgtatggaagtttcattcttttaatctggcagaaactggttcagttttttttgaaacagggtctcactgtgttgacagttggagtgcaacagtgagatcatggctcactgcagcctcaactcccaggctcaaacaatcctcccacctcagcctcccaaatagctgggactacaggagactgccaccatgcccagctaatttttgtgttttttgtacagacagggtttaaccatgttgcccaggctgatcctgaacctttttcttttaaaagactagtcaagcatagtagtgagaaggctggttcacttttaaagtctccatatgtggccacattttagattttatatacatcaatagtttttgctgggtaacctattctatctgtaggtaagaatggaagtcctaggactgggtgtggtggctcacacctgtaatcccagcaatttgggaggccaaggcaggtgggtcgcttgagcccagtagttggagaccagcctgggcaacatggtgaaaccctgtctctacagaaaattcaaaaattagccaggcgtggtggtgcatgcctgtggtcccagctactcgggaggctgaggtgggaggatcgcttgagctgaggcggtggagactgcagtgagctatgatcactccagcctgggtgacagagtgagactctatctggaaaaaaagagtagtagaagtccttgtactgttggaattgtttaatcagtgagcattcagagatattggttataaatgttgagtatggctaccaactgaccacatggttatgggccaaggtacaaaatgtctgagtcacttgttttattgtaaaaattcatgtgaatgtctaaggttttgaagatttacacctgtgttttctaggagttttacatttttctttcctatgcctttgttttgttttcaggtaagtttggcatgtggtgtaaagtaggagcccagctttgttttccaggcgcatatccagttgtcccagcagctggatttcacagcttactgcgattgcgaggcttctggttttcaaggctatcactgagcaaaagagagggggatgtgaatagggcaagttaaaaggccacaaagatcagtgttcttgctaagattcagttgttttcttgaataaatgctccttagatcgctgcaagcttttgggtaatttccagaatattgaaaaacttgattttaacaatttttgccaatattctctttgctgatttgaggagcagattttttggaggttcttactctgccattctgaaaatgcctactcataagtttctgttttgcctggggcataatcagatctccgtatgaaataataattttgatatatgtgtatatttgggtcagaacttcttagcggtgggcaggatttggactgaccaaaaaaaatgcttaaggtggccttctcctgtctcttcaggactctaaaagactgtcctgggtggaggctgggctgtgttcacaagcaggccagtgggtgagaactatgggcagccagtgagaccatgtcatttttgtccctgccagactgtttctgtgctcatagacatatgaaaacatctggagatacgtttgagctcatttttttccccagagatggacttccaatttcctctactgtttatggtattccccagaaaatttgttagacttggacctctcctttagaatgaatttgggagagaccaatgttaaagggggtaattggagagaccagggaaggcttcttgcaggagctatgagttttaacctagttctacagagtgagcaagaggtgattagttgaagaaaataggtggtaagaagtagttcaatttaacacaagccatggagattatatgtaattaaatcccctcactgaaccaatgcaagaataaaagccaggcttatccctgggagaaagccagaaactatgctgtgatacacacacacacacacacacacacacacggaatcctgtctctacaaaaaagacaaaaattatcagggtgtggtggcacatgcctgtagtcccagctgcttgggaggctgaggtgggaagattgcttcttgagcttgggaggtccaggtggcactgagccttgatcccactactacactccagcctggggaacagagtgagactctgtctcaaaataaataaataaataaggaggggaggctgtatatcatagtcataaaaaattcaagacctgatgtcagacaacttaagttcaaatgccagatcttctgcttattggctgtgtgaccctgggaaacttactttatctctttggtcctattatatttgtaaaatgggaatatctacctgcttcacaggtttggtgagaagtttaaatgagagaatgcatcaatagtgcaaagcacaatgtcttgcatagagtgtttactaaaagccacattttattttatttatttttattttatttatctgtttatttatgtatttatttatttattgagacagagtcttgctctgtcgccaggctggagtgcagtggcacaatctcggctcactgcaacctccgcctcctgggttcaagcagttctcctgcctcagtctccctagtagctgggagtacaggcacacaccaccacacccagctaatttttgtatttttagtagagatggggttttgccatgttggccaggatggtctcgatctcttgaccttgtgatctgcccgccttggcctctcaaagtgctgggattacaggcatgagccactgcacccagcctatctttatttttttgagatggagtttctcactctgttgtctaggctggagtgcagtggtgcaatcttggctcactgcaacctccacctcccaggttctagcaattctcctacctcagcctcgcaagtagctgggattacaggcatgtgccaccacgcccagctaattttgtagttttagtagagacagggtttcaccatgttggacaggctggtgttgaactcctggcctcaagtgattcactgggctcagtctcccagagtgctgggattacaggcgtgagccactgcgcctagccaatttttatttttgagacagggtcttactctgtcagccaggctggagtgcagtggtaccatttcagctcactgcaactgatagggaaggggaaagggaagtactgggaagggaagagcatgatccctttaaatgatatggaaggagggaagagtgtggtccctggctaggcctctacccccgggcctatgcccatggacctgggtgaggacaggcatttttgttttcctgcccaaatgttgcatttcccaagaccaccctggcctgccataccaccatcctgtgcctataaaaaccccgagacgctagcaggcagacacacatgtggctgggcattgagaggagcacatcagtggaggaacacacaggtggctggatgtggagaggaacgcatcgacagttaccagcacgccggcaggccattgagcggcagaacgacacggagtttggctagggcagtcagaaaaaacctgggccgcaagcagcctgactccagaggaaaaccatctcccttctggttcccccgtctactgagagctacttccacttaataaaatcttgaactcattctccaagcccacgtgtgatctgattcctccagtacaccaaggcaagaactccaggatacagaaagctctctgtccttgcaataaggcaggggtcgaattgagctaacacaagctgcctacaggcagctaaactaaaagaacaccctgtaacacacgcccactggggcttcagctgtaaacattcacccctagacactgccgtggggctcccagcccatctgtatgctcccatagaggtttgagcagtggggcactgaagaagtgagctacaccccccattgcacaccctgcaaggggtacgagagaacttttcctttttcacaacctctgcctcctgggcttaagtgatcctaacatctcagcctccccagtaactggaagtacgggcacgtcaccatgcctggctaaattttgttttttttttgtagagacgccgtctccctgttactcaggctggtctcaaactcctggcctcaagcaatcttcctgcctcagcctcccaaagtgctgggattacaggcgtgaaccactatgctggctggtgggcagccacatgttaaatctctgagtctagccataaatccaaatatcaaatgcacaaagcctaaaaaccgtgtgagtgtggtcaaaatagaaactttttgaatgcgttctgaaatttatttctgttctgttcacttttagaatttggtagcatcttgaaaatgccaacttgtctccatcatgttaggaagaatcatatggagtgttttgttttttttggtctatatttgagacagaacatctgtgaacaaaaggtctctgaaaaggagactggaagaaagagacttccagtgaacagttgcaaacccaggagtcacagcctccagtgtaaaacaaaagtacatttataacgaaggattgaagcatggttagttctgattggtcaatgcagctgagttctggttggtccatatagcatagccctgattggtcaacacagctgagctctgattggctgaggaagatgagctctgattggttggttcagggaagcactgaaagtctgaaagataaaagagtgcaggttttcagggaactcagagtatgtgtgtgacccctagtcggcaaatggctcgttggctttattttacatttaggcccagtgagctgctcaagatccatcttgaaggattggctttttcaggtttatgtttgttcacacatgaaaggaggagcactcactttggggcttggggggtgcagggctacagtagaggcagggatcaagcagagcgtatctccaggggttaggtgagattcagagggatggagtcaagttcctgatcagctaaacctcctactaggagattctactacctgaacttttatctccttgaatttgggaggtacaaggtttttatttattgaatcatcaaacatgcattgaggcgggggttacagtagtttgtttgtttgtttgcttgtttttaactattgcatgagttctggacccagggcaggcttgaatctgagctctagcatttcctggctgtgtgactatggacaatttacccaacctttctgttcctcttttgcttcatctgtaacacgaggataatcatattatctacctcactgagttgtgagcattaaatgggataatacagatacagtattcagtgctcaacaaatattaaatattataataattattttatagtggttggaaatatggctattttaattctctgtgtacatgtttaattctttacatggtcaactggttttgttcatcattgtttctcctctgcctgtctgttctaggtacgacacttacaaatttgttgggtgcatgaatgaatgcgtacaggtaaacatttataatacaatgagaggtgctataatagagcttgagtacaagacactttgcaggacatggagaaggatatgattaactttgagcagttccgaaacagttcactgagcgaggctgttcccttctagaattttcacagtgcagtgggctgtcagagcaaactgcactggggaattaagtaaagggatgctagatagccaccaggtggcgatattgcagaaggattcaagtagcggaggaaaggagcagccctcttccagccaggagtccatgttcctgtccacgtcagattttttctcctgtccacgaaagttcaagctgtgatttctttccctttgttctgatggtcttggagcactgccgttcctgcccaaggctgttttggagctgcctagtgctccagccattctgtc

SEQ ID NO: 1188 - DNA, 83009 bp, mus musculus
cccttttaagcctcagtctcggttagcttcacttcagcgggaacctgcccactaaggaggccgattctttccggctcgagcaggtccggacccgcccctctggcgtctagcagtctcggaggcctgcccgtatagttcagggccggacagcgagcggcggcgacttgccagtaaggtaagtttgtggggttttcgtttgtcccgttcgtcagcaggcttcgctctcttttgcgcttttcccgcgcgtgaattcccgatctgaggactcgaactccagccgatctggagagacgggggcagaagggtagggtcagtgggccgggggtagagaaggttttgctacagtcctccacgcccccagcctttcacgtctcccccacgcgacagaaacacgtgttgtgcttctgtcttggcttgtcgcgggcgatagtgtgtttgtatgtgtgcaggtgggatcgcgctttttattctcctctgtaggcaaggcttccgggccccaagtccccgggggagcacctggtcaactgccacccggttcctgtggggcactggcttgagctacgtgtcgttcccactctaaggaacatcgcgactccgggagctctgcttttcccgcctcggagtggagaaaagcaggcgcgccgctcgcttgccactgctagggaatctggttgtcttaagttcacttagagatagagttgttaccctagtttcccataaattccgtggcttggttttaaacaaaggggcggcggggggatggcgtaataaatatttggagtattcaggactgattagccatgatcaatagtaggaccccacagaaggttttaatgaatggttacttttggttattcaggtattggaatttgattatgaatgaactaaactgcttcccttctttctatataccatgcatttcttaacgaccatcccatctggcataagagatagtgaagtttgattaatttgtcccttctacttgttcttatctacagtaaacaaaaaatgggggtagaataaggttattggctaaagtaacgttattggccttttggccaaattaccaataccttaattccgcttattactgtgaatgatcagagtttagctgtcttgcattttgctaattcactagatacttgtggagcttaaattatagatattatgccatctccttcttcttgcttttttgtttttattctgcctcactgtgcattattctaagtctgtaatgctcagccggtgtttttcagaccttttgactgtgaccgacagtaagaaataaattttatattgtgacctagtacacatgtagacaatatataaccgacaactgtttttacagaaacaacacttaacacttactacttgcaatatactctgataatttccattacattttaaaaaatgtacaccacaacaccctaatgatttgtccctagacctttagttttcaaacttgtgtgtgcactttatttaaaatttatttaaataaataatttatttaaaatttatttaaataaataatttatttaaaatttatttaaataatttatttaaaatttatttaaataatttatttaaaatttatttaaataaataatttatttaaaatttatttaaataatttatttaaaatttatttaaataatttatttaaaatttatttaaataatttatttaaaatttatttaaataatttatttaaaatttatttaaataaataatttatttaaaatttatttaaataaataatttatttaaaatgcagattgccctggctccctccagaaattggttctgtggtctagtgggacccaggaagatatacaatatagcatatatgaaatacttggtacagtgtcaagtgcacaggtgttcagtgaatattagttttcttcttggggaacaaatgttatttatctttagggatataatcaactcttcaaggtttcatctgtccctggcaaggtggcgtccaatactaagaactgttttccccaggtagaggaagtagcggggtgggggatgggtccaggatctgagattaatctttaagcagttggcttccctgaacaatgtcggaaatacagaagcttagaggttgaggaacataaggattagagaggttctgtgactttcccaggattgtgctgtcagtaagtggatctccgagactagaagtcacttccttattctaatattcttgtccattctgccttgatagcagccgcaatctggaggcagtggttgaagcagaaagagagcttccctaacttgcctatcccaaaggagagacaactgaatttgactcctagttcggttttaaagtaatgaaacttctaacctgcacattgtgcacatgtaccctaaaacttaaagtataataataaaaaaaaagaataatggtgaaataaaggtttttttaaagggaaaaaaaataatgaaacctgagagatctaaaatattttttaaaatacacccaaaggtttctgtggatttatagctatgaaaaatggatatagtttagctaattcttttatatagagtattttaaaacactggttaaataatttattaatgcaacattgaaagaaattaaagatgaaaaatctcactcaattctgctaccataatataactgataattctgttcccctcctatctttatccacatgtacccatgtttttacatgattgtgatcctttttcatatacttttttgttatttttatttaatactgttttggaaatttttttctgtgttgtgatgatctttatattttgcattattaacagcaacctaatatttcgtagagtgagttggctgtaatttacttagcctaactaaccaacaacagaaaataagatactatgtgtcctttgaaaagggagatgtagccaggtgcggtggctcacacctgtaatcccagcactttgggaggctgaggcggaagaatcacttgaatccaggagttcaagaccagcctgggtaacacagtgaacccccatctccataaaaaatattaaaaaattagtcaggcttggtggcatgtgcctgtggtcccagctactcaggaggctgaggtgagaggatcgcttgagcatgggaggttggggctgcagtgagctgtgattacgccactgcactccagcctgggcgacagaacaagattgtgtctcaaaaaaaaaaaaaaagtaaagggagatgtgctaatatagttattccatgatgtcttgggttatttaaaatcatttctataacttatgtcttacataacagtgagctcaataggaagcctaacaggaaggccagatctagatctggacctgagctgggagtttttgcccctcttggatgtatgaatttgacaatcaagatttctatgtgctagagcaggcagtgatcagtcctggtgtcctttatacatatgagttaggttgaatgtactttttttttttttttttttgagacggtctgctctgtcggcccagctggagtgcagtggtatgatcacagctcactgcagcctcgacctctggggctacaagtagctgggactgtaggcacatgctaccatacctggctaatttttttttttttcttttttggtagggactgggcttcaccacgttccccatgctggtctcaaactcctgggctcaagcaatccacttgcctcagcctcctaaagtgctgggattgcaggtgtgagccactgggcccagccatgaatgttcttttttttttttttttttttttaagacagtcaagtgaagcaaagggagtggagaaggaacaaagaattctgtaactggttgtgattaattagttgtattaataaataccactgtagtcagaccagcctgaatttatttttttactaagtatagacatttttaaaatgatttactttaaaaaatatatgaatcacagcagcttcacataggttcaagtgccatagtaacactcacactgttactttatgaatatttttttcgaagattatatgagtgtgtattaatttataatttaaacaatttttataaaggagccaattaagttggctgggagaataaaggctacaattagtctatattagcacatctccattttcaaagcacacatattgtcttattttctgtcattctaaaacattacttctttaaaattaagaaatatttcaaacagaaaaatagacttatgaaccatcatccatgtatctaccaaagatttaacaattgttataattttgccacattttctttaaggtgttgatctttttaaagaactaaaacattacagctatctccttataccccttcccaatctcatttccttcccatcccagagatacttttccaaagttggtatacatttttccaatctgtatttataagtgccctgacatgtggccataaatgatttgtaatatattgttttgtgtgtctttaagatttatataaatggtataatttattcttctgaagtttttttttcttttttgagatagggtctcactctgctgcccaggctggagtgcagccacgtgatcttggctcattgcaacctccacctcttgggcccaagtgatcctcccacctcagcctctggagtaggtgggaccacaggtctacaggtgcgcaccaccatgcttggctaatttttaatttttttttgtagagacaaggtctcactatgttgctcaggccgttcttgaactcctggggtcaagtgatcctcctgcctcagcctcccaaagtgctgatattacaggtgtgagccactgtgcttggccctgcagcatttttttttttttggtcagcagtatttttgagattttaaaatgcaaataaagttattttttattgctatatagtattccaatatatgactaaatcacttttaaaaaaatctccattccgttattgctgttggacatttaggttgttgtaaatatagagataagattcatataaatcatgcaaatattgttatgattccacttgcatgaggtacctagaatagagtaattcatagagacagaaagtaaagtagagtttaccaggggctggaggagggaggaaaagggagttagtgttcagtgagtacagagtttctgttcaggatgatgaaaaagttttgtcaacagatagttgtgacagttgaataacatcatgagtgtacctaatactaccaaaattgtacagtttaaaatgggtaaaatggcaaatattatatgtattttaccacaattaaaaaactaaaaattagaaacataagaattatgcttattttttcagaagcatatgtttaattgctttattttctgtggagtgaggccatgaaaaaagtgaacattcctattaaaaaataaactttaagttatattagccagatctgtttttccttgtaaataacagtttttgagatctttatatgacaacttttcttacttgcatgtctgtaaaaggtttttatgattatcattcttcagaattctccagttttttgttttttgagggtttttttgctctacttttccagagttttgggaaagattcttataaatatgggcgtacctttgaggctgtcttttgcatttgactgctattcaccagttagttctttcaagtattttactctctctcctctcctcacctaccctcccctattccctgccctctcttgcatccctccatcccctttccaagctgccatacctcttcctaggtcttcatgcccacacatacactctgccatcccttgggtccttctcagctcctccaagattctctctctctctctctcttttttttttttttgagacggaatctcgctctgttgcccaggatggagtgcagtggcgcgatctcggctcactgcaacctccacctcccaggttcaagcgattctcctgcctcagcctcctgagtagctgggattacaggcactcaccaccacgcctgactaatttttgtatttttagtagagacgggttttcaccatgttgctcaaggctggtcttgaactcctgacctcatgatctgcccacctcagcctcccaaagtgctgggattacaggatcaaacttcacatgagcaattaacagtcttcagcaatatcacacttttaacatttgaagaattgatccatcctcatttgggattaaaataaaaactttttctaggtcttaaaattagattctgaccttaaggctttgagaagctatagtatgaagggggaaaaaagaacttaatgtgaaagataatcagcaaattatactgcttaagatgtttaatatgaacttgaaaccaatgcaccattttcagaagccctatattttgttttggcataagatgattaccatttgaagtttgatccctctctgtttccttcaaaatgcctgggctaacttcacctctccctatcaatttctctctgggaacagaaacatttagagtaagacattagtaattcagtttttacttccagagttggcatgcataactattactgacaaatagggtcattactgtgctttgaggcttagatttttctactttcttcttgagtactttttctggaagactttatatcttggtagaacaaggggtttcttctgtgaatttgtacttcctttgcatctctgcctctctaattaatgatgtgttaaacaatcatatgtattgccagaggttgctatttatagaaatggttttataacatgactaatcatatgtgaattttcaggccagatctctcagtcatgatgttcttgagaaggttgagtgcattcgtggaacttgatgattgtcaataactaggcggtttagggaaaatgttgcctctaaagaagaatagtctatttgcttctaagaaactaggaacaatttttaataaatcgtatggctaagcttctgtgctggtcacctcttgacagtcatttctcaaagtaaatgtaggggaatgaatgattactctcaaaatcatttatactttgtgagacagaaatccttaaacattatgctgaaatggcttatgataggtacccaggcttgaactgattttgtttctgccttttgacacacagtagatttatcttcctaatgatgtgttgcttaagctagtattaaaatagaagaatagtgtccggttccttcacttactagttgcttgaccctaggaaagttagtgtctcagagcctctgcttcctcagctatagaatggagatcaaaatacctttttggtttgttgttaggtaatgaaggtaagggatttcagtttcaataagtgcttccttttatcttttcccctttatattacataagagagtctagaacttgagtgataaagtggtgtgtcctgaaatgaccatcatttattgattctagatcaggtttcctactaccaagaacactcccagaatcaataaataatagtaggtagtacacagagcagataatttgcatgctgatacatgagatagatgaatagtaattttttaaaattatagtttgaaatccagtttatgttcactgtctgggccagctgatagtgtgtccagaattggttccttctggtgggttcttggtctcgctgacttcaagaatgaagctgcggaccctcgcggtgagtattacagttcttaaagatggtgtgtccggagtttcctccttctggtgggttcgtggtcttgctgacttcagaagtgaagctgcagacctttgcagtgagtgttacagctcttaaaggcagtgtgtctggagttgttcattcctcctggtgggttcgtggtcttgctggcttcaggagtgaacctccgcggtgagtgttacagctcataaaggtggtgcgtccagagttgttcttactcccgatgggttcgtggtctcactggcttcaggagtgaagctgcagaccttcacggtgagtgttacagctcataaaggctgtgtggacccaaagagtgatcagcagcaagatttattgtgaagcgtgaaagaacaaagcttccacagcctggaaggggactcgagtgggttgctgctcctggctcgggtggccagcttttattcccttatttggccccacccacatcctgctgattgttccattttatagagtgctgatgggtccattttacagagtgctgattcgtccgtttttacagagtgctgattggtgcatttacaaacctttagctagacacagagcgctgattggtgtgtttttacagagtgctgattggtgtgtttacaaacctttagctagacacagagcactggttggtgtgtttacaaacctttagctagacagagtgctgattggtgcatttacaatcctttagctagacagaaaagttctccaggtccccacctgattagttagacacagacctgattagaagacactgattagttcttcaccagcagtgaggataaccccagcattatactttggaaagctttcacatagcactttacataaaattaaattagacaaggtaatatatgtgaagagtcctatacaaacttatttttaaaataatattttggttattcacttaatggaaccgtcagaattttagaagtgaggaaactgaggctccaaatgcatttaaatgactagaacagtctagtgggcatcaacactcattcagttgttttctttatctccagccatttagttaattcagtaagccccatttagattggactgccaggtagggaacattctgctcatttctagtagcccttctaataagctctgatgatttttgggggcctagtgtgctttctgctgagggcctttatcatctagtattcctttctttgaatatgtgtgcttgcattgagtcacccaagagagactgtaagctgggctcaacatacaaagctgtagttttatcagttttaagctcctgtagttaggcagtgtggataaggagaggttacttagaagaggaagagaggttgtctggagaaacccaacaaggcagagatagcgtattcctcttgattgccacagatagggagtacagacctgtttcccattttttaataaagtaatgatatgcatagggaagctaaagtgtgctaagttcctgtttgttaaaaaaggatagggaatactgaataatttcagactttgttttaaaaaatataaatttaactctgtgtgaaaagaaataattcaagagaatgcttacaaattaatagaatatgtaacttccacgcctgggaaaaattaagagaataaagaaaatctcatcaatccaaatatgcagaaaaagataaaagatatatagagcctggcaaataaaaaatacaaagtaagatggaagaaaaatccagtagtgttagtagtcacaataaatgtaagtaagttaaactcactaagagactgtcagattggatttaaaatatttcggctatgctacttacaaaaaccacatttaaaatgacacagaaaggttgaaaacaagggaatagaaaaagatgcactaggccaataccaacctaaagaaaaatggtgaggcaacatcagtgtcagacaaaatatgatttaaggcagtttagtaataattagttacttcatactgatgaaagaaagaaaacttaccaagaagagtctgtcaactgtgaacttcatataggcccctaacaatacagtcttgaaatacataaaggaggccgggcgtggtggctcacacctgtaatcccagcacttggggaggctaaggcgggtggatcacctgaggtcaggagtttgagaccagcctgatcaacatggtgaaaccccatctctataaaaatacaaaaaacaaaaaaattagccaagcgtggtggcacatgcctgtaatccctgttacttgggaggctgaggcaggagaatcacttgaacctgggaggcggaggttgcaggaggttgcagtgagccaagattgtgccatcgcactgcagcctggacaacaagagtgaaactccatctcaaaacaaacaaacaaacaaaagaaatatataaaggaaaaagcaatgggattatagggaaaaactgacaattcataataattggaggcttttaaacacctttgtcagaaactggtcaagcaaaatagattaaaaaataaaaaaagctaaggatatgaaatatttaagatctaaatgagatggaagggcaagaatatttaattccaaatttttagtgacaaaaatgtacttttagtccaaaaagtgatttttttgttttatttctcaaatttctaaggcagaaaaaattaaagttatgtgctacatttaataggaagattcttaaattatttccaaaagaatagaaattccataaatgcaagggcataggaaaaaaaatccaccttttgatggctaccagaaaactttagttttgtctgcaatatgacattgatgacaatacctaaatctggaagtgtttgtcaatttcttttacaggataaacacccaccatggtttgacaacaatgaatttttctatcaatatttatattatcatcatgtatattaaaacatataacacataaataattatatgttataaaacctataataatattataatttataacaacatagcacttgtaacctcaggaaagtggtacacttgggaatataaaactaaacacagcaaatgctcttattgcttccctttctgtgccttccaggattgagttgttacagttgaaatcaccatttggagctcacatttaaaaagttttaagatgtgtataagacttgaaaataagcatgttgtaactaacacattcagataaatgttgtccttcagagttactcttgggaaagttttcccttatacccatgacactaacagtattcaagatgctgtatctcagccatttaaagaggtacatttttttcatgtcttaacatctctgaaatggaggcaagtccaatagttgaatggtatcttttggccaggtggcagttgtgacatgatagttgttcctgcatgcacagataatatcaaaatctttaggatcaaaactttcataatggatgactgaagtgaaaaatccctgagacaatggaggatcacctttaactcttagaaaatagtggttgtggggaatgaatggaggagatagtaaatcagatttagttaccaatatgctgaaatgggagacaaaaggaagctagtctacatatttgcaaagctgacttaagagcatagcaaaaatggcttttagttctcttataatttattttttaaaatgctgctttaacagtgctcctggtggcatagaagttatcaagaaatttgtgttgacaattggggcctggcacggtggcttatgtctgtaatcccaacactgggaggctgaggcaggcagatcatctgaggtcaggagttcgagaccagcctggccaacacagtgaaaccgagtctccactaaaaatacaaaaattagccaggcatggtggcacatgcctgtagtcccagctactcaggagactgaggcgggagaattgcttgaatccgggacgcggaggttacagtgagctgagattgtgccactgcactccagcctgggtgactgaaggagaccgtctcaaaaaaaaaaaaaaaaaaaaaaaaagagagaaagaaaagaaaattggactcaatgtgaatttttgagatacattaaccaagttactttgcttatacgtttttctaatatatgcatgtttgattaaaatctatgtctacaatgaaaagagctctttcaaaaagtatttaaaaattaaataataaggaattatgacaggttggtggtttttctcccttcctttcttagtggtgcataaagtaatgcaactcttagttttaatgagacatttttgaaatttgttagaattgcctttcagagctactgtgttaaaaactaatttttagtcatctcattttattaattttgactgggatagaattataagttcacaatgacttttcccttaacacttttaagatattttcccactgtcttctaatgtttattattgctaatgaagagcctgctgtcaatctagttgttgctccttattaggtaaatttgtttttttctctctggtaactatgagaattttttctctatagggtttcaatatattgtatataacgggtatgtgtgtttgtatggtagtgaggagggattgcctgcttgcacttggtggctttttaaatctgagaactaatttttcttcagttctaggaaattcacttatcaactctttgaatactgcctctgccattctattttttccttctctgttccttctggatatatattggagcttctttttctccttatctcttaattctctccccttttccatctttcttatttatttatttttatctgccctcggtactggcagatttttttctgttctctcttctaatttgctaatttttttctcttcaactgtgtagtctattatttaaatctgtcttttgagcatttttatttctaatactgttaggcgtttcttggatttccttttggttctttttcacattcacttagttttatggatgctatttctttcttgagctctttgaacatatcagacatatattttgatgtgctgttcagattgtgcttttatctctaatttctgggataagaattctctcattttcttaggtctaaagatgactgacttagatgttttgtatatcttgtctgtgagtaaccttctaagggctttttttttttgactatatgtgacctaggaagtggagatgtcccttttgagtaatgtcatgggcaacctgcctggaccttgaaggttttatcaactcctaaccagtttttatgataacatcttatcttgaagtttctacatcacaaacataaattgaatttgagccatctatgcatatcttctgtagcagtttgggattctcacatgtttcttgtcttttccatcctcctgtagatgtttctcagatttaaacttcactaggtctctgctgattcaggagcctgtggccttaccaggtagccttaaatcgtaccccaaattcagcattgtatttccagctattaaggcacatatctcattcaaggtatcatcttgggctaatcaacattaacttctgctcatgggtatgaattccctttctgtctgacacttaaaaaattgtccttctttctggaaaaactttgctttgtattaaaaaatgtttttattaaatgattgtaaactggtacttctagaagtttggagtacgagggagcaactccagtgtggcttctgtccaccatcttttctttgaggtctcattgagagctctaattttttttcccattcttctcttatccttttttagggtttggagtcatcagcaggtttaattttggaggaactttacaggtgggttcattatttggctctgcaaaaacaacagtgactacttccactacagggtttattttctctacatctggtataggagggttaaatttgagggtgttgtcccaaccagttgcaagtgcatcttcatcttccactggcttattcacatccagctccagctacacagactacaggattcatttttggaacactggttgtgtcaactcctgccccagtagcaactgaattttccttagagtaagagcaatacagtttctgattttttttagtggatacaaaggtaattgtctctgagagacaaactgggtaaagaaatgatatgttatttctaaatcaactatttctggcctggcgcagtggttcgcgcttgtaatcccagcactttgagaggccaaagcaggtggattgcttgagcacaggagtttgagaccagcctgggtaacatggcaaaactccgtctctacaaaaaatacaaaaaattagccgggcgtggtagtatgtgcctgtagtcccagctactcaggaggttgaggtgggaggattgcctgagcccgggaggtcgaggctgcagtgagccatgattgcaccactgcactccagcctgggtgacagagcgagacgctgtctcaaaaatgaaaatctatttggaattatgctatttattcccaaggtagtctaccaaattgaaggcagctgagatttgaggcacaaggcacactgaattctgtactgtggactcccttcattttatgtgaaccataggaggagtactcactgagttttggaaatgtatcatcttgaaattaggctacttgctgaataagtgactctttagagagatctttttctatcgatcattgtaatgaactcattatatagttttccctcatgcatctcagaattttaaaggaggtactcatttcatgcctttttaggtaaatccacttgtttttttgtagcactgatagcctcatgtcttttagtagcacctgagaacctggtgaaagcaagggtattccctctggaattctcctttatcctgttatagttatctaataacttgtaattgaatgctaaataatctttcttaggaggattaatttaaatattaaagcattttgtcatgggtcatgaaatacatttaaaaatttctaaacttttctgtagttggttagtgtggaaaaaaagataaaaaatctctaaaaattgttttaaagagatgcgtgttgtttgatttagtgtctaaaacaaaaacttgtgttgtttaataaagtgctgggctggcagaaagaggaagtataagtccttttttttgttttgagatggagtctcactctgtcgccaggctggattgcagtggcgtgatcttggctcactgcaacctctgcctcctgggttcaagcaattctcctgcctcagcctcctgagtagctgggattacaggcatgcgctactgtgcccggctaatttttgtatttttagtagagacagggtttcaccatcttggccaggctggtctcaaactcctgacctcgtgatccacctgcctcggcctcccaaagtgctgggattacaggtgtgagccacggcgcccggccatataagtccttttgtctctacagaagacaaaattttctgaactactctttccccattaaaacatttttaaatgtttttccccttaaggtggatcaaattaggtaacctttatctatgaatgagaaatatggagctctgtacatgtattcctatattaatatctggttatctttctgtattgagatgaaataacctatagaacaaaaccttcacatttaaaacttaatttgacaggagccatgttatctagttgccttttaatatgtcagataactattatgttgatttttgtttccttttttctatttagaatgtgcctgtattaaaatacctcatgtaaccgtaaagttatacacctactaaacccacaacaattaaaaaaaaaaaaagttggacaacactgcttccacacaacctacagtgattacaggggcttctggggtaggtgccaacacccttactaatgctgcaactagcaataccctgtcacatgaggtgacagcatccactccttttgcttttggctcttctccctcctctgctatttaggtttctcattcatcggtggaggcacacctcagactgggagcaccagtttcaatattgtttccatgaggcatgccgctcagccaacagcatttgtagaattaccccttattcctgctacttaggcatctagtggcacaactgctgtacaaccaatagctcctttcgtccttggcagacagtccacaagtaaggtttgaactctgctctctaatggagaagcacagtattcaagattgattttgagattcttacttgattgattcaaatccaaatgtggtcacttctcttgttggaggttagtgttattgatgaatataggggaaattaaatacaaagtgccccttctggtttatagttttaggtttagaaccaatcaatctttgttttggaaaaagcaacaaactcctgagaaccagtagtctagaccaattggcatatagtaatcagagttaccctgaaatattttggccaattgtttaatgcttatgtttaacaaatatttcttgttcacaatctgttgattgtttttcttcctctcttaaaacttctgaaatgaaatttatcaggaggaacaatagaacaagaaagcatatctttagggtagtatgacattttagagaatattatatgatgcaataagtcagttatatggcatgatttgggagtggtatattcttgctaaaatattttggctagtggagacatcttatatactatatatgggtaaccagtttccagttaggttgcagtaaaatacatttaacttgtattcaacattaatgagaagacattcaggatcttgctaaaccaaaatgcagttaataaaatgttatatacagtggaccatatagtatataatcttttgggaatgccttttttcactcagcgtaattttctggagattcatccagattgttgtctgtatcgattctctttctttctttctttctttctttctttctttctttctttctttctttctttctttctttctttcttttctttctttttccttccttccttccttccttccttccttccttccttccctccttctttctttctttctctctctctctttctttctttcattgagacagggtctcgctctctctctggctggagtacagtggcacgatcatggcttactgcagcctcgacctcccaggctcaagtgattcttccacctcagcctcctgagtagctgggaccatagacgtgcaccaccacacctggctaatttattattattattattattatttgtagggacggggtttcaccatgttgcccaggctggtctcaaactcttgagcttaagcaatcctcctgccttggcttcccaaagtgctgggattacaggcatgggccactgtgcctggcctgcatgtttctttttattgctgcatactgttgtattgtatggatgtattacagtttttttaaaactattatctatgaatggatatttgtattttttctactttttggctattatgaataaagctgctatgaacatttgtgtactgatttttttcatgaatataagtcttcattactctgggataaatacccagtagtgcaatttctgggttatacagtagttgcatattcagttttataagaaactgccaaacttttccatgttagctgtaccattttacatacccaccagcaatgtatacaagatctagtttctttgtatcctcactatcatttggtgttactattttttattttagccatttttgtagatagtgataccataattgtagttttaatttacagtttctctgatagttaatgatgttgaacatcttttcctgtacttatcatctgtatatcttatcagttcatgtctttttttagtgagaaaaaaagcatccaaaatagcaatgtattataggagtcctttttgcatgaggatttgagtaatgtcagtggataatataattttacaaaagacagaatgctgtttgtgattttttctattgttaaacttacacctaggtatttcttttttttagagattgtacatgatattgtgtttgcttttcatcactagtatatagaaatacagttgattttgtatgtctatcttgtatcctgaaacattggagaactcatttattctaggagttttttttgtaaatttcttatgatttttctacatagataattatgtcatttgcaaatatagtttcatttcttcctttccaatctgatgcctttttttcttgccttaatgcaatagctagaacttccagcactgttttggataagagtggtgagagcaagttgccttgttattgatcttagggggaaaacattcggtctttcactattaagtatagtcttagctgcagttttttgttggtgttctttatcaagttaaggaagttcccctctctgtattccaattttttttggcggggctgggggagtggtgggggggagtttttaccatgactgggtgttgaagtttttcaaatgctttttctgcatcaattgatatggtcatgtgattggttttcattatcccgctaatacagtgaattacatcaactggccctaaatattgtaacaaccttgcatctctgaaataaatcccacttgtcatggtatatagttcttttatatattgttgaattatatttgctattatttcattaaggattcttgcatttatgttcatgaaggatattggtccgcagttttcttttttctattgtctgtctggttttggtcagtaagtaatactagcttcataaaatgagttggtcagtgagtaatactagcttcataaaatgagttctcctgttttattttctgaaagaaattcttcaaacatttggtagaattttccaatgaaatcatcccaacctggagattgatttttgggagttttcacatttatgaattcaaattcgttaattgtcatagggccagtcaaatgatgtttctcatattgatgaattgtggtcgtttatgttttttgaaaagttggtccatttcttctaaattattaaattcatgggcatagtattcttttgatgtctgctaggtatgtcatgatatcccctgttttcattcctaatatttgtatttgtgttttccctcttttattgtcagtcttactagaattgttaattttatagatcttcccaaaaatcagctcttggctgggtgcagtggctcacgcctgtaatcccagcactttgggaggcctaggcgggcggatcacctgaggtcaggcgttcaagaccagcctggccaacgtggcaaaacatcgtctctactaaaaacacaacagtcagccgggcatggtggtgcgcacctgtaatcccagctactcgggaggccgaggcaggagaattgcttgaacccgggaggcagaggttgcagtgagccaagactgcaccactgccctccagcctgggtgacagagccagacttcatctcaaaataaataaataaataaataaaagaattagctgtttgtacaattttttttattgttttcgtttttaattttactgagtttttggtctttttttctgtttgctttgggcttattttgctattttttttctcagttcttcagttgggagcttaaattattgattagatttttcttcttttctaatgtgtacatttaatgctgtaacttaccctgtctgtactgctttgtgtctcacaaattttgataggatgtattttcattttcattcaatttggtgtatttttaaatttctcttgagacttcctctctgacccatgtattatttagaagtgttcagtttccaaatgtttgaagattttcctgttatctttctagtttgattcaattgtagttggagaatgcactctgtatcattttaattcttttaaatttgtcgttgtttgttttatggctaaatatatgatctatcttggtatttctttcatgggcacttgaaaagtatgtgtattcttttgttttgttttttgagacagagtctagctctgtcacccaggctggagttcagtagcgtgatctgcaacttccgcctcccgcattcaagcaattctcctgcttcagcctcccaagtggctgggattacaggcatgcacccccatgcccagctaacttttgtatttttagtagagacagggtttcaccatattggccagactggtctcgaactcctgacctcaagtgatctgcccacctcagctcccaacgtgctaggattacaggagtgagctatcacgccccgctcgaaaagtatgtgtattttttactactatataattcatccatgtaaccaaaaaccacttgtaccccaaatgctactgacatttttttaaagtagtagatatgtaggatgaacaagtctagagatctaatatataacatcatgaggagtatagttaacaaaattgtgtattaaaagtatctgcaaaactgagtagatttttgctgttacacaaaaaaatggataattatgtaagatgatggctatgttaatttgcttaactatagtaactgttttattatttatatgtatcccataacattatgtttaatatattaaatatacccaataaattgatttttaaaaatgaaaagtatgtgtattctgctttgttgggtgaagtgttctataaatgtcaattagatcctgaaggttcatgatgtttttgagttcttctgtatccttgctgattttctgataagttctatcagttggtaagagacgggtattgaactctctaactgtgtaatagtgaatttctctgtaagtttcatcagtttttgctttacatatttggaagctctgttgtttggttcatacacatatgattactaagacttcttagaggattggccctcttatcattgtaaatatcctcctctgtctatggtaattttctttgttctgaagtctactttgtctgataataatatatctactccctactcccttttgttaaatgttgcatggtatattttttcccatcttttaactcttaacttgcctatatcattacttttgaagtgactttcatacagacaacatatagttgagtcgtgtttttaattccttctaccaatttttaattggtatgtataggccatttacatgtactataattattgtattgctgtattagggcttaagtgtgtcattttttaaattatggttttcatttctttcttttccatttctgccttcctattggttatgtgaacattttttagaattccattttgatttgtctatagtgtttttgagagtatctttttgtatagcttttacggtcactctagatatcatatacagtatacatctcttatcacagtctactggcattgctattttaccagtttgagtgaagtctaaaaattgttcctccctgtatgtcccttaacccttccccatttgtaatgtaattgtcttgactatttcctctacatatatttagagccatatcagacagggttataatttttgcttcagctttcaaacataattaagaaaactgaaggtaagaaggaaagcctattatatttacccatatttttgcttttatttgttgttttttacttcccgaggttccaagattccttcttttatactttcctttctgttttaataatttccttcagccatttttttttttttttttttttttttgagacggagtctcgctgtgtcgcccaggctggagtgcagtggcgcgatctcggctcactgcaagctccgcctccggggtacacgccattcgcctgcctcagcctcccgagtagctgggactacttttacggtagtctattggcaacagattttctgagctttccatcatctctcaatgccttgatttcctctcttttttctggaggatattttcgttagctgtgagttgacagttcttttctttcagcacttgaaaagtattgggctacttctttcttgctttcctgctttctgatgagaaatcctctgtcatttaaatagtcttttctctcttggttagatgctatttttctcttactgctttcaagtttttttctttgcctttggttttcagaagtttaattattatgtgtctttgtaaatttctttgtgcttatcctttttgggttcgctctgcttcttgagtatgttcatttatgcctctttggcataaatttggaacattttcacctatttttctatcagctattatttactttttagcgctaccctctttctcttcttgtctctgatgacacgaaagttaagtccttggttatagtccaacaggacctgatgctctgttaattttttttcagtctatttttccctgttgtttggattggataatttctatgattctatcatccagttcactgattcttatttctgtactctccctctattctactactgggtccttctaccaacctttgcatttcatctattacaaatttttcattctaaaatttttgcttggttctttataacttccgtttctttaccaataattaattagtttctttctttctttctttctttctttctttctttctttctttctttctttctttctttcttctctttttttgtgctgaggcgggttttttcatttgtttgaagtgtgttaataattgtttgttgatgaatttgttttacatgaatgctttaaaatctttgtaatttttaaactgaaacctagatattctcatactatgttatgagactctggatctgatttaaaccttttgctttggctggctttatttgacattgttctggtggaggggggggaggtgctgcctttttactgcagaatgggagtaggacttcagtttccatacttggtctcagtggacacctgaaatgagggtctccaagttactgctaggtggagtggggattcctgcccccgacatggtttctgctggcaaggtgaggatggagtttattaactgctggcagggatgaaaaacctggcttcgagtttggtcttcttttataccaccctggcgagggtgttgggatgccttattatagcctcacaagggtgggtgtctaggctctcctggtgtttgctagcatgagtgcagataggaccacagatttttctgtggtggttggttatagttggagtggttattgtctaaaagttttctgacttgcttggctgccccctcccttgccctttgtctaaaaaaagcagacttttttgttagggctttttgaaaaatttatacccattggcatttctgggttgccagcctgttcaactccaagcctgggaaatatgaggcaaaaagaaaacctagggaactcaccaccatattgttcctttggttttggaatccctagccagtttgccttcttctctctacctttcagaatcttcttaggtttatttattttttatcttattttacttttttctctttttttaagcaatagagccagggtctcattatgttgctcaggctggttttgaactcctgagctcaagtgatcctcccacctcagcctcccaaagtcctaggattacaggtgtgagccaccactcctgggcttcttacgtctattttatatgtaacgtcctggggttttagttgtatctagggggaagaagagggagaagtacagctactccatctgccctgaaatggaagtccttaagattttaattaattagagacatggtctcactctgttgcccaggctggagtacagtggcacaatcacagcttactgcagcctcaaactcctgggctcaagtgattgtcccgtctcggcctctggagtagctaggactgcaggcacatgccgccatgcctggctaatatttttcttttaagacagggtcttgctatgttgcccagggtggtcttgaactcctggcctcaaatgatcctccctctttgtcctcccaatgcactgggattacaggcatgagccaccacacctagcctaagattttagttattatgttgtcaaaactttcattttttaggggttctctcacagcttattcatataggcctttccatctcaacattcttatttttttggttattttgtgttttatatttttaagaatcttaatttttccccctaagagattagtgaattgaaccattgtgttttgttaaatagacatcctttctctattaattgaagttgctgccttcctgatacaccaaattattgtttgacttggcttgactctgcttctaggctttctattctgttctgttgatctctttttcttgttctagtactaccatttttgttactgtagcatgccccccctatcttgtagtgtaaggtcactacctctattcttttaaaaaaaactgctattttctatgtcctactatttattaagatagttggcattttcttaagttcttaaacgtaaaggaattaaggctgattttgggatccttatagcactagatggaggaaattgtgatattgaacccttcttctagttcagtagttctcagctggagacagttggccccaccatgggggaattttggccaaatctggagacatttttggttgtcaagactagggagatgctactggcatcagagcccagggatgctgctgaacatcctacagtgcatagttcagtcccccacagcaaagaattatttggtaatgtcgaacaactctgatcttgtcctttaattaggaagctaaggtttttgtctcttaaatccttttctaagattcatttaacttaaaagcaaatcatattaagtggtatttgctcccctagttacctttaggtatgtgatttaaggtcaggcgcctgaaattatgccagtatctgggacaaatgatcaagatttttaaatacgggcataaatcaagtgtaaatttaattagagatagtaaagaggtttcagtaatatgaccagttacaaaataaataatacaaaaatcaatagctttcccatgtttaagcaatagcagttgggaaatataatggagaaaggtctaattaacaatttcagccaaaagtatgagatgcataggagtaaacttttaaaaatatgcatgacttagatgaagcaaaccacaacattttactgatgaatgtaaaagaggatgtgaataaatgaaaagacccactgaatgctcagaccctataagataaagatgtcatttatctttgaattaatctatacatttcatgcaattctcgtaaaaccataatgggaatctttgggggaaggaaaggaaggaaggacttgacaagattttaaagtttatatgggggaataaatgcatgagacaagccacctctatttttttttttaggaaagtaatgagaacttgcaagaaaatatgtgaaaattattataaatttattcttttcctgtaaatttaaaatattatgtaacataaaaataaaataattctagtgctatggaacagggatagaaagaaaaatcagtgaaatattttgaagtacagtgcagaaacaaacctgtgcttgtgaaggtgacatttcaaatttgtgagatagagaaaagagtagtgaataaatgaattgcagtagctggctaaccagttattgtgggtaaggggatgaattttgcctaaaaagattaactgaaaaaaatccttggttacttaaggtagaaagtaaaaccatagccaggtgcatggctcatgcctgtaatcccagcactttgggagggcgaggtgggtggatcacttgaggtcaggagttcaagaccagcctggccaacatggtgaaacctcgtcactacagaaaaaaaaaaaaaagttgggcgttgtgatgcatgcctgtagtcccagctactagggaggctgaggcaggagaatcacttgaacccaggaggcggaggttgcagtaagccgagatcgtgccactgcaccactccaactgggtgacaaagcgagactccacctcaaaaaaaaaaaaaaaaaaagcgaaaccataaatttttttaaagcataggtgaatatgaaaatatgtaaataatatttctggagttgaggagataagcatttctataggagtttaaaataacatagtcaaatgattcaaaaataaaactataaatagcataaataggtatattattccccatctgcatctttattacccctgcccctttcccatactcagttaaccactgtaattgcgtatgtctttccagagcttcttcatgagtttgttgagaaataaaaatacatattagtcctctgccttttttgatataaatggtatactctagacactattctgtaccttgctttttaacttgtattctgtaccttacttaaaaactttatgtgcttattttacacatttggaatgttttcacattagtcagtacatagagaacttcagtatgtttttcctcagtattttttataggatcgtagtattccatgctctggatgtgctataatttatatatccagtcccttgctgatggccatttgggttgtttacataatcctttactaatacaaacagtgatgcaatggatatcattttacatgtcattttacaggtattcaagtatatttttgtggctaaatttccagaaaaagtattgcgggttcaaaagatagatgcatttgtaatttttaaaacattgaccagttgtttcccatagttgtaccaatttatccccccatttggaatctgtgaggctgcctgcttctttatagtgtccttaacagagtgtgtttagtttttgacttattgtcattcgttaaatgaaattattctcaatgtagttataatttgcaattttctcttaaaaatgaggttgaacaccttttcatatgtttaagagaaaagtctttttaaacatgatatgaagacatagactattatatagagacatagacagagagaaaaaatgatggaaagatttgactacataaaaataaaataaaaactgaatggcaaactggggtagaggaattattgcaacatatgacaaaataaatagccttgatatacacttttattaaaaatcagtaatagtgttggtaggagtataaattgtctcaatttctatggaaaacaatatggagatttctcagagaattaaaaatagaaccaccttttgacttagcaattccacgctgggtatctatacaaaggaaaagaaaccagtatataaaaaagacacttgcacttacatgtttattgcagcactgttcacaatggcaaagtcatgaaatcaacctcaatgtccataagtggttgattggactatgcagccataaaaagaatgaaatcatatcgtttgtgatatcatggatggagccagaggcctaagtgaagtaactcagaaacagacaatcaaatattgcatgttctcatgtataagtgggagctaaacggtaggtacacatggacattaaaatgaaaataataaacactagggactccaaaaggagagagttgggggtaggggtaaaggttgaaaaattacctattgggtactgtgttcactatttgggtgatgggtacactagaagcccaacccccactattatgcaatatatctatgtaactttaaaataaaatttaaaaatatcagtaataagacagtattctttgatgtgaaaatgggcagatgacatgaataggcaatttcaaatgaaaaaattgaagtagcaatgaaacccatattaaaaattcaacctctcagataggtaatgaattgtaaatataaatgcctttgctatacaattggttatttcttttcttttcttttttttttttgagatggagtcttgctttgttgccaggctggagtgcggtggtacgatctcggctcagtgcaacctccgcctcctggtttcaagcgattctcctgcctcagccttctgagtagctgggactgcaagggtgtactaccacacccagctcattttttttttatttttagtagagacggggtttcaccatgttggccaggatggtctctatctcttgacctgtatcctcctgcctcagcctcccaaagtacaattggttatttctttaaaagtgtacatatggttcttctcctaaatgaaacatagggatattgcactgtgtaaattttaagtagcttttgtatgtggtaaagtttccaattccttccccacatctcctttctgtttctttcacccccagaggacctagatgttttggatagcagaatcttacatcatttgtcaccatgacagttgaatgcaggcaataataggtgcaagtacagttacttattaagcacctttttccttttaaaggtgaaatagaatatctgtaattatgtgttagagtctagaaaaagttggttcaattcagcagaaacatttattgaacaattactattatgtgccatgtgcattgatctgcagtgaggatgaaaagatatgaactttgctttcaagtaactctatcttatttgtgtcactatgcattaatttatccttatagttttctttttaaagaggcaggtaatctgttttctgaaaatttattccagaccttcatttattctttacatactgtacagccatttaaaatgtacagttcagtggttcacagagctatgcaaccattacaacaggccgtattagaatattttcatcatccccaaaagaaactctctactcattagcagtcattgcccattcctccttttccccagtctttggcaaccactaatctacattttgtctctgtaatggaatcatatattttttataaatggaataatatattattcagtcttttgtgactagcttctttcacttagcatgctgtcaaagctcattcatatggtagcgtggtacttttccttttatggcaagtacaattttattgcttggatatgctgtattttattcatccattcatcagttaataggcatttggattgtttctaccttttgtctattttgaataatactgctatgaatattcacatatatgtttttgtgtggatatatgtttcatctctttttggcatatatatgtatccctaagagtaaaattgctggatcatacggtaacactatgttagcgcattgaggaaatgccagacagttttccaaagaggtacagaattttacatttccaacaggatcctcatcaacacttgatctatctttttgattatagccatcctaatgggtataatgtagtatctcattgtggctttgatttgcaattccctaatgactgaggatagtgagcatgttttcatgtgctttgttggccatttgtatcagcaattttgtatctttctgaccattctcttgcagtcacatctgcctctgaccacatcctggaaaggttctctgctttaagggattggggtcattaaattttctcacttggataattcaggataatctcaaggtttttaaccttaatcccatctgtaaaatcccttttatcaagtaaggcgatatgttcacaagttctgggtattaggccatctttggggactggttttctgtctatcacaccatcttaacaatattaagtcttttgatctataaacatgagatcctttagaacatctttaatttcttccaatgatgtttcatatttttgtgtacattatgtaatttaaaaattgtccttaagtatttccttttgagcaatcataaatggaattatattcttaatttctttcattttgtattgttcattgttataatagagaaatgtaattatttttatatattaatcttgtatcctgcaaccttacaaaacttgtttattgttctagtagattttttttatttcttagaattttctgtattcgtgatcatgtcatctatgaatagagagttttacttctttcttttcaatccacatgtgttttatttctttttcctgcctattgtcctggctagaattttcaatgtattgttgaatcgaagtggctagagcagacatccttgttttgtttctgatggtagtgggaaagtatttagtctttctccattaagtgtgatgttactgtagattattcattagtgccctttatcctgtttaggaagctcccttctcttcctaatttgttgagtgtttctgccatgaaagggtattggattttatcaaatgcttttactgcttctattgagatgataatgtgttttttttaataatagcataattgaggtataattcacatatcttaaaattcactgttttaagtatacaatccagtggtttttaatatagtcacagagtgtacaactatcaccactatgtaatttgagaacattttcatcgcccccccgacaaaaaaaaaaaccctatacccattggcagtcactccccattacccattcctcccagcccctgggaatcattaatatactttctgtccatgaatttgtctattctggacatttcatataaatagaatttcacaatatgaagctttttgttttgtttttttggtctggcttcttacatttagcataatgttttcaagattcatccatgttgtagcgtacatcagtacttaattcttccgatttcaggacggaccttttcagctttctttttccctggttatctctgataaactatccgacttacaccctaaattgttattctcataaagctccctgcctcctcttaattgtttacctcccaaatctccattttttatagtaatgttttgggcttgaatgtcctcacactctgtttcaaataaagtcagttatttggggaatggcttgggagctctctgttcttatgaatggcctttatccctgggcagaatcgttcagccagtgctttgggtactgagcagtagcagtagccactggtcttcttgcttacctcttcaggtgtggaccttaaccctgcaagtaaactggggtggaataatcagggtgagggtgattggggcctcagtattctcagccttctctacttggggtagagtctccaccctgtgagtaaaggaagggagcccctgaactcttggctatactgaacaggaatttcaccccttcaactctgtgttggaagtgataagaaatgctggctacctttccctcccattgggatactctattccttgattgggagctggggtcagagggagtaaagttttggctacccctccctagagagtagcttccatcaaggtagacaaggggacggtgaaaggaaaggagtgccttgtggctcatatgccattgactgtcactgttacattactgagttttagtagattttcttgaataaatgtttcttcatttgctctggggtcttaaaacaatttccagccatttccgatttaaagaaaaaaaagtaactttttgctggaactttttgctggttatggatttacttgggaacaggtccatgggactttttatgctgcagttctggaagtggatcccccctcttaggacttctttttcagtaaagtagaatttctttgttatgatggtgctagaagactgactatactaaagtagtaccaatgaactgttttttaaatcaagcttttactctgtcttattgattaggtttcaggatacctgcttttccttgctttgtttttatttctccatattaatgaaccttgtcataatgttgttttacttttaaaaattatttttagtgacatatttttctgtttgttactttgatttttaggtttggctccagcagctgctgttgccaccaccactagttcaagcaccatgcagtttacctcaatatcaaattctttgacctccactgctgctattgggctctcatgtaagttactaattctaaagaaaatactgttatttcccatgatgccaccttactcagtttgccagtatatgctacagatctctgtctcagaaattatcattattcttgaacccatttataattgctgatatcaatagtagctttgcttaagaacctaattctcatggctttagctgtgaattttttatattaacatggttattatagcttaaaatgctaactttaagcatataattcattaatattgtgatgcattgaaacaactccttgaagctattaacagaagggagagtgggagttttgccaagtatttctgaagggaagaagtccttatccatgtgactaagataaaatgggaaataaatgtaggagccttgctatagtgtgttttctgataccgacctggtttgtggtccttacattttacctatcagaagtggaacatgacaaagggccagctgtagttttggggttctaattgacattgtgtaatgtcttgtgacctctccacctgaagaggaccatctatctggatgctttgagctaagaggtgagacattatctcgtaaccccaacttctttgttacacattttccattagtatagtaatagcaaatgttgacaatattgaattcaggccaggctcagtggcttatgcctgtaatcctagcattttgggaggccatggcaggtggattgcttgagcccaggagtttgagaacagcctgggcaatgtggtgaaaccctgtctctacaaaaaaatacaaaaatttgccggacatagtggtgcatgcctgtagtcccagctactggggaggcttaggtgggaggattgcttgagcccaggaggtcaaggctgcagtgagccaagattgcaccactgcactccagcctgggtgacggagtaacaccctgtcaaaccaaaaaaaaaaaaaaggaaaggaagaaagaaagagagagagggggagagagagggagggagggagagagagagaaagggagggagggagagagagagagggagggagggagggagagagagagagagagaaagaaagaaaaaaaagaaaagaaaatactgaattttgtatgtcttaggcaattttttcttacaggcctctataaactgacttctttcaaggtttcttcttcacaatatcataatgttcatcattaaattttgttgtaatcctagctgtaatagcccccctccccagctctatgacagtaagattgtctccattcctgggaatacaactagccagaaaatgtttgatgcttaattgagcatgaatagtgctcaattaaccatcaccatcctcttgtgttattggcatagttaggcattagttaagattggttaccacatgaattatgttttctaccacttagacttcaattttgagacatgactatgattctggaatcattttgatatatgtaagcagtatccttctcaactgtgatagatttcatgaatatgaccatgtccaaggtttggagttaaaattattgaattaattccatgttcagtcaaaacttgctctctgacctttgacaggttcccccacttttctccctctgatgtccttgtctacaaaatgaaaagatattgggaccacaatatcttttaattaactttaatgaattataacttacacatcataaaattaactcactttaagtatgcaatccagaaattttagtaagtttatcgaattgtgtaaccatcactgtatttagttttagagcatttccatcattgcagtaagatccctcagccacagacaaccactaatctgttttccatctccatatatttgccttttctggacatttcatgtaaatggtttgaccatggttttttgaagtttaaccaaaagtttctaaaggactcttcagatgaaaaagactatataaatttctcactgtttttgatttaaagggtaatagttaatattatgttgttctctgcagttggtgctccaacaacttcggctagaacacttgatattataaccttgggatttgcattaaaattccctggagcaggtggagcagctcctactgcagttagtaagattttagaattatcaggatgtcttgggggtctcattggaaatgtgcttcataacaagcagtaagtaggttctatggcttttagggctaagtggttttgaccatctcatcagagtatccaaaaggtacaccaatatgtttatgtagatgattgccaaagagtacaatgagacagttgatatcaatgatgctacttctttgagatgactacaggcaaaacagctgccaaattcttgccaaccatcaaacttaagaattttcgttattgatcacagtatttagctggttgagactgataaagttttttttttctctaaaagttaatttaagttttgacctctattgaagttggccctcttctaaagttggttataggagtttccctagacctattctaaatttgtttctgccagttaggagctagttaggctgtagatggaagaaaacttggttatccattgcccgtagctattagagctgggtggtaaggggtcatctactcaaacctgtcttttaagttagactccattttggagaagtcttgtttgtttttactgtaagaagtttacttagggattaaatgaatctgttttaatctggcttaaactaaaagtcaatcccgtttaagcttaaaataattattcctaaacagacatgtatatcatccctccctttttttttaagatacagtcttactttgtcacccaggttagagtgcagtggcgtgattatagctgactgcagcctaatctcctggattcaagtgatcctcccacctcagccttctgagtacctgggactgcaggcatgcaccaccatgaccaactgatttttttttttttttttttagtagagatgaggtctcactacattgtccaggctggtctcaaactcctgggctcaagctatcctcccaccttggcctcccaaagtgctcagcttgtaggcttgaggcaccacacctggcctcatctttttatttcttcttttacatgaccttatgagtttctactgtttagtagactaactggccaatgtatgagacttgtgaagggtgtgtcataagaacattacaagttaccatatttgcaaaaaatgtaacacatttccccataaaacaatgaccaaaaaaaaaccctgattcttttagtcatgggttgaatcactgaaatatgaatgggcagcctctttgatgatgctgtcatacccagcccttatctatataagtctcaaattccttcctacaaatactacttttgccactagcccatcccttagcaccatgatatggtttggctatgtcctcacccaaatctcatcttgaattgtacctcccataattcccatgtgttgtgggagagacctggtgagaggtaactgaatcatggggacaggtctttctcatattgttcttgtgatagtgaataagtctcacaagatatgatggttttataaaagggagttcccttacacaagctctcttgcctgtcaccatgtaagatgtgactttgctcctcattcactttttgtcatgattttgaggcctccccagccatgtgaaactgtgagtcaattaaacctctttcctttataaactatccagcctcaggtatgtctttattagcagcatgagaacagactaatacacaccatttcacccaccaggaccttaagcacttacccttctccccattaggtatgtctcaacctgacagccccaatttggggtgttttcttccccctacttacctttctttctcttcaagtgtatttacttattcagattcttcatctcactaaccagtcttgcagagcagctttcaagcatctgtatctgtagatttacagccatttgggattactgtctgccctagatataatcagcaaattttaagagaaatttgatttttatagtttgggaaggtgatgatgtccatttccagcatggattgagatgtatagttgttgatcagggacaggataggaaaatttgatagtagaatattttaaaggctattttcattattttttaaatgtgagttcaaatttagtgtgtagttttttgtattatttttagaaccatacttcccttttactacacagatattgtaggattgactgtattaactggttaagaccaaagttgtaatttgcaaaatcagactgtgatagaactttcaaacccattcctttatttggtattaattgaaatattatttgaatatgccagagttaatttatgcctttaaaaatagcatgaaagataacaaaaataaaactgtacaaaaagttaaaataggccgggtgtggcggctcatgcctgtaatcctagcactttgggaggccgaggcaggtggatcacgaggtcaggagatcaagaccatcctggctaacacagtgaaaccccgtctgtactaaaaatacaaaaaattagccaggcgtggtggcacatgcctgtagtcccagctactcgggaggctgaggcaggagaatcacttgaacccaggtggtggaggttgcagtgagccaagattgtgccactgcactctagcctgggtgacagagcgagactccatctcaaaaaaaaaaaaaaaaagttaaaataatcataccattttaaaatgactcaggattcctttatgtttgggctgcttataggtaaaaacaattcgtacatgcatatatacatatcactccctctagagagaacagtttatctttttagacatttttctaagcatatacatacattaaatttgttttataaaaatggtaccatactctgtgtgtgtgtgtgtgtacacattcttagaatttgctgtttcctcttaagtacacatcttttttttttttctttttcttttattttttttgagacagaatctcgctctgtcgctcacttagcctcctgggtagctgggattacaggtgtgcaccacatctggctgatttttgtatttttagtagagatggggtttcaccatgttggccaggctcgtctcaaactcctgacctccagtgatatacctgcctcggcctcccaaagtgctgggattacaggtgtgagccaccatgcctagccaattatatatctttgaatatctatccatgttaggaagtacagattactttattagaaaaccatctttgggtgaagatattctcctttacaagaagggctcatttttttaaaaaaaaaatttctttctgtcttgaatgcagtagttactcagtgtttggttgaattaatcaataaagggagtctattggcattatcattaatttttagcatttgtgaggaaggttttcctttcaggtaagatttttgttctcagatgaataaaatgatgacttatggttgtaaagaatatcacacaagatccaatctgtaatctctccactgttctaaccatagtgactcctgggcttctttgtgattgggcatggtcttcctctgtggtgcacattttaccctcacaagggctaacataaagaatggggaattatcataagaacctttgtggccaaaaaggaaatggagtcttgtggaattcaagtaaagtcattgccacgacactgttaccttaaggaaattggaacttaagattattcttaaggcagctttagggacctcccaaatcaaacattgcatatacataattcggttattctccctttgtctacttttttctttttttaaatttctcattggtttccttacctctttctctgccttcctgctgtaccttattcttaattgtgacttgctcatggtcccttacttctacttcatctccttcttctgtcagtcctatcaagtctttttgcctatagttggattccttctatacttttggaaatatttcccagtatctgcctagagtcagatttttccgtattgctaaatttttgaaaatgaaattctgactcatattaatcctgtttcactagagctttttgtgccagaccctcaggtaggctgctagtagtacattggatggcttcccatccttcagttggccatcctgcccagtcaactttgaaccaggaacaaaaaggacagagttatctggaacaaagaatgggtatttgagcttgttccctcagcaggaatgttccctcaggccagcctccctcagagtagtcagtgcttgcagcaggcaccatggtttatgcatttatccagtgtggccattaacctgaaactattgctaattgggaaagcaaagctaacataaaacaaacaatcatgtacgttatattttcataacatatttcttgttacagaagcagcatttactagttgtaagaacatttgaaaatgcagagaaccaaaaagaagaaaataaaaccttcccaatgccctagcagccacaattttctgtgccttgttcattaagtgctcagtgtgtagtaagaaccaaaagtgctgcagaaatttagaaaaccaaaggaaactatgagtaggagagaagtgggtgataaatatggggaacaaagaatttgagtcaagccatgaagtatacttaggattttatctatagagagcaggacattctaataggggtgtaacagaaaaagacatataggagagagtctgggctgtagataaagctttgagaggcttttgactagggtttgcaaaaatgcatgcctagtattggctgtggtataaagaaataggcactctttcctattgatagggacataaattggcaaaattgtttagatagggcaatttggcaagttatgttaaaatttagagcatgctgacactttgatctagaaattttatttctaggaattaattacacagatacagtcatgtaaatatgcaaagatatagatgtacagagatcttttgtaaattgcaattattcttttcttgaaagtttcataaaacttaccagcagtggcatctgggactggagtttcctttatgagaagaattttgaggattgatttgatttctttcatggttattgggctggttagaagttttatttttctatgaatttatccaggattttcagctggaaagttaatccaggtacctggcctgccatttattatttcatattacaacagtgttgaattcaaatctgcatctttgagttcaaatttgtatttttaaaaatgcctccataattttaaatctgaatgatcaaggcttaaatgaaacaaatttctcatttcttactaacattatacactttattttccagttacaacttcaacgactaccaccgccactttcaccaccaacactactaccacaatcaccagtggctttactgtgaaccaaaaccaactgttatcaagagggtttgaaaaccttgtaccttatacttcaactgttaggtaagcctatttatttaaaaacttgcatgtgtttcattttatttatcatgtacaagacatttgcttggataactttagaataatatttgaaagttagctaaatgactgagttgagggaacagtcaagagaaagatttctgtagcttaggaagttgaataaacagcagcacacctttaccttctgaatatcattataatagaatcattactattactaataatagctaccacttattgtgcaattactgtgtatgtaatctgtgtatgtttagcaagatgacaatgcattacaagcatcatgtcatttatcctcacagtaaccctatgaggtaggcagtattttcattttcattttataggtgagaaaacaagagcatatagagattttataatctgctcatagtcgcatacttgttaatggttgagccaggattaaaattcagacagtcaagctctggagcctgtatatgatgtttctctctagtatttgttcattttttaaattaagctttttattttgggataattgtagagtcacatgtatatgtaagaaataatacacaacattctgtatggtctttatatcatttcctccaatgataacatctcaacagtactacagtataatatcacaaccaagatattgatattgctacagtcaaaatacagaacagttttatcactacaaggattcctcctgttacccttgtatagccacacccactcccctcctttccttgaccctgagcaacaattaatgttctctatttctataatcttgacatttcaagagtgttgtacagatagagtcatatatatgtgacctttggggattggatttttttattcagcataattccttgtgatccacccaagttgtcgtgtgcatcaacagtttgttcttttttatttctgagtagtattccatggtattgtggatgcaccatggtttgtttaaccattcacctgttgatggacatataggttgtttccagttttttggatattatgaaaaaagctggtgtgaacattgatgtacatgtttattatgaatataagtatttctgtgggataaatgcctaggagtgcagttgtcgggtggtatggtggttacatgttttttgtttgttttgttttttaagaaactgtcaaattcttttccagagtactgtgccattttacatgcccactagcaatgtatgggtgatccagattgtctgcattcttgccaggatttggtgttgtcactactttttatttgagcccttctgacagatgtgaagtgatatctcattatggttttaatttgcatttccctgatgactaatgatgttgaacgtcttttcacatgtttatttgccatcagtagatcctctttggtgaaatgtctgttcatatcttttgtccattttctacttggattatttgatttttttactgtttggttttcagagtttgttatgtactctagatgccagtcttttgtcagatatgtggctcataagtatattctttaactgtgtaacttggcttttcatcctcttaacagggtccttttgctgtatcaaaacctttaattaatgagttacagtttatcacattttcttttaatgaattgtgcttttagtgtcaattataagaaatcttttcttagccctagatcccaaagattttctttttcttctgtgtttttctaaaagttttatagtttcacattttacatttgagcttgtgatccaactggagtcaatttttatataaggtgtgaggtttaggtcaagattaatttttttttgtctgtggatgtcgagtttttccaacatcatttattgaaagactatcttcccccctgaattgcttttgcacctttgtcaaaaatcaatttgtgtcaaatgctttttcagcctcaattgatagtcttaagattttgtttctttatcttggtgaagtggtagattacactgattgattttcagatgttcaaccagccctgcatatgtggaataaatcccacttgatcatggtgtataattttttggtacatttttaaaaatttggtttcctggtattttgtttgaggacttttgtatctaagttcatgagagatattagtctgtagttttcgtctttttttatgtctctagttttgatatcagggtaacattggctctataaaatgatctggaaagtattctgttttctgttttctaaaagaaatagtgtaaaattaatgttaattcataaaatgttggcagaattctctagcgaaaacttctcggcctgtatctttcttttaaaggggtatttatttattaattaatttattattattatttttttttttgagacagagtctcactgtgacgcccaggctagagtgcagtgtcaagatcttagctcactgcatcctccacctcccaggttcaagtgattctcctgcctcagccgaggcctcctgagtagctgggattacaagctcccgccaccacgtccagctaatctttgttttttgtttttttgttttgtttgtttgtttgtttgtttgtttgagacggagtctcgctctgtcgcccaggctggagtgcagtggcacgatctcggctcactgcaagctccgcctcccaggttcacgccattctcctgcctcagcctcctgagtagctgggactgcaggcacccgccaccacgcccagttaatttttttgtatttttagtagagacggggtttcaccgtgttagccaggctggtctcgaactcctgacttcgtgatcctcccgtctgggcctcccaaagtgctgggattacaggcgtgagccactgcgcccagctaaaggggcttttaggctaaaggggcttttaaattacaaatcaatttctttagtggttctagaactattcaggttatctagttcatctttgatgaatgtattgtttttaaagagttggcccattttttatattgttaaaaataaagtagttcatagtattccattattgtccttttaatggctgtagggatattcctgtttcatttctgatgttagtggtttgtgtctttcttttatcaattttatcgatcgcttcccaaagagccagcttttgtttaattaatcattttctattcttttcatgttttcaatttcacttgatatctactctattatttccttccttctgattgcactgagttcattttgctctttttctagttcgttgaggtatgaactcagactattgatttgagatttttcctattttttaacgtacacatttagtgctataaatacccaactcaacacttccttaactgtgacctacatattatgttatattgtgatttcattcagctctatatacttcttaaatttcctttgtgaatccttctttgactaatttattatttagaagtgtgttgtttaatttccaagtgtttggagattttcttgttgttttttctgtattgatcgctactttgatcccattgtggtattagaatatgctttgtacgattttagttcttttaaatttatttaggtttgttttgtgggtgaggatacagtctgtcttgatgaatgttccatggacatttgaaaattgtgttttctgctgcagggtggaatgttctatatatgttaattaaattctgttgcttcactgtaatttcagatactgtgttattggagtctttctgtctagtagttctttcagttgtggagagtggctttttgaaatctccgcctttaattgtggatttctctatttctccctttagctctatcagtttttatttcatgtattttgaggctttcttgtttggtcacctatacatttaggattgctagccttctggatgccttgattcctttatcactctgtaatgtctctctttggttctagtaattttctttgttctgtagtccactttatctgatattaatatagccatttctttttaaaaaaatgaaccttgcatggtacattctttccattcttttactttcaaactatgtattaatatatccttgtatttgaagtgaatttcttatagacggtatattgttggatcattttttattcactcttccactctctgtattttaattggtatgtttagcacatttatatttaaggtaactattcacatgttagagcttaaatctgccattttatttgtttgttgcctctgatttttgttcttctctttcttttttttaccctgctgtcagttgtttgagtattttgggggggtttcatcttgttctgtttatagtgtttttaaatacattattttgtatagttttattactggttgctctaggtattacagatacatgcattacttacaacagtgtagtcataccactacagtgtttgggtgaagtgcagaaaccttaattccatttagttccttttacccttcttagcttttaagtatggttgtctcagccatttcttctgtgtacattgaatatcacatcacatggggttataatttttacttcagccatcaaatgatctgagaaacgagaagtagaatagtatatttaccttgtctatacccattttgatattccttactttatatcaggggtcctcaacccctgggctgaagaccagtactgctctgtagcctgttaggaaccggaccacacagcaagaggtgagcagcaggtgagcgtgcattactgcctgagctccgcctcctgtcagatcagacattagattctcataggagcgtgaaccctatagtaaactacacatgcaagggatctaggttgtgcgctcctgatgagaatctaatgcctgatgatcctcccccaggcccctcccgccatctgtggaaaaattgtcttccacaaaaccagttcctggtgccaaaagggttggggatcgctgctttatatgatgttccaagtcttctgttttcatttcctttctgtttaatcttcaagggtaggtttactagcaacaaattatcttgaattgactttgtgtgagaatatctttatctcccccttcatttctgaaggacattttcaccagatacagaagtcattgttgacactttttttcattcagtgcttgaagcctgcatggttttagacgagaaatctggtgtcatctaaactgatactcccttttaagtaatgcatttttttctttctggttgctttcaagatttttttttctttgtctttagttttcagaagtttaattattttgtgtcttagcgtggatttgagttattctctttgggatttgtccagcttcttgaatctatgagtttatatcttttcacaaactttgagagttttcaatctttttttttaaatacgtttttcagtcccattctctctttcctctctttctggagctcttattatacaaatgttactgcttttattattgtcttccaagtccttgagacatttttcatttgtttctgcgaagtttttctttgttttctgtaaattatatttgtctgtcatcaagttttcttattctatcctctgttgactccattctgttatcaaattccttaggtgagcttgttatttcggttattttacatttcagttctatacgtttcatttggttgtttttcatactttctatttctttgctgagattttctgtttttttcatttgttttaagaaaatttgaaatggcttgtttgagcctttttttgatggtcgctttaaaattattttcagataattccaacatctgatacctctcagtgttggcatctgttgccttttctctttcaagttgtgggttttctcggttttgatatgataggtaatttttttttcattttttttaaattttttttattattattactattattattattattttttttaaattatactttaagttttagggtacatgtgcacattgtgcaggttagttacatatgtatacgtgtgccatgctggtgcgctgcacccactaactcatcatctagcattaggtatatctcccaatgctatccctcccccctccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttgatccagtctatcattgttggacatttgggttggttccaagtctttgctattgtgaataatgccgcaataaacatacgtgtgcatgtgtctttatagcagcgtgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttttcaatgattgccattctaactggtgtgagatgatatctcatagtggttttgatttgcatttctctgatggccagtgatgatgagcattttttcatgtgtctgttggctgcataaatgtcttcttttgagaagtgtctgttcatgtccctcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcccccactgtgcagaagctctttagtttaattagatcccatttgtcaattttggctttggttgccattgcttttggtgttttggacatgaagtccttgcccacgcctatgtcctgaatggtaatgcctaggtttccttctagggtttttatggttttaggtctaacgtttaaatctttaatccatcttgaattgatttttgtataaggtgtaaggaagggatccggtttcagctttctacatatggctagccagttttcccagcaccatttattaaataggaaatcctttccccattgcttgtttttctcagatttgtcaaagatcaggtagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttttcttttggcttaggattgacttggtgatgcgggctcttttttggttccatatgaactttaaagtcgttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataggaatacttgtgatttttgtacattgattttgtatcctgagactttgctgaagttgcttattagcttaaggagattttgggctgagacaatggggttttctagataaacaatcatgtcgtctgcaaacagggacaatttgacttcctcttttcctaattgaataccctttatttccttctcctgcctgattgccctggccagaacttccaacactatgttgaataggagcagtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtgatttttgtctttggctctgtttatatgctggattacatttattgatttgtgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactcttgattattgccacaatttcagctcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtatatttgattcttctctctttttttctttattagtcttgctagcggtctatcaattttgttgatcctttcaaaaaaccagctcctggattcactgattttttgaagggttttttgtgtctctatttccttcagttctgctctgattttagttatttcttgccttctgctagcttttgaatgtgtttgctcttgcttttctagttcttttaactgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagtaggttgttcagtttccatgtagttgagtggctttgagtgagattcttaatcctgagttctagtttgattgcgctgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaggtctctttgtaggtcactcaggacttgctttatgaatctgggtgctcctgtattggctgcatatatatttaggatagttagctcctcttgttgaattgatccctttaccattatgtaatggccttctttgtctcttttgatctttgttgatttaaagtctgttttatcagagactaggattgcaacccctgcctttttttgttttccatttgcttggtagatcttcctccatccttttattttgagcctatgtgtgtctctgcacatgagatgggtctcctgaatacagcacactgatgggtcttgactctttatccaatttgccagtctgtgtcttttaattggagaatttagtccatttacatttaaagttagtgttgttatgtgtgaatttgatcctgtcattatgatgttagctggtgattttgctcgttagttgatgcagtttcttcctagtcttgatggtctttacattttggcatgattttgcagcggctggtaccggttgttcctttccatgtttagcgcttccttcaggagctcttttagggcaggcctggtggtgacaaaatctctcagcacttgcttgtctgtaaagtattttatttctccttcacttatgaagcttagtttggctggatatgaaattctgggttgaaaattcttttctttaagaatgttgaatattggcccccactctcttctggcttgtagggtttctgctgagagatccgctgttagtctgatgggcttccctttgagggtaacctgacctttctctctggctgcccttaacattttttccttcatttcaactttggtgaatctgacaattatgtgtcttggagttgctcttcccgaggagtatctttgtggcgttctctgtatttcctgaatctgaacgttggcctgccttgctagattggggaagttctcctggataatatcctgcagagtgttttccaacttggttgcattctccccatcactttcaggtacaccaatcagacgtagatttggtcttttcacatcgtcccacatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcctctcagctcgtcaaaatcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcggggatcaggggtcagggacccacttgaggaggcagtctgcctgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttggagcttcccggctgctttgtttacctaatcaagcctgggcaatggcgggcgcccctcccccagcctggctgccgccttgcagtttgatctcagactgctgtgctagcaatcagcgagatgccgtgggcgtaggaccctccgagccaggtgtgggatatagtctcgtcgtgcgccgttttttaagccggtctgaaaagcgcaatattcgggtgggagtgacccgattttccaggtgcgtccgtcacccctttctttgactcggaaagggaactccctgaccccttgcgcttcccaggtgagggaatgcctcgccctgctttggcttgcgcacggtgcgcgcacccactggcctgcgcccactgtctggcactccctagtgagatgaacccggtacctcagatggaaatgcagaaatcacccgtcttctgtgtcgctcacgctgggagctgtagaccggagctgttcctatttggccatcttggctcctcccctatgataggtaatttttaaaattttatcttggacattttgtctattatgttaggaaagtctaggtcctattttcatatttttttttcatcaagcatctcttttttgacatgtagtacaaggggtgggtgtgtttgtatgttcagcttcccactggaccttacccacaccactccagcaaaagtggagcacttaccacgctgcctcaaggcagatgggtggtatggaaactgcttcccgcttagccccactgactcatccctcatgaaaggtgaacattgcatgctaccactttattgacagtaagtggagatgtaagctcagctcccagctgggccctggagcccccagatcagggggaagtggaggactgactcacactgcttagttgctgcacatggaggcagaatttcagcttcctgttggccccactgacacaaggggagggaagaagaagcataatgtcaactactttgtttcatatcacttcattcagcctccttggttggtatgaaggcttagctctctactgggcccagctgacacaggctcatgggagaagcgggacaaagtactgactaggcgctctttgccctacctcatttagtcttggctttgccagtggatgtggaggtcaagcttctcattgagcattgctgaccccatggatggcaggaagtgggatccctacaagccctaacttgaatcaccttgttcagttgtaatgatgctgggtgggtatagagattcagctccccactgggtctctctgacaccagaggcaagaggtgaagcctaatggtgactaaccctgcctcattctgcctcattgagccctgttgctactgggtagggatttaggttcaacttgtcattggatcccacagaaagaaccctggtggaggaattggaatcgtgcctgtgtcttccacttagggaattgatgattaccttcccactgagccgtgctgacactaccccagcagaggaatcaccattgactggctctgctggccaaaagatcagctagttgctgagccttttttgataccacttggcaggggaatcagagttctgcatggttctacccagtgaggaatgcccactctcttgtggatactactcaaacagggaatgggtcactttgactaagagctgggggagagagaatcctatctccttagctatgcctacccagaaaggagcttctctcatgctgagctgggatgaggggaagagaaggagcagattatggcacagactttagctattcttgctgtgatttagtaggtttcttaataaatctttatttactatattcacctaggataatttcaagtgactttgaggggttgttttttttaatcatctttaccagttatgtttgttttcttgggaagcaggtatgggaaattccttacatgctgttttcttctcagagtcctcctgtgttcgtttttaaaatctgatcacactttttaaagtatgattattggatcatcctgcatctttttatgttttagtgtagtagcaactcctgtgatgacatatggtcatctggagggtcttataaatgagtggaaccttgagctggaagatcaagagaagtactttcttctccaggccactcaggtcaatgcttgggaccatacattgattgagaatggtgagatggtaagaaaatattttcattaatctacctacattgtgcaagtatttgcagatgaacacaagaaaatagacctgtgttttgtggttttctttgttgttgttgttttgtttatgtttttgttttttgagacagggtcttgctctatcacctaggctggagcacagtggtgcaattacagctcactgcagcctcgatctccctggctcaagcaattctcccacctcagcctcctaagtagctgggaccacaggggcacaccagcacccccagctaactgtgtgtgtgttttttcagtagggatagggtcccactgcgttgtccagtctggtctcaaactcctaggctcaagtgatcctcctgcctcagcctcccaaagtgctgggattataggcatgagccaccatacccagccctgtggttaattttctattccaatattggtgagcagctcaaagtatattccttaggcaataagtaccctgaataaaaggaaatctttcatatttgaagtgtatttgagaaaattaatattgctctaaaattgttatataaattcaaatacttatattgttgtattcatatttctctttatagattcgtattttacatggagaagtgaacaaagtgaaactggatcagaaaaggtagaaccttagatttccttggttgaaagattaaagacctatctttttattcagtgttttttttttccttctgtagtttgttaactcttttctttttgtcactccaaattcctttcatcagcctttttattaacttattttattcagattggaacaagaattggattttatcctgtcacagcagcaggaactagaatttctgttgacttatttagaggagtctacgcgtgaccagagtggacttcattatctgcaggatgcagatgaggagcatgtggagatgtaagtaactgaaaaaagattgaagaatggggcaggacttacgtattctgagagcattccaggaacagaggggaaaagtcgaattggaaggcaaggaatacaaatcggtagaaagggacaagcttttgtagttgacatttatcaatttgtttgattgttttctggttatcttttctggatgcttgtaaatgaggaaatcattctggcaattttgttttatagcattttgtttactgttattactgtcaaccttatgcatgttcactgtaaagtttttgtatttgtcaaatttgttcttaaattagaagtacaaattttatgtgtatggtgtcatggtattgtgggatatttatggtctcctctttatgttgattctgctaaaactaatagtcatgcaattgctttagtgataaatcatttgctattttaaaggcaatttgttaatctggaggcaaactgtatagctttcaaaaatggagtgattttgtcaatgtcttaggagggctatattttatttgtgaactcttcagtctttaccttctgtcaatacagtgccagtattcccaaagtaactttatttctctggaactgaggtttggtaattggccaatttattaagtattagaatttgtatgaatgaacaacataatctagattgagactaaattggacacattttatcaatgacttattatgagttaagactgggcctgtttttaacatgcttgcaagttaacttttttgtaggcgcattaaatgtggtaagtacaactaatctatactaacctaaatcagtttctgcttttgtatttcaacctttgtgaatttttcttttctttgtattgctttctatgcattctatcatttttttgaaacatatagagttacatttttggccataagatcctaactgtagtttgaagaaatcttcatgacattagttcctttccagttgctcctttgtagtcatatatatatatatatctgaatatatatatatctgaatatatatatatatatctgaatatatatatatctgaatatatatatatatctgaatatatatatatatctgaatatatatatatatatctgaatatatatatatatatatatatatatctgaatatatatatatattcaagatgaagtcttgctctgtcgcccaggctggaatgcagtggcacgatctcggctcactgcaacctctgcctcctgggttcaagcgattcttctgcctcagcgtcctgagtagctgggattacaggcatgcgccaccacacccagctaattttttgtatttttagtagggaccgggtttcaccatgttggccaggctggtctcgaactcctgacttcatgatccactcccctcgggctcccaaagtgctgggattacaggcatgagccaccgcgcccggcccagatttgtattgtgatgaaatatttaccagaatcttcaataatgtaggcaaccaattctatggcataagtactatgccatagaaaggcagtagatagttgttacctacaaatctaattgactctttcaatctttatacacattaaggttgaaaaatcctctggccactttaattctcataaacatatttattgactgggtcgtgtgtgtgtgtgtgtgtgtgtgtgtgtgtggtttgggtggaaatctcgagaatttaggcaactaacttgtgaacttagcaggtttgtctatctttgattattgtgaagctcatttctcaaaacatcttttttgcctgatgaagtatatttatatgaggttttattttgaaaatttgtgtattcaagatcattgaagacatctcagcatctattgaatattgccaaaccctaaataacttctcttttgtatgtaaatgtgctataggtgtattttgacaccttaaaggattcctttgctctacagatccccagggtattcacctagaggataaataggtgaaggtaaaaaggcaaggtagataaaagtcttctcatttggagtctttttagaacatggtaataataacgtcacaaatgctgcatccatgaaaatatatcagtagtcataactgagctccactgaaaagacaggggaattagggcaaatccaattggtagtgtcatgtttatatatcaataacaataggtagtggagaaaacactttttgttaatccctttattttacttgccttttcagttacagattagcagaaagtatagatgctcagctgaaacaaatggcccaagatctcaaggacgttgttaatcacctgaatacatttgaaagttcttctgacactactgatccggtgtgtttactgctttgtgtacttaggcaaccaagatttagtatgaaattagcatacagccaggtatggtggctcatgcctataaccccagcacttcggtaggccgaggcaagagaactgttttaggccaagagtttgagaccagcctgggcaacatagtgagaccctgtctctatcaaaaatgaaaaaatctatctgggcatggtggtacatacctatagtcctacctactctggaggctgaggtgagaggatcacttgagcccaggagttgaaagctgcagtgagctatgcttgcaccactgtgctctagcctgggtgacagagtgagatcctgtctctagaaagaaattagcattctgtggttcttttaagctagtcccttttttccgtcttctatagtgtttcttcctgcctctagaaatatgaagccccttgggtgtggttagtggagcaggaaacatctagaggcagaaaaggttgtgagttttttgtggttattcccaggaaggtgaaaatattactcttccctaagttgtcatgcttttctcccttattcttcacataactaagtatgtacctgtatttatttttctgttcacttactagccagttcattcttctttttacatatttgtttacatacttatataagtgttagtaggtatgcttgtgtctgttcaacacaaccaggcaatccttaatttatggttagattgtattttaaaatttgttaggttgactatttgagactttacatttttctatagaaacttggtgaaatatggttattaggtttacacctgcccccacagaatactatttagctcataataaatgtattatatcagtggaattacagctgaggctccaattagagttaaggtgctgtgaattaatttggcagtaagaaagaattgttttttttttctttctctatactctgattaaacagcttatttcctgtacctttccctgttgtcttagcagctaaatggagtcctccttttcccgctcccactctgtggcagtagtagtaagagggatctcccattgtgggagttcccattgtgctttctatcagttaatcataatcaggagtgaggccaggatcgggtaggtgaagatgaatgacatatatgtaagtggtgattattctttagtaagctctttgttcaattatatacagacagttctttatctacatacacattaccattttttaaattatgaagatacagtgtgttatagctgagaaagtattagaattttgtttaagtcatttaatctctctgggtcttggctccttctttttgcaaaatgtcaaggatagactaaatgatctgtaggtcccttcccgctataaaaattatgccattctgtactttgggtgaatctaaagttgaacaaagacaaatataaattaatctgaaattattcatgctaccatgtccctgtgttcacacaaatgatcaagagtttacaaaatacagattttctcttaatgaaatattagattaccattgtaattccaaaattcaaaattgttttgttgtaatagaattttggtgcataggtaaatatatgcagatttagacattcagcagagttgatttctagtttctctgtgttgaattaatataagtggagtgttctcaatcaagtaactaaaaggagactataattctgtctttgtccattttctctacttagccctggattgttttattttattttagtagtgggtagtaaatggtttgagtctttttgttttcctggcaggggtgattgggatgtttaagatgagtcaattaaagggtaattgctgtttgattgcagaataaaagaagaaagagatcactgacagctctttttgcagatagcataaatccttggacaagaaacgggaaaaacattttctgaacaataatattcctgtagataatttattttaaccggattaacaaagctttattactctgggtcatatactagggtagaaaaataggagctatgtgttccagtattcacggtgatgagatttatctatttttattccccctttttttgtgagcggcaatgggaaagaccacctaatgtctaaaagttttattaagtaagttcatattatgcactgtgttattcagtcacattttcttacaaaatccataaggaaaattaagtcatctatattaacagtaccctgataatatactggtgtatttctttctagtcttttttgctatgctgctaaaaatacttcttttgtattaaagagtactggaaactatataactttttgtattctatcttcacttaatattctttcatggtctttcccaaaaattttaaccattctttgaaaacatgagttttaatggtactataatgtttcatcagggttgactttaccatgatctatttaatcattttttgattggtagagatattgtttccaatctttagccaatataaaatagtccagtaatcaccacttatatttagatttgattatctcctctggataacggaaatagaatatactgactgagtcaaaaggtatgaatattttaaagcttttgatatgtatcataaaaatttacattttgaaaggttgggtcaatttatattactattggctatatatgaatgtaactattttttcccacacactcgataactgagtaagaccatttttaaaaaattgctgatttggttgacaactggtgctatttttaatttttttatgtgaattcattgtcttgtgaaatgtgtcttaatgttctttatactgtggtagtcagtttcttattgaattgtaggtatccaattcatgatagttacaaataattaaattgaaccaatatataaagataatgaacattgcaaatatgaattagcaacaaaaaaattagtatttagtaattctcagtccatttcttaccagaagaaattaaaagtcacttcctaatgtcaatttcttatgtttattttttatttaccacctcagaataatcataatctaaaagtcttatatgtatttttagctccaccagatctgcagaattctgaatgcccatatggactccctgcagtggattgatcggaattcaggtgggagtttgcttgtatgccactctgtgtatttattgcaagtagaaaacgtgatacatgtcagttgtatgctccatgaccaaactcatataaaagctgttgtatgggtgttgcttaacgcacagtatgtgtattatagttctgaaaaactgtaattccttatttttttaaatgaagtacacatgggataaactagaaattaatgaaaatagaggatggataggaatggggcacatagaattgggatagaagcaagacttctatgaatatgcctttttacacagttttgacttgggggccatataaatgttttacataccaaaaaattagaattaagtcaaaaataatgagaaggaagacaaatactaaaattgaatacatactgaaactaaacaaacctacataactaatttataacaatcgcccagttcagataacttttgaacatagtgttcttgatgatgcatccttctaggaggtcatcttaaggatataaggaacatcagggaaattttaaactttctcttaataggtttattattagtttcagaattataataccagtattactaccatttcatatatattgagaaataaagtaaagcatattagtgataatagaagtcaagattttcattgaaagtcaaagagatacaagttatttttcctcttcttttctatttgcattataaatttgaatttaagatatgagtaatgaattcctgttcctttgttctatacacagaaatggcctagaagcaatgacagacatatcccagtggcaatgagcacacctagaacctagatcttggtttctaaatgccattcacactaaaaggaaccaagtcttcttggggaactgtctaatctcatgcctcaggctgggaaagtacagagtgagcttgagacttcttgtgcaagaaagcaatcattgttcagtgactaataaggttatatcagggcacaagattgtgcttgaagggactcccactggccacattaggatggtttgaacatcaaaaagaatagtagtagtaacagattataatagattgagggaaaataaaatctcatgaatctataatgatactccaaaaaaaaggaggtacaggagaaagtctacagaagcatgccagctaattattgaaagaaggaatgataaaattagaaaactgctattaataaaactttcaacagaacactttcattaagctcactctcatcttgaacacctgcctcattcgtaaaatgttcaaactgtcatttcttggcagaaaaatatgctagcagaaaatgtaccaaatacagtctgtaagttgctgagttaattttttcaaaacagttttattgaggcataatttacataccataaagttcacccattttaattgtacacttcaatgaggaaaagagccattttgcaaccccagcacaatcattgattcaggcaaggatcatcaatgaatgctaaaaccattgagtttaagatcgctggagaataggatatttatgtggtctcaaaaatatcactccatagattactgaatagttacaaaggacaaaatgtgcctttacaacagctatctaacttgtaccactttaatgaagtgatcaaacttagcctctccaatagtagaataactggactttatgtgcctcttgatctgacatgataagaagtatacaataccatttatgtagtagtcttatcaaaaatgtttaatttgaatctaatcataagaaaataatcagatattccacatgtgagacattctgaaagatgatgtagtattcttacccaaaatgtttaacttgaatctaatctcaggaaaataatcagacattctatgtgtgagacattctgaaagataattggcttggactcttcaaaaagttcgttatgagaaaaaaaattcgaagcaagcaaacaaaaataagtggatagtcttagattaaaaaaggcataacattcaagtctaccttgttacccttgattaggtactgatcaaaactaaaaagatattgtttagaatattgggggattgaatatggactgtatattaaatgatattaaggaattgtttattttactagatgtgatagttattgattatgtaggaaaagatccttattcttagaagattcaggctatgttatttagagaattctcatgtctgtggtttactttcagcaaaaatttgcaaagaggaagatttagcaatttgtggcaaaatgttaacagtgggttaatctaggtaaaaggcatacaagtgtgtggtttttactattctctcaactttcctatagacttaaaaattggggggtggaaatcatttttatagactttgcctaaatatggaatataatgaagcctaaggaattaagacaaatgggagctagttaaccagagttaactacttttaaagatgtggccttaaaataatacaaattttattatttggcatgctagatttttcattttctgcattaatagaggtcatcaaccatgaacttcttcagcttctttcccttccagacatacctatatcatcattcatctttacttccttctctcctgtgttaaggaaaaaatattctatcaattttgaaactattttgaattatcagagggaggttaaattctatatcgctttaatattttttaaaactgcctgatggggagagtttctaagtcagatagatacgggttcaagtcaaggcattaccacttaattgttgtgtgaccttaattgttacttaatctctctgagtctgtatcttcatttttaaaatgagggataatatctatcttttaggggttttgtaaggattaaaagaagcaatgtcagtaaatggtagtggcagaactggttactgattatcagaatttactatgtttgtgtggtcaggtaagagaaaagaagggtcatgtgattcaaaaggtagctattaaattggatctagagaaggtagttccaggtagtttatcaccaaaaaccacttacctagacaggttataagaactgctgagatgtgagagtgtcagtaactagaaaacactcaggaatgagattaaacaatgcttgacttagttgtcttcctgtcgcatatttttctacagtgatcagtgcttctcgggtagagttgaggaaggtgtcaaaaagtaatttgggctgtagagaaaaattatagtgatttttttctcttggcagggattctctttgtcataaatgaaatctcaaggctttcagccagtgtttccttaataaaattaagattgttagcattgaaaagggacttactttatttaaatggagaaactgtggctcagagaggttgaatgacttctttaagaacacacagctaattaatggcagagctaggaccaggatccagacttccttattatcagaatggtgttctttcttctggtatgctcttaaaacaattgtaatgtaggatcactaaatataaaaacaaatcttagtcatgtacctaatagtagaggacaaaggttatcaaagtatgatagtactttggataggatataagttctaggtatctggggaaagttctaagtaaacacaggataaaaagagtaaaacaatgaagagtaatgattacttggagttacttttttgctaaaaattcatttgagctggagaggcgatgagatttcatattggttctcaactgagacaaaggaggccatgaaaaagaatgagaaaaaaagcctggtatttcttgactgtgggctcctttttgccattcccacccaaggagactttctttttcatatcaggaaatgacaagatgaagaaattgagagtggcagggtttaattatgctgtcttaagagaggttgttttttgttgttttattttgttttttagtagttaattggatcatgtatgctgaaatgatctgtggactgaaaagttttttgagtaagctcaatgaatccatttatttctactcaaataatcgttatagaaaaagtaatagatgtgttattttaacaatacaaatattatagttttttactaaagagaaatcttcaacttgtatataatcaaatctttattttaaaaggattctgggaaatgttttgataattcaatatctttaattttagtacacatttttttccatcataaaacatgacaactgttgcactaagaagatcatatatttaactaaaaagttggctctttaaaagtgatttggaggctgggcactgtctctcatacctgcaatcccagcacttcaggaggccaaggtggatggatcgcttgagcccagggattcgaaaccagcctgggcaacaaagtgagacctcatctcttaaaaaaaaaatagctgggtgtagtagcacacacctgtggttccagctacttgggatactgaggtaggaggtttgagcttgggagttcgaggcttcagtgagccatgattgcatcactacaccctagccttggtgacagtgagactgtgtctaataaaaaagcgtgatttggaaatgaaacattacactttaaatatgttaaaatattacataaaagtccagtcaacttttcaatatccatgaataagttacagagaactaggcccctttctttctctaacttatgtgatgggttagataagtgatgggactgaactagaaaggtgtcaaagtactagataattgaattaaggagtgtctgaacatgtgtaggtaatgaccagtttttacatttgatatttccctcctttgtttaacattaactatgccttttttcctcccgatcagtctagataattgggaattagtagtaactatagtcaaataccagtttcccctcttgttattctctttgtaaaaatttacaacattattttgaggttgacttgatggcaatgctgcagtcacacatctgtcttctgagttggtagtcattgaaactgcagcaactccagttcttctgggaccacttatgacagaattggcaatgcatctgaaccaattcgttactagttttaagtatatggtgctacttctcttagagaggcaacatggggtgagggataggcattttctgtttcttcatataccaaaccataatcatgtctggtaatatttatccaacaccccaataaaggaacgggcaatggaaaaatcttatacttgtaattatttgaaagttcactgagtattttcatggcattttacttctttcataaagtatcccaaagcttcaagactaaaatatatttcttccacaattattgcagtctcttaaggaatagaactggataattatttaatagctgctcacaacatttaggctgctatttagggcagagttactccttagagtaactataagcaccatagggattttgtaatatttccaaaataaaatcccattagtactaagctgaatggctatgaacaccttatttttttggtgcaaaacattcttagttgtctctcatgatttgactaactcttgcataaaatgtcataggatcattttagagaagtagttttgtgtgatatgtaataatcatactttatatttacccagtgttaatatttattgtctgagggtattgcttttaattagattttttggagtaggatttttttaagaagctttggtgcagacaagaaagattttttaaaaatacatatattatatgtattttttgagacagagcctcactctgtcacccaggctggagtgcagtggcatgatctcggctcactgcaacctctgccttccggttcaagtgattctgcctcccgagtagctgggactacaggcacgcaccaccatacccggctaatttttgtattttttggtagagacagggtttcatggtgttggccaggctggtctcgaactcttggcttcaagtgatccaccgcctcggcctcccaaagtgtgaggattacaagcatgagccaccacactcggcctaaaaatatttttattaattactttcatccatccctctcatatctgaagagtatcagatgctgagatgccaaaagatgcctttgaattccaattaaggtgccttcttcctgtttcgtcttctagaatagaatctgatttactgagcaaggttgtttcatttacttcctctttttctttaattctttgggaaatcttggtggcattggttgattggtgaggtcatctcttgtgttcttgagtataatgttccacttcacctacttgaaaagtgaatgcccttgttctgccagagatgcggcagcaacacaaagatatctctgtttgtgaggttcacttttagcgtctcttaacctcaacagagacacttggttgttcccagtgcagttaattgaaaggtattttatgtctttccactgtttattagccacttgctcatctttgttcccctttacagacaaaatagattttttgtcacacctttgtctcttgattctgaagaacttcttgtaggtttgattagggtactaaaattagaattgagcaagtattcagctgctgttaggaaagcacatgtatgtgatggttaacattctcagagctccacttcccaaacttccttttctatatgtaaatccagatttgaaatacactcaatacatctgcaaaattagatttctcactaatcctacttatgtacattttgtgcccaagtgaatttcctcaagttggagagactccccagatgaaatatgtaacataatttaaatcacttccaaatagcagaatatatattgtttgtgagaaggacggatttttctccaaagtaattttatttctgttactgaccaaaaaacaaacaccgtacactggagtcttactctaatgctttttttggggcccatctcaatggccacctcatggataagataaactgatggtatttcaccagttaaactttgccagatgggattcagataggccagccacattctaagcacttcagtgtttgaagggacaacaaatagtatttgctgcaatgccagttattagctcagcataatactttttattaaaaaattgcacagcatttggcaaacaggtgtactgtaacagaaaaagcactcttgtatgggaatctaaagatacaggtcatagtagaaattcattagctttggcctttgagaggtaacttaaccttcttgagtttttaattatttgttccatcccagggtattgtgggtaatatatatgggcattttgaaaactgagtgctatataattggaagatgttcttttagatgccagttgaaacagcacagtagctgtgactctaaatacaaagcatctactatatgccaagtcattgtgtatctcagtgtaggaggtataaatattaatggcacctctgccttgaacagatacaaagtgagggggtaggggtatggtaaaggaagaagaacataatattcagttgatttcctagaaaaggtagaatttgaaatgagacttgaataagtaataatttcaacaggatgactgaataaagaccacttaagatataataattctactacatttttctcctctgcctccatgaattcaggatgctttcaccatcttttctttttacactcttccttgaaatgtattttttattaattttgtgtgaagggcagtgctacacacaagcagaatgtcttgtcaccaccttaatatatcagtggcaagaccagtatgtgtattctcatggcagaaatggagctttgtacatctctgtaaatactctttctcccatcagacatacttagcactaggaattcaggtacattaattctgagtgtaactttgattttaataaactgggtatcttaaaagaatctatgagtagtgagaagacagtattctctctttcatcctcttccctctcccctctccctgtatccttcccttcctccgtttctgaatgagaaataaaccttaattatggcaagcccctaagatttcaaggttgcttttaaacagcctaactaacaacctcactaacatagaaggtagattggacaataactgaaaccttaaaatgtggcactggcttagcaggcaggcaacaatgaggaaacatacggtgaaggctgaaaagatggccagccatattaagcagttagaacagatttggtaaaactgttgcctaacataaattgggggtcatattatatggttactgagctggcagttgtaggaaaagaggttgggaatcaaaacttatttgtgtgcgttggtctttttttaattgaagtttctattgaggtagttgtagaataatatagaagtcatgttaattctttacctagttttcctcagaggcaacatcttgcaaaactgtagtacagtattacaactaggatattcacattgataaaatctaatctacttcagatttccccagttttacttgtgtgtgtgtatttagttctgtacagttttatcacatgtagatttgtatatctaccaccatagtcaagatacagaacagtttcataccacatttcctcatgttccccctttaatcacagcatccaccttccctcccttctaccaagttcccttacccacccctctaccgcatttcctaattaactccttggcaaccacaaatctattttctatttctaaaattctatcatttcaaaatacataaatagagtcatacagcatgtaaccttttgggattggcttttttccccctcagcataattctccaaagattcattgtgtttctgtgtgtatcaatagtttgattctttctattgctgagtaatattccatggtatgggtataccgcagttggtttaaccattcacctgttgcaggacatctgggctgtttccagttttaggacattatgaataaaactgctgtgaacatttatgtacaggttcttttgtgaatgtaagttttcatttctctgggatagatatccaagaatacaattgctggatcatatggtagttgtgggtttagacactgccacattattttccagactggctgtaccattttatgtatcccccagcagtgtatgagtgatccagtttgtctgtgtcctcaccagcatttggtattttcgctatttttcattttagctcttgtaatggaggtgtagtgatatcaaggcagttttaagttgcatttccctgatgaatgatggtgctgaaccttttcctgtacttacttcccatcagtataaacttttcagtgaaatgcctgtttgtgtcctctgtccattttctaatcaaattgtttattttttactgttgtgttttgagaatcttcatgtgttctagatgcaagtcttttgtcacatatgtggtttgcaaatattttctcgcagtctgtagcctatctattcattttcttagtagagttgttcacagaacaaagttttttaattttgatgcaatgcatttgatcagttttattttatggattatgtttatggtgtccagtctaagaactttttgcctagccccatatccccaagattttttcctatatcttttttctacaagttttatcattttacatttaaggctgtgacccattttgatttaatttttatataagataggaggcttagattaagattcttcttttttttcctacaaatatccagttgttccagcaccatttttgaaaaagtatccttcctcaattaaattgcttttgtgccttaaaaaacaacaacaacaaaaaacctgtttgacatatttgtgtgggtctttttctgaggtctctatactatgggtctatgtgtctttcccccaatgctttcattactatagccatacagtaagaagccttagtatctggtagaatgattcttctcactttattctactctgtcaagattgttttagtttccatgaaaatgtcctgggatttgataggaattgcatttaacctatagatcaatttggggagaattaacatctttactgtgttgagtcttcccatctatgaacatatgtcccaaaatttatctaggtgttctttgatttcttttatgagcattttgtaattttcatcacccacatcacatacatgttttggttttgttagatttataccttagtattttattactttgtagtgattatgaatggtattatgttacgcaagtttttgttagtgtaaaatcaacacaatttttgtgtgttgattttatatcttttgacattgctgaactcacttgttagttctaggcggtttttttgtgtggattcctcggaattttccttatagacagttatgtcatctgcaaatagagtattatttcttcctttccaatctgtatgtcatttatttctttttcttgtctttttgcactggctagaacttccagtatactatgttgagtagtagtgataagagcagacatccttgccttgttcctgatcttatgtggaaagtcttcagtctttcaccttaagtatgatgttatttgtagattttttttgtagacgccctttatcaagttgaggtaattcccctctgggagtttttgtttgtttgtttgttttaccatgaacaggtactggattttgtcaaaattccttttctgtagcaattgacataatcatgatttttcttctttaactcatgatacagtggattacattgagatataataattttattttattttatgttttgagacagagtttcactcttgttgcccaggctggagtgcaatggtgcaaacttggctcactgcaacatccgcctcccaggttcaagcgattctcctgcctcagcctcccaaatagctgggattacagacgtgccaccacacccagctaattttgtatttttagtagagacagagtttcaccttgttggtcaggctgctctcgaactcctgacatctggtgatccacccacctcagcctcccaaagtgctgggattacaggcatgagccaccacgcccagcctacgttgatatattttcaatcttgagtcagccttacatatgtggaataaattctacttggtcagggtttataattccttttatacattgtagccaaatacatctagtcttttgttgaggatttttaaatgtatgagagatttttcaagtgttcatgatatgtattggttggtagtttggggcattttttgttttgttttcttttgctgtttctgccaggttttggtaatagtataatactggcctttattttttagaaggatttgtgaataattggtattaattcttctttaagtgcttggtagaattttccagtaaagttatctgggcctggatattttgtttttgagagcttttaagttacaaatggaatttctttaatgtttccaggactattcagattatctgtttcatcttggttgagatctcatagtttgtagtcttttaggaattggtgcattcctgctaagtggttgactttatgagtataaatttgttgataggatttcctttttacccttttaatggcagtaggatctgtagtggtataccctgtttcctggttttggtgatttgtgttttctctatttttttttctgtcttgctagaggtttattaattttattgatttttttcagagtcagctttttgtctcgatgtttttctgtgatttttctgtttgcaatttcattgataacaactctttgttattttcttcattctgcttgctttgggttaattttgctctttttctgttttcttaaggtaagaacttaagattattgatttgcaaactctccttctttttaataagtgacttatgggttggagggtagcatatacagcgtgggtgttgttagacaaagggatgattcacatcctgggtggggcagagctgaactgtgtaagatttcatcacactactcagaatggtgcacaatttaaaacttatacatggtttatttctagaaatttttatttaacattttctgaccacagttgaccactggtaactgaaatcacgtaaagtgaaaccatgcctaagggaggactactgcattctccttatttatttatttatttatttttgccaacgcgcccagctaagggctcatttttaatcataaataatattgcctaatattacagctgacattccattattaccttgcctagtaggtttccagagaaacagtgttgaaagccaaactcgaggtcatttcaccagggagaaagaaaaggttttattaaccctttactcatagcagtccagggtaatctcacagtatcaggacccagtctcctatattgctgctctgccattcatggcttctatttccaaggttactttgaagtccaagaatcctgctggagctctagctaccacatccatgttctagcaggaacagaagatgagcccacctgcttccccttaagcctttaagtttaaagaaacttcccagaagcaccactaagcacttgttattttcttttttcttttttttcccatcactcagcacttcttattccatgtcaattccagaacttagtcatatgaccacatgtatctgcaaggaaagctaggcacattgctaacctgaataaattatgggattctgatacaaagcaaaaaagggagaacagatcattgggtcaggcaattagcatgctctcctatacatacataagggggaaacaataagctttttattaaaagctgagactaaaaaaatgtcacataaattagctgggcatggtggcacatgcctataatcccagctacttgggaggccgaggcatgataatcgcttgaacctgggaggcagaggttgcggtgagccaagatcatgccaccgcactccagcctgggcaacaagagtgacagactatcaaaaaataaaaaaattaaaaagtcatgtagacattgggatatagatgattgcttataatcatctgcttatgattttaaaatgctttttatcaaggtaagtcattttccaatgaaatacaaaacttttgaaagaaaaaaattctttgggccaggcatgatggctcacacctgtaattatagcaccttgtcgaggcaggaggaccacttgagctcatgagtccgacaccagcctgggcaacacgacaaaaccccgtctctacaaaaaatacaaaaataagctgggcatggtcgcacacgcctgtagtcccagccactagggaggctgaggtgggaggatggcttaagcccaggaggcggaggttgcagtgagcccagactgcgccactgcactacagcctgggcgacagagccagaacttgatttaaaaaaaaattattcatcctagaacgttagctctctaatctgttaaaatagttttatctccatcaattgtgagatgtaattaacatgaggtatattttaacttactggtgctaggttaaactataggaaattgctgttttttgtagtcagaaacaataaaatattggcaattttacacaggtcaacctgtaacaaagtatcaaagggtgtgaataatttacttaaaaaatataaactagcacagatttagtttactgccatgataaaatgactaatacagctgaatttcaataatctttctcaagtgggaaaggagcaaaattacatctggaatatttggaattgttcctttatccttaagcacttcaaaattctttttctgttcctagataaaatacttattgtagtagactaaaaataggccccaaagacttccatgccctaatccctagtattatgcctgtgtatgttaaatgacctagcaaaagagactttgcagatggaattaatgttgttttgttttgttttgtctttgagatggagtctcgctctgtcgcccaggttggagtgcagtggtgcaatctcagctcactgcaacctccacctcccgggctcaagcaattctcccaccccagcaccctgagtagccgggaccacaggtgtgtgccaccatacctggataatttttgtatttttagtagagacggggtttcaccatgttggccaggctggtttcaaactcctgacctcgtgatccacccgcctcgcctcccaaagtgccgggatcacaggcgtgagccactgcgcccggccagaattaatcttatacaccttcagcagggtgcagtggttcatgcctgcaatcccagcacattgagaggccaagacaggaggatcaccagagcccaggagttcaagaccagcctgggcaacataatgagaacccatctcttaaaaaaaatgtaaaaaaacagccaggcatggtggtgtgtgcctgcagtcccacccactcaggaggctgaggtgggaggactgcctgagcccgggagttcaaggctgtagtaagccgcggtcatgctactgcactccagcctgggcgacagagcgagaccctgtcccaaaggaaaaaaaaaaaagttatcgatcttaaaatagggagattatccacgtgggcccagagtaatcaaatagacatttaacagtaggaatggaagacagcagggtaggtcagagagagggatgatggaagaagtaacaggaatgattcaaaatgggagagggacttcacccactattgcaggctctgaagaaaaggggatcatgagccaaggaatgaaggcagccttcagaagctagaaatgaccctcagctaacagacagcaaggaaaggagactttgatccttcaactgcaaagaactgaattctgccaacaactgaataaacaaggaaatggatttgcccccaaccccaaaaactccataaaggaatgcattcctgccagcactttgaatttaggccaggtaagacccgttgtcacacttttcacctacaaaactataagacaatacatttgtgttaactcactgagtttgaagtaatttgtaacagcctcaaaggaaaacttatatacttaacttaataaaacctcgaatttaaaggactcagaagggtccctaaagtcatttacaagtatttcattttacttattttttgagacagggtctcactgtgtcacccaggcaagagtacagaggcgcaaacgcagctcactgcagcctcgacctcccatcccaggccatcctcccaggccagctgcccagtagctggtaccacaggcatacgacactatgtccagctaattctaaaaaattttttgtagagacggggcctccccacgttacccagactggtctcaaactcctaggtccaagtgatcctcccacctcggcctcccaaagtgctgagattacaggtgtgagccactgcacccagcccaaactgtattttaaaaatccaattcatgtctggtcccaaatgattctggtaaaataagttgtgttatgactggatatgtgtgtatagccagtaaaatgcaataaaacattaaaagactgaaagctacacagcaattatttttatgtaagaactctaaaaagttcttgacaagttattatgggaaacatttcatctaggagtgatttctaaggcagcatttgagtttccataaaaacagaactttctcagaaggtatatcaataagaggaccagaatcttctatttccaagtgcattggtttctcctgttcacaactcaggtttgaactctcgttcatttgaatcttttcctcttccaattccaaagatttatctggggctgaagctaccacttcttcgtcttcattttcatgtagaaagctacaaatcatgttgggtcgataggagaaatcattatcctttatttgcaaccattccatcccacctatgttttcttctccttccttcttctctgtcagaagagttcttgtcatgctgagcttcttcattgtatgacatttatattttaacactgttttattattgccttctgtatcagcatgttcaacattttcttcaaatataacacaggtcccaagagtgtcttcatactccccagcaaagacacagctgtccacttgcagaatgggcctctcagtgtcaatgcccaaaaccttgcatttattttcacatttgagagaaagtctgaatcaataattcctgataattccactagaaccaactgctcctcctcttcctcctcttctccatcctccagatcccgctagtcggccgcggccttggtcccgcggcgcctcgcctactagtcactggcgacgcggagctgccatcttgagtaccggccctacattctcttttaaggcatttctgataatcagcaatttaaaaaccctagttgttatcgccaactgtcaatttcactaatggttcctttactatccattataaagctccatgttaacaaacatctgcacatagatatcccaaaggctcaaattaaacttgtctaaaactaaactccttattttcatattctcccgggtctcccagatctgtaactccttttctttttctcagcaaaagactgctgctatttactcaggaatctaaagcaggctatttctatttcttcagtaagtgatgatgattatacttcttaaatagctcttgaatcctttctcttcactagtttcccactaccacatccctatttcaggctttctttgtcccccaccttgaaaatataatttttttcaggtttatgaaaaacatcagctccttgtccataccttattttcttactccctaggggcaatcactttcaattatgttagctaaattttgcaactatttatttttatatttttaaacatcatgtagtgttactttttagtttttccgtattaggccttctctactgactttccaaaatgggtggaggggaggatttaactcttttacatcatatatacatatatacacacacacacattttcctcatcctaatatgtatatattataaatttcacataaatcaatatttaatatttggattatgattgcataaatgttatttgcagcctggccatgtagtatactatattatgtcttcttccttttacaagttttattttcctttgagtcttatttctttatttacttagttttctatatacttttctaagtccctgcttttactgtaaatctatcagttgcctctttgattcatctctgccagagtcctctaatctccatactacagtccttaattgttgctttcttgatctgctgctcggctatggtctgtcttctatagcattcttatattgactctactctttgttggttctccagtttcatggctcttacttacacttctgtttcttggtttattcccttgtttctgatatagcacatattctagcagtttccagaaagagtgcataggaagtaaactttttgagaccttgcctgtctgaaaaggtgtttattctaccttcacatctaatcgataatatcgggtattgaattttagcttggaaataattttccctggaacttttgaagaagttgttctgttgttttctaactttgagggccattttgattcctgaacctcatgtgaacttttcattgtgtttttcaatggaaggttttaggatcttcctcaaaatactgaaatatcagatgatgcgttttggtgtggatctgtttgacccactgagcccattattggtgactcaaggaattcatttctttcagtttgggtctattttcttgaattaagtttttgctcattctttctggaaatactgtttttctaatgtttgatgccctggactgatctaaatttaatttctctcctattttctcgttatatttttgttaaattttctggggtatgtactcaactttttatttgtctttctactgatctttgatttctgctataagtttaattttgcaagagatgttgtgttgttttatgattatatatatgtactttgtaaatagcatcctgttcttatttcatgaattcagtattatctctttgaggatattaatgattttttaaatgtatgttttattctttctggagtatttcttttagctttctttatatttctgttttgtttcagtctttctcatgttagaggctttccccaaatatctggtgattcttggttgtccatttatattcaagaatgatatactgaaaagttttgtaggtggggcttgttaacttactataggataatttggctagacattttcattgggggacctctaactgttatcttcaggatttatctctttagctggtcaaattctctggagaagaaacttccagctcctggctagagataagcctggtgttaagccagtgttctgagaactgttagagaagagactgcaggcttagtgttcagcttgtaggctttcactttatccctgtataactttgacttaattcccgttttggtacagaatacttgccctctgctctgcctggtgtccctgatccacagcttatttggttcaccctctccaaaggaaaattatctccaggagttgggtagggagaattgcccagatgtaggatgtggatgagaggaggggtctgtttcttatgctttgacaattctgtttttagctccactttcaatatcactttgaattacctagctctactaattccatattctttctagggttctctcatacaaatccagctgcaattttcatagtttttttgttgtctcctttcttgtttttgtccttacgattttatgcttttgtctttttcttcttctgttaaaaatatctttactgctatttgacaaatgttttgaaatagagcagtggtaaatgcatgtgcttaatctctaactggtaaccttagtggtctcctccgcctagtcttaccccattctaattcactttcacaatactgtcaagatgatcttgataaagtcacactctattctagtcatctctttattaaaacccttcactagttcccattgtccaatgataaatttgattctttgcataatatacaaagtaccctgcataatctaacccctatctggttctctagcctcatcttgaagaagtatttatggttttctaaacgcctgatattctttcctcatctatattttcggacgttcagtttcttttgcctggagtactctaccccatcatcgtctgcatggtagctgctcccatgtcaagatggtttgtgaagccttccttgactgccttggctcatcattctaatagttgtttatccccttctttgtatccaggctgtgttctacataatgtagtattagcatttatcatataatattgcagttatttgtctacatgtctgtttactggaatttgagcttcttgatagagataatatcttaattatttttgtatcttcagaatttagcaatgcctggcatgagcttggggtccaatatatggtttcaatttatttgttgcctgatatttacacaggatactgtatttagcttttggtggagaaagagatacaaagctaacagacatgtgcacatgaccatctttccatgttattaaacattctacatttaatggctgctaaatattgcattatatggatataccatagtttgtttagttaatagcccattgttaggtattagttaatgtttcaaactttttgctgttttaaatcatgctgcagtaaaaacctagctgtaggtaaattttaaggtgtacatccatgattactggacataaataaaattcttagaagttaaaatgctaaatcagtagtaatgtctgttttaaaagcttttggtatatatccttccaggtaggttgtactaatttatattttcaccagaaattcattggggggacccatttttctgcattctttccagtaccactcctgtaattactaccaccaccaccaccatgatcattctttgccaaaatttgcaagttaaaataatattttcctggtttaatttgcattcctctggttactaatgaggttgagtattttgaaaatgtttataaataatttgtgtgtcattttataagttgcctatttgtgtttttaactgttttactctcaggattttttttttatctcactgcctcaatttttttctgggagaaatgagagatatactatatagcattgtttatgaaagtacattgtgttctttgacagtgaatttaatctcatctaataatttttatatgtataacttaaaattttcttaaagcattaattacagtttctagaagtctgtgtttgggtttaatgactaaatctcttttcctaatcttttttgaatatttacctaaagtatttgcaaaaggctaagttgaagaaaacatctgtctccaaaacagaatgacactgactggaagcagcttcaccaaaatcttttgagaataataaataattgttttaaaatattttaaaatacacaaatataccaccttaaccaatagccatttagttaggcctatagagttgtacagacatcaaacaatccagtattagaacactttttttaccgccaaaattttctcttggccatttgcagttattccccatttctatcccaaaccccatgcaaccactaatctactttctgtctttatagatttgccttttctggagagtttatgtagattgaatcatattatatgtggccttttgtgtctggtttctttcatttagcataatattttcaaggttcatctatgttgtaacatgtatcagtacttaattcctgttattgctgtgtatcatttcattgtacagtcataccatattttgtttatccattcatcagttgatggacatttcttggttttttttttttgagacagagtttctctcgtcacccagactggagtgcaatggcacaatctcagctcactgcaacctccacctcctgggttcaagcgattctcctgcctcagcctcttgagtagctgggattacaggctcctgccaccacacctggctaatttttgtatttttagtagatacagggtttcacaaggttggccaggctggtctcgaactcctgacctcaggtgatcctcttgcctcggccccccaaagtgctgggattacaggcatgaggcacagcacccagcctcttgttgttttttaaaatatagttttagcacttacatttagattgataatccatcttgagttgatttttgtatatagttaaaggtgggggtttgatttcatttggatgtagatatccagttgtcccagagccatttgttgaaaaagattatgatttctaccattgaattgccttggtaccttataaggttttatttctggactttgtttctgtttcattgatctctatggctattattgcccatatcatgctgtcttgattacttgattaagttttaaaattagatagtgttaaatcctacagtttgttcttatttttcaagattgtttttttctggatcctttgcctctccatatacatttaaattaagcttgtctatttctataaaaagagcctgctagaattttcatagggattacattgaatctgtagatcaacttgtggagaattgccatcttaacaatagtgagtcttttaatccatgaacatggaatatatctccacttatttagatattctttagtttttcttagcaatgtttttttgttgtcagtgtacaggtcttatacttcatttgttaagtttattcctaagtattataattctttttgatgctattgtgaatgaaattgttttcttattttcatattgtttagaacaattattttttaataatgtcaatatgtgtatgccatatttaatatgctggcaggaaccagtcaatcactgatgcttgtcatgggaccaaaattctgggcattaagtacctaggtgcagtttttgcccttaaagaatgaaagtcctaaaaaatttaaagtatgttaatacagaaatagtcctgggaattcaattagaagacatgacaaaatgctaatagtaaggctttcttaagaatgctgacttgtatttcttgacagtttattgatttttaaaatcattataaatgtacccctttgcatttaatatgtatcaatcagcaaattactagaatgtgcctatgttgacacttctgatctcaagttaatggtttgttgtagtgctcatctgtgcttccatcatattaaaaactgttatttaggtgaaaaaattgcaccccgcagttagttattacaacaaaaaggagatatagtttgccaggttgaacataatgtttttctggccttttatagacagccagcattgaaatcactgtccttaaagcatgatcttgcagaatgtctttataagataaaatgaggtattacactttaaaaactgggtaacattagggtttttctgattgggtgaagaaaattaaagtatattacagctggcccttcaacaatgaagggtttaggggtgctaatccctacacagtaaaaaaccaaatataactttcgactccccaaaacttaactactaatagcctactgttgatggaagccttaccactaacatagtcaattaacacgtattttgcatgttatatgtattattatatactgtattcttatgataaagtaagctagagaaaaagaaaatgttgttaagaaaatcataaggaagaaaagaaacatttaccagttattaagtggaattggatcatcataaagttcttcattctcttcatcttcatgttgaacagggtgaggaggaagaggagagggtggtcttgtctcaagtgtggcagaagtggaagaaaattcacgtatagtgaacttgcgcagtttaaacctatgttttccaagagtcaactgtatatcgtttaaattttttagtgtttctcttgtaaattgtttttcttcttgggcaccagttatggcttattcatgagtaaccattaatgaacactaaaagaaatgacaaagtttatttgtgcatgttaatagaaaaactcagagtatcatgcttacttcaacagcttagttttactagcagaaagttactgtttcatatgataaaattaatggtattctgtggtactctgcccctgagaaaatttaagaaccaccaagttaaataaatcattattggaaaagaacagaaatgtaaatatactcagtgcgctcatttgcttataggtagctaagacccaccaaaacctatactcccaatttaatgactaccctgtatgtcacttttagggtataatgagtcaaaaagcagttaacacctcatcctaacaaaacataaatgtcaactagacagttatttgcctgaaagctagggagagcagaaaaaaaaaaaagtcttgtccattgtttgcacagtttccaaacagatagatgagtgtttttttcttatgtgttttctaaaacgtaaagctattgaaattgctatgtaaaattttgttaatcatgtgttgaaaggaatacgtaaattatgttcatgggatattttggccttagattaatgattgtgtgactttttctcctataggcatgctgcgaaggaaggtagaagtggtaacacgggttttcgaggattatcgtcacgaggagcatgcacacaatgtcaacactgctttttagtgaatgaccatatcttcagcatgtcgtttctggattattacctacaaattctgatgttaaatagagtagtatttatacttaatatttcatcttgatcataatgaattgtgcatcctttttttcatttaagtattgtactgttgagaattataccttagttttgtttttagtattagaaaatcaaaattatactagcccctttgtccagacagcaacctcttagatgctgactctatatgtgtaatttatgtcttactctccctggcatcagtacacatcatccttctcactccagttgaatcatagggtgatgtctgccaaaagtacatgccaacctatatagtgctagatactgtaaagtctcttctcctcaaaggaacctactgtctagtttgagatataattaatgcttgtctgcataaaaacaatatagataatataaagaagtgcagtatgaattatagaaagtgtgttatagagattcagagcagggaggaaaagttagggtagattattattaaagggttaaggaaaggtaagtttcaaggaatttggttatttttaatgtatggatatactggcattttatttggttttagcatatgatttatagttggtgatttccgtatatttgtttgtttttctttttttttgtttgtttgttttgttttgttttaaataagccttgttcttaggtttggaacagtctggtctcctgtgtttcatgtttcacctaagtcataaataaaggtaatgtcctaaaaaaaaacatgtaatactgaaattaactattaaaagtttt

SEQ ID NO: 1189 - DNA, 83009 bp, mus musculus; identical to SEQ ID NO: 1188

SEQ ID NO: 1190 - DNA, 282842 bp, mus musculus
cctccattctttcctctcctgctgcatggaactatctcctgagtgctgcaagttgtaacgggcaccgctgagcctgtttccctttggagcacttcttatctagaagcagtgtttagtttcttccaaactgggccacttcgtccacctactctgttctgagtaaggaaacagcctccaagcatcagcagagcccagatgagcacgggccgcggagccgcttagcagtctcccgggacccagctccggaggagccgcaagcatgcaccctgggtgagctgttgctgccccgagctcccctcctctttcttacttcgggttactttgccaggccgggactatactggtacttctgtcactgcagagaaattgggagcaggcatccaaaagggttcggggggcgacaggcagacgcacgaccccgaagcctagagagcccattactcaccctccctcccatttcaggttgtggctgctcctggttacgttgtgcctgaccgaggaactggcagcagcggtgagtctcttctcacgacccttttccgtccccctcctttgaccctctaaccatccccatctctagtatttatgttagggggttgcagagagtttcaccacgagacggagtccacaccactcccctttctaatgggagttaatgagattcttgagaggaatagcacagtgtcaagtcagtgtttttgggaccaagatatcttccaaaacttcgtaacgggttgggaaaataaaagtggaagacacaagatgcacacatttctgagcctcttccccagacgacttaagatgactagcatcaatctccacggcagaagaaacataattttccctggtcttcaagaacttgaattggcacactagtttgagagtgggaggagagcacaaggagtggaacttcaaagtgccgcagatgctatggaaatgaaacttaagtacatgcttagagtcgtttgacagtaccaggtgacaacatctggattctttaactacctgaattgaactgataccactaggtgatgttcaatttctgtctgatgtgtcgtgttactcgtttctgcatcaccagaaagttaaaagataaagctgttataatagaaaaaaaaatcaaagttaacatttcataggctgtttagatgtcatctatcaaatcaactagggactgcaggtaaagaaatttctgaagacttttggtcaagaaaagtttaatgggtcccagaaagtattgaaatctccagtggaattactaggataatttcacaaagatggagtgacccaaataatcaaagatgctgcagttttccagtttcactagctacttaagctggcagaaataaaaactgttgagtttgaatacgaagttgttcaattgttgagtactatttcactgctgtattttttttaaaaattcttaatgatacccaaagccattccctatatagatgagagatgaatatatattccaaatatttatcttgtgggttttgatcattttaactgattggctctgctttttaatattttaaatatttttaaatactattatagggccatacgtaattcaacctaataaatcacccaatgtgtttatgaaaaaatggattattttatcttggcatatgatgtctttaagaaaataccagagtgaagctatttttcttgtaaagagaggaagatgccagaaaacttgaataccaacatcttgtgaccccttaactcaatatcagttcctatgtaagtaaattctggacttcgtaagcaaagatattgatctaagactctgtgtacttctccatcttattccttcaatatacaagtttagttatgtattaccttgaggctcaataactacattaattgaaaatgccaagatttgattagttaacaattcatccaggaatcttgccacttgtaaaagtgtcatgcatgggcagaataccctcaagcaaaacttttatttttagactctggctgattttattcagtgtacttttgggaaaaacactacagatcattccagatagctgaagacttcacaaacactgcatcctgtcacttaatacctttaaaaaccactttaatgcttgcaattctttcaagtattgaaatgagtctccaaaattaagcactgctttggtgtatgagttttagactctgtctcattgttttatgtcacctgctatgtcagtatgattgaccatggtaagtctaaaattgaccttgagttccacagataatactttattttttgacttatttaagtacacagccacttccttcacttgttgtttacttatgcaaaatatctttgacattgtaaagctactttttttcagttttggggaaaatgacaaatataaagacagtcacagaataagttatcagaagatgacttttctgaagggttgttttgtttttcttttacactctttgcacgggattcttatctatacgggctggttctcgtattctacactcaattccagtttatcctcatgagtttgtgtgtttttcaccctttggattgttttaaacatttaaattctctgtgccatgtttgactaatattaacgaaaatagctattaaaaatagattggcaggaactatgttgtgttttgctatgagaaagtctctttactgtgagaattaagctgccaataatattggcaagcatttaaagattgggtcatttaggggcttttgggctctttcttttcctgagtttacaaagcacatctatataaagtaaaggaaaactaaatgttaaaatccatgttaaagaatgagcttccattaaatttactttaaaggagtaatgatcttcattcaggtgaaatatttgcacaatttatctgcataaaatagaatctaggatctcagaacatccatgtctttggctgttaggcgcctaactatctaaggggctgtgctaggccacgcacagcatgcaaagatttatttaaacatagttcctaactctctaggaatttgctttctcagacaatggtggtcattatgttccttagaagataggatgcttaatgataagttattatctacatgtacttgcatcgtgttagcgaaatgtctagaaagatacaaatctcaccatcagccaatatatctaggaaaaaacatatatcccgaagtagtcagatccttatgttttcttcacactttgccccctccaaatgagctttcaggaaaaggtctaatacaatcaagcatacttaaagtcaaaagcctagggggatacttatttgggttgggaggagggtaaggagagaaaacatttctattgttccttctgcagagagcataggtaaaatgcctttagctgcactcaaatcaaggtctgattgaaatatcaacttctttctttaaagttgtaacatgcccaggttggtcctttctgctgtgattttcagtcgtatagtagtcatcaatatatgaatattatgttaagggagttcagcgatggagacgatctcttccagttctaaagaccaagaggaatatttgcattatctggggctgtgtctctataaatccttaaagtactcttctactttacctgctagcaaatatcctatatcagctagctatgaaaaatcacaacatataatatacgtgtgtgtatgtgtgtatataaatatataatatatatatatatatatcttgggatgactaaggatactgatagaaatgtatgagtacactattaagtaaatcatcaaatgactgtaaatagataatccatagatgataatatatttacattatttataggtgaaattcaaatatattttaagatagaggaggggataatagatgttattatctaaagtgttactaaagaagcaaatatataaccatttcaaaaattgttttattatacattttaatgattgtatttcagtgtaatcagtttccattgtaatcctatgtattttattgtatacttctaaaactagcagggtgctgtggtgtgtgcctgtagtcccagctacttaggaggaggctgaggcaggaggattgcttgagaacagaagtttgaggctgtgacgcaccatcatcgtgcctgtgaatagccactgtactccaccctgggcagcagagtgaaaccctgtctcaaaaggaaaaaaaaaatagtattctaaaaaggagtccataggcttcactagactgccaaactatggcatgaaaaaagtacccctagtttaagaaaattggttttacaaaaacagtcattttctaatgtttgttcaggcatgaggggaattgtgttgactctaagtgccaacaatcttttaatttttaagcatagtttggagtcttcaataaatatgctcctatattctgtaagctcataatcaagccatatgactggagtaaagtatactgtttcccttattatctcattaatagaaaaaactgattgacctcaattattaatattggtttttatttgcctgaattatatggattatttcataattttaccacaggtgcaattatggtacaccacagcctcaagcaatccacctgcctcagcctcctgagtagctgggactataggcacacaccacagctccctgttagaataatcttaaaagtatggctgggtgcagtggctcatgcctgtaatcccagcagtttgggaggccgaggtaggtggattgcttgagctcatgagttcaagaccagcctaggcaacatagtgaaactccgtctctacaaaaaatacaaaaattagctgggcatggtggtgcacgcctatagtcctatctactgggaggctgaggtgggaggatggcttgagcccaggagttggaggttgcaggtgagctgagatcatgccactgcactacagcctgagcaatagagctagaccttgtcaaaaaaaaaaagagaaaaagaaaagaaaaagaaagaaaaaacagtatacagtaatatacttggagtatagacttgtcttatactgtgtaggtgacaagacatacacatagaaaaagaacatcgtgggataacatcaggctatattaaactatcaagtcctttatagctgcctgaatgtcccagtgaggcagatcatagggcttttacttggtttaaagtctaattaaatgtaaatagaagacctgataagcatgctcaagggaaaatagtaatgggaaaattagctaagagcaattatcaactctctttctttaatctatccctttcctagggtttctatttttcttctataaacaatattgaattctcctccgttataacaatgaatttaaacaaaatcacttcatttactttaataactctaacctcttcaattgcattacccccaagttcctgggtattgtctagtcttcatcaccaaccacttacccttcaacctattatagtctcaactgagtctactccaggcaaacagccctctttcaagctactaatggctgcctaattaccaaacccaatggcttatttgcagtccccattctatctgacttcactgtgttatctgacatttcccagttactctgatacttctttatccccttgtttttttttaattttgttttgttttgtttttttgtttttttgtttgagacagagtctcactatgtcacccaggctggagtgcagtggcacagtcttggctcactgcaacctccacctcccaggttcaagtgattctcctgcctcagcctcccgagtagctgggactacaggtgcccgccatcacacccggctaatttttgtattttgagtagagacggggtttcaccatgttagccagtctggtcttgaactcctgacctcaggtgatccacccgcctcggcctcccaaagtgctgggattacaggcgtgagccaccgcacccggcctcctcttgttttttaagacattatacctcactagggagctggtaataatcctgaaataaataatcctgaatcccataattctaaatgttgaaatcctgaaagatcaaaatcccaaaaatattctggaaaaagtaattttaaaaattatttaaaagatatttacttacatttttaaaaggatagttgtttgagaaacataaaacacaacagaacattccaaaggtcactttacataataaaatagacaataataacatacatagttttgtaaggataaacacttagtatatactagtgacagtcacacttgtatgacagttataagtagttgaactgtattcacaaagaaataggtcaaaaggaaaatgtataaagacatatcactatggttggtaattgtgtgcatccagctttataactgtagtcatctgaaataccttgatgaacaacaaaagtcttttgacaagatagataaaaaaccaccataggtgaccaccgtatatgcagtcatccaaagagccaagatcttgagaaattttatctttcacaaatgcgggtgtacaaaaagacatctcttcattcactgaggaggttttcacatttttacatacacacacaatgcttacacagaaagtcaacattgtgataatacacgttcatggaatcaaatttctgatgtccaacgcaacagaagaaaagtctgccccagctctcagagagagaccaatttgcattctctgtttgttctctcccagcctctagcctatgggatggtgccagcccacattgagggcagatcttccctagcttatccactgggactcatacatgaatctcctttggaaacaccctcacagacacacctaaaataatacattaccgggtttctaggtattccttaatccagtccaattgaacctaaaattaagtccgcaagtccaccccttgtcaacttggcacccgttatgcatcttcttaaaccatacttaatttctaaataaagacaataacaaggaaatagttccacttcacatgatgcaactaacatggcacaaccatcccatctgcgaccaaaaacacacttccccagaattcagttttcaggatttcaacattcgggattttaatctttcagtattgtgattttcaggattttagatgttaaagattttagactctagggatttagactttagggattttgatctttgggatttcaacatttgggattatagcattcaggattgtgtcttttgggattatgacacaaacttgcctcactagttctccttatacttctctgatctttttatttatgctattaattcaacaaatatttattgagcaacagctatattccagatagtatgccaggccctagtgacacagtggtgaacaagttagccatgaactttgctcttatggaatttataatctttatcagtctcttgtcctaaaatggtggattttttccaaaacttaattctttactgtcttcttgcctcaatggttttaactatgcctcctatatagtgatgattatcaaatttatatccccagccaagacatctcttttgagctctaaatctatgtttccatttgcctactaaccccttgtacctgtctctcaattagttgatatatacaaaacacttaaaacagtgcctggagtttagtataggcactcagccaaagccagctattattatttttattgccccaaatacagtatagttaaaggtgaaattgttttcttctccttcccatgacactccaaccagctgtgatcttttttatttttgttaaatgtcatcaccatccaccaagtttcagcaagaagctacagaagcagccatcagctttcattatttccaaaattctcaccaaattttgataattttaccaaaaatctgtagaatctggcttttccattcatattctgttggtttcaaacttcatacatcagtagcctcctgactggtttttctacctcctgactccatccttatctctacattgccactagagttattttactaacaacaaacccaattatggtatcttctgatttaatgcctttattggtttcttctttcttccaggataaaatgcatactacttggtttggcacatttaagggctttcattttctgacccaactgcttttctagcctcatgtctgtgtgtttcttcctaccagtccttctttccaaactcatggtgtatattacacttcattcagactgaacttctcaccattcccaaaccactttatattctttcacatctctttgcccctggatatgcagtccctctctctggaatatccttctgtattgtttctaccttcttttctatctaatgaactcctactcaatccttaatacccagaccaaatataattttttctatgaaacagttccagacctcttcagaatgaatttattcttccttctcctgtgcttccaaggagctttgggcctctttggtagcacatccatgtggtggtaagattcctatgcttatatgactacgttacattcttcaaccttgtacttaggatgtccaggatactgccaggctgagcataggtgatcaagagatgactttcaaatgagtaaacatctcctaatggctcgcaacaaactgccttctccctgtctatcttaaaaattactaatgttaactccaataacaattgaattgatggaaaaatatcaaccctgttcaatagtataatgtttaagagaaagcactctagaatcagacttttgtctaaatgttgcctctgccctctgacacttcctagctgtgtgacttagagtaactcgttttacctttctgagatttaattttcttttttctttttgagtgttcaatgaaatttttattgagataattgtagattcacatgcagttgtaaaaaatagtacagagagatcctatgtacgcttatccagttttcccctagttgtaatactataatataatatcacaacccagatactgacattgataacattcactgatcttatttcattttcctcgtacttatttgtatgtgtattttgttctatacaatgtcctcacaggtgtaggttgggatttccattgccacagtcaagataccaaagtcaacaaggatccctcatgctgtccttttataaccacatccatattcctcctccaacaacatatattaagtttttacaaatgtatacagttttataactgtctccacaattgtaataaaaacacttatttcccagaaagttcccttacactttttgcagtcaattccctcctcctcattctgcacgctaggcaaccactgatctgcttcctattattgtagttttgccttttctagaatttcatgtaaatgtaatcagcatagcacttttgagatttatccatgttgttataagtatcagtagttcattccttttattgctgagtaataaaaggaatggatatatcacatgttaattctctcttcatcagtccatagacttttaagttgtttacagttcttaattatcatgagcaaagctatgaatattcaagtcctcatgtgaacatgttttcatttctcttgggtaggtatccaggagtatgattgctatatggtaagcacatatttcattttggatagtttctaagtctatagcttcatattcactgatttttccttcttcagagtctaatctgatattaacaccacctgtgtgttttttttcatttcagatattatatttttcttttctagaaattccttttggattttaaattttacaaacttccattcttctcctcatcctggtcacattttcctctaccttcctgaacccatgaatctttttttttaaagttttattttaggttcgggggtcatatgtgcagatttgttacataggtaaactcgtgtcacaggagtttgttgtacagattatttcatcaccccagtactaagcctagtacccaataattatttttttctgaccctcttcctccagggtttaattttctcatcagcagaaaagggatgatgatattatactttgttcttgaggtattattgtggatgctgtatgtgaacatgccatgcaccaggtaggtgctaaattcctctcccatcttttccccccagtatcctcagagacttaaaaatcatttcccaattttggcaattgatgtttgataagatgagagaaagggagatatcagagaaggctctctcatttgtagattttatgtctagaacaaacttgtccaacttgtgccccaagggccgcatatggcccaggacggctttgaatgcggcctaacacaaattggtaaactttcttaaaacattacgagatatatttgctttttttttttagctcattagctattgttagtattactgtattttatttgtggcccaagacaatgctttttcttccaatgtggcccaggaaagccaaaagattggacatccctggggacaatggccatatttctcagttgtccccctcatctctttatcccaatttcaccaccataatagtaacatatgttttcaagtctttcaagtttacaaagcactttatcatatattattttgttagctgctcaagacaaccctgtgagggacaaatattctcatcccagagagattaactgatttatctaaggtcacaaacccaacaaatggcagagttaaagcccactctactgtgctatctctttaatttaagttttttatcatctcttatccggactccctacagcagacctaactgttccagtttcagactttcactgcctcctcattggctttcctgatatccatcctctctgaaagcaaagagcttattctaaaacacaaattgatcatgccactctaacatttgtggaagctccctacacccatggagtatctgatctggccctgcctacccatccaattccatctcctgtcttgtcctcatgtagctgatgtttaggtcacagttatacttgtgatgttggcttaacaggacgtgcatattcactccttctgcttctcctgtttttttcatcctctgtcttgccttcctcctgtctctacagatggacatattgttcttctcttaggaagttaagttagtatttttctgaagtctcctcttcttttgtctttctgtttctcactgttttttcgtcccttcaactaatatttatttagtgactactatgtgccaggcattgttgtcaaccccattgtgggaaggactatgtcaagcactaagccactgtagccagagcacagggaaggggaagaggaaagagagaggtagaactttgtgagatgtggatggaggataggaaagagacctgctctgcactcttacttgctccgtaactcctcagagcatttacctaacacctgtactaccgtatatctctctatgtggggtgtaattgacattatagttattgccggccacttattttgcgtccagttctctaacaaaccctttatacgtggaggactcactcctgcagcatatatctggtccttccacatttatcaaatgtaggcaagccatgaggcatgtgtctattctcaagccttttgggggttccgtatttaattctggatgtccatttcctgattttttctccttctatttctttatgaagtggttaaaaaattaaaagctgtaactttaaagccaaatatccccaggttcaaacacaaactccactattaactacggccttaggacaaatcattaaatatattattaactgtaaaattattactattgcagttattattttcccctcattcattgtgattgcctctctgctagaaatgggtagtgaggccacttgggtgacaatttaggaaaaaaaagttgtttaattatttgttgaatttgtttttcaagtgtcctaggggaaaaagagttagaattgttattttacttgttccagtttccccaaagccacttctacctctgctgccctacctttgtgatttcctgtagagacctgcttcccaactaaagattatgcccaaagacaccgccccaggcatctttgaagtcccagttcccctttgtctaacaacaataaggctagtttgccattatctttcagtctggtttgcttgtattgagggggagttggtgttattcagtggaaaatttcctggtcataaagctctacaacatttacctcagagagaccaagctttcccagaattgtctggcacctctggctctgaggctgaattggtcttttgggagacagatttttctcttgcggagggaattaatgttagttatatttttccttgctctgtacaactttgagtgaccatttttccgtacccaagggaagaggattggcaaagaaaatttaaaatgcctagatttctaaactctgtgagtgtagcagatcccttaaggactggaacaaaccttagatgtatgagatttatattgtcttttagatatgattaagttgcataaataccgtctagcacctagcatgcaactaaatatccagaacatgctcatagatactgatgttgaggttgctgttgataatgaagaaaaatgggacactctattagaacatttttcaaaatttacgacagtagaccccttttcccccaaactaaatctcatatgccctccccagaaatatcaatgtatttattaacaattcaaatttttaacagtaatttataaagtcagtaagaaggaagagcttgaaatgaacataaacatctgaaattgagagctacagaggtgtgtgtgtgtgtgtgtgtgtgtgtgtgtgtttgtgtgtgtgttgtgctgtcgcccaggctggagtgcagtggtgcgatctcggctcactgcaacctctgcctctcgggttcaagctcttctcctgcctcagcctcccgagtagctggtactacaggcacccgtcaccatgcccggctaattttttgtatttttagtagagacagggtttcaccttgttagccaggatggtctcgatctcctgacctcgtgatccatccccccttagcctcccaaagtgcagagattacaggcatgagccaccacgcctggcctgagagctatagaagtcttaatctccagtttatttctgtttattttatagaatgttgagaaaatcctgatgtaatagtgaacatcatggggtgagggcttttttatcttgctatctcaggatgctctgcagttaaacagaaatagcaagaaaacctatatttccaggtctgcacacataattcacgctctctttgtctctctcctctctctcctctctgtctctctgtctctctgtctctctctctctcacacacacacacacacacacacacacacacacacatacagttaactgggcagcacccattaatacaatcagtgttggtttccagtgtgttaatgtttggtatgtaacccatttgaatggtgcatactttgttttataacagtttttaaatatgttatttatttatttatttattttacttatgggttttttgagacagggtctcactctgtcacccaggctggagtgcagtggtgtgatcaccactcattgtaacctcaacctccccagctcaagcgatcctcctgcctcagcccccagagtggctgggactacaggtgtggtcccccatgcccagctaatttttgtatgttttgtagagatggggttttcactttgtaggctcgtctcaaactctgggcagaagcgatctgcccaccttggcctcctaaagttctgggattacaggcgtgagccaccccgtatggcctaaaatatgtttttttaaatgaaattaaaatctgatattgtggaactgccaaaatttcaaacagcacaatttcagttacttccacagtttcaatacactatatcatatggtaatcagtcattaaactccataagacagaataaaatgctacagaaggtgtaagaagggagaggtcaatatggattgtagttagggaaggcgtcacagaagtatgattcttgctgggtcttaaagaaatagtagaaaatgagtaattaatatctatattatatattctagattttccaggacatccttgattttatgatttcttctaaagaaaacttctagaaaaacaagtaaatacacaaatatatttgtatttatctggattgatgacttatctttgctttcaaaatgcagtcctattaaatattggagggacgggctgatcagaaagcataaattaaaacatgtaggaggaatcagagtgctgccaccccatacagaatctttgaggatattagaaaaaggcactccttcctctaggcagtcatagttctgtgccatgccacactcattggtaagcaatgagcaggctggacttctgcccccatttgccccatcaatcgggttttcttttgcagtgaaccctatgaagaatcatacactacagttctagcagggatgaacatggttgagtggagggcagtgagaagagctagagcacaggatgattattatggagtaaagggaaacgactgtggacagttggaacagggtcaggctatggagaccttaacctcaaggcagagggaagaattggctttgattggggatgtgggtgttgttacaacttcttgaacaggggaaagataaaagtggttaagagggaagaaactaaaagtaaagactgtgtttaaaggaaagcctttattataaaaagatagattgtagactcttggtaagtatatctatgttagatatataggatacagggagttatatgtacaaaaaattatcctgcattaagaacaatgagcaaaagacctttgatcatgtcaatatttcccccaaatagcaatcagtgctttgtaggtgtcagaagtcagaggtgtgtgcatttaataatcatgttattaataatgagagcttctatttggagagatgttactgtaagtgaggtgctggaaccagaatgttagatcgaggtttaaaactgttctttctttgccattcctagctgtttctacttgaggaagtcatcttaacttttttgtgttccactgttacatttgtgaaataatgggatttacttcatagagttattgagatgcttaaaagagataatgcacataacactcttagcattactcttggcactcagcaagtgttaattaaatcttatttgctattattattgttgatgttagggttattgttaagaacttgatgccaaccatttgatttctgtccattggaagcatgtttctcacatttaactggtcaattgccaaatctagttctcacagtacaccacatcacataacgttttgccttgtaaattttctatgtgtttattgccatttgtttaagcattcttccctcaaaggaaacttagaagacaagatttgaaactgacatagtgggcatcaaatttagtaagattttcagttttgttgtctgaagaattaaagaaatcgcaaactaaaggcaaaaacatcattttctcagttttatatcttagtgaagtgatgagactcttccaacagtatattctgtgtcagggagtttgcagctgcaatccttaaacttccaaattcttctgtttttctgtcctgccaaatccctctactgcaccccaacctaggactactggaagaatggaaggcacaatggtcatgttagaagagacctgtagctttccctgttttgatgtccagcacctgttttgagccctcagcctaaactttccagtccttgaaaccatgaaagtaggttgaggctcccattcaacctaacggctaggatagccaaaggtgctgagattgctccttctttgtccatggacttttagttttcagagtataagtcagcagggagaagatttttgacctaaaacattgcgttttagagtcagattggtggcagttcctttctgtatttcaaaggatctctctatacatttctatgtgtatattcctctggaagtttggttgtgccctcctgaattccttcgagagtatgtgttcatttatggatttttgtttgtcaatttgttttccttttagtgctgtctcttactgtctttgtaacattttgaaacagtttcaaaattacagaatagtttcaagtatagtacaaatttttatttcctttttctttctttttagacagagtcctgctctattgcccaggctggagtgaagtggcataatcatagctcattgcagcctggaactcctgggctcaagcgatccattcacctcagcctcccatatggctgggactacaggcatgcaccaccatgtccagctaattttttaaaaattttttgtagaaacaaggtctgcccaagctgggaactcctgggctcaagtgatcctcccatctcagccttcctaagtgctgggattacaggcatgagtcacagcaccaggcccgttttgttttttataactattggagaataagttgccaatatgatgccacattaccctcaaatactttaatgtgcattcttcaaacaaagatgttatgctatgtagccatttttctattttaaaaattagtatgaaatattttaggcaacaaaaagctataatatcatttatatgaatatgacataaagtaacataatgaacacatatatgaccatcacccagcttaagaagtaaaacactgccaatgcaaatgaaaccacttatgtaccacttccatggccccgcctccaccatcataaatttggtgtatatcgttcatttctaacctggggttcttaagttagtttcaggtaggtctatgagcaccctcaaattgtatgtagaatttgatgtgtgtctggacttttctggggaaaaggtccatagctttaatgagatttacatggataaatctctggcaaagtaccagatttcgtgcaaaaattgtctacagctagtgcatatacttttctgccactcatttattgcttagctttttgtattctagctttctatctaaccagttcattgagattaatttcttaaagttcacttcctcatcactaaatccaatggcttcttttcatccttatcctcattgaactacctgcagattcttactcttggctcacttgtccttctagattatttcccttcccttagcttctgcactctcttgatattccccagtctcctcatttagaaaatataatgcctaactcatgtggttgtgagaattagctgtaatgttcccaaagcacctgattgttgtatgcgctcaataaatttagctgttattagcaattaatcctcataccactgtgttgcatctcatcatcttccagctctgtattcaagatgttgctaatggacagagatcatggcaaaaagacagccagcaaatactgcctcaatgtcctgcactgctgttcattagcttactagcagccttataactactagtagttccggttagacagtatcagtaatctgtagagtcttcaggagaaaatcatttaggtaaagactagttagcgttaaattatatagagatataaatttaatttcatctcctaaagcttgtaacactattgttggcccggtcacttttaaggacctcagaaagtaaaaatgtagttctcccctgcttgtttattcagctttttgctcattctgctactaaatagactgacaaatgaaagcgtcaacactattatgaaggacacctgcttgtctcaagctgggctggggccagttattctggatggaccattgaagagccatatgacttttaatcactatttacttggagcagaatgagaagaagcatttataccagtcccctgaggctgccctgtcctgaattgtgcctttatcttttcatgtccactattagatgccagtaacagtgacatacttttgttcatattcataatagaatcctacagtattttaaggcacaatcctctgagaagcactaaggcccctactgaggctcaactgcctggaggaaaacagccaagctatctttgcctctgttgggtagagtgcttgaactcctaactgccatccattctttcaggatagggtaggttatgctgtcatagcaaacaactccccaaatctcagtagcttaaaataacctaagtttcttcttgtttatgctacgtgtccataatgagtcacctgggggacattacagagtcctccctctaggacctagatggaccagccaccatctggaacactgcttattatcatggcagaaggaaagagagttctggaggtctcacactgcatcaccaattaaatatgattcctggaaaggatatgacacttttttctcatacaccattggtcagctttgattggggctagttaagggacatcaagtattatcctaccatgtgccctgaaggtggagagctgaaaatgttcagtgagcagccctaatgacccccttgcacacttaatgcaccctgtagaaagacatctctggtctctctagccctgtccctttccctcaaacatcttactaagtcatgtcccttcgatttcactcattcttgttccattgctcctgcagaaaccaaggaacttgtcaatttgttaatttttgtgcatattgcagtctgtattgtttaatgcaagaccatggtctttttttgctcagtttgaattttttctacccctttggtgttctcgcagttgtatgctgtagcgatggacaaagatattagcttagaacaattttgtttcaataaaattatctatttttgacttttcctgccatcttgtgctatttagtgttatggtaatagaatagctataattctgtgaccctttgaccataacaatgagattaaatgatttgcttaagggtatgtaacaaggtagtattaaaggagcctgaactagaactcaggttttctgacttatagactgttttatatttattatgccacgtcctattatttaaaaggttgtataactgacagcagtgtaatttacttccagagacaattggtaacaaaagaatctggtctttaatcttgaatagaaggaatttcccatttaaatgcctccttttgaatattttgatgaattccatgtagtaaaatcagattcctgggattcctatgccaacaagtgtgtattcttgcctgaagcaaacaagtaactggccctgaatggatcaataatataatcctatctataagactcaaataaataagaactttcaccacccctgctgcacctcaatctaaaataaggcattgtatatattgtattattgcaggtttgtttcttactagtatttagaatgtcaggcaatgttccaggattaaaattaaaaatgaaatcaatagcctggtgacagcattatgtttatgctatgtcaacctgcctcagtttggagttactttttatatgatatgctgtggattcttctcatatatagtttactataaagctctacaataattcctcttgtcttaagcaaattttctactagtaagggcttaagagaaggcactagccaatgagattatcactaaaaatcacaaatgataaaggcagcatcttgtatacaaacaaatcttaatacgtaggcacagagttattgtcaagatatcaaccaaatgtcacacgggtggtccagggtatctgcaggtaccaccaacctttgcccaagatgcagtggaaggatacatcattgggtttttatatggattcaataatttaaatttgtagattaagaaaaagaagacttgtcaaagaatgccacacagaaattattagaataatgctctgaattgtgttaatagtttgtcctctggcatcaggtgatctttattactcttctgacactaaaatctgggaatattattttatgtagaagcacaaagctacatatctgaggacaatggccattagtgcaaagtcaaagccagttttacttatggtatatctgccatgatagagacattttccataacattttcttacagagttatttcttgtagttatgtagctatcaggttgatttttttttctcgtggaaaattttgtgcaaaatgaagcagagtaaacagtgttcctatcactgagcttcaacagttatcaacttgtggccaatctgctatgagacctttatgaagattatcataatcgtttgcatttcatgtctgtgaactgttttttaattatttttcactttccagggcaaccacaggtataagtgttaggattttacataaggaaagagaatttattcaaaccacttgaaaataatatccaaagtattcatgccattagcatagctcagccacagatatcaaccaatttcctaagatattcttagaggcagtcagacagcatccttctattaacacctattcgttatgtcaaatcacttagaagctagaaaagcaccattgcttctcaactatggtctgcaacatttgggtgtctgcaaatatgttcttggtgatctaacacttcttaagtttaagaaacattgttttaatatcaaaatggtaacactccttttgagtgttcactcttactcaggttgaattattttaccagtacttgttttttaaaatggcaatgcatcaccaaaacacatttccataatatgatttaactttcttatgtcagtgtttctcaaataggttcatgaatccattctagagttccttagagttctctgaaggatgagaaataccactctaagggaagaatgtagaatatttgataattttatgaaacaaaatacatgtatggtatagaagcctgtttcccaatctaggtaggatgctgtatcgggttttcatactatgtaagtaaaacaatattctctatatatttgtcttaattaataaacattgaaatttacaacagtttatttttctcatgcagagctgaacattaaaaattatacctatattacaaagaacaataatttggtagaaagaaggctccagactactgatacacaggttattcagtggcagtaagaggcttctaaactgacttcagaatagaaacttactaatgctttcagtttctttcagaactgtgaaagaacaagaacatagtttaggccattctatgtacattaattactgctactactaatactactactactaatatgataacagtggcaaaaggatgatgataatactatatgccagttattgtactaagaaccttatttacattttttacttcatcctcaccaccacccaaacgcagtagggtggtaggtttcttcttcatgtgtgcttgtggtgctgctgatatcaggcagagtcctttggtggaagctcctggagtccatctgcttccagttcatatgggcagtttctcctttcccatcttgcagtaggttgctactgctataacattcattcccatattgcagtatcaatacttcatcagcatctaatatttgtacacagttaacacagtctcttttacacatgtgatctcatttgatcctgtcaggaacacaatgaaataagaaaggaaaatagagtattaagtgaactttagatgaggaaatggaggctcaaatatttcttaattcatcaaggtataagtcttcttcatattaccttctactattgttatattgaatcttgactcttctctaagtgtgaaaagtacagtcatctttgtttaccagttaatagggagatagatcttaatcctcattgattgtgcccttctacacccaacaaggtatcaggcacaccataggcacttaaaaaatgcagtaacttggcttgttagattttgtacttaaatggataaagagctaaaagaatacaataaatttcaggtacgtcttgcagcaggttagtatgtggttattcattaagctgtgtaatttctatctaaatcttaggaactccctaatacagaagggccccaaatattttcctaccaatgatcacacactgtctaaaagtaaactattgtagaaacattcctttggccactgatactcctagacattatcctaaattccatacatgtctaggaagtacaagtaatttccacattagtgaaaaatagatttttaaaaacatttttgctgaggatttcactcaggctgtttttaaaaagataaaagatagttttggagcagggaacatgattggggtgagtttacaaggagtgctgtaacaaattgtttattttctactctaataattataactggtgctttttcagcatacactgcttgccagactttatgctataaataatattattattccattttgcaaatgagaaacctgagactcaaaagttaaatagtttgtggagggtcaaaggctagcaagtggcagaactgggatttaaaccaatgtctgactaagcccaaatctcctgtttttaacaataaaccttcactgctttgtcagtgggagtaagaagaagcagcgaggatgaatgggaaagaatatacaaatggttgctaggaagatacccatgccaaacatttacttaagtcacagtggagactacaagtctgtggactcaagtcctatggcagatattttggcttaaatcctcctggaggtaaccacttccctttcattcagcgtcaccagctactttatttttcctgtgcttatttggttaccctctttggtcttcagtgttgttgtttgccaggtgaagcctgaacaatatagtcagatctcctttgcataaaccttatcttcagtatgcagctcaaaatgtgttatttataaattctcatcatttaaggctactagcagcaatgaataattcatagtaagagttgctttttgcaactagtaaattgaaaggttgatcattcttccagagtgaactttaagaaactcattctcacaggctggaatgatgaatgataaggatatttcctttaaacttgtgtttagagtatttatatatattatctgaattgaactacttaccagttatatcagataggtagggattatatacccattttgtagatggaagtgactgaggcttaatgatattaagttattaacttgctaacagataaaataaccatttacaaagccacaagttgaatcagttggtcttcccataattctgcatttcctgttcttcttgcccatcctgtgacctagtacattcctcttcctctaatacaagcttcctgtgtgaaccaaataaataatataggcattacattttacagtagtcagttggggtgattgaagggagagcccatttgggaccagggtaaacaggaaagttttttcggaggaagtgaaatttgagttgccacatgaaacaatggcttactgatctccctcattctttcataaatcctgtaggtaggaaagagatatgctttcctgattccaaattaattcagctatgtgtagatatttgctaatagagaatggtgggtatggagaggatgatatttgtagaccttttaaaagtatgtttacattaaaggaattagttggagagaagagaaatcctacttttctgccaaggtaccttcaaattgcactacctccacaaattgtactatgactgctctggcctccattaatcttacatttatctgaaatcctctaataactatagtgtagactagctgttacaaactggtgatccatgatcctaatatggttcaaagacatgttttgttttcaccagtgctgctgtaggctaggggttggattattttttcttttattctttttgtttttgagacaggatctcactctgttgcccaggctggagtgcagtggcacaaccatggttcactgcagcctcaacttcccaggctcaagtgatccttccacctcagcctcctgagtggctaggtctacaggtgtgcacccccatgctcagcttcttcttctttttttttttttttttgagagagaggcagggtctcgctatgttgccagggctggtcttaaactcctggactcaagcaatcctcccaccttgacctcccaaagtgctgagattacaggcatgagccactgtgtccagccaggggtaggattttatttattttcttggagagaagagcaggattttgaacccacagacttgccataacctctcaacaaggctctccagatgttttggtatggtgaaatacaaccatattgggagatttaggtttcaacagttcatagccaaggacatgtgtggtccattgagcaaaatgaccctcttcttcctcaacacttatgtagaatacacttaggaatggtctcagcattcgcatcttcctaactggagacagaaagtacaaaatggcatcaagctttctgagagattagatcactgccctattatgtttctttctgcctcagagcattttcctctgaaattgattaaagtcttttagttaacaggcagattgaatataatcttttcctcttcaacctattagtcactgactactgagcataactcagaggtttgattagagagttccattaaaaatcatcatacactgcattttccatgtctctatgaatttcgctttgctctgtgcagtggccatagacttaaccctcaacctgcattttgtaacaaatgacatgaggagagaatgaaacctttaattagtgtctcttgaggatgttatggttctgaaaagctctgcaccgatgagaaccaccagatattatccacactgtgtctgaaaaccagtagtaatagatgtttaactcctacattgccttcagtctttgtgactctccagagtaccagggaccaaggctgggaaaccagttctaactggactgtctagaagccaggtaaggccagcacatcctgtttccatcaaagcagtggaaactgactgaatactgctaacacggtgaaaccccgtctctactaaaaatacaaagaattagccggctgtggtggcaggtgtctgtagtcccagctactcaggaggctgaggcaggagaatggcgtgaacctgggaggcagagcttgcagtgagccgagatcgcgccactgcactccagcctgggcgacagagcgagactctgtcagaaaaaataataataataaagaaaagaaaagaaaaaagaaatgcttctgatgacctgtcaggttatcttttccttttggatcctaaagaacatgctgaatcagctcacatggactggaatgacactagacgccagtgttatgattaactctgtaagccagacaatccattggctaaattctatccaacagattcttttcattcttttaaaatatgttaagattaaatctatcatcttcttacacctgaattttggcatcagtaatctcatttggagattcacacttttgtaccctaattttgtgtgggactgtgatgctaactctctagcaccaaataaagcctttttacttcatattactttaactagtgtagcaatcctgctgtgtgcctttaagaatactaaacattaagggtctataacctactcttccaaattccacagcaaggtattaccttcagctttcttcaaacaagagcaaatgagtcaaatgatatagactgtagagcaatgaccaacaagaccttttgaaagaaactcacttcctcacctttgattctttggcatgcataccccaaatcaattacatgggactccaggctgtgttgatttttttatttgtgccaaaattttgttgaattagctggaatatgaaattaaatgtgttttcacctgggtcagggaaatgcctttgttatgcagtggttgttcagctggcaggtgtgtacctgcttggttcattatacactggctgtcagaatcctacctttcccatgttaactaggctcccttttaattcagtgaagttggtgcctgaggtggttgggtaccggaaggcaacagaagagacaaagacattcagttattttgtcaaattggtgggaacatcagtagagtggagtgctagctttacagatctcctacaaacagaaaatggcccctgaaatggcatgtgatgacagcgatgcatccttacctctcacctatgcttcttccttctttatgaattcatggcagtcttggatttagtagaatgcgtctttgcacaataagtttagacttgttaagcgtgagagactatatgttcaaatttccagtgagagggatataggaactccagccagtgaactatactgatgtatctaatatttctgagagaatataaattttggtttgtcctatgttgtgccatattctctaagtaatgtaattacaaagaataggaataaaccagtatttacatataatacttgtttttggaaagctagataagcctataaatcttatgacactatcttttactccttttattgagcaggcattttggatgggtcccagaacacatttcatgcttttctattaaaacaaacacaatgttattcctgtgtgtcttttctttttctctgataaggcttatctcgtgcttctcttcagtaagatctaggtgtgcttttgtgaaaatccctattttagtctgtgaaatgcagcctccagcaaaacaggcaccccatggcctcccttgcatagtttccataaacctttctttcttcttccctctgatcccacccctatcctcaacaccgagcaacccctcccttcaaacagcaccagaggaaaaaaatatgaaactaaagagatgcacttgaaatgcctccaggttttgcaataaagcttaatgttctaagcatcaactttggcatgcacaagcacccgggatttacaagtctcagataattacagttctaagcagttgaagtatatctcactctctgtttttcctgccatataatataatatcctcaatacattaaattaataaatgacctagtaccctcatctaaccctctgttttaaggggacaaaagtaatggaaactcactggataccaactaggggggaacttctggccctgccactgtggccttagggaattcacttcaactcttcttgagttgcttcatttgtaaagtggagataacagtgtctgtcctgttcacctcacatggttctagccaatttcccacatactagtgtatatgtacacaggccccacacaccttgaaaatcatcttatttcagactccctccttccctatcacagacaagacaaaattgcatacctctttctataaactggcatctagaagaaattaaagggtaaacttactatcataatcatcaatcttatctgtcttttccttatatttttaaggtattgtccacttgccaagtgaaaagtagctcttacaaaagacatgatttctgtatgtaattatgatttactggcaagatttttaaaagaagacattaactagtgcctgccttggcctacctctgatcctatcttttttatgcattaattaccatattgaaatgcaatttattcatttttcatttacctttgctgtgcccaaattcttcatctttgagatgttgattgttttaccctttgacaggcatttctgccttcttcctatgagttgatgtctagacagataacagttattaaaagcttgggaaatgattgttatcctaggtaggctggtgcagggtttgttaagaagtaaacattctctgtttaagcttgctttgaaaaatataactcatttgtcactcatttaagatggaaattgagttcttggtgaaaatgtcactcgagaaaatggaagtatggggtacctaagtgtcatgaatggctggagtcttgctggggaagggataaagcaagtctttgggtactctaaaatgttgataatcagttgtcaaagaaatattaattgattgatgatattaatgatgttcttacggccataacattggtgggaaaggggggtaaattatttttaaactgatatacccaatcctacttgcaaagaaattgactagagacaggcttaaagtttgagatttctcaattatgtcatgttttatccagaaaccactattgccaaacagcaaatgttattaatatgtgcttatttaatttagaaaagtgtacatcaatctaacctggaaaacatggtaaaggccatcctttaccatgtcatctaggatattatctatctgttttatatgtctgccttcttatctatatgaaaaaaactcttgagtgcctgaattattttaacatgcccttacctatgcacccactaaactacttctactcagagtaggtgttcaataaatgtgaaagtgattaatcaggtaattcaagaaaacagagtggtgcaaaatcatggaggctaaggagtgataaaagggtccttgacttagtggccatgcaatcatgttttcctctggcttcttcattgttaggcctcctagaccatgtttggagagaatttcactgactccaggacttttggcactactctggagataagaacgttcaggaaacatactgatcactttccaaacaccctcagacctgctgcttaatagccacctgaaaaattctttaattttaatttctcaccttcccggggatctctttcctggatgataggaggaggattccggggaagacttcaagagacaagcctggaatgagctgcttgagagaaacagaagggttgatcctgcccagcttagggaagacattgttggagaagatttcactactcagtcattcaatgaaaaaatgaagaccatccccaacccttgatcatctaataccacttttgtcctacagaggggcatagctttcagcaagacattcgtcatccaacccattctctgcctgatgccttcccattctttcttattacttttgaggggcttaaatttaaaagggtagcataatggagcttttacatagctgacttgtagggtggttgctcttggccatagttgttaggagcacagcaggtaatgttagactgacctgggttctattccagcttttccacttcctagcagtgagactttgcacaagtgactttacctgttcgaacttatccaagcctgaatttttgtactggtaaaataatagtactcacctctcaggattgtttagaggaaaaagtgagataacagttttaaatcacttagcatagtagtcacttgattgttgctactaattgttcccaacatcacagtttcattatgataattattattcgaaataataaataacttcctatctttgtggcctttatgaaaggtctctgggaacctctattggctacagcttagggtgaacagtttgctagattcatctcctcacatactcaggctaagttacttctatccaaggtaattgtcttctacaaatacaacctgcttaaaagttaggcattacaaccacaaagttatcagctatggaggtcaaagatactgaacatttcacttaggctgcatctcttttcacttctgaatctactccttcaattatctagaccggtggttttcaaaacttttgaacagcaacataccccttttgtatccaagtgaagtcatatacagaaccacaacacataaagtatatgaaagtaatattttatttatttatttttttgagacagagtgtcgctcttgttgtccaggctggagtgcaatggcgcaatctcagctcaccacaacctctgcctcccgggttcaagcaattcttctgcctcagcctcctgagtagccgggattataggcatgtgccaccacacctggctaattttgtatttttagtagggacggggtttctccttgttggtcaggttggtctcgaactcccaacttcaggtgatccacccatctcagcctcccaaagtgctgggattacaggcgtgagccaccgtgcctggccatattttattaacatgagttttttcataggttcatatgcatgatatttatatattattttcagtacaaaaaaatgaaactaggtactaagattgacagtcgtagtcttttgttggtgtataattcaacttgatcctgcattttttttctacacagtattgaaaaataaaattcacatctctgtagtaagtgcaaatggctgcagattttttgtcgttttaataagtgatccataagcttaaaagaatagtaacagaaaaaaaattgtgtggactggtaaaagctacttagcttgctttctttctttctttcgttctttctttctttctttctttctttctttctctctttcttttctgaaacaaggtcttgctttgtcacccaggctgaagtgcagtggccttgtctccactcattgcaaacagcaacctctgcctcccaggcccaagcaatccacccacctcagcctccctcccgagtagccgggactataggccatgtgccaccacacttggctaatttttaaattttttatagagatgaattctcaatatattgccaaggctggtcttgaactcctggactcaagcaatcctcccacttcagccttcccaagtgccatgattacaggcatgagccaccccacccggcctacttagcttctctgagccttggttttcctgtttgtaaaatagcaatcacaatagtacctgtctcaggggggtttgagggttaagtaagacattgtatgtaaagtctctaaggaatttggcagacttttcagaatgcttggcacataagcaatcagtaaatactaactggtactaacgcgatcaccaccaccatcagcagcagaatccatttgaattccgtaaatcatacagcaggaaaattggtaagtagattccttagctcatttcatcttcattgtttggtgggaaacactttttcaaatcaatcttacaatattgtaaaatgcttaaccttaaatgcccatctctatcagatactaactctaggtcctgtagtacataatttggaaaccactggtgtagaagtctgaccaagtttctgcaaagattgcctggtagattatgagctctttgagagcaggggctattttatttatctgtgtattctttctgttgcctgagacagcagatgctcaaaaaatatttcttagattatattcaggttcatgtctatagattttaaagaagcttactattacccctaattacctttccatttaaaatcaaattttcttttttgtcttcctctacattttctccaacattactgtaaattttaaaaattatcccctgaatcaagagtcccaaccttttggtggtaaagagttcctcagttcctcagttggaacttccaggttatgaaggccttaatatcctctgaagaaggaaagcaatttagcattaatctctcaagggagaggcaacaaacatttgattttagacttgacagtttctggttataaaagttgcttttagcaaccatataaaagtcattagcagtcataacaaagccgttctattacatataattcgctcccagagttgagatttctggtagtaaaatcacagacgccataaaactgtggcagttggctgttaatacaacctgtccttatgttctagaaggcaaatttagattgccattgcttaaagaattacagaacttctaacttcttgcctccctttcttcctttctttcttccttccttccacaatcattatatcaccatcacccatattagttcttgccctcaagtagttaaaattctagcaaggaagacagacacacacaaaaaaatgccttcacatttattgcatggcagtctaattgaaatatacaaagtatattataaaagcacagagcagtgaagcaccaaaagcagcattagtgggatatcctaaaggatagattggagttatccaggaaaaggggtgaggatggaaagaaagactatttcaggcataggttgcggcattgaggataaagccaggacaagatacacctactatgtacccacaaaaattaaaaagtaaaaagtaaacagggcaagaaccagcatggtgtgtgtggaaaactccaagtagttcattgttagagaggcatgaagtgccaggtagaaactgatgaaaaacaagcctagaataggcaggtaccagatcaaggaggaccttggataacagataacataaaaagcctgaaatgtatcatgtaagtgatagtgatctactagaagattctagtataatggtggataccggaaggttagtagaaatgttgggtgacaattttcctaagaagtctggtaagtaaagggttaagataaggtcaggaggaagggcgaggattgtagaaatggagtggaaaaaacagattcatgggcttggtgcgctggctcacacctataatcccagcactttgggagtccaagttgggaagatggtgtgggtccaggagtttgacaccagcctaggcaacatagtgagacctcttctctacaaaaagttaaaataaaattagccaggcattgtggcatgtgcctgtagtactagctactcaagagtctgaggtgggaagatcacttgagcccaggacgtcaaggctgcagtgatccaagatcacccctctgtgctccagcctgggcaacacagcaagaccctgtctccacaaaaaaagagataaataggaggtaaaattggcaggatttcataatttagtgcacatagggtaagggaaagaagaattattaagaaatgtctatcttaggtttcctgcttagtgatatcaatgacagtggaagatggagaaatttaggaggagttagacttgacatcagctttggatgtaagtttgagaagcctgctctcccttggtccatgcaagaggaattaattataaggcaattggaaatactagttcttggtagaggtttggcccagatatagatatgggaatgatgggcatattgatgatagttgaaactaactataggaatggatgggtttactcaaggagaaaatgtagcatgaaaagaacagagatctgataatggagtccaggcataacatcaacatttaataaatatttcttgagtgcttacaccaaatataggaaagccctgacctaaaggacttcacaacctagttaacaatgatactgaatttctggccgggcacagtggctcatgcctgtaataccagcactttgggaggctgaggcgggcggatcacttgaggtcaggaattcaagaccagcctggccaacacggtgaaaacccatctctactaaaaatacaaaaatcagccaggcctgtaatcccagctactggggaggctgaggtacgggaatcacttgaacccgggaggcagaggttgcagtgagccgagatcatgccactgcattccagcctgggggaaagagggagaactccgcttcaagaaaaaaaaaaacaaaaacaaaaacaaaacaaaacaaaaaaaacccatgatactaaatttcaaactgcttctcaaagtgccaggtttctgaggaggtgcagaggataaggaatagactgagcagtctttcactcatgctttaattagaagagcttcacttctacgtgtgtgtgtgtgtttgtgtttgtgtgtttctttttccattgtatgtttgttttgtgtggggggtagatgaggttgctgttgttaaaaaagagaagtttgacaaccattgtgctaaaaatctgatttaaatatagtaaacaaaatattcaagatgaatacctggctcaaactctacttttggtgaaaagaaagggattaaatcaatttcaaaaattggcaatgatatatggctggtgttcagttctatttcactcacttcagcatcattcaatcatcatacattactaagtatgaaagaatagaggagaaattggaatacatatttgttaggagatgcatgccagatgaggtattgagtacatgaagcaggtaaggtagatttttaaatattttgctactgactttggatatgatgagatgaacagttagaagccattgttctccaatagacttttgccttaatgtatgttttagaataaatttaaccatatcactgatcacatataacacatgaggtgaattgaaaattagcattcctaaaggatgaaatttctacaaatcaaaacttccgcagggatgttggtcaatgcttcttttaaaaccgaggatatagataatttgtatatgggagtgatatcctctgtctcccctccatgccactctaataactaagcaacaagatttatatcatgtttagaatttatcagtagaataaataagtccctggaagtcaaacatataaggataatcaatgttatcatcatctgacaggagagattaataggatttgtatattttaaaagtgaaaagtagtcatttttatttactaaaataatatgtcttagtctgtgttgcactactataacagaacaccacagactgagtaatctacaaaaggcaacaatttatttctcacagtattggaggctgggaagttcaagatcaaggtgcagaaatatgggagttgcactgaggggaaaagcctatagcagttctgctttcaattgttaagacttggaatagcagcaaggttgaggggcacaaagaaggagcctctgaatctaagacccccttattaaatcaggacacgtaaagagagcaaatggtcccagatcgatagtgttcttcccttccagtacaagcagacaagaatattattttaaaatccccaatttagatatacagttttacagcagattatgaagcagatctttgattcacaaatatcaaagatcaccaagtactgaggaagtaagtcaccataaacaggaatcagcaaaaacaataatgagcagatttatatccctaaacgctttatttagaatatttatgtatgatgtgttgaaaaaactagggatatattccaaagatgagctatcaaacaaaaagagacaaatatgagttactagggaaatctgcaaaataactaaatggaacttctagaattgaacaacgcatttattaaaataagaaatgcagtgaatggttaaaaacaaaaataaagagcaaattggggaactagaagaaaaatctagaattatctacaatggggatagaaaaacaagagtagcaatattaaaaaaataagagatgtggagcacagaatgcaaatacttaactcatattgaattagagcgccagaaggagataatagagggaattgaggagaggtattatttgtatacataattatgaagaatatttcagaatttattaaacatatgaatcctcaaattcaggaaatacaacacataccaaaacaagatgagagagagagagagagagagagagagagagagagagagagagagagagctaatctttgcatagatacattgtggtgaaactttaggacaccatcaagaaaaagatcttaacagcagagggacagatcacatagagaagaacaacaattacactgaaagcagatcacttaccgatcgaaatggaatgcaaaatttaatgcaatgcaagaagaaaataacaaatctgctatcttagaggaagatttttaaacacctcattcaattatgaatacttcaagcagataaaaaattagcaaagatatagaatatttgaacaacctaagtacaagcttgatatagtaaatgtttatagaacactatatccaacagttagagaatacatattcttctctagcagacatggaacatacataaaaattgagcatgtattcggccctaaagcaaattacaacagaatttaaagaaatccatacgtctagaacatgttttctaaccatatgacgtcaacaacaaaaagataattttcaaaatccctatgcatttagacattgaaaacacacataatattataataaaaattaaattttagaattgaatgataacaaaaatactatatatcaaaacttgtagcatgtaatgagatttatacatggaaaaatgtatgttattcaattcttataataagaaaatgaagactaaaaattaatgatatagatattcaacttcagaagttagaaaaagaaaaacagaacaaatcctaaaaagttgaagaaaaagttaggaggagaaattaattaaatagaaaacaaacatgcagcggagaggatcattaaagtcaaagttggttttctgaaaagaataataaaactgaaaaacctctggcaaggaaaaaatgtcgcaaataatatcagctattaaaaagaagatataactatatatgctctggatattgaaaatatgataagaggatgttgcaaacaactttatgccattaaattttgcttaaaataaaatagacaaattcttagaagaataacgattaaagaaatgcattctgtagttaaagttatactaatcttttatgaaacagattatctcagtctttatacagattttccagagaatagaaaaagcaggagtaccccaccaacttattccatgagatcagtataactttaaggggaaaaaaagataatggcaaaaagagaaaggaaaattactggccagtttcttttatgaacataaatgtaacaatcctaaacaaaatactaggaaagtaaatccagtaggatataaaaaggaaaatctatcatgacatgttgggttaatctcaggaatgtagcagtggttttaacattaagacatgcataaattcaaattacaatatcaatagattgaaggaggaaaaatatacccatctcagtagagagatttccccacaatagtacatggataactccctggcaattcacttgacctccatagtggatgaaacattttaaaagcaataagctgtgagttttaggtcttggttttcagtttggttactccctgttaacatgtaaatgctgcaaatttttattttagttaaaaataaaacttatgttgcctgattacaaaataatatacctgcattgtagaaaaatggaaaaatgcagaaaagaataaggaagaaaagtaagagtacccacccataattccacaatttttaactttttcagttcatatccttccaatagattttatgtatgtgtatatatttgtattgtaaaggaatgtgaccatactgtacatattatgctatcgtaacctattttcatttatcagtatcatgaatatatttaatataatctccctaacagccttatacatcacctattaatgaccacattttatcatattaaatagatattatattttactcccatattgttacacattttaggttgttttcaacctaagttcttgaaaataatactgtgattaacacttttatagctgaggctttatacttacttattttccttagggaacataactacacataaaattactatgtcaaaggatgtgcacatttttaaggactcaagaaatgactattttcagacacatatctaaatatatatatgaacttaataaatagtgaaggtagcacctcaaatcagcttttttggagatagttgacagtaattttgaaaaagtgaaatctgtattgcatacaagacaccacaatatacatcgggtataataaaatcttaaatgtgagagacaaaaccttgaaaaattctacaagagaacatagagaaatattctcatataagtgtggaatagggaatgactttctaaattctaaggatgttataaagcctgaaaggctaaagaaaattcttgatacctttgaacactttctaaattttttgtgtcaaaaatagttcatggaaaaaatagtaggcaaatgccacatttgggcaaatatttacaacgtgagtaaaagaaaggcttaattcattactatataaagaaatgaaggctatcttttatctgtgcatttatatttaaacacacatacacattcatacacatacacacacacacacacatacatacatacatgggcctttttcaaaaaacagaagataagactttttcttttgtcctttttcacagtgggagctggaaaagagattttctgaaaccagattgtaaattgcaaaaggcatttttctctggggttcaggtgagatgaggcagcagtttcaccctgctgtatttggaccctagatagaaagcatattccttttgtcattgctctgagatgcagctctagccttgagctaagagcaaaaataagtgagctatgaaaatctgggtgtgactactaaaatgctgataatttaatctattacaagcaaaaatgagtaatgagatagtaccatctttatgtgatttatggccaaagtttttaacattgtagtaaagaagtctcttattttaagagactctgaaagagcgaggagagagggaaggaaaggagggagaaagcggaattaaatgacaaacctagagacttctatttcctgggggtagtaacagcaaaatatttgcccagcagtaaagagggcaaagaaatcacttcttagagaattgtctaaagacattttttcctagcaaataataatctctacaaaccttcacctcataataaaggaggctcagtactggccttcggaaaagaaaagttttattggcagccatgtagtctgaatacagagtctgatagaaatcataaagcatgtcttgactggtagtcatgatgacagcaatagaatggctttcaggcactaaaaggaacacagtaaactccctgaaattagccatctccactgtctttttcaatgtgagactgacaatacttagtttacaattcagtgtgatctccatgttaaacaagtaggaaaatcagagtaggctgggaattttggaagcttctgcattatctgggtttatgttcttagatgggcttttctatagtccctttgcattatcaaactttcaaaatggttaataatgaaatatactaggatgaatcattggattattcaatggtgattaaaatctgctgctttccctgggtgtctcatcttccttccagccctagcattttgtgtgttgaaaagaacattgcctgaagggaaaacacttgcacaaacagtacacttggaaacaatccaactaaaaacttggaggcatgttcctgacccaaataggaacatatcctattgtctttttgccccagttttccctgatttgtagtatttaaagagttgctgttttgaagaaattacagtataatttataccaatctagaatgtaaatgtaattggacaatttacaaattagataggtctagtactaatgaaaggcacaaaataaaaaatcttagagtctatttgagaccattaaccagggcagaatctaacatagtacattgaacttagtgggcatttcatacgtgtttgttaaattaaactgaatgagttcgtaaaacagcattctctctattactgccttgctaaaaattcttgcatggtttttcatttatgagaaatccaagttcaactcctcctccccttctgtacccagcagtagtcagcagctttatttcatactacctacttatgtgcctccttcaccatggccagcaaaatagatataatgcctcccaagactttgactggccatactacaaaaaggatgctctcccttcaatttatccaaacacttcacagccttctacttacagcatggattccacatccttctgcttattctgccctgacactctagcgccaaagtatttattgccacttttctcttttgtctttccctcttgtttgactcttaccaagtatacttattggtttctccaaattcgcaattttccagtctttttttctcagattgtcaactcttagaagtgagaagttcctagcatatatctctctgtacaccctacctcttttttctgggttcttaatctagggtcttaatcaaggaaggcgatcccttaacggtctgtggatagaactatatttcaatgtaacctacttttttggtaatcctataggtcctattttagttttgaattttttcattgaagtagaacatccatctagaaaagtgcacgaatcataagtgaatttttgcatgatgaatagaactgtataactaccacccagaacaaggaacaagaatgttaccaccactacagaatatagaacctaacacatcctgacttctgacaccatagatcagttctgtatgttcttgaactttaattagtaggaatcactgttatgtgtttagtttatgcatttaaggaattgttctgagaagatgtccaaaacacacagacacacataaattttaaaaggtacagaaccatggacaaccttttaggctttcccagatctaagatttctgagtttgattctttacataaaatgagggggaatttgcagaagtaattgcaaaagtaaagtgactcagaatcagaatctgataatgcctaaaatagatgggcagtgccaaggatttgcgaagattgattcatcattagtcagttcttgccgtgagggtagggtggggcgagtactttttgacctaccaaatgagctttaactattttaacatatattgctcacggctttgtgttttactctttaacaataattttaagaatagtcagctgttttgtggactaaactctcacatcgtctaacacggggtcttgagtgtaaaaagaactcagtaagtatctgcttaaccattttgtgcttcagtatctgcttggccattttgaaccacaatgtcagctaattagccttttcaaaaaggtacatttttgtctaattggtagtttctaccagacttcaatggaattcctttgcttggtatcagctatagaaagatgtgtttgcactgagggtggacaacactacagcaaggacctacatgtgtaggcagagactgatctaactaatcagtaaaaactgcaaatgagcatcagttccatacaatgtctttgtgatatgattacatcagtatacctacttctccatatgtgtttttttttttttcagggagttagatggctcctctctgcttgttctttttgcctaatatttttgttgtcctgaatatcttccattaattgaatgtcatgtttttattgcttacttgaatgcatacagcattcaagggctgtggcagatgaaaaagaaatagaatgtgctggtctaaatcacctagtaatttaatgactagtttgagaaacaagacataaaaagagataaacaaaagtgcacgcctgactatatttaagcaataaatgataaagacattaacaattgttgattgttaagtgagtaacccacttttggagaggatgaggaaggcctcaaagaacagatcatcaccatcatagctaattcataatttctatgtagaataggcttagggtatagcaatctgagtagaaggaagggttgagggacttgtcctgaaactgcatttacattaacaaacatactgttcttatgtagattatatgcttatttataatggatcttgaagaatacttagggcctggcttagtgaaggagagaaaatcttcttggttgaagagtcccaatctactgtgtgtataactgaatttgtggaagatacgatgtgtaagacaaggtttctgttctcaataatgttgtaacctgcatggagaggcaccatatacatgaatagaaagtcattacaaatagaaataattttgagataaatgtcatttgcaagtgctaagtgatcaaaggagaaagagaggtcagcatttgccttggtggtcagggaagccttcctgggtcaggtgaaactttgagctaggccttgaaagagacatagaaatcgaacaggcagagaaagggagctcatgtcaaattacattgattgtcttccctgacttcacagtcagcactgaatgaactctcttcctgtgactcaccttctgaatgacatcattttataaatcttaggtgcatcatgacttgcgttacttttgaattggaagtgttatctccccaacagcctgtggaatgattatttagcactggcaggtagtgctgcatcatacctttctgttctgaaagagttaacagagcttctataggtatccaaccagaagttcaggcactggacctagactttagataacagaaatgcctttgtgctggagtacacttaatgagagagagcacctctgtcccgacacatttgatgaattcactcaatttgggaaaacccagaccagcgcacagacactaagatgagaaaagaaaaggtttcgttcaccttcttcattccaaggttgtgaattcattcttgggaggccttgaaaagggagggtggaaagagtaggaggaggagtggaggtgggggatacggagtttctgacctgaattccacaacagaggaatgtgtgaacagcaagagacacaggtacaggctagtgctctcacatacctgaggaaaacagattttacccaacttccactctgtccactctgcagacagttgacagtgtggtaaagagaattaataattctatataattattttatttaataacttatttttatttactaattttatttgttattatttattaatatgttttatttcccagagtttagggagggtaccgtgaaaaaggagagagaattaacattttaaaacacttaaacacaaaaaagaaattggctgtagaatgtccaaagtgaacagtttaatgctgtttaaagcggtcctggatcagccatgtttaaatgaggtatatgaagaacaaaaatcatgcttgttctgattcgtcataaaactacaaggtggttaactgggagagaaaatgacgtcagcccctcttattatgaagccctttgggaaagctagttagatgtattttttactatctttgtgagagacccttgggacagaagttagtttcagaaaatgcaaaacatccacagggacaatcatagtacatttgttcacattgccatgcaaactgtaaaggcaaatataaactataattcagggcacatagaaaagttaaggaaacatgggaagttgattctcctgcttaataagactgacaggataaaccaaagtcaaatcatttatattttataagctgtaatgttttctagatattgggttaaggaaaaacatgagatacctgcagttattgcatcaactcattgtaatttttgcttatagttcttttcttttgagattgataaatattatctgtggagatttttcttctcacctaaagaaagttcctttggctgatggggcacatttcacggtatacacaggatctgctgtcatagagaatagccctataaaccctcaaactgataagttatttcaactttcaactgtgagtcagaatctgatgctccagaggtagcatgtggaagatcacacagtaacacatgtttagcttttgatgaagagctttataaactttgctaggaaaaggtactcttgcccttgatctttcagtagtgcattgagtgacaaagacaagcaatagtaaattggttggggtggagtggaatggtgatgacattaatataaaaacaaacttcactgaatactatgtaagtataccatcctagagaaagtggtatatggcaacatagaatctcagaacctgtattcatatggattatttttattattaatttttattgagtaataatatacattcaatgaaatataaaaaaaaaacttaactcttctgcttaatatataaaaccacctagatcaagatatagaacatttccagaattgcaccagacttgcttctaacttctatcaccatagattactttttgactcttcttgaattcataaaaatggaattacatggtgtaaattcttttatgtctagctttttgttatcatctgtaagattgttgctagtagcatttacaattacttttaatgcaaattgatcagtgaacaattcagtgattccacaagtagacgataaatgccttctacatgccagacattgtgctaggtgctaggaattcataacccagttatatatggttcctgccttcaaggaactaacagctttagtggaaaagatgaacaggctaaaaataagaatatagccacaccagctttttttgtgattagtatttacaaaagatacccctcccatctttttattaggtttggtgcaaaagtaattgaagttttcgccattactttttttttctttttctttttcttttattattatactttaagttctggggtacatgtgcagaatgtgcaggtttattacataggtatacatgtgccatggtggtttgctgcacccatcaacccctcatctgcattaggtatttctcctaatgctatccctcccctagacccctacaccccgacaggccccagtgtgtgatgttcccctccctgtgtccatgcactctcatcgttcaactcccgcttatcagcgagaacatgcagtctttggttttctgttcttgtgttagtttgctgagaatgatggtttccagcttcatccatgtccctgcaaaggatatgaactcatccttttttatggctgcatagtattccatggtgtatatgtgccacattttctttatccagtctatcattgatggacatttgggttggttctaagtctttgctattgtgaacagtgccgccataaacatacgtgtgcatgtgtctttatagtagaatgatttataatcctttgggtacatacccaataatgggattgctgtatcaaatggtatttctagttctagatccttgaggaattgccacactgtcttccacaatggttgaactaatttacactcccaccaacagtgtaaaagcgttcctttttctccacatcctctccagtatctgttgtttacttttaaagttactttttattacttttaaaggtgaaaatcacaattacttttgcaccaacctaataatttcaaccatgctatgactttatagttatttggtgacagctttattgagatgtaattcacatactgtaccactgaattcacttatttaaagtgtatagttcaatggtttttagtatattcattggtgtttataactatcaccacagtcaagtttggaacattttcaccagctcaaaaagaaatcccatagctgtgggcaatgatccctctataactttatctccccaaaccccaagcaaccactaatctgctttctgtctctatagatttgcctattctgagcatttcatataaatgaaaccatacagtatgtagtcttttgtaaatggattctttcacttagtataatgttcttagtgttcattaattggtagcatgcatcagtactttattcctttttatggttgaataatattccaatgtataaatataccacattttgtttatccattcatcggttgaaggacattatgattcttttttcactttttggctattatgaataatgttgctatgaatattcatgtacaaattattgtgtggtcatttttttcctcttgagtatatacctagatgtgaaattgataggtcaaatcacaattctacataaactttttaaagagctaccaggctatttttcaaaatggctgcaccattatacattcccatcagcaatatactaaggtttcagtttctcatatctttgtcagcacttgttatctcttttattatagccattgtcttagtctgtttgggttgctgtaacaaaataccataaactgggtggtatataaacaacagaaacttattttacacagttctataggctacaaaattcaagattaaggcatcaacagattcagtgtgtgatgagggcccactttctgtttcatggacagtgttctcactgtgttctcatgtggtggaagcaatgaacaagctttcttgggccccttttataagggcactaataccatttatgaggtttccactctcatgacctaatcacctcctgaaggccctaattcctaatatccttaccttgggggttagaattttagcatgctaattttggggagactcaaagatccaagtcatacacaacatccattctcatgagtgtgaagtggtatctcattgtagtttttatttgcacttccctgatggctaatgatattgagcatcttctcatgtgcttatcagtcacttaaatattttctttggagaacagtttttttttttttcagatcatttgtccatttttaattgggttaattgtctttttgatgtccagttgtgagagttctttatctgttctagattacacgctccttatcagatagatgatttgcaaatattttttcccattgtgtgggttatcttttcaatttcttgatagtgtcttttgaggtatgaaaatgtttaattataataaaatccactctattctttttcttgttgttcatgcttttggagtcatatacaagaatccattgccaaatttgaggtcctaaatatttatatgttttcttctaaaagttttatagttttagcgcttacatttagggctttgatccattttcagttaattattacatattgtgtgatgtagcagtccgagttcattctcttgcatgtggatatccagttgttccacgccatttgttgaaaagacttccttcctcattgaatggtcttggcacctttgttaaaaatcaactgaggcgggagagctggcaagatggccgaacaggaacagctctggtctgtaactcctagcaagattgatgcagaaggcgagtgatttctgcatttccaactgaggtacccggttcatctcattgggactggttggacagtgggtgcagcccatgaagggcgagccaaagcagggtggggcagcgcctcacacaggaagcacaaggggtcgggggatttccctttcttagccacagtaagccatgagagactgtactgggaaaaacagtacaccctggcccagatgcagcacttttcccacagtctttgcaaccagcagaccaggagattccctctggtgcctggctcggggggtcccaaccccacagagcccaacaagctaagatccactggcttgaaattcttgctgctagcacagcagtctgaggtcgactgggagcttggtggggggaggggcttctgccattgccgaggcttgaataggtgattttaccctcacagtgtaaacaaagccaccaggaagttaaaactgggtagagcccaccacagctcagcaaggcctcctgcctctctagattcctcctctctgggcagggtgtctctgaaaaaaaggcagcagccccagtcagggacttatagataaaacccccatctccctgggacagagcacctgggggaaggggcagctgtgggtgcagcttcagcagacttaaacgttcctgcctgtcatctctgaagagagcagcggttctcccagcacagcgtttgtgctctgataagggactgactgcctgctcaagtgggcccttcacccttgtttatcctgactgggagacacctaccagtaggggcagacagacagctcatacaggaaagcgctggatggcatttggctggtgcccctctgtgacgaagcttccagaggaaggaacaccatctccactggtgatacccgggaaaacagggtctggagtggacctccagcaaactccagcagacctgcagcagaggggcctgactattagaaggaaaactaacaaacagaaaggaatagtatcaacatcaacaaaaaggacgtccactcagagaccccatccaaaggtcaccaacatcaaatccacgaagatggagagaaaccagcacaaaaaggctgaaaattccaaaaaccagagtgcctcttctcttccaaaggatcacaatgcctcgccagcaaggaaacaaaactggatggagaatgagtttgatgaactgacagaagtaggcttcagaaggtgggtaataacaaactcctccgagctaaagatgcatgttctaaaccaatgcaaggaagctaagaaccttgaaaaaaggttagacaaattgctaactagaataaccagtttagagaagacataaatgacccaatggagctgaaaaacacaacatgagaactttgtgaagcatacacaagtatcaacagccagaatgatcaagcagaagaaaggatatcagagattgaagatcaactcaatgaaataaagcgagaagaaaagattagagaaaaaaggatgaaaagaaacgaatgaagcctccaagaaatatggaactttgtgaaaagaccaaatctatgtttgattggtgtacctgaaaatgatggggagaatgaaaccaagttggaaaacactcttcaggatattatccaggagaacttccccaacttagcaaggcaggccaacattcaaattcaggaaatacagagaacaccacaaaaatactcctccagaagagcaacctcaagatatataattgtcagattcaccaaggttaaaatgaaggaaaaaatgttaagggcacccagagagaaaggttgggttatccacaaagggaaccccttcagactaaaagtgggtatctctgcagaaaccctacaagccagaagaaagtgaaggccaatattcaacattcttaaagaaaagaattttcaacccagaatttcatatgcagccaaactaagcttcataagtgaaggagaaataaaatcctttacagacaagcaaatgctgagagattttgtcaccaccgggcctgccttacaagagctcctgaaggaagcagtaaacatggaaaggaacaactggtaccagccactggaaaaacataccaaattgtaaagaccatcgacgctgtgaagaaactgcatcaactaatgggcaaaacaaccagctagcatcataacgacaggatcaaattcacgtataatgatattaaccttaaatgtgaactagctaaatgccccaattaaaagacacagactgacaaattggataaagagtcaagacctatcagggtgctatattcaggagacccatcacacatgcaaagacacacataggctcaaaataaagggatggaagaatatttaccaagcaaatggaaagcaaaaaaaaacaaaaacaaaaagcaggggttgcaatcctagtctctgataaaacagactttaaaccaacaaagatcaaaagagagaaagaaggtcattatataatggtaaagggatcaatgcaaaagaagaggtaactatcctaaatatatatgcacccaatacgggagcatccagattcataaagcaagttctttgacacctgcaaagagacttagactcacacacaataatagtgggagactttaacaccccactgtcaatattagacagatcaacaagacagaaaattaacaaggatatccaggacttgaactcagctctgggtcaagtggacctaatagacatctacagaactctccaccccaaatcaacagaatatgtgttcttctcagcaccacatctcacttattctaaaattgactacataattggaagtaaaacactccttagcaaatgcaagagaacggaaatcataacaaaacagtctgtcagaccacaatgcaatcaaattagaactcaggattaagaaacccactcaaaaccacacaattacctggaaactgaacaacctgctcctgaatgactactgggtaaacaacgaaatgaaggcagaaatcaagatgttctttggaaccaatgagaacaaagacacaacataccagaatcactgggacacattaaagcagtgtgtagagggaaatgtatagcactaaatgcccacaagagaaagcaggaaagatctaaaatcgacacactaacatcacaattaaaagaactagagaagcaaaagcaaacaaattcaaaagctagcagaagacaagaaataactaagattagagcagaactgaaggagatagagacacgaaaaacccttcaaaaaatcaatgaatccaggagccagttttttgaaaagatcaacaaaataaatagactgatagccagactaataaagaagagaagagagaagaatcaaatagacgcaataaaaaatgataaaggggatatcaccaacaatcccacagaaatgcaaagtaccgtcagagaatactataaacacttctacacaaataaactagaaaatctagaagaaatggataaattcctggacacatacaccctcccaagactaaaccaggaagaagtcaaatccctgaataaacgaataacaagttctgaaattaaggcagtaattaatagcctaccaaccaaaaaagtccaggaccagacggattcacagccgaattctaccagaggtacaaagaggagctggtaccattccttttgaaactattccaaagaatagaaaaagagggaatcctccctaactcattttatgagcccaacattgtcctgataccaaaacctggcggagacacaacaaaaaaagaaaattttagggcaatatccctgatgaactttgatgcagaaatcctcaataagatactggcaaaccgaatacagcagcacatcaaaaagcttatccaccacgatcaagttggcttcatcctggggatgcaaggctggttcaacatacacaaatcaataaatgtaatccatcacataaacagaaccaatgacaaaaaccacatgattatctcaatagatgcagaaaaggccttcaacaaaattcaacagcccttcacgctaaaaactctcaatgaactaagtattgatggaaactatctcaaaatagtaagagctatttatgacaaacccatagccaatatcatactgaatgggcaaaaactggaagcattgccttttaaaaccagcacaaggcaaggatgtcctatctcaccagccctaatcaacatagtattggaagttctggccagggtaatcaggcaagagaaagaaataaaagatattcaattaggaaaagaggaagtcaaattgtctctgtttgtagatgacatgattgtatatttagaaaaccccataatctcagaccaaaatccccttaagctgataagcaacttcagcaaagtctcaggatacaaaatcaatgtgcaaaaatcacaagcattcctgtacaccaataacagacaaacagagagccaaatcatgagtgaactctcattcacaattactacaaacagaataaaatacctaggaatccaacttaaaagggatatgaaggacctcttcaaggagaactacaaaccactgctcaaggaaataagagaggacacaaagaaatggaaaaacattccatgttcatggataggaagaatcaatattgtgaaaatggccatactgcccaaagtaatttatagattcagtgctatccccatcaagctaccattgactttcttcacggaattggaaaaaactacttcaaatttcatatggaaacagaaaagagtccacatagccaagaaaatcctaagcaaaaagaacaaagcttggaggcctcatgctgcctgacttcaaactatactacaaggctacagtaacaaaaacagcatggtaatggtaccaaaatatatatagaccaatggaacagaacagaggcctcagaaataacaccacatatctacaagcatctgatctttgacaaaccagacaaaagcaagcaatggggaaaggattccttatttaataaatggtgttgggagagctgtctagccatatgcagagagcagaaactggatcccttccttacaccttatacaaaaattaactcaagatggattaatgacttaagcataagacctaaaaccataaaaaccctagaagaaagcctaagcaataccattcagagcataggcatgggcaaacacttcatgactaaaacaccaaaagcaatggcaacaaaagccaaaatagacaaatgggatctaattaaactaaagagcttctgcacagcaaaagaaactatcatcacagttaccaggcaacctacagaatgggagaaaatttttgtgatctatccatctgacaaagggctaatatccagaatctacaaagaacgtaaacaattttacaagaaaaaaaaacccatcaaaacgtgggcgaacgatatgaacattcacttctcaaaagaagacgtttatgcagccaacaaatgtatggaaaaattgctcatcatcactggtcattagagaaaggcaaatcaaaaccacaatgaggtaccatctcacgccagttagaatggtgatcattaaaaagtcaggaaacaacaaatgctggaaaggatgtggagaactaggaatgcttttacactgttggtgggagtgtaaattagttcaaccattgtggaagacagtgtggctattcctcagggatctagaactagaaataccatttgacccaggaatcccattgctgggtatatacacaaaggattataaatcattctactataaagagacatgcacatgtatgtttattgtggcactgttcacaatagcaaagacttggaaccaacccaaatgcccatcaatgatagactggataaagaaaatgtggcacatataccccatggaatactatgcagccataaaaaaagcatgagttcatgtcctttgcagggacatggatgaagctggaaaccatcattctgaggaaactatcacaaggacagaaaaccaaacactgcatgttctcactcataagtgggagttgaacaataagaacacatggacacagggaggggaacatcacacactggggccttttgggggggtaggggtctaggggagagatagcattaggagaaatacctaatgtagatgaggggttgatgggtgcagcaaaccaccatggcacatgtgtacctatgtaacaaacctgcatgttctgcacatgtatcccagaacttaaagtataatttaaaaaaagaaacaaaaataaaatcaattgaccaagatgtatgggtttatgtcttaagtctcaattctatttcattgatctatatctctgtccttacagtggtaccatactgtcctgattattgttgctttgaagtaagttttgaaaggaggaaatgtgaatcctccagttttattcttatttttcaaaattgatttggttaatctggaaaccaaccaattccatggaatttgaatcagctgatcaatttctacaaagaagccatctgggattctaatagggattttattgaatctataaatcagtttgagggagtattgccatcttaaagattttgccttctgatctatgaacatagtcgtgttttttatttagattttctttaatatctttttaaaaatgttttgtagttttccaactaagttttgccttttttgtcaaagtaattcctatatatttaattctttttgatagtactgtaaatgtaattacttttcgtaatttcatttttaaattgttcattaccagtgtacagaagtactatcaaaaaggcaaaacttagttggaaaactacaaaacatttttcccattctatacacatactatatttcccattcatatagtatatatgactaggaaaaaaaatagtatatataagaattggtactatctgaggtttcaggcatccaactggggtcttggaaaataccacccatcccccacagataaggcggtctactgcatacaaagtgatggcatgctaactgtgacatttgatccttccaaaaatacactgagtaattgggatcattgccacttttacagccagcaaagttaagtcaagcaggggagcaaagtcttggtgtaagttttgaaaacattctgaagtccaatattttttccctttagattccccatgtgaccttagacaagttatttgactctccaaatcttatttcctcatcttaaaatgagagcagttgagagtcgacatttacgtttcctttattctctaatattccattatttttgaattatcctcttttgaggtgtccttctttctttccatatttcaaaaacaattatgttctctctcatgcctaccaagtaggattctattccctcagaatggaaaagcttgccactatgagccagatccccaacacagtgtgtatccctctcatgcaatagtctccaaacaaaccagtttacattagtaactgcacgtaaactggaattaactcagagatttcccctacgtgcttcccaggtgttttcctcattgtttgagataaaacagtcattcatatttgcctgtttcttgaatctgtgcctacattcattgccttgcccctgccaagttgaattttgcctaaggaaaatgatgtttggtttttcacagtaaatcagatggatggatggagagttaagatgaatagctggaaagatgaatggatggatgagaagatcaaagaatggctggagggccagaagaatgaggagatagatgtctgggtggatgggtagaggaataagtgaatgggtaagtggctaagtggttaaaagtatagaggataaaaaggatagagaaatggataaatgggtagagaaatggataaatgggtagatgaatggatgagtaggtgggtaggtgggtaactggatgaatgaatgcatagacaggtaaatcaatatgtaaatataagtaaccaaacttagatgcaataaaaaatacatactcagtcccatcttcaccactttgcactgtgatttgggaagcccccagtttgggccagaatagatttatcacatggttgttccagaggaacttaactttctgtatttttccaacattgagatccacatcaatatcatgcatgtgacttgcatctggtttgagggatcctttgaaaatctcatattgttttgagtttccattacttccatacaaagcaatcctgatgtacccactcactttcttttttccagacagtgtgactgataccttatatctccaactagtaaagttaccactctctcctgtgttgaggaaaaatatttgttcaacggcactggttttccccttaaattggtcagcatagtgccccattttggggcatccttcagctggacaagggaaacagctattcgcctcgcattcgttgcagagttacatctctttgttctgttctaagccacaggaatgcaaaaacacccaaaacagggccaccaacatcttcctcaggcttctggggtaacctacctcccaaaactcattgtaggaggcacagggatagcccaggaagccatcagggttgaggatgctgcttgagtcagggttttacttcttatagcttggtgctctgttgctagatgcatatatgtgtgtaattgttatgtctttctgatgggttgaccctttcatcatgataaaatgtccctatttttctctagcaacatattttgttttaaagtcaattatgtctgattttatttttatttaaagtgtgactctttatacttaaattataactctgtagttgggtcagatgggtcttgctttttattcattctgacagtctctgcatttaaattgcagtgattaatcaatttacattaaatgtaatggttcttatcgtttaagtgtactaacttgctatttcttttatatttctctttgttcctttgttcttttttcttgcctttttggaattaatcaaaagggtttattattattattattattattattattattattattatttttggcgggggaatggagacagggtctcactctgtcgcccagactggagtacagtggcatgatctccgctcaccgcaacctctgcctcctgggttcaagcgattctcctgcctcagcctcccgagtagctgggatttcaggcacgcaccactaccgcccagctaatttttgtatttttagtagaggcggggtttcaccatgttggccaggctggtcttgaattcctgacctcaaatgatccacccacctctgcctgccaaagtgctgggtttacaagcgtgagccaccgtgcctggcctagtttttcattttatctcatttcaattttggatttttagctatgtgtcttggttgttgtttggggattggagggaggttttttgtagtgattgttctagggattacaattaatttatcacagtatacacattcatggctatggaggtgtggaataatctgacatatttggaaagtgagatgttctttgtgcctggatcttagagattaatgtaggggttaatgtaaccattaatcagactagagtgatgataatattttcatttattaagtacttattatgtgccaggcactgtggtaagtgttttatacatattcaattaaatcatttcatcttcacaactacccagtgggtagatacgagaaaactaaggcttggtaactttccaaaggtcacatagcaagtaagagacaaatccaggatgaaaatcctagcagacataatgaaggtgaaaagaaaatggtatatttgtattggggtgcatttgaaaatttctgaggaaagacaagatgtgagcagacttatattttaacacaactctgcctgctgaattggaaataattagagggcaccaaaacttggactgagataccagtgaagatactgctgttagagtctaggtgagaaataatgagtgcctaaaataggaaaataaaaaagagggtaaaaaagaaaattaaaattcaagagaaaaatcaatatgagctgagatgttagtcataaagagagagagataggaagaaaatagagaatgaaaagtccttattttgtgctaagcttaggaagaaagagtagattcaaatatcggttattactaataccaatatcatcagttgcatatgattttatttgttagactgtatactaatgctattggcattaataacattattgttgttgttgttaatgaaactttcattaccaataactttttaaattattattataatgattaacatttaccaagtgttacctatgtgctaggtactattctaattgctttgtttatatgtattacctcatttaattcccataatagccttgtgagttaggtactaatattccattttgcaattgtggaagctgaggtccaaggaggttaagtaactgcccaaaggcacatagctaataaatagtacagccaaatctagtctgaaagtattgatataattatttggcctgtacaatgcttctttttttaaaaaaatgttaacttgttttcaacatgtagacatcaacataacttaaattttttaaagatacatatttctcagcttcttttaaagcagtatgctagaatctggctatactgggtctgctttcccatatggcagtgttcagctggacttaatgagctgcccctttagacagatcataagctctcaagtagaactcagtgcccatccatcctgcttaccttatttatgttacctgactatcccttttgggatgagttacaaaccttaaggcacaagaatacctgcagttctcaggaattgggggctaagacaaacaaatagaagataataaataagataacctataatttaataatacagtcatggttgagggcacaatattttaaagggacagtgacgaactgggaatttttatagaagatggcttacattgaagagtagatgcaaatagaaccatgaaggtgggcttgatccactttataggtaataatactctaataataataatgctcactatgtctcaggcattgtaacaaatgctttacatgcatatatctctttgaatcctttcaacaaccctatggagtatattattatcctctttttacagatgaggaaaatgaggcccatatcactttggtaatttgtgcaagaatacacagctactttttgattcaatgactctgggcttctgattctggctcagagccctttatagtgtagtttcagaaagtgctgaaaatcttcatagtttccatattctctaagaagaatttgtaaactgagtaagtaacagtgttgcagagaacttacaagtatgatttgcctcaggtgttccatagttgcctctaaatttctttcagggaactgttgaataaaagatgagacagatcagtagtggtgaaaaagatcccaaaagttaatcaataccacaggttgttctggattgaaaaggatgtcactgccttatggaaaagctcctaggttcaatgtgtatccagtttcctgtctattttaaagctcagtaaacaacgcgtaggccaatggagacttcactgttcactctggccagtgcatgacctattcctccagccctgaagaaatccagtttccaaaaagtgattcagttaaacttttttttcttaaatggcaattcagctatttatgaactagtttactgagataatccccttaagctgtagaggacaatttatttaggaaagactgtcaacattcttgattcacaaaagtaaaaaataggcttcttaaatttagtttgtgttaattaaatatactatctccattagcttgtgtttttaaaatagtagattgacagcattacctggttgaatgagtataaagcaaaaactctcctgctgaagaatctcagtaaatgcataaacccaggagcttctatgctgactctttagcatgttggattatttagcagattcttggaattattatcaaatattggcggcagagagatttgtaggacagaccaccaggtccagcctgatcattggcaataatgaagagagaagacacaaacagggtcaggggcagggcaaagagaagacttggggtctccaactgctggagggatattcttctctctgtaccatccagccttgagagctttttaaaaatattaacttattttaaatgtgagattgagacaaatctagtatgtttcacctgtatttgtcataatactactagtatgtctccatcagctgtgaagtatactgcaattaacatattaataataaaatagtaacatttgtggattttttgatataaataaagcagagtcaagattatcccttaaatcagtcagagtctcagcaggaagtggatagtacactaaaaagactaatttagaagagtttaggtaaggtagttcacacctgtaatcccagcactttggcaggcaaaggaaggaagactgtttgaagtccaggagcttgggactagccctggcaacatagcaagccccttctctacaaaaaaaaaaaaaaaaaaaaaaagttttttaattagttgagagtggtggtgtacaactgtagtcccatgtagtcccagctactcaagagactgaggtgggaggatagcttgatcccaggaggttgcggctgcagtgagctatgattgcgccactgcactccagtgtgggcaacagagcgaggtcctgtctcaaaaataaaaataaaggaatttaacgaagtgactattcacaaaagtgtgggcattctccctggacataaaacagggtgaaaaaaggtggagcattgagatcaaacgggcaaacataatacctaacacatcctttaacaatatgttaggccaattgcagtaattttttaaaatccaaaatattgggagtttaatataataaagatccaatgtgggtccatggaggaaataggtgactgtgtcccatgcagtcattcagaaacccaagctctttccatgaactttctgccatggcctaaggcaggagtcagcaaacttttctgtaaagggccaagtagtaaatactttggctttgtgcgtctgcctctgtcacaactacttatctctgttgttgagcacaaaaacagccatagacaatacttaaaggaacaggtataactgtgttccaataaaattttatttacaaaaataggtagcatcaagatttggcccagggggccatagtttgccaatccaggcctaaggcatcataatcttccatggaatcctttacatctgagggcagataagaaaaaagagagtatgtggaagattacatgaatagtttttatggatcatacctggaagtggcatacaagaatcctacccgtatttcattgtccagaactgagtcatgtggctgcatctaacgtcaagtgaagctggcgaatataatctatgtgcccagaaagatgaaaaaactctggcaaacatctggccagcttctatagcttaaaatttcctctaatttccttgctgtaagccaacttttcctaaagggtatctcatatatacaatacatgtactggagactttttagggaaaaaatgggttctgagaccatatatgattagaaataatatttataggttctttcttcatattgagattcacagtgcgtattaacatatcaaaggttctgaaaagtcttatagtgtgaaacaaagaaacaaacaaaaagctccctaaaatgttggtgaacactattttataataaagttactgatgctcacttgcatttggagtgggagatgaagggagtagagtccaggcagtgctggggaaattatttatgatcccatatatttgcattggaatttcttgtgcataaaaactttttaaaatataaagccactacatgaaaacattttttttttaaatttcttcacatccttacctaccacctacacaaatggactgcctactttaatttctgaatattgttcatatgcctatttctgactagaaagttgagttagagctttttttttttttttttttttttttttgagacggagtcttgctctgtcgcccaggctggagtgcagtggcgtgatctcggctcactgcaagctccgcctcccgggttcacaccattctcctgcctcagcctcgctagtagctaggactacaggtgtgcatcaccaggcacaccaccatgcccatctaattttttggtttttttagtagagacggggtttcaccatgttagccaggatggtctcgatctcctgacctcgtgattcgcctgcctcggcctcccaaatgctgggattacaggcgtgagccaccgcgcccggccgagttacagctttttaaattctcctcctccccttaactattattaagaaacacccaagaatgatcaataaatacttaaaaaaaaaaaaaaaagaaattttttttctgtacagagaaagttgaaacatccatttccatgtttgggatgagagaagattatttatgttattggagaacagaagattatagactgtcaataaacttttacttttaaatgaataaataatacatgacaattcttttcacataaaaaaaaaaaagaaagaggaagacctctttgcagttgagataagaggaaggcatctgtctcctgctcatccgtgggcaatggaatgtctcagtgtaaagcccaattgtatattccatctactgagataggggaaaaccgccttagggctggaggtgggacatgctggcagcaatactgctctttaatgcattgagatgtttatgtatatgcacatcaaaatcacagcacttttttctttaccttgtttatgatgcagagacctttgttcacgcgttttcttactgaccttctctccactattaccctattgtcttgccacatccccctctccgggaaacgcccgataatgatcaacaaatactaagggaactcagaggccgcggccggcgcgggtcccccttatgctgaacgctggtcccctgggcccatttttctttctctacactttttctctgtgtctgtttcttttccaagtctctcattccacctaaggagaaacacccacaggtgtggaggggcaacccagcccttcaaatttacatagagttaaatatacacatattactctgaagataaaccttaggtgtaagaaaagtattaagtgagagtgtttgtgtgagtatgagtttgtacatattttcagaaaaaaagagcaataattgcaacaaaacaaataaataagctgactaatagaaaactaaacacctcaaaaatgctgaaagcaaatctatactttttgttttgtcttgaattcctttattcattttattttattttattttattttatttttttgagacagagtttcactcctgttgcccaggctggagtgcaatggcacgatcttggctcactgcaacctccaccttttgggttcaagtgattctcctgcctcagcctcccagtagctgggactacaggcaggtgccaccatgcccagttaaattttttttttttttgtatttttggtggagactgggttttaccatgttggccaggctggtcttgcattcctgatctcaaatgatccatccacctcggcctcccaaagtgatgggattacaggtgtgacctgccacattcagcgtgtcttgaatttattactgtaaaatgttatggcttatggttcagattctccctagaatctgcctattaaagcacaggcatctttgtcttcagaaataacactcttgagtagaacaataaaagccctcttcaaacagaaaaaaataatcatttttaacacttattttaatgaaaatttaaccaacattgagtaattggatatatttttattgttttatgtgtgtgtgaatgtataaaatggtacatacaggaaaaataatttaagccagaaaaaagatgtaagttaatatttgtaatgaatgaaactggagagtagttaattattagttgcagataatatctttgtttatgtagataacaaaaggagcagaaagactattttaaaagtttatttaggtgggtaggcaacattttaagataataccctggattaccagtctgttgcacacctgctgtgtcatactttcctcttcagtgaaaaaaaaatgtgtgactgtgttgggaaatcactcatgaaattaggttactcatctgttgactttgtgtttatcaaaacggagattattctgattgtgctaaacttaatcacaggtgcttctaagagaaagagacacatagaaaaaaaaaaaaaaaaagatttagcctagggtttggagtatggttgaggctgcagctgggaggcaaatggctccagacgtgagaactgcaaatgttagaaatcaggtagagagctgacctacatattaagattccaggagaaaaggtagtttggaatagataaggacacctcttttattcagaatccaaaaagagtattaaaaacaagaggttggtagcattttccaagaatcccagcatcatgtttccaaactctcattgattctgattatagaagggttttccccaggtaactcagaaaaaaatattttaggataatactctttctttcatcttaagtcaaataagtaaaaattcctgagaccagcaatttgcatgaggtaggttgattgttatacagacccacacaggccagtgtctttcattatatactacatttggaaaaaataaccttaattcctgagataagcaccatcaaaatgattgaaaaatctacagtccaaatcattcatttcttaatcccaagagatgctcttccccttcaacctagctgagtgaagaaggcacttccctggagatggcaattagattagaaagcctggagccttccccttgattacttaaaatgatcctaagtccttgagctagcttagatggatgttaatggtttccaggggacagacaacttagaaaagacaacttcattgcacttctcttttccgtttacttacttaacgccttgaaaatacttttctaaattttattaaagagactgcaagcccttaaaaatgaatcagagcgctctctcctgatttcaaatagctgaatgaaattctgccaagtgccgataacaacaatccttctgtgtcatggatggtcaaccctgactcccacacccttaaagcaagtgtgaagtctaatcagtataatgacaaagtagttattaacattttgaaaaaccaccctaaattgctgtacttctatgagttatattggtagattctaactctttttctttggccagattgcttgtctagggactttgtgattaaaaaggcaggagattatttacgaaatgaacaaatgaggtggttgtttactttaccaaagaatttactcactcctgagaaccttctctgtgcattgaaaataggacgtgattgacagccccttttaaattacctttgaatactaaaatgtcagccaaacctgtattttaggttcaattctgttagtggtttatgagcattaaaaaatgtgttaaatatttcttccgtggttattatattccttggacagctttaggcccccacatgtctcttagcctgccttagtttccccattgttcaagtgggataataatactttttttaccccaaagaggtgatttgaaaattaagtggtgaatgagctgctttgaagatgaactgccatgttttcctggttcctttgcttctagattggctcattttgctacggcaaaaatgttgtaaatatgccatgctcagttttcacgttagcatacactcttgaaaacaaaatttgcttaaaatattttcccacttctctgcctttggtttgtggggctttgggttaattagcatcctccagctcttatctaagcctttgctaagggctaattaaccagtgtatactttgtcaaattctaatgagaactgataaggagtctttttagcctgttttattttcttttgggggaggatatattcttttagcaaacatttgtgttttttgcaaggagacaatgtttgttaatttaaccaatgtttactaagcatctttaaggccttttgggggacacaaatgaatataaaaggaaaacaattttaaaggagcaaaggatctgaggaagttaagctagttatagaaatctgtaagccacaaacattatgcatatgtgtgaagagactctagagtaaatgagcactgaagtgggcttaaggtgacaggcttgactgatgtagaggccctgctttggatagtaatgaacaagatgaagtgtgtaggatggactgggggctggggagatataacaggcttaatcaaggaaggagagagacataatcagggatgggggtggagtaacagggacagggagactggagggaaaatagtattgcactgggattcaggagacctgggtttagtcctgatgcaaacttcaccattctgtagctctttgacctttggcttgtcagttcccctcttcaaactttaggtcacgccctccacaattcagggtcagcactatgcaaaagatttccaaggaaggcattctgggatttgaaaacttcctcaagagaagtgagctttaaattttaaattcagtcaagctctcaagttttcagtagacctcacggctgaaaagaaagagattacagaagagagggatggaccttatgaaggcccctttatttgtcttttttccctttgtgtgaagaatcgggtcttgctatgttgcccaagctggtcttgaactactgggctcaagcgatcctcctgcctatgcctccctaagagctgagattacaggcatgagccaccgtgcctggctgaaggcccatttattaaggcccagaaccagcataaggaaaagccatatgaagaaaaaaatatatgagacagaaaattttgtatcaaatgcattagatagatatgtggaaaagagttatcatgtagtagaaaaaaacacaagctttggggttgaatagacctgtctaaggtatgaatccacttacccacttagttgtgattgtgatttcaagcaagttccttaacctctctgaacaagaattttctaattattaaagtggaataataatactacatactaaatagggttgatttgaagacaaaatgaattaatctgagcaaagcacatgtggcttaccatagcactcaataaatggtagtcattcatagcttccaattactgtagccctcgtttgcctggactgttttgctagacaaattagcctacacaaaggggactctttagctcctccttagagactgagcttttatcatcttgaaatcgaggtcttccatgtcagtttacacaacagcaaccccctccctctgacactcttagacttcctcaacatccctcccagaaaactggttttgaggcatctctgctattttcaatttgtcagtatctgaatctgcctggtcccaatcagtctagatgtggagagttggactgcattcttattttccaagtgcctttgattttattcttgtgaatgtagagttttcacagagcactgaggaaggcaaacagcccaatcacccttttcttcattcacaggggcttattgggggcctctgctagggtaaagatttcagttctgttactcagatatgttaggcaaagatctgtttggtgattagttttgattagataggagtttcacacaaaagggggcttgtgcatttattgtagttactgagattaagggagctaggtactgctgtgggaagctgccccattgaaaagaggggccattctttgatgttgagaggcccggccttccccagtgagaaaaatgactgttagtctccctgattttgcaaagcacttgaaaagcgctttaaccaactccttagctttcataatgcttgtttacaggtaggggtttaagtctgtgcaggggaagcaaaatggagatttcatttttcttgtttcccatgatctcagcggcagctcaacttttttcttcctgcttttattctttctcttttttccatcttttacacttaatcacacactcttctttcccaggtcctattcaggtcttttttttttttttttttttccttcatattggacctctgtcatgctacattgatccaacccatacctctccagagcactcacacactttatttatgtatttgtttgtttgtttgtttattgagaaagggtcttgctctgtcacccaagctggagtgcagtggcacaatcatgggtcactgccacctcgacctcctgggcccaagcaatcctcccacctcagccttccaagtagctggaactacaggcatgcacaaccacactggctaatatttaaaagagttttttttttttttttttttttatagagacagagtatttccatgttacccaggctgatctcaaactcctggtctcactcaagtgaaaattaaagtatatacagttgtgtttagaatttttttaatgttttaataagctacaatacatatataagttctaatatatatgtgcaaatgtttgctggtggaatatgcaagaaactggttatcaaaggtttcttctgggctgtcagctagtgggagacttttaatttttgttttgtacttttttgtacagtttgaattttcttaccatgttcatatattgcttttttaaaggccaaagggggtttctggaagatgaattatcattcttttttttctttttgatgcttttctatattaaaaaaaacacaatagatgttattttaaaaaggaaatcaataagacagaccctgtctcagtagagttcgtagtgaatgtgataaaccagagaacagatgctttactagatccaagaatagaggtttgaacaaagttctgaggaaagcatggaggagaaactggttccatttctccaaaggtatcaggaaaatgtcacagaagaggtgacatttgagctaagtcttggtagagcacaggacattggtgggcaacattccaggaagaatggatggaccatacaaaggcacagtggtgtggaaggccatcgtttattcaaagagtgtttattgaggttgaagacacattaatatgtgtctgcaggtgattatgtaagggagattggtaagtaataacaacacatactatgtgctggacgctgggctaggagctttaatttctccacctctaatccttagaagggtgttcaggaatctctggccttaagaacagcagcagtagtagagacagcagcagcccagagtttggatgtggaccaaatcgggttgcaattatagcaatttggtctatctaatccttccttaaagcactgtgttgaggttttagagaagctatatataatgtccttgatgtatagtcagacctcaaaaaagttagctgttatctcatcattaccattccttttctccaaactccagcttagtgctgcatatacagtagcaaatccctacgactgaatgattgatgagagagttgattaaggtatatggtaggacatgatatgacagggatctcacctcctatttctccatccggtccttagtaccaagaagtcagaacattttgcctaagagaacctagtacataccatctctgaatttgtgaggaggcagagctccaggtacttgaagaaaataaagggagttgtatattctctctgtgaagatgatcacccccaaggtttttagactacatggatgacagaataaaaagtaaaaatgaaaaaccatcaacacaaaccaaatttaagataatgtctcttagcttcaataaacaaggcaggataatgctaacaccaacactgaagcaggaagaccctgaaacatggctgctttgtagtgtcatgaaaattaaaatgggagttggaagttcccactttcatcttttagctgtgtgatcttcaacaatgttatttcccccttctggggaaatggtccctctttgttatgggagttaagattggattagagttagagtcagcaaactgcagccaaatccagtcggccacctgtttttataaataaagttttattggaacacagccactctattcatttaactaatatctgtggttgctttccccctgcaacagcagagttgagaagttgtgacaaagactatattgcctgcaaagacaaaaacatttactgtttggccctttacagaaatagtttgctaacctctgattgatgtgtaaggtcccttcctcctctgacaatctgtgatatgcgtactgctaaagacttaatgtgtcagaccatttgcaatccttaggttcacctggaaacctttcatgaaatttggaaatactccagaggtcccacctgtatgtttattattttgtttttgtttattattaatccaaaaacgttttaaggatttgctgtttgctaggtacagtgatagttctgggttgcaatggggagcaaaccagacatgatcctagcagtcatggagcttagagtcttctggaggagacagtttttaacagaacctcctcatatctttcactttggaaagcaaagccaacaaattatttcatggtaggttgaactgtccaggtttacatttgggtttatgaacacctttattcattcatttattagtttattctttcattcattcaatatatacagtcatgcactacataatgacattttggtcaacagtgaaccacatgtacgatggtagtcctataagattataatggagctgaaaatttcctgttgcctagtgacattatacccattgtaacatcatagcagaacacattctttatgtgttggtcatgatgttggtgtaaacaaagctattgcactgccagttgtataaaagtataacacatataattatgtacagccatgatacttggtaataattataaactactattactggttttcgtatttactatactattatcattattgtaaagtgtactccatctacttctgaaacaaaaaagtttactgtaaaacagcctctgacaggtccttcagaaagtgttctaggagaaggcattgttatcataggaggtgatagctccatgtgtgttattgcccccaaacacccactaggatgagatgtggaggtggaagaaagtgatgttgatgatcctgaccctgtgtaagcctaggctaatgtgtgtgtttgtgcctgtgtttttaacagaaaattttaaaaattaacaaaataaaatattttagcaataaaaaaacttatagaataatataaagaaaaacatatttttgtacagctgtacagtgtgtgttttaagctaagtgttactataaaatattcaaaagtctaaaatattagaattatataaagtaaaatagagtaagataaagttaacttattattgaagaaagaaaattattttatacagttagagtagcctaagtgtacagttatagccattgtaacatcatagcagtggtgtagtgtttatgaagcctacagtagtgtactgtaataccctaggccctcacattcactcaccactcacttacccactcacccagaacaacttctagtcctgcaagctccattcatggtaagtgccctagacagggatataattttttaaatcttttataccatatttttacagtgccttttctaggttttgatatgtttggataacaaatacttacattgttttataattgcctgcagaattcacttactgctatatgggtttgtagcctaggagtaataggctatatcatatagcctaggtatatagatagtaagctataccatttaggtttgtataaacctaaatgaaattgcctaacaacacatttctcagaaggcaccatggtggttaagagacatatgactatatatataaagtacttatgtgctaggtgctgggctgggctagatggaaaaatatactaatgaaaaaaaaaaacaaagtttctgttctcatggaccttagatacatattaaattttaaaatgacaaataagtatataattatcaactgttataaatgctctgaagaaaaggagcatggtcacatggcaacaaataacaagggaataagatctagactgatgacatcagggagaagcattccagctaatatccgaaggatgtgtaggaccagtaaatcgagatagtagtactgataattgtttcctttcttggttgatgaaaatggagcttggaaacatgtaaattagtattttttcaatctgaaggttgaaacccattttgaaaaaatcaattatatggatcctgaccaacatttgtttcctatgcaatagaatggaatggacaagattgaaatagaatagaatgaaaatttccagttgttttctggaaataattgttttgtaaaactatgtaaaatgcatttcctctcatcgtgggcctcagtccagaaagatcactgacccaaaagatctgctttggctctatataattacaatttgtcacatagataacagcttctccaggttcctgtctttaagacacgagggtatgttctgcaggtacttccaagcttacctttgtgctcttttcagagtaagtgtaagagtgagtgagagaacaccagccaccatttactgagcacctactctgggaccagacagtgcacaaagtaccttttgtacattataccatttaatcctcacagtaatcctatgaaataggcacaattcatcatctcattatcagataatgatatttgaggttcagagaagttaaggcactagcccaaggccacacagccagtatatttttttgcctacataattagtaatgaaataaacacaaactcaatttgatattctctgaactttcatcagatttgatagaaattaatcaggtttgaaacactggttgagaacctgctagatttctaacacttgtttcatgatctgagttccgtagagcttcaaattaagtctatccctcttctcctttctagaaaaagtattttctaattcctgagctgctttgatggaattttaacccacttaattccaatgtggccaaacacattgtttgcaactgaaaagaaagaatgacactgatgtcatacactattagtcccatagccctgcagatctccaaaaaagaatctgtaaagaagggaatttggggaacaatagactcctatagggtcacaataggcaatatcagagtgatcagctctccaggctgggagatataaataaaaggtgcatggcaagtgaaactacaatagcaaggcctcagggagcagagtttgatgctatcatttagagattggaactggttccatttaattttcctaaatgaaatatattagcaggtgccaccccacatttttactccagtaatttcattcttctttaacatacagtgagaatggtagggggcagggagaaacccctcaatgactaaatagaaagaaattaatagccttttgggtcagagaattataattctgaaagcagattttccttaaccagataatgagctgcagttaaagagaagattggaataatgtgaagataatttcataagtgccccttttcaggaccctctggtttaaaggggcaatctcaacatgatgtgatgcaaaatcactttgcagtggtagtgataaaaattggttttggtaccgcctctaatccaaatttggataaccttgagaaaagtaaattcacttctgtggagcctcagtttcctcatcgtgtaaaatggggatgaaaacaaaacacctggcccaactcagagggttgttgggaggatcaggtggcaaatacataggaaaaatatgtctcatgaactggacatttctataccaatataaggtatgagaatgatacatcaagttcttgcttaagaatgtacaatataaagtccaaactcctcagaagactttttgatgcagctaataatctgatcccacctaacctctctagaattatcactaattatgcctttattagacccctctgctccatttctgtggttttcttactctcctggagatactctttttcctgcttttgttactttacttatgctcttcttcttgcttaggttgtcctttccatctaactaaagcaacttggaagtgcacctagcttaagaagtgccccctccaagaaggctttctacaccttcatcactactcaaaatatgatcctcacacctgactattagaaatgcagatcttcaggtcttgcccagacttactgaatcagcttctgcattttaacaaattccccaaatgatttcttggcacatagagtttgagaagtgctttccagcccacattcgcttctcccttctctggacttttagggcatttagcagtgtctgtcttgctactgaaaactattgttttcaactttgagattgtaggcacttgggaggcagctatatatttactgattttgtgtttaagaaatttttttacctactttcaataccacagaggtttattatgggtcttctgtgtttaagccactgtgggtacaaaaaaatgagtaagatgtagtgcctaccctaaagggactcaaggtctaagaaatggagaaattgctttcttgcttatttcattgcttccttcctttcatctatccttcaatattttataaacattactcttatttcagacacagcactagttgttgggaatttgaggatagctgagacaaaacctcttattttgggtctagtaaaaatacatatgaccataagcaagtaaatttacatttgttaatgctgtaatagtattgccttgggagtgcagttgagtgattgatttgggaaatgaagaagtagaaaaggttacagaaagaaattagagttgaatttggaagttgagtacgaaccctcaggtagacaggggtctcccatacagagggaagagcatgcgcacatacacactaaatacatactatgttttatgtttagggaatgttgagtcattaggtgtggtgacatcatggaatatgtgtgtgttctggggcaggggaagtctgggtggctagaaataaggctcaaaattaggctgggatattccagcactattcaccatagccaagatatggaatcaacctaagcgtccattagcagatgattagatgaagaaaatgtggtaattaatggaatactattcaaccagaaaaaagtggtatacaatggaatactattcaaccataaaaataatgcaataatgtcttttgtagcaacatgaatggaactggaggccattatcccgagtgaaacaactcaggaagtcaagtaccacacgttctcatttataagtgagagctgaaaaatgtgtacacatgaacctagagtgtggaatgatagacatttgagactcagaaaggtgggaggggagtgggtgatgtaaaactatttaatgggtacaatgcacattgttcgtgtgatgaatacactaaaagcccagacttcaccactctgcaatatatccatgtaacaaaactgcacttgtaccccttaaatttatacaaataaaaattaaaaattaaaaaaaattaagccaaaagtcacattaaacatgtcctatgtaacacttaccacaataaggaacttaggttggtttttttcctttcattagacaatggggagttctcggtgattttcagatctattatctcatagcaggtgctcaataaaactttcttgaatagattgtggaaggagataaaaggttcttctcaaggttgtaggcaaagtgttctttaatttactctgaaatgaagcttgttaagaggctactgtgggccagtcgtggtggctcacacctgtaatcccagcactttgggagccctggatgagcagatcacttgaggacaggagttcaagatcagcctggccaatgtggcgaaaccccatctctacaaataatacaaaaaaaattagggtgtggtggcacacacctgtaatcccagccactcagaaggctgaggtgtgagaatcgtttgaacccagaaggcagaggtttgcaatgagccaagatcgcaccactgcactccagcctgggtgacagagcaagacgccctctcaagaaaaaaaaaggtggggggctactgtgatgagagagggaaatatgcctaactatgcataacttaattaagagacttccctatcagaatggcaaaatcaaagcacaactgcaaagcctcagaacaaattgatctgaataaaatgcaggttattacgtcatccaaacccagacagaatgtctgatataagtgaagaatctttgaaatccccctttacaggtagcaggcctgtgagtttctggaaagtgaaggcagaagtacatgcacatggttttgttataaacttgcagctgtgaagaaaaacaattgtgcttaggggtctggacaaccaacttccaagccatgctcttctacttactagtggtgtaatttggggacaagttatacctgtgtttgggggctgaaaatacgcccctgctactttttatttttataacctgctttcctatttgaggaatcttgtatgaaaccaccagggcaaatgtggtattatattactaaatgcccactagattctttgcaggaatttactgactcaacttttgaggaagctctgaagaggtccacatatagagatttatgagcaattgtagaatgccaattgattcatagaatcatggaatttcaaggctcaaaggaaatgtggaagtagtatcgcttttacctcaccaaacctcctctataatattcctaccagataataatcttgctttgtgtttgccccttccagtacgacacacatcacctccagctacatacagtccactctctcgtgtgctagtgcaattctcctcagccactctgagttttagcagttccatccttgttttgagctactgtaatctcacattgcataaatagaagtaaaaatagcacagtatctagaccaggagacttcattgtcttgaattcttctgcactcaagggtagatcatacctcaaagtttaaggatggctctggggcatgaggtttagcacatatgtaaagcaactgagttgtgtccagaagagagtggcttaggacatgagggcacaggtgaagaaagtggggctgttgagactggagaaaagactcctggacaggttagctgtgtttaaatatttgaagggctgtcatggggaaaagggatttaccgtgttctacattggcacaggactagagctaggatcaataggttgaagctctaggaaataaattttaattcaatataaggaaaagctgtctaatagtctgagttctccaaaggaccaataaataggccaccttgagagggaaggagtacccagtaactgcagttatttcaacataggctgaatgctttttaaaaggacatttttggattgggagcccagccctcatggacccttgggtggatcttgagatgttcccaaggaaccttgatgttccctggaatcacttgaaaagaagtggactaggcgacctttacagcccagtttatccctatgagtacacatcaacatgcctgtgatccagtttatatatcaacatgcccatgatcatgtattaacattttacccatctgttcaagttctaccttcttgtaacctactcctttttttaaaatgttttgttaaacttattgtaagaggaaagatccaagctgtctaatagattgtattccttttggcctggagccaaatgacctgtgaccactccctacaggcaggcaaaatagttattagagtaatatggatggtatgttatttcactttctattctcttgagcacacgtgctctctctgtctctgtctctgtctctctgtctctctctctctttctctctctcacacacacacacacacacacacacaaactagtttgatggaattgagatctagagatgccaaatgacttgtccaagttcatatagctacttaatgttagatctaggaatggaaccagaacaatatacgttacattattaatagtgtgccttgaatttctgatgagattgtaagccctttttctcctctaatatatgctctaaatacttacagagttaattaatttagaagtgtgtgtttgtgataaatctgtagtttcaagatatacaacaacatctgatggtatttatgactccttttatctcaaatcagtgaggtttcactggcctcagaagctgtggtgatcttaatacatgagacttaagatgactatgggcatgcctgttgctcccaggctctctcttgtgaaaagattctgggttgttctttatgtatactgtccacgttttatgacttggaagttccattcagcttcctttaaaatcccttggctaaaatcgaatgttgtcccagggatgacttagtgcactgggcctaggagagagggcttcctctcttggatggctgagtagttcctttaatctatttaccacaagtgttcattgctctgaggctctgggattcttcaggatgaaagccctctataaatatttgttattgttatgataaccagtatggcttcctgagtcagataaatttgtcttctggcttctgcttttcatagcttccctccctatccttttatttctctctccagataacttttgtattggggaagtaatctatttgtgcagttaattaagctgagtgcaatgtgatagacattagtgactgtccaggttgtgactgctaagggatgaaggccttagagctgagggttcataccataaatatatattttcatcaaccagagggaaaaaaatccttgaaaacagaattaaaaatgatagcagaagaataattaaatattgcatggaggggtcatggggactggtttccacaaaattaaaaatggtaaatcgatgtttgcaatatcctgtagactatcatcatgatagctctgacttccagcctcctctaagatgatagtcagactctttacagggaacacagccttccctgatctgccccacgctaatttcccagacttactcttcactctaatgaatcattcccattcctccttgcttataaaatgactccacttcttaaaagaaaacccccggtccttcaaaggttaaagtgttggccgggtgcggtagctcacacctgtaatcccagcactttgggaggccgaggtgggcagatcacgaggtcaggagttcgagaccagcttggccaacatagtgaaaacctgtctctactaaaaatacaaaaaaaaagctgggcatggtggcaggtgcctgtaatcccagctactcgggaggctgaggcaggagaatggcttgagcccgggaggcggaggttgcagtgagccgagattgtgccattgcactccaacctgagtgacaagagcaagacttcatctcaaaaaaaaaaaaaaaaaaaggttaaagtgtcaactctcatgaaactgccctgactatactaatcgcaaaacatcaatctctctactcctttttctgaaatcctgtactcctctctgcattctcatgtggcatgtcatagtttggggaagtaaattctggtaatcttctcaagtgagtcattcttgtctcccaaatattatcagtttgtaagctcctgaaagacagaacccaatgcttctttatataatgtgtccttgtattcccaacagcaccttttgcatagtaaatactggattaattgtttagttgataacttcatgtttgaggagagtcatagttgaacagaatggaaaaggaagactcatagttggatattgacaagaatgaaattatgtggggacctcagccattgagatgaaggaaaactggatagatccctggagtttcggattatttagcagttgggtaagaagattagttggtagtactgcacagaccaaaacatctggttgcctccaaatatgatcaacacagctgttggtgtacttagaattacttctcttccaaggttaatgacttttgtccagctgtgtccagtcttctagcagctactcagaatatagccattctggatcacatctgttgactctacacaagtaagaaatgtacacggaacttctttatttctttaactgcaaatatgttatgtaggcggtattaccctgaaacttatacttcctaaaggcaaattatggcagcccctatactttaactttcctgaacatataagcatttaaaatgaataccatatatttgctcactcacacctgtcccccactgtcttgaattctgcattgatacattgttcccacttcaagccaagaacttgtttgtattgagtcctgaaacacaaagtaggcacctagtaggcacttaataagttttggctgatttaattaaagatctgctaaatagagtctaaacaccaaaccacctgtatttaattttaagaagaaatgaccagagatagacataatcatgaatctcctggtacaggaaagagtattacaggaatagtgtagacagttatccttcattaccttgcaagacaggataataggaaaaatacctgcaattgcagcttgcctgaattagataagaaggcaatattagcagaatgattaaaaacaaggactttggtgtcagacagatctggattagagtcttagctcccgtcactgattagctgtgtggccttcggtaatttacttattctttggccctcaattgtctaatttataaaatgaggataatgatatggcctaccacatgggattggcttgaggataaaataaaatgatgtaggagactttcacattttttacgaggtggagaaggagccagtggagaataaaaggttgatgatacaagaaagggagagaataactgattggcaaggacttggagataatatcttttgaacactatggacagatctgctttcagaatggtttggaattcagctctgtcttgaaccatattcaaactacttatctctagtgcagatccggtccctaggactctgaagctcttttcgatgtactccctctccctcatgcctgctccagaagcaccaccctctagaaaggatcaggactcctagctttccatttcagccaccttattgtacccataccttaccttatgttatgttgccagcttatagacagaattcaaaagaaaagactgctgaagaaagcctttgctttattatgtctgcagtcttctgaagttaaaaaaaattcagttatatcataaccaatagaatgggaagagaaaaatttttaaaagtcattatcagccaggcacggtggctcacgcctataatcccagcactctgggaggctgaggagggcagatcacctgagttcaggagttcgagaccagcctggccaacgtgaagaaaccccatctctaataaaaatacaaaaattagccaggtgcagtggctcacgcctgtggtcccagctactcgggaggctgaggcaggagaattgcttgaacccaggaggcagaagttgtagtgagcccagattgtgccactacactccagcctgggcaacagagtagtgagactctgtctcaaaaaaaaaaaaaaaaagtcattatccttgaacttaggtcttcttagacgttatagctaaagcaaggtagagccatactagtcctcaaaagaattcttactattttcttagttactttacctgtcagtgttcatgcttccattcagtaaaatgcctacagctgtgcctggtattggaaatacagaaatggataatatactgtccatgctgtcaaataatttgtagtctgataggggagacagaagaggaaaattacagttcctatgctgagttctaagtgctgtgcagcaccaggggtgctgtgtgcatctggggcaccctacgttttggggaaggtgtcaggcaagacttcttgggaagcctgagggctaatgatattatacaagaataaccttgaatctgctttcaactcttggcaaactttggtactttagcaattatttgtaacaaattatttggatatagcttacaactgattttaacaggccgatgatgtgttataagggttacaagactataaaatgccttcctatctgggttcccagtcccaagccatccctattctaggacaacatatacgtaactgctagagttactctcccaaaagtcctccaagaagaagtgtcaagttggagttatccaagagaagggggagagggagaagcaaggagaagaagaaaaaggcatactgggcaaagtaatatcgtacacaaaaggcaaggggtgaaagaggggaatgtgtagtgtgtagtgtaaagggagattggtggaagtgacaagagaagttcagagaatcagcatggagggacacgtatgccatggtaaggaagttggattcagttctacaaggtaatgagaaatcacagaagcagtttttttaagagtgaccatctatctatgtgttatcactgtcttacctcagtgtttgtcaggtggggaaactgaggccagggtgtaagcagaattttatcaaattccaggttggagtggtattttagggccaaagctgagatggagtcaaaccatttcatgcctttactgacaagccacctagctctggtctagggactgtgaaatagtaagcagagaaggcttagacttatcagtaacaggtttggggaatcatgcatagtcttgttcccagtgtgtataatgataagactctgccagaagtcttctagctctaacattccttttctctcttgtctcagtcctgtgtattttcaagctctctacccatcattgtaagcattcactgagtgaattatctatatttgtctgtttgtatatatgtatgtatgttgagaaggtaatactagaaaaaccaaactgctaaaaaggaatagagaacagcctagaaagaggtaatataaataaaaagcatttagggttcgaaacatttcttttttctactttaaatgcatggaatagagttttctactctttgttgttgtatcatgaggatgatgaattaatgtctgccggcatttttagcttttttttttcagatgaaatgtgcttcttctgctcttattattctaatagataaatattacagatgaaaaattccaggaaaataaagaatgatgattacatccctgagctgtctgtattgatgacttgttgccagtttcttcatacttatcttaaagccatttaattaaactttttcttggagaactctttcagtaggtgatagaaacttggatttacattgtcatttatgtgaagggctaatattcttacactgtggtatttcctgcctttttttcagacatttctgcctgttatggaaaagtttaagtcttggggctcaggggtaacttgataaatcaaaattccatgtttcaaatctggctcaatatgaagtgagtttttcacccttcaaacctatttacttcctaggagcctagctactggtttagccccatatcttcctaggctgcttcacaatacttttcagcctttgttatgtaaattccaactcttaaacatagattcctatattgtttgaacacctcccctcccatatggttaagacagataaagactttcttttttttattttattttattattattatactttaagttttagggtacatatgcacaatgtgcaggttagttacatatgtatacatgtgccatggtggtgtgctgtacccattaatcatcattctcagtaaactatcgcaaggacaaaaaaccaaacaccgcatgttctcactcataggtgggaatggaacaatgagaacacatggatacaggaaggggagcatcacactctggggactgttgtggggtggggggagggggaagggatagcattaggagatatacctaatgctaaatgacgagttaatgggtgcagataaagactttcaagcaagatcgcctaggtttcaatccttgacctgacatttactagctgtcaatcttaggtgttttttagcttctctttggcttagtttcctcctctgaaaaatggggttattagtagtatctaccttgtcaggttgtaatgagaattaaataacttcactacgtaaagcatctgaaaagtgcttatcacataatcaatattattatctgcctgctaattatctgctgattttgttattccttctattttgtatttgttattccctcaatttataactttctttcctaagagttttgcatggctgactctttatcatcaggcaggtgtccattcaaatgtcatcccctcagggaggcattccctgtccacccaatctaaagtaggtccctccctgccaggctctgtcatatcaccctgtgattgccttaattgttcatgtccaccatctgtaattatctagttttttatttatgtactatttgagtactttcaccagaacataagctccatggggccagggaccttgtctgccttgttcaccactgtaccaaatagcatgtggcaatgttcagttgaaatgcattgaatgaataaacaaatactgtgattccattttctgaaccaaagccagtgcaccttgtctgtcaaagaacctttatttgtgtgcttctaggtgtagaaactactggatggtatattttggattataaaaatggaaacttcttgtacatttttgatagtttaggtggagacagcactgagaatgtcattagaactggcttggaaaacccattcatgtgatctctgtaatgccagtgtttcctacagtggtccttgcaaaatgggtacccgatagtgttagtcactccctcctcttgtcccttgggtctccttggatggatctggacatctcaaggggtatgactttgtaatttttattttgatgtctctagagcacttagtacagtgatttgtacacagtgggtgctcaataattgtccaccctgtgaatgaaccttctctttttctttaacatcacaacttcatatatcaacgaggtgtggaaagaaaagagacaacttacgtagggttgtcaagagttatgacttatatttgagggtttgaatagcaaatacactaaaaacagccaatcacctaataagagattgtctaacccaggccctagatacttctcaaagagaccattgtttggtgacttcaaggtgggttccctgtcagactttcaggttgccatagagatgacatgtttttcttcctaaatgatatttgcttgtaatctcagaactctgttcaggaaattagcacaggttatttgggagtgagaaaggagtgactatggcagcttcgagccttgctacctggtaaaggcctagtttgctaaatgaagtaaaaaaaaaggggggggggagggatttaaactgcattctaaggaaaaggttagagttgtgaagcctttcttttcccctactgtgaatgaggaggtgatatacaaagaaagaagaaagagttccaagtcacagggttcaaaattcagggctatattatgcctgtaatagttgttgccacagaaaatgggacttgtggaaagaaaaagttatcatcagtatcatctaataaagcacttatagaaatgtactgagcaccatggaaacattttgtggtgtctggtagttataatttatcttagtatatgcttgttgagggaagagaccacattttaccattccctttgcatccggtgcagcaccttaacctgtctcatctgcaaggtctctttccttttcctcctcccttgtattaatctttctaaattactcttctcatagcgtcacttattttttttttgagatggagtctaactctgtcacccaggctggagtgcagtggcacaatctcgcaatctcagctcactgcaacctctgccacacgggttcaagccattcttgagcctcagcctcccaaatagctgggattacaggcacatgccaccatgcccagctaatttttgtatttttagtagagacagggtttcaccatgttggccaggctggtcttgaactcctgacctcaagtgatccacctgcctcagcctcccaaagtgctaggattacaggcgtgagccacagcgctcggccagcatcactttctatcaaaacatttaatggtgcctccttgtcagttgaataaaatcaaacccttaagcctaacactaaaaccctttcaagatctatctttctagcttactttcccactacttccataatatacgctaatctcagacatcctggagtacttatcttgcatttcctgtatatgccctgtgctcttttggtttgatctttcccaccacctcctcctccactgaatgtttgcttatgctgttccttccctctggaatgcctctccctcaccctataatctctagctaatgaaattcttcccatcctttaaagctcatttaaatgctacctcagtaggaagtgatcttttggtgttgtgaattcctttagccttttctcctaatcttcttttcatcctcctgaggcttaatacaaagcctcccatacaggtattcaaatatttgaaaaaattataaatgaactgtaggttgagtcacatatatgcctcccagaggcagaaatgacagccatcttgcaaggctagctaagaggtgttctgtatactgaagcttgttttctcattgtattccatgataaaaagagaagatgaatttcaggattgtttgggcagcaataatcagggaaagagaaggaaatttacatgagtacaactaaggattttctgagaagacctggcttgtcactgcttctaggagtagaacccaggccttagggggaaagatatggagacctagaaacactgaggacagtgaacttgtctagcctttttttcttcttataaccactaccctgtatagctcagccacgctggcgttgccttcaccatcacctcatcaaacagtgtcctgtcattctgttgccaaggaaactatatggtgggattccactgatgggggattaatacaaggaaagaaaacaaatatacattccctcaattaagacatccccacaaggaagcccaaagttctgtcaagcctcataagatgacaggcaaaattgcctgctaccttgtccagaagcagcatggcatacatagctcaatgctaatgacagagggctgtaagcacgtaatcccttaggaccatggcatgatggtccaaagcacctaccataagtgtaattctcatgccttatcttaaaaattcagacctattttgcagtcttctctaaaatgtaattgtgtttgttgggatatttaaaataatgttttaagatgaagttgatgttccatagatgtgtataggtttatgctgtagctttaaaggactacctgggacacctctgtatattccagtattagtctcagccctgatgtggtgaggattaaatgagataatatttagcatgcaacccagtgctagaaacatagtaagtgctccatatgggacttgtttgtggttaatttctctcagaatacagtttctttgtccattaaatgagattacagtgataccttcatcaaagatttgtcactaggattctgtgaaatatgcatgcaaagtacattgactccttgttgcctggcaatgtaaaagcccacttttgaggggaggactttgctattcacattccacagagtaaaatgttgggttgtattcacattcaacacagctttagtgttcatttcttatgcatcaggcatgttcttctctttttatgtggagatagaggaaataaaatggaagcaacagcaggtaagcaacacttgggtgcacacgcacttcacaacagccgcagaaatacttctccaaatgcctgcattcacctgactccaaagaaaaggccgcaggcagagtattctgaccaagattcctgtgtcccaaagaccttgccacattgatcggggaaaaagaagttttgtattaagatggcaattacccagacaatttgcaaagggtattttacctgccagtatgttccctggcagaaatgatctctgattacaagcctcatgcagtgaatatatagatatcttgtttcactatcttgcctctgtgtggggtgtgtgtgtatgcgtggatgttgaagtgtgtgtttaatttatgtttcttgctgcttgaagagatacagcttcgatgttttttcttttcacataaaatcactatttatccccagctgaaaataacctttttattgttcttgtttttgtctccttctttctgtgcctctacaagcaaagcttcctgttgaatcttgaaacatctgactttaaaatcagggtacagtcttgtgagggtatttccacgtgcaatcagtcacagaagccatgcagccaagtgccttagtagattgcaatcacagggttgtattcactcgaggtgtggctgtgagggtctccccagctacccttctaacatacacatagatatacacaggcatacacacatacacacacacacacacacacacacacacacacacagagagagagagttacctccttttttaatactgtttatttgtatgtttaaagactgaattttataaattaaaaattaaattatacacattgctacaatgatttattttcaaatcagaaaatgcagacaagtataaagaagaaacaaataccattccaccccccaaccccaagaaaatagccactgttagcatttgtagaagtgacttacatttttctaggacacaaattcatttaatttcaccttagtaatgaaaagaaaactgtcaatagggcacaattctttggacgatgacagtaatgtgacttgaaatgaagcaaagtccaggcgctaggatgtgcacctgagagatgattgggaccccgaggctaagcttggctgcagcggaattcattgtggggagaacagagaattaaatgccagaacagaagctattacagagggattgactgtccttgcccaggctctatagcgtaagcaaaactttccctactccttgctggctgaaaccctgagttctgactcttgagaaggaaagggttcgattttgacggtcaactacacataatcaccttcccgcattgtcccgaaaccagaaacggagtcagtactaagtaccaaggtcctttgaacatcatttatttttcaggaaccactctttcaaaaaaaaaatcaattacagatgctttttgggagagtgggatgtgtggcaaagagacatgaaagtcagcgttccgcaagatttagttgttacttatgggaagatgaatgatttaaatctctcttgaagctgaacctccttaagtatccacttatattgtcactacccatgagcatgtcagggcaatatatgtatatatagatttacctagatgcctgaattggttttttcattctttccaccaattcctacaactctggttctcaaactgtagccttagaagcacctgtagagcttggagatggaagggggtgctacttccagagtttctgactttagtaggtctgggatgaggacctgagaatctgtatttcctacaagtttctaggtgatgatgataatgctggtttgagaaccagattttgagaatcactgccctacaagaatatataggcatgatttcatctcaaaatatttagggaaaagatgaaactgtgaattttccaaaatattattcctgatttaggctaattttggtagaaaattattgaatttagccaccactactccattaccccatatatattgcagattgtatttttcaatttatgatagcatttttgttttagagttcctttttatctatccttctgccctccgatcaacagaatttctcccatctttgtctttctgaaaaagtataatttcctaatacctcagtggtatgtgggcagtcttttttggagaagatttctagctctgccaattattagctgtagatccttcagtaagttagctgacatttctgaaccccagtgtccacatctgtaaaaaggacaaaaccaaaacaaacagaaaaacatgtggctcacctagggagtgtgtgcatcagacaagataaatagtgtataaaatgcctagcatagacgaaaataaatgttaggcccccatatcccttctattatctgtatttatgttgcagggattgttactactatttctagtgttgattcatctataatagaatatagtatctatctaatggagccaaggcaacatctcctggagatctcagcaaatcaagatttccctatggttctaagacatattttatgtcagggacaagtgggaacaggaataattacagcaagcatttattggtgcctgctactatgattgttgagaatgatctcatctaatcctaacgacagccccatacggaaagtattattataatcattattttacagatgaggaaatggaggctcagaaaagttaggtaacttgcctgaggtcccacagatgctaataaatgcagagccaagatctaaaccaagggctatcttttctccaaagtctgagccccctaattattgcacaacactgcctctccagttcagtatcataagctgtccctgttgagaagggaccttagacatcacagagtaatcctttcatagtagagatgaaagaactgaggcctggtggtggagtgagatacatcagctcactgatggcaaagccaagagctaaacttgggttgactctaacctctgaactttttacagcaatatagttttgctttcgtacaaatgaaaagttttcactgtgccgttcaagcatcagacaaacaaacaatgactctactgaattagagggaaaatttaacaatcagctctctgtgggaggaagggaaagccctgatttgtagcttttgccaatttccatggtataaatactcccaccaaggctgatttcaacttatccatgtcatggcactggatgctaagttgggaggagatgcacacaatccactgcctcaagctggtgtgatctgactctagcataccactgcatccgtcctcatggagaatgacaaccaaaccctgagtattgttccaagctaagattctgatggtgaagaaaaaaatgagtgtttcttatatgccaggattctgaaattcaatagaattggtatcctcgccaactcttcttttagagtttaggactggttctattactgggattgagcctttgccaaggccctcttgtgacttatttatagaacttttcccccccaaaggatatatgaatatattgtgtcatgctctatctttagaaatgctaatcccttgtctcaattgatatctttgaaattgaggataaattaaagtacaccaaagaagttgtttgtttttattttgttttaatttaaactaccaaaaaaatagttttaaaacttataaaatgacccaaagaacacatatttattttaggaaatttagaaaactcatgcaaacaaaagaaaataggttttaaaaaaatccgtttttccaaaatccagaggtaaacatggctaacatattggtgtacatatttctaatgttttttccttcctatatgcagatagaatttttttccaaaaaaaaatagccctacaataaaggaaatccatttgcaaaatgaaaagctatcacagattattatcttccatgtacaggtcctgccattctattcatattcacggaaatgatatgttagctatatttatgctgatgttcttcacgcatttgaagataatactgctaatggggattgttatctgtgagtacagatgggactaaaaagaccagggtgacagtctcagccttttccactccatagaccactgtacacacaaagactgttttcgagttacaattgcagctgtgcggatatggtgactgattgggactctgcctctgagacccgaggtcatcctagagctcagaaaacaaccccctcctgcactcccttattgctgtagccagcctggcctgcctgctgcttgtttcctgctgcctgcagctcagccccattgtttgaagtggggcttcagagctgctttaatgggttttcttctgccctccctgcttggggttgcctcacttcagttcaccatacaacagtctgatctggtgtcctggggccatccatccttcacacatgtccagcccagtggggcgctgttagaaatggaatttgttcattccctctcctcagtcttgatttttgtgaaacaataccctagaaaaatttaccagtcataataacaatgctagatgactgactctgggaaattaatgtttctttctgaagtagatgctcattaataagttggggaatagtggccaacaagacttaccagaaggtaaggtaaagtaactgacctctctggaatctttgcttttggctgtgagtctcaaatgtggatttgacagatccttttctgacatgttcctgagttcaattccctccttgaaggccaacgttgaaagacagataatcagcaaatgtttgggaaatgcagctcttaattaggagttgcttaaacgtgtggtaaattgtatatacagcaggtcctattcaatgccattttattaaaatgttaatgaggaaaaaaattgattctccccagggccactgcccatgtggaaggtgcacatcctcctcatgtctgcgtgtgttctttgggtactccgctttcctcccacttcccacacttgtgcacatgaggtgtctaagttgtcctagtgtaagtgggtggtgtgtgagtgctccctgcgacgggatggcatcctgtccagggtggttctcaccttgcatgccccctgtgctgccaggatgggcttcggccacccacaaccctgagctggaattagcgggttggaaaataactaaatgaagtaatacaaattattggaaaataaaaatttgtaaagtatatgataaccatacaaatgcatgacaataaacgacactctaggaaagcactcaacaatctgccacatttgtgattcttctggaactgctgggtggcaggaggtgctccttatgatttcgctttgcaaacatttatatcttgacctgacccaccatcactacgaccgctgtcactcaccaattcaccaaaaattgggcaaataattctctttcttgttcttattaacttttcttaaatgtatgtatagctcacacttatttaaatgtttaatattagaagtgttttgggtctttatttagaagtttggtggctttgaccagatgtatgctgtaggaacttaacttttgttactcttgtttgtatcaattagcctagagtaaaattggcttcattatacatcatttcacttacagtcacactttccaagaacctattgatgttaagtgaggacttaattacatatcattgtataaatgggtgatatttggtgggttcatgctgatatttttcgtgtagcacattatttattggtagactgtcaggctctctccaaagagaagaaacctttttggtgggaaaacaatgtaacaaaagagagcccaggcctctggacagtttgtgaaaggcggtattttttttttcatttcagaggagttaagagtactagttgagtgaccttaagaaaataatttcacctgtcctgtctcagtttccttcttagtaaaagggaaatactaatatattctctatggtgatgttgtaaagattaaatgaaaaagagtagcacttgaagcgcttcacacacactgcctggcacataataaattctatgttcattaaatgatggctatattctccaaggggaaggcagtatccacatggctccaggtggcaaggtagtgttccccatgcaggggaaccagttgaccctccagttaaatgttggtgccacggtgtgtggggggtgcgggggtgtttctggtttcccctcttgtgttgcttcaaatcctggtgaatcacaacatttagacttgtgtttctcaaccttggctgcacattgcaattatgtggggagctttaaaaagtatggatgcctgagtcccaccttcagagagtctgatttaatttatctgcagtggtacctgggcaaagggatttttcaaagctcccccaagtgattctaatgtgcagtcagagttgagaatcacttgattttaggcagatgctccacatctgtgacaaagatgatgaaaattaacatcatgctataggaggcagcgtgccactacagccttgatcatggattccttccaaatctcttgacccagggcaataatcaccaacccacaaaatttgcattagccccacctgtatttatcaaatgtcaccatcagccatactgtaccacactccattaaatgcgcgtaatttgcataaggggcagggataaaaagctcacacctggttttgtaatcaggttaagaaaatgtacagtagtctaagagttaatctcattaatgctgatctcctatgcttgggttgttagctattactcagcttttattaatttaggcttgaacatgtatctgccttgtccacaattccagatgatgctataactcatgcccttctgtcagttccagaagatgactacatgtgttttatttagataaactgaaattatttcagctttcaactgttttggtaattttgtttcatttatggatgatgagtggtaagatccactcttcatttttacatactaaaagtcatctgaaaacagatttgtttggttaatgaagtcttatgggatgggaaagattgaggagggaacatagtacttgaagttttagttagtatggattaaaaacaagtagggcaacttttgtttgcttggagggctcaaaaccaggtaaataaaaccctacgttgagattcagtagttaggaacaggtattcactctatatgtctatgatgtgtactagcttaatttaggtttagtttagcttagtttagacacttaatccatgctggagacactattagtaacataggaacattcatcccccacccatggttagtatccatctgggtaacaggccagatgaagttaatttctatataaaatggaaatataagtcatatccactcaaatatttgaatttatatctggattctttcctgtaaatgtcttgctgctcttgatggaggaaaatggatatggtttttacataaggacatgatttatgaagcaactctctgaaccccaaaaagcctagtggcaaataaatttgtcaatttgaaatcaaaggatcttgaatcagaaacaaatgattgttgatcatagaatattgttttaatttaaagcattttttctcataatcactcattggaaatgaattgttgatactatggcttttaatatgtgacttaaattgctcaaaaaaaatgaaaagtatctttttgaaacatcaggaaaaaaaagccttctggacaggccttagtgctgagtctcagcaaaattcaagttttatcttaagcacatatcttttatgttccaaaatctttctgaaaactctgagattctgccaagttggatgaagaaagcagaaagggagcatagttggtttttgttttgtttgtaaagctgttccctctttcttgtttattcttggtggccaagagacagatcctgggttgctttgttctttggctgggatcactaccttaccatatgaagggatttttaaagcttcggtttgcttccttgaagtaaaaggcagatgcaacttttgcctttaagtacattctcagtggaaactaatgtttggggtgtttcgaggggctgattttagacatggagtcctgtcctggaactttcaatgcagatctgagcctgtgagaaacattactttttgaaatggagttgattttattcttgggattgacaaaatagaaacaatacttactaactacaaccagtaaagtggatctttacaaacagaacattcatggaaaaaaaaacatgcaattttattttatccctaccacttgataatagttaagattgtctaatcaatttcactattgttgcacttccaggatgcttgattgggtcacctttcgttaatggctagtagtgctaactggcatgcaacttaactccccccaacgctcacccctcctttcttcactgccttttttttttttttttttggctttttgcctttgcagccaaaaatagctggcaaattatgttcattttcaacctaatttggaatggaagggaaaaaccaaaattttattgcaatattttttattgcttcagttactctgaacatttattatttactattatcctttatctggataatgactgctttgtttgccatttcaaccaatagttaattcatcagcaaaatcaaatctcaaacttcacatctcttccaatccacaaatcctgttcatctctaattccaaacttacatgcctctatgactagggatatttattcttgtttagtaatgtttattttgttatgcttttccttgaaagaaggactattttataagcagtaacttttcttctgtaattaaacattccatccaaccaaaaatagaccttgagaatctcaatcatttttttactgccctatatcattgtctatacatctcggatcttgccacagttccgtccccctgatttagatggcatgaagacagaagccacatttagtggcttacacatagcaggtgtttgttaaattgaattgagtcacttatgggcaccatgtcaactcccagcctttgtacatacacacacacacacacacacacacacacacacacacacactatatatatatatatatatatatatatatattcccattaatctttttcatagcgctcttttcctttcctttgtagtatttattataaattctaaatttatagattgataaaaactgaacttcatatctacacacattaaaaaaagtactgcttagtacctttctatatgcttgtcacttggaacaactctatgagtcatgtaagttccatgaggccaagactcatgtcccacttgttttccactgtatccccagtagataatgcagtgtctaacacataccaggcactctcaaatactgtttgaataaatgaagaaaaattttttacttacccttaaactagctctatataactgtctaattccaccattagagggcatgtagggtcaaagtttcattcaataaatatccactgggtagctacctagacaagcactgtgatcggctctattgcaggcccaaagaatttagcaaaagatgcctgcaattgaaagccttgtttctaaatagggatgcaagacataccttgtgcagcaagatgtctacccataattattcgtagaatgtgccattgcttttctcattcattgtacagagtgtatttttggttcaaaaggggtgttagcttaggagtgttctcagaggaaggttacctggccctttgggtgtcaccttacttagttccccatatttctgggtctggccctaagctttgcccacttgggaatttaattttgtcagcccaggggtagtagggatatatcatttattagcctacactagccaaggtcacaagaggtggacacctagactagaatacaatttattgaattagcataagaaaagataattgctaagcatctgatggtcacatgaacaagtcttctgcctgtaggaaaatccatgtgggaagccaaaagataacagaaaggttgctttatgtgtgtagcaccattgcaaggggagttggttgcataatcttaatattttgtggcagccaactctaatggtctgatccatccgtcttcaggatggggatttgctaacctcagttaatggaaaatagatttcttgagccagaggttcttcctagccttgggagtgctgctttgccaagaacttccttctgaaaatccacattttcaatatttccaactaaccttcttcctctcaatggactctctctttccttagatatgataataacattgtttgggttactgtctggactggctttcagcctggaacctctgctgtatcttttaaggtgactttgcacctttagtcttatctaatgtgttttaattttattcatcaaattctcagagtttagtgggtgcatttatcggtcctctgggaatctttatataatctagtacaattctcaaatgaaagagggaaatgcatttctgacccaagagtcactgccattttttcagatggaagaaaaatttttcagcggtagaagtgattagttttgccttggggagtgtattagtctgttttcacggtgctgataaaggcatacccaagactgagtaatttataaagaaaaagaggtttaatggactcatagttccatggggctggggaaccctcacaatcatgatggaaggcaaaaggcacatctttcatggtggcaggcaagagagaatgagagccaaaagaaagggaaaaccccttataaaaccatcatgtctgctgagacttattcactaccaccagaacagtatgggggaaactgctccctgtgattcaattatctcccactgggtccttcccacaacaggtgggaattataggagctacaattcaagatgagatttggatggggacacagccaaaccatacagggagttaggaaaggctttccagaagaggtgacattagagctgaatcacaaattagaagctgtagatgtggaatggagaatatggtagtttccaagtggcgagaacaacttgtacacatgttattgtgtacttgtaaggcattgttgcatattaggatgaataagacacagcccaatggatgtttaggtaggttcaatgacagaaagctcagatacatcccctgttgcatgactctcattcagccttacaaaccctaggatacagcagctattgcccattctgtctgaaacactgcatccaagccaagtcttgatccttaaattattaaaatcttttctaaatacacaaacacaaatatgagagtgcttcctccataagcttctaaagcattttttcctttcatggcctttataaagtatagttatttgtgtaaatatataaatttgacctgccctcctgtccattccccccccccaccccactagtagattataagttcctggaagaaaaataactttattttttaatgaactattttagatatttgtcattcctatgtatgtctttatatttttactgcatttttcagaaacataaaagtgttttacatgtttttaaaccttatttaaatgatatgaaacatcattctacagcttgctgttttcattcattttacttacatcttaataatcaactatattatatttctatttatttcattttaacctttatttattacttcattatatgcctataatcataatttggtgatcttttcatttcttcctgaatatttaagttatgtttacatttttggggtaacagagacaaccattttggaaaacatttgccaatatatagtaaagttgaaaatgcacatgcttgtcaactaagtaagtcaatttctagatatatacactgggtctgtactatccaacatggtagccattaaccacatgtgaccatttaaattaaaactttaattaattaaaatttaaaaataaaatagtatttaaatttcagctcctcagtagaactagccatatttcaggtgtccaatagccatagatggctagtggctactgaattgaagcacacagatatagagcatttccatcatcacagacattctaatgaactctccaatgctgccctggagaataattttatttgtattttcccagtacactatgaacataaaaagcactaaatagctatggagtgaatgaatgaatgtgaaaatactgcattacagagctatatatggtaaatgttaactgagttccaggaagaagagctatatgaggttagagggggtgattgcgtataagggtcctgggcatgggcttggaggaggatcgactaaggtgtttatccagggcaatcaactgcagcatagcaagaggaagagttggaaatcattactgcagagaaaataagataactaaagaacagaaaagccgtagcaagaatcagatccaaagcaagactgtgagaggggaaaacgagttatgaggtcagaagccaaaaagattaaacggaggctaagaggtggagtgcaaggcaggtcagagagagcagttcaggacagatgctgtgaataatgtaaagtatctgaagtctgtgctctgggctttgagggctgagtaaactctcaatcctgtgatcaaaatatgttcatttcctaagtatattgccatcatccacaagacctatctactactttgaaagctatgtttaagagagggttatctgtaaacatgtggaagaataggatttgactcccacaacatatagctatcaaagtttgggagggtgagggtgaggcctgaactgggctgctaagaactgaatttctgaggttaattactctaggaagaggaagagaacatggagggagcaaatgtggtatagaagagtagatcaaaaaggaaaggaggatgaaaagggcgaaggtcagccaaaaatcgaatacaatgagaggggacgttgtgcaggtcttaatattggttttcagttaattgtagagttatttctataaacttaaaagccagcaggaatgtgatgtgggattcagaagctgttggtctaatttagtcaaaaactacagagagctctagccccaggctcttgcctggctttctgagctgctttgtagcccactcctggttttcacaaaagtttcttcagctctttcctgccccaccaaccccactaactttcagagtcagaggtactgattaaaagatctgattcccaacattttttttggcagggagagagagcaggtgtgtggccacaggggaagttgggtatgagtgaaaaatcagagacagccattttaaagtgcctgagtcaagcaggctatcctatgtctctctcatatcttgtaaaattcagcttgacggtaaaaatctcatctctcctgcccactcccttcacaattttacatactatagtctaaactaatttaagctttcagctgttattttcaaaacttgataatcagattagtgcctacatttgtttacaaaggtataaccaattctagggccagaccaaacaaagctctgtttatgtgtttgtttgcaacagtgcaatctcatttttaaccatggcttttgagaatagcagcatattacagaagggctagagacagctcacccaaaggggcgaacaaaccattctacctgaccttaggaaattaatccttcaagtgtcgattgtgcattatgaaagcagccaactgtctgccagcagtgggtttgcaatcccagaaatctgatgcttttctataccttcaagcaatactaacagaggtttggattcctgagcaagaccagtctgaaagaactatatgtgggcattgctaattctttacaaagattacaagtcttcattcccaagactattccttgttctgacctctctacttttttccatctcatgtaacttcactctttcaacctcaaatccctatgcctaggcacaagccagtctaccgaaatgtgggcagctgtcttggcatgcatgggcaatcagatgtttgaagaaaattgatgaataaccatgtgtccaagacatccaaagggcttagagaattaaaagccttattcttatggttaaacactgggaatgccatctcattcctccccagtgatttctctattatcagctggaaagccaccagcagatcccttgttcattggccaggatgcaaactaacacttctttcaagtctcacttttgttctcagggttaggaacactgccattattaaaaaaaaaatctggttggtccagctaattggacttcttaggtcataattacagtatcgtgacatcagcctacattttcctggaattgattattaagcctcattatctatatctttgtgtcctgacaccaccatttaggaccaaatcattgaacctaccatactatatacaactaggctaaatgttccctaagtcctaggactatgaataaactgtttccttaggaagatttgggaaagtaatggataatcataaatactaacatgtattaagtgcttattaacctagcattaatgcttgcattatctcattgaatattcacaacaaaccaacaaggttacttactattattcatatccccatgtttacagttgaggaaactgaggttcagaagggtgagaaaacttgcccaagattacacagctaataaatactgaattggaatttactctcatgtctgttttgattcaaagcatatgcacttgctgcttcttggaaggtgtctgtctgctcctcgcttcacgagcaagaactcatctgattttaatttgttagaaactgaaaatacagtagaataaacagatgtttcctttctgatggagtgatgggttataatgtcctgttttacatgtcagcaatagttttgaggccaattgtggacatttgtagatctctcatcctaagtatttattgggcatctattatgtaccaacacatggtgggtgattcaaataagtgtaaggaataggaattaccaggagtgagtgtcttaccagagaaatgaggttacctgacaggaaccccctcagaatatatatacacatgtaaaataatatgccaattcatgtgacaactctaaatattgggtgagacactgaggtgttaatagaaaggacactggtctgagaaccagtgttgttttagaaacagttgtgtaatgttaacttttaatgctaattttaaaataaagtgggcctacctcagtcattctgggtttcttgactagaggcagagaagaaataatcaggaaagtcttcatggacgagctggactatgaagaatgggcaaaatttgaattggtgggaaagggagaggagactccaggtccaaggaggaacaaggaaggaaaagtaggagttagggtaaagagaagggaaatgagcccagagtgttaaatggttacaaaggtataaccaattctagggccagaccaaacaaagctctgcttatgtgtttcattgcaacagtgcaatctaatttttaaccatgagcggagacatgcatacatgctttaaaggagcaaaacccatagttaggcataaaaaaatcagggaccaatggattgattaatcaattgatcaattgattgatttttattgtggtaaaatatacataatataaattttaccattttaaccatttaaacagtacaattcatggcattaagtacactcacaatattgtacaaccatcatcactatctacttccagaactttctcaccaccccaaatgggaaccctgtacccattaagcaactactcctcattaacctctctccccagcccctggcaaccactaatcttttgtctctatggatttagtctttctgaatatttcatataaatgaaataatagaatacatggcttctttaatttagcataaccttttcgacattcatctgtgttgtaatatgtatcagaatttcatttctttttatggctgaattgtattgtatttatggctgaattccattgtatggatataccacattttgtttattcatttatctgttgatagacagttaggtggctcccaccttttgactattgtgaatagagctgctatcaacattggcgtagaagtttttgtttggacacttgttttcaattcttttgggtatacacctagcaatgcaattgctgagtcatatggcaattctatgtttaatttactgaggaacttttaatgtaaatctgtcatattacttaaaaacaagggctttcaactttgagttgaatcctggctttgttacttgctagttggccgacgttgagcaagtgatataacctgtcagcctcagttttcccatctgctgaatagggttgttttggggatcacatggcatgatgcatataaagtctcaacacagtgcctgacacatattaagcattagatacctgtcagctactaggaatatcctgtagtagtcttattcaaaatgttctgtatagtcagcatcacagacaagtagaggcatgaccctcttatttattttgctacttacctcatcacccccaccttgtagagctctggaagtagtcggaatttccagaaaatgatctaccctcatttcttaacccccaaattttaaattattagaattgtgcatgtatgtatgtgtatatatatgtgtgtgtttctgtatatatttatacacatacatatatacatacacacttccatgtactgtacacacaaattattctagtgaaaacatttctttaaaatctcaaaagcctgtgtgtcttttataaaaccgacactttccaggaagaggcaatgcaatttagtagttaagagaatatgtttgaatcaaaatagacatgggaatgaatgaaaattcagtgtttattagctgtgtaatattgggaaggttacctcatccatctgagcctcagtttcctcatctgtaaaccaagaatataaatagtagtacccacctttgtgactttttgtgaataatagatgggataaggcaagcattagtgctaggaacacagcaagcacacaatcttcagtctggtgctacaaagatacccatgactttgaccttccttgctttcccacacaccacaggccaccaaagtggcccacaggagttaaagagccaaagactttagctaggcctgaaagaatatcaaatggtcataaagagtttttccaaatgaaatgaaattacaccataacaaaagctgttcaagactctgtaatctcaaatgcatcctttgagtatcctgattacgcttagtctctgttggtagttacatttttctaagaggaattaactttccatctgcacagaacagtaccatatagtatttgagctgaaagggaaaatgacagtgaaaggagttaatatctgtgatactctgcactcagcttgtcttatttgatcattataacaactctgttatgaggtaaatatccttattcccattttggaactgcagaaactggggctcagaagaaacttgctcagaactaataagtgtcagaagcaagatttggacccggatccttctgaagactcgaatttactataccacacacttactttaaagaatttctgagattttcttttgctattggtgaggcagaaaccaagaaaggtaaagtgagttgtccaaggtcactcagccatttattataataataaagcaggactggaatccagttccaggaatgccatctcatgttactttattgcctctaatggatgaataatgtaatagttcatcagttaaaaatgattaaatgttgggagaaaatctgaaaataaatttcatccataacttattttcatctcatgtttcaccgaccttattgaaaaactgttttgtgtagttagaaatgaactaatgacctggtgttccctgatgtctgtgtgcccactgtattcactacttgatgttcagaagtaaataggcaaatgcaggcagtccacaggttatttcagttctagtttataaccactgtgatgggtaattttatgtgtcgacttggctaggctatgatgaccagaagtttggtaaaatactagtctaggtgttattgtaaagatatatttaagatgtgatgaacatttaaatcaggagacttcgcagtataatttgaagtcaggcaatgtggtaactccaactttataccttttgcttaggattcctttggctattcaggcccttttatggttccatatgaattttagaattgtttttttctaattctgtgaaaaatgacattgataatttaatagaaattgcattgaatttgtagattgctttgggcagtatggtcattttaacaaaattgattctttcaatccatgagcatgggttgtttctccatttgtttgtgtcatctacaatttctttcaccagtgttttgtagttctccttgtaggtatcttttaactccttggttaaatgtattcctaggtattgttttgtagatactgttaatgggattgggttcttgacttggttctcagctttattgttatcagtgtacagaaacactactaattttttcacattgattttatattttgcaaatttattgaagtcatttatcaaatctaagagtcttttaggtttttagatataagatcatatcatcaatgaacacagataatttgactttctcttttccaatttggatgcctttttttccttctattgcttaaatgctctagctaggacttccagtactatgttgaataggagtggtgaaagtgggcaaacttgtcttgttctcattcttaaagggaattcttttaactttttcctgttcaatatgatgttggctgtgggtttgtcaggtatggcttttattattttgaggtatgttccttctccatctagtttgttgagggtttttctcatgaagggatgctggattttatcgaatgttttttctgcatctattgaaatgattatatgatttttgtttttaattctgtttatgtggttaatcacatttattgatttgcatattgaaccatctttgcatacctggaataaaacccacttgatcatgatgtagcatagttctagtataaaaatagacacatagattagtggaatagaatagagaacccagaaggaaagccacatacctacaaccaactgatctttgacaaaattgacaagaatattcattgaggaaagtgccctctatcaataaataaggctggaaaaattggacagccatatgcagaagaatgaaactgaacccatatctatcaccatatcctaaaattaactcaagatagattaaatgcaagatctcaaactataaaaattctagaaaaaaaaactaggaaaaatacttctgaacattggcctaggagaaaaatttattactaatcctcagaagcaaacataacaaaaacaaaaatagacacatgtgacttaatgcaactaaaaagcttctgcacagcaaaagaaataattgacagagtaaaaagataacctatggaatgggagaaaatatttgcaaactatgcatctaatgtctagaatctacaaggaactaaactaaaaaaaaaaactaacaaataactctattaaaaatgggcaaaggacatgaacaaatgattttttcaaaagaagaaatgcaggtggccaacaaacatgaaaacatgcccaacatcactaatcaccagagaaatgcaaattaaaaccacaatgacataccttcttacagcagtctggctattatttaaaaggcaagaaacaacagatgttggtgaggatgcagagaaaagagaatgcttatattctgttggtgggaatgtaaattagtacaactggtatggaaagcagtataggaagtttcgcaaagaagtaaaaatagaactaccactactgtgtgtccagcaatctcactactgggtatctaccaaaaggaaaagaaatcattgtttcaaagagacacctgcactcatgtatttatcactgcactattcacaatagcaaagtcatggaatcaacctaaatgtccatcaatggatgtttcaataaaaagaatgtgatatatatcccatggaatgacagccacaaaaaagaatggaatcatgttttttgcagcaacatggatggaactgggggccattttcctgagtgaaatgactaagaaatagaaagtcaaaaaccacatattctcactcataagtgggagataaaaaatgagttagacatggacatacagaaaggaataatagacattggatactccaaaaagttggagtgtagaagtggggtgagggatgaaatactacctgttgggtacaatgtacactgtttgggtgatgggtaacactaaaaacccagacttcactgctactcaacatattcatgtaacacaactgcacttgtaccccctaaatctataaaaatcaataaatcagtagactttgtgtaaagcagattaccctccataatgtgggtggaccacatccaatcagctgaaggcctcaagagaaaaagactgagatcccctgacaaagtagcaattctgtctccaaactgcctttggactttagacagcaacgtcatctcttccctgggtctctaccctgccagcctgccctgcagattccagacttgctagtttccacaactgagtgggctaattccttaatacaaatataatcacgtgccacaaacaatgtcttggtcaaggacggatggcatatacaacagtggttacatagtattttaatgctgtatctttctgtacctttttaatgttcagatatatttaaacacataattacttaacatcgtgtttcaattgcctgaagtattcagtactgtaacactgcacatgttttatcctaagagcaataggctataaaatatagcctagcatgtagtaggctataccatctaagtttgtgtaagtatgctatgatgtttgcacagtgacgaaatcgcctaaggatgtatttctcagaatgtttcctagttgttgagtgacaggagtgtacatacacacacacaaatatcattttggctatattttcctggagatcccgaactaataacaaccacctactaatgtaccaggcacagtgctaggctctgggaatatttagaagagacctctgtgcaaagaaatttgcacaatatggcaaaatgtgacaaaacacattgacaaaggtaggtcaaggcgggaaaataaagccacaagaaaagcatccggggcatttcatgatgtcctttacacatgatgataactaaggacactcagacatttatctgcaagtgggaaatttatttaatttagaaggagaaaccttgcaaaaatagaggtaaaaatagactcccctctttactttagactatcctgtttgttacatctactcaataaattaattcaataaacatttattgaatcttagctttgtgcacagtgtgtaatgacatagttgtgatgatataagaaacctcagatttgccagcgtttccccctaaacttggcttaatctctggaacccaagctagggttggaaaaattacttggtatagctgtggagtgaaaacgggcacacagatgctcctgctgagaccacctgtatctctgacaactttatttgggccaaattagttgaatatatgggctggtggcagttacctgtcccctgtcttctacctcctggtttccaggattgcctactcagttttcaggctctatcagtacttagtttgcattcatcaaccatttaaaaggccagccctgggtatttcagggaaggatcatgtccttaaaatgtagtgaattccacttattcccaaggatgcaagctcttctctgactccctgcactgaagtcatttagagtcttttgagagttaagactaattaaagctcatagagtacttggagagccgtgcatgacagcacatgaatattttcaaagcggtgtcttatgcctagtatctgggccaggaccaggcctatagaatttaattgaatgtgtatccctggttaaaggtggagctccccagtagcagagtctttgtcccattctgctgtgtatccatataagtttgagccctactttctctgcacagatctttaaggtagatgttcgtcagggctttttcccggaactctttcactctctgcacaaactcatccttgcataattctacgttctatcccaaatctgtcttccaagctccaagcccatatatatatataactgtttagacatattttcctggctattcacagatatttcaaactcagcatgtccaaaaccgaactcattttctacacacgcacatgcacacacatacacacaaattggtcctattccatgcttccccatctcagcaaatggcattaccatcctccctgttgctcaagctgaaagagtcaccttcgactcctctttttccttcccttcccacaaaggttcagtcattcaccttaatccgtccatttaccaactcagaaacttaaatcccaaacataaaataaaacttaaacttaaaacataaaaaaatagaatagtacaatgaaactcctcccatgtaccaattgctcagcttcaaatttaccaattcatagacagtctcatttccaacaatcctcacttctcaccctcaatcattgtgaaacaaataccagaaataatctcatttcatctgtatttcattaagtatctcttaaaagtaagttatgaaaacatccaaaatcccattatcacaccaacaaaattgacaataatataatataatcgaatatccagacaatgttcatatttccccattgtttcataaatggatttgcttccttacatttgagtatccaaataaagtccctacattgtgattggatgataaatctcttaagtcattgtattttttaagttttattttgtttttaaattgactcataattgtacatacttagagggtacagtgggatgtttccatacatatataaattgtgtaatgatcaaatcctggtaattaacatatccatcacctcaaacacttatcatttctttgtggtaagacattcaaattcctctattctagctattttgaactatacaaaatattacttttgactgcagtcaccctactgtgcagtagaacaccagaacttattcctcctctctaactataactttgtatccattgaccaacttctctccatcattcccagcccccttcccactcttcttagcccctagaaaccattattttactctctacttctgtgagatcaacttcttttagatttcacacatgagatcatgtggtatttattctgtgtttgacttttctcacttaacataatgtcatctaggcttatccatgttgttgcaaatgagaagattttgttctttttatggctgagtagcatttctccatgtacatatgtaccacattttatttatccatccatccaatgatggacacttaggttgacttcatatcttggctattgtgaatagtgctgcaataaatctgggatcacagatatctcttcaacatcatttcatttcctttggatatttcatattcctttggaattgccagatcatgaagtagttctatttctaattttttgaggcatctccatactgttgttcataatggctttaatctgtagcttctcctcaatctctcttttttctccctgaaatatttgtggaaaaaactggatcattttgtcttgtaagtttcccacagttttgatttgttggttggtgttggcattggtattggttggtgctggtattgtaaagctttggcagttagatctagagacttaatcatattccatttctctctctctctttctctccctcttcctctctgcctccctccttctctccccctttccctctcccccttccaccgcctcttccccttcccctctttctgcaaaactatttaatcacgtagtgttttattcttccatcattattgatgtacaaaatgtctgcaatgtctgcttgatcttctttctgaaatactagcagctgttgatatctattacctcaatctattacttcactgggagttgcaaatgttgattctgtaattctgtcttttcttatgcatactgtacttgaatactttatttaggagaaacatcccttcattaatttttatggttatcctgagttatagttcatttaggaaaggcagaatgaatgcttgattccactatcctttttttaacaaatttaaaaaataattatttccctggcatcctccaaaagtgacctgtgaaaggtttttttgtgtgtaggttaccattatggattcatgaagttccaaatattttacaaatttcattgaatgcagttatcgttattggtgttcaggccatcacttatttgggcagtgggaacctattcagaatgacttctgagtccctttgctgtgtttttttttaacagtgttactgagatataactgacttatagtaaactgaacatatttaaattgtacaatttaataagtttaggcaagtatgtacaagcatgaaagcatcaccacaatgaagataatgaacatgtccattatctgcaaaagttccctcatattcctttgtaataccttctctcactcttctctgccaccccccatccttggacaataacaaatctgttttctgtcactatagataaattttaatttgctagaattccatggaaatggaaacataaaatacatgtgcttttctacataattaaaaaataattatgctttttactcagcataattattttgatactcattcatgatgctgcctgtaccaatagccctgtatgacaaaggtccccaacccccaggaccggttggggactgctgacatatgagatatgtcagcagtccccaaccttttgggcaccagggactggttttgtggaagacaatttttccatagaaggggccggggtgggaggtgtggggcgagggatgcttacaggatgaaactattccacctcagatcatcaggcattagttagattctcaaaaggagcgtgcaacctagattttttgcatgtgcaattttcaataggatttgtgatcctatgagaatctaatgccaccactcatctgacaggaggcagaactcaggtgctcacatgcccgctgctcacctcctgctgtgcggcccagttcctaacaggccacagacaggtacgggtctttgtcctgggagttggagacccctgagatatgtgatatgcgaatattttctctcagtctagagcttatctttccattctcataagaatatcattcaaaaaggaagttttaatttagatgatgtccaatttcttcatttttttctttcatgcttcaagtttctggtgttgtatctaaatctctgcttaatctaagaggacaaagattttctcctaatttttctactggaaattttaaagtctcaggcttatatttacatttacaatatattttgagttaatttttgtacatagtgtgaagtatagatcaaagttcatcatttgtttattttgcatattgaatgtccaattgtttcagcaccatttgtttaagacaattctttctctactggactaccactgcagctttgtcaaaaatcagttgactatatatatgtggctctatttctggactctattctgtttcattcatacttttgtctgtctttacactctcttgattgctgtagcttcacaataagtcttgaagtaggtcctgtacgtcttacagctttttctttttctaagttgtttgggctatgctaggtcctttggattttcatatacatgttcaaattgcactgagtttatgatcatcaattgggggaaaattgatatcataaagatatctttccatttatttaagccttctttaattttctcagcaattaactttgccatgcaaagcgactgcacatcttttgtcagatttattcctgttttatatatttgatgttatcatatgacatttttatttcagtttccaattgtttgttgctagtttacagaaatgcaactaatttttgtatatcgaccttgtatcatccagcattactaaactcacttattagttctagtagtttttttgtagatttcatgctatattttatatagatcatgttatctgtgaataaagacttgttttgcatcttccttttgaatatggatgccttttttgcactggctagaacctgtagcacaatgttgaatagaagtgtaaatgtggacatctttgccttgcccccaatcttagcagggaaagcattcaggcttccaccaacagacacgatgatatctgtagtattttccatagatgccttttagcaggttaaagaagttcccttctatttctagtttgctttgagtttttatcacagtagaggctggattttctcaaattctttttctgcatctattgagataatcatagttttttttttttttctttttggtctgctaatatggtgagttacactgactaatttttagatgttaaaccgaactaccattcctggaataaactgaacttggtcataatgtaccatcatttctatatattgttaggttcgattttgtgaatttttgttaagaagttttgtatctatatccctgaaaaatattggtctgtaatgtaatgctggactcacagagtgagttagaaattgatgcctcatcttcgattttctgggagaatttgtgtaggatcaatatatttattccttaaatgtttggtagaaatcaccagtgaggccatctagcccaggagtttcctttattggaaggtttttaactgcaaattcaatttctttaatagataagggactactgggattttctacttcttcttcagtgagatttggtagtttatgtcttgcacgggaatcaccaaagataaagtcttgccacagaagggcttttaaaaattagttttgcatctcactgtggttagaaacaaaaagaaaagtagatgagttttgaagtcatgaaatatggaattagagacaaaaatactggaccgctccttcgcctatggctttgattaagcccaaaaagtttaaactggagtttgaactttgcttatgacatgcagtgctttttttctagcatgatgctttttaaagtccattcccaccaaccaagtagactacttgacttgtttctattttctgcctatgagaagggattagggctgtttctcctaattttagaaatgtaggcatacgtgacaagttggtctgtcttgttcatgctgcaagcaaaatgaaaattaacttctgaaaggatttacagcttaatattgcagccaaaaaataggtaaaagtaatatgttgttctttgcaaatgaagacagaggtcctggtgtatttgctgggttttgtactttgtaggattttttttccttctgatttttccccctagtcatgagggatggattttctatgaggcactcaattttcctggttagtcttctccacatgtaatctttccccatctgtgagcaagttaaaacatcttttgccttatcaacacatgtaagccttgtagataattaacaaataacagaatttgttgtttgaatcacagataaataacaaatagatcttaagtataagtatatccccaaatattgcatggaacatatactaatttgggacatactcatactaaaaagttacttgtggtttttctgaaattcaagcttaatgtgcatcctgtatttttatttgctaaatctgagtattcctcacatgctccctatgactagccttgggaagtgttgttctttcatagctactcagtaaattcttactaacagaagaaaaagaggcttctattttaagaacattatgggcaacatttagtttgcctgtttgtgtgttaaatgtggaaatgacctgtatttgtctcctattctgtctcctaatagctgctactactggagaactacacacatgaactcaccatctgtttcaactgggcatttttagactgtgtcccactagtccaaaagacagaaatggcactgcccttaaccatttggacttaataacagaggagacaatctgccaggatatttctaacgggacacagtctctgtcctggaatcccaacccttcctatttctgtaggcttaaaaacaaaattcttaatctcccaactagaaacgttaaaggattttgttttcaacttgtaatgattttcctaaagctatcatgttataaattagcagacaggctctgtgccaagccactaaaggccatgacactcactgtatacttaaggtctagtagcaagagtaagctcacacgatgtagaaggacatacagtttctccacgcattgcgcaactgaggaaattgaggcccagctcaatcacctgaaataattttgagtatttttattggaaaactattgccacagtttctctaaagtagtcaaaaaggaaggctgttagagtgagcaacgaatacaacagtgaaacattagcagtgctattgttggaaaagacagaaagtgaaatttaagaaaggatgtgtgaattgtgtgatatatgagttctatctcagtaaagtttttacaaaaaggaaaaagaacggatgtgactagaatttcgagagaaatggatgaaacatgaaaggtattccaggaaaatggaataataataaatagacttctatgactagagggggtgacaggtggacttgcaatggtaggttgagcctaattttgagtgcccttaaatatcatgcttaaattttgaactttgtgggtaatggggagctatcaaaggcttttgagtgaagacagaacaatcacatccaagttttagaagcatatctttttatcttctccaatgatacttctcactttctccttttgactgcagttatctcctgtatcaagcttttagtttcctgagtgcaaggaacatgttttctaaatatttgtcttttttccatagtgcccaacacagtgcctttatacatagcaggtgtgcattaaagattgtctagcaagcatacagcaggcactcaataaatacttgctgagtaaatgaataaatgtaatcattgcaatgctagttataactctactttcccctcctactttggaaagcatataagaaagcaaatgagtaggagtgactcaattacagaaagaaacatgaatcccctcttaattttctgaaaaattaaggggaagaatttgtattttgactattattactaacaattatttttgacacacatcataactgaatttgtcacacaagtgtgccatgatgctacttgtagggttttcagacaaaacagatgacactcagttaaatttgaattgcagataaataacaaatatatcttaagtataagtatatccccaaatattgcatggaacatatactaatttgggacatactcatactaaaaagttacttgtggtttttctgaaattcaagcttaatgtgcatcctgtatttttatttgctaaatctgagtattcctcacatgctccctatgactagccttgggaagtgttgttctttcatagctactcagtaaattcttactaacagaggaaaaagaggcttctgttttaagaacattacgggcaacatttagtttgcctgtttgtgtgttaagcatttacttgttggatttactttaaggtctaactgggtagtactatatcccctcaggccctggttcatactggctggctagagcttttcaagtgaaacctggcatgcctgttcctcttttacccctgatgccatcagttgtttttatctatggtgtgaacacagttgagcagatgttggagggaaatggcttcctgaaatattcagaaatgtctggtgtcagcttcttccttaaaataaagtataggtgacaagtcccacatggtaggaagccagctcccacagatcacttccttctcttctcagagtctttcattcataaactcatagggagctgttcttaaaaggcaaatgcacattaaacatgggacagaacccagcttggtttaatgtgtgtttgaatgtgtgtgtgtgtttgtgtgtgtgtatgtgtgtgtgtgcccgtgtgtgtgtatgttcacatttcaatgcaaaggttttaggttttgttttagaattgctcaaagtaaagccagattctttgtattattagcaagaagttcataaacgtagggtgatgttaaacggggcctagtttaagggaagagctctaagattttgagccaaacctgggtctgaatttatgctgctccctagctgactgaccttgggaaggcaaactaaccccttgaagcatcagcttttttatctgtaaaatgataatggtaatagtgcctacctcatggtggaggtggaacagttcagtgagataacagaagtgaactacttaattaggcacataacagatgctcacggtagccattattgtgaatgtggccccaggataggtctgatctagccaaagaggcctcagaatttctggaccctgaggccactggcagggaatgaagattatatatatatatacctcagcatcttgtattatttttctcttttagatgtttggctctcttcactttgtcacttaactagcaaatgataccaactgtctgaaactcaggatgtttttttaatctggaaaatggtcatatgaaaaataattcgtttcaaaagtagttataagaattatatatgaaggttatttagaaaatgtacacacagtacaaataatattgtgaagtaagtagagtaatattgataaaaagtacccccaaataggcacctgtcaaccctcatcttttttttcctgactttttaagtttcaggccaattcctggaactagtggcagcagttccaataaaaaacaacaacaaaaacaaaaaacaaaatgaaacaaaacaaaaaaacaagagtcacacagttgaaggtatctggtttcttatccccactctgatacttaactttctatgttgaaaaagtcacttaacagctgagttttcatttcctcatctttaaaatgggaattagtcattgaatgagaacctattaggcatccacatgcacagtactagagactgtaattgtaaataataccagctgacatagattgagcgtattctcaatataccaagcacttgacaaagagcatcatcttatttaacctcactaaaccctataaagtaaaatatccctattttatagtgcaggaaattgaggcttaaaggatttccattgatttgtcttatagtgaacccaagatcttcatctcaaaggaacctaatgtctaggagggtaggtgaagatataaataaatcattgtaatgttgcatacgtgtctatgtctctacacagacacatacatctaaaatatctatttcagatttgtggtggaaaatcaaatgagattttatgtgaaagacattttgaagaaacctgaagttattaaaaggggatagtttcattatgctgtatgaaaccaggaatgagcagccatttcaacaaccatttactgtgctaattcaagacaaatttattatattccaaggactgtcttgttttgcactgtgcagagtattaacagagctaacgtctttacaggaccacaccttctttcttctgagacatagtcacaatcctaaaaccgatgcatttctttaaccccgccagagtcaatcatccattgatcctactacctttctactgccccttgcccaccgcctgtgctcagttccttccacaggaaacctagatcctatggtccataatcataatcacttctttccatatacccttgactcccttgcccctcttttcctttatcatcctcacctagcagaccccaaccttgattaaatccaactcttcctctaatcttcatatgtatccacgtggctggacaagtctaccaaaaacctcacaatattgataactgatgttcgtttaagtccatgaccaccaaattcaagtgggcccttagagctgccttgcagtcctgccacatttccctagttcatgccttctccttgctctcctaactgatcatgtcacaccttatttctccacaaacctccagtaactccttcatgttcttattctcagttgataaccttgattcttgtttcactgagaggaaaaaataagtatgttgaagagaatgtctgcatgcttccattaccacatcaactaccctacctgcatctgtatctatgtattctgccttcccacctgtcactgtggatgaactttcaattctcttacctaagggcattccatcaacttctgtattagataccatcctctcttgtacacttaaagtcatccccaacaattcttccatctctctcctgtgtcaacacatattccctcaaactactaatatatttcaatatctccaatcttaacaaaaaaattaaacatacttcttaccccatgtccctctctggctacagtgccatttcttccattcccaatacccctttagataattggctatcctggactactccagttcctcacttcccactctgtattgaaccccttgcaatctggcttttagccacactaagccactgaaatttatctggtacagatcaccacattgctaaatccattggtatgttttcatatcttgtcttacttgacctgtcaacaatttaagtttatcactttttttcctccttgctttccaggacccctctggttgttgattctttactcatctcactggctactccctctcagattccttctcaagtacctcctcatgctctcttaacactgacatgcttcagtgcttaattctagggtgtattctcttccctttatctacctccactcccttggtaatctcatctactttggaggctttttgtttttttagagagggtctcactctgtcactcaggctgggtgcagtggcacgatcagcctcaaactcctgggctccagtgatcctcctgcctcagcctcctgagtagctgggactacaggcacatgccatcacacctgtctaatttttttgtagagatggggtatcaccatgttgcccaggctggtctcgaactcctcggctcaagcgatccccctgccttggcttcccaagtgctgggattacaaattacagacacaagccaccacacctaaccccttggctttatataacaatgatagcagagatggtgatctccagataaaccatgttctctcctactctccatgttgttaggttttccagtatgtctggttctttctaaagagaatatgaacacaagagatgtatcacttccagtaatggggaattaagagcagttactaggatctgagatagtggagttgctagacaaaagcagcttggaaatccaagtcacctttggagaaggccactaagaggagctgcttgtgtcttattggattatgactctataaattgccttgggcagtatggccgttttcacgatattgattcttcctacccatgagcatggaatattcttccatttgtttgtatcctcttttatttcattgagcagtggtttgtagttctccttgaagaggtccttcacgtcccttgtaagttggattcctgggtattttattctctttgaagcaattgtgaatgggagttcactcatgatttgtctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccatttatttccttctcctgcctaatcgccctggccagaacttccaacactatgttgaataggagtggtgagagagggcatccctgtcttgtgccagttttcaaagggaatgcttccagtttttgcccattcattatgatactggctgtgggtttgtcatagatagctcttattattttgagatacgtcccatcaatacctaatttattgagagtttttagcatgaagggttgttgaattttgtcaaaggccttttctgcatctattgagataaacatgtggtttttgtctttggttctgtttatatgctggattacatttattgatttgcatatattgaatcagccttgcatcccagggatgaagccctcttgatcatggtggataacaaggtaatttatagattcaatgccatctccatcaagctaccaatgactttcttcacagaattggaaaaaactactttaaagttcatatggaaccaaaaaagagcccgcatcaccaagtcaatcctaagccaaaagaacaaagctggaggcatcacgctacctgacttcaaactatactacaaggctacagtcaccaaaacagcatggtactggtaccaaaacagagatatagatcaatggaacagaacggagccctcagaaataacgccacatatctacaactatctgatctttgacaaacctgagaaaaacaagcaatggggaaaggattccctatttaataaatggtgctgggaaaactggctagccgtatgtagaaagctgaaactggatcccttccttacaccttatacgaaaattaattcaagatggattaaagactgaaacattagacctaaaaccataaaaaccctagaagaaaacctaggcactaccattcaggattatgacaaaagtgagaaatcaaactttgtgtgctaaaccattgcgatcttaagtttgttaccacaacgtagtcaagtctatactgactaaggcatcttccttgaattccagacttccatagccagctcctcaactcctccatttgaatatcttatacacatctcaaaaccagaattcctgacgcttcccaagcaagcttctccaacagttttctccatctgaataaatggcaattgcatccttgtagttgcctagtacagaaactttggagtcattcttgacttctccctttcagtcacatcccacatccaatccatcagcaaatcctagcagctctacctttaaaacatacctagaatcattttacttctgtcagactctataactgcctctctgttataaacatccatcatcctgctgaactaccgcaacagcctcctaggtggcctttctgcttctgtgcttgccccactacagttcacatggcagcttgagtaatcctccttaaaaagtaaatcaactggtgtcactcatatgttccaagcccttcagtggatttccaggggcaaagctcttacattggtctatgaaatcttctatgatctggctcttgctccaactctggctttaccatgtatcccatccccctattcactgaactccaggcttctggcctccttgctgtagccaaaacatcaagcatattctctcatttactgcctttgcacttgctgttccctttgcctagaatactctttcctcagatattcacataactcattccttcatcttctatagcagtgtttctgaaacattatgtgcatcagaatcacctgaagggcttgttaaaacatagatttctgagccccaccctaaagtttatgattcagtggatcgtggaggagacaagaatttacaactctaacaatttcccaggactgatgattctgggccaaggactgtgctttgaaaaacactgttttctgctcagaagtccccttataagcaaggccttctctgacttccttatataaaataacaacctaaccccaacacttcctaccctcttacccaatttagtttcctccataatacagatcaactgacaaatatgtatgtaatattcatttactgtttgtcttccctctaaattttaaacaccatgaaaacaaggacttggtttcacttatggctgtatgatactgccactatcacccatctctaacacagtgcctagtacatagtaggcacttaataaatatttgttgaatgaatggtgagaataaaattatacacagccagtcttctgtgacctaagcttctggagaaaattgctcacaaagataactggcctttgcaatccaatcacttcagctaagcctctgttacttcctatcttgcttcctgggttaccttttgcatcattgtcatccttgccaacccccatgcaagaaagcactggtgatgcctagaaaagcctattggttggtggtagaggcactgtgatgtaactctttatttcaggagacccaggagaaacgaagaatcccaagtgatgctgatctctaacacttgtaactcaattgttctgagagcaattatttcacagcccttcactgaatatctgctgtgacagggctgcagagaagcataagacatggtcctgatcccagtctgatggcagaatcaaattgagtaaaatactgcaaaactccatcagcaaagggaagagagtaagaactgctcctgaaattgctgagagggaggcagtgtataagggtgtcttcaccaaaaagatggttgagctgggtttaaaagaatgaatagaagttttgtttgtggtaaagggagtaggaaaacattttagacataggaaccagcatcagcaaaaggatagatgtgtggagtagagattatatttaaaatatttagcaatatttagggttatggtttagcaaaccctaacctttaaccctaattgctaaatatttttagcatttaaaaataattttggaggccgatgtgggaggatcacttcaggccaggagttcgagatcagcatggccaacatggcaaaaccccatctctactaaaaatacaaaaattagctgggtgtggtggcaggtgcctgtaatcccagctactcaggaagctgaggcagagaatggcttgaacctgggaggcggaggctgcagtgagcccaggtcgcaccactgcactccagcctgggtgacagagtgatactccatctcaaaaaaaagttaagtgagtgcagtgattctctgaaatgagaaataacttgtagtggtgatctgggggaaaaaagtacaatcttccctttatttactaggcatttttattcagtaacaataaaaccatgaaaaattcatttcaatgtataaaatgtgattatgttcttgattcagataattacatatacagacatcaacaaatccaaatggacatcctgaccaagcaaagtgaacatcagctatagacaaactggcatgatcataccagtgcacagcacttgataaggagctccagagagagaccagaatgttgcaaaaaatgctgagtagtctagtatagctaatgttaatataataataatagctgacacttagtgcatactataagccaggtactatgttttgcatgcttaatcttattgagtcctccaatcaaactctgtacagtagatactgttgccatcctcattttacagataggaaaattgggtttcagagagataaagtcagttgcctaagttcatccaactcggaaatattagagctgggatttaaacctgtacagactgactccagaacttatattcctaattaagggatactgcctcagatattggctagaacatagttttgccccttaacactgtggttttatacaaaggagtaaaataaattgacttttcccttataaacgttatggtctggatgaggaaacaagactctcagctatgcaaccttaggaacattgcaaagactctcccataacaacatgagacacttacccagtgaatgggacttagggagtattgtggttcaccgaagctgaagtggtcatggaaaatatagaacttgaatttggccttgagaggtacggaacagtaggaagaatattgcattatgttcagaagtgttagaatccacttgttaacagtgtgacccaagccaaaataatcttcttcagtgttatcatctgtaaaatgggtgatttggattagaccaatacttcttaacaaaagtacaccccaggaggtattttggaacttgtgaggccatttgtgattgtcaaaatgatcagggagtcagggacacttactaggtggctgccaggaatgacaggtgttctgaatactatgcatcctgaaggatagagaagacctctggatattcatggagatgaaaactgtttataattatttaagtctagaacataaccacattttacatattgaaatgaagtttttcatggttttcttgttacaaataaaactgcccagtaaataaagggaagattgtacttcctgccccccacccacgatcatcaccatgagttgtttatcatttgagagaatcactgcacttactaatagcaactgcattcatgatacttgaatcatcaatactacatcccagtgtcattctgtgtcagcagcctgttacattcataataattctctatagagctgttggcctctgactaccacttcatgacatcttctaatatagccatgtatgagcttttatatattgaaatacatatctttttaatataaattacttttcttctttttttttctttgcaatacagttagggcataatatgtgcttttaaaatttttgcttaattaggagatatacctaatgctaaatgacgagttaatgggtgcagcacaccaacatggcacatgtatacatatgtaacaaacctgcacgttgtgcacatgtaccctaaaacttaaagtataataataataagatttaaaaaaatttttttgcttacatttttattataacttattcctatgaatttatttttaggatagcaagggagagtaataattataataaaaataataaagtactgctcggatagagttaagaaccactgtattagatgatctcccaaagcctttccagttttaattttcttgggtataagatgggcttgatcttgagagaaaagggagagcattccaaggtggaaatgacaccagccacatggcctggtcaagcagggggtggagtgtccccagacaagccaggataaggcagaggcttctcaggtctagtctggtcatgttccctggaagcctgccttcactcctcccacctcactgtaattgaagactcctggggaaactgccagggctggcattacaggaaattgccttgtggccaacagggcttctctggttactttcctcagtgacaaaggacagtgatgatttcctgttagctgagtgtctttgcctccttgttctggcgagttcctaagaaaccttagcttctgattcttatggttttgttcagctcctgctattgttttttttttccctgtcttatccagttcccttgcttccagcctctttgctccatgcttgaggggtctggaaatttttcatctactatagaccaattttatggaacactcaaacagacattgtttggaagtaggccatagctccaaatagatgccatttcaactttggcaacacctgtcaagttctcttccttgaaggggatgacttttatcacttaatattatgtattattttgtattcttaataattatatgtgcttgttgaagactgcttagaaaacacagaaatgtatggagaaggaaatacaaattatccataataccaagaaatatagtactcaacattagacaagggtgtaagcataggtgaagataaaattcaatgctgctctctcagttctctcttgtattccagcccctagcttcctcctgccagagtacctcttgatctcacccttattaaaacttgcctgtcctatattccataaaatggaaggtaaactggaaagtgtgcaataacacttaccatgtcaagggcttataagagagataaaatataacgtataaggaaggtgtttggaatctaaaatagtaatattttgtcatagctttgccatctttaccttattaccaaggtgttgtgatgataaagtgttgtgggaatgtctaaagagataagagaccatctgagaaattcacagtgctctctaggaattaggaaaaggcacacagtacacagaggcaagaatgattaagtgtgaggtcagctcataaatatgcctttctctttggaaaaaacatccaacattaaacaaaaaagttggatggtactaaatccatcccagagataaagttcttgttacagataacagttagaatttatgttttccttttttcccaaggtggatatggtcagaatggcagtttttctcattgttgagtccttgtattgaggttctggtagacaaaggacttagaaaacactaaggcttaagggttaaggtcaagactttggagttagtcagacccgagttcaaatcctaactccattaatatagtcaccaaaaattccttgagtgtcatccatggtttcagacattggagatgcagtgttggacaaaacaatgaagtccctacttacatgaagcttacattctagtaggagtaaagagaatgtctaacgatgaaaaggtaatgaaatgatatgattggaagtaacaggagactcagcaatggcctctctgagaatggacaattgaactgagacctgagtgatgaaaagaggccaggatttttaaaaaatatctaggagaagaacattgcagaaaaaagtaacagcgagggcagaggccctgaggcaggaacaggcttgatgtttttaatgaacagaatgaacgccctcctgtgtgactgaagcagagtgagccagagagaaaggagatgaggttggtgaggatcagcacatggcaggtcatgtgggggccttgcagaaattcagctagcaatcatcacgatcaatcagaggagaggcaaaaatgaagttagagagcttggggggtactgtaaaataccaactgaggaatttggatctgactaactgggcatgggagtgccactgtaaggtgtgaattgtgtgctgaaatggagtttgaggagaacaattccgagagcagagtacaaggtagccattttcatttgtcactacatatctagcacttgaatttcactcaagttatctgctacagctacttctttaccaatgagtgcaaatccataagtcactggacacctgttttcacaggaatatgtctagagtctatttccagcccccaagtaaagatattctgttgtatattgtgcctggaatttctaccagtgaggaggtgtctaaagcaaagttcccaaaccggctatttatttgataaggtatagacctgaactaaaaggatgctagcttaagtttagtttttatttcatttgactactgacaacatcagataagatcattaagccgcaatagatttacttggtaaagaagctaagagttaggtctgctgggacaacattgcttcttggttcacatggtttattaactttttcctttttttaatagggagagaagtcttatggaaagccatgtgggggccaggactgcagtgggagctgtcagtgttttcctgagaaaggagcgagagtaagttgcttatttcattgttgaaagacaaatagtggcatgggagctgttatctgttttctttagaaataaactgcttagaatttactcttatgacctcatggaacaagcaaagtgatgaggaccagctggaaggagctttgctaactaatgatagtcagagttagattggtcaaactctctgaggtaccaagaagaggtttccttcattcacttaatgccaaggtttcctcagagtttcatctggagtttttccaaaagccaattaggttgtagagagccagattgtgacaatgtttgtagataagtgtacattttcatagctcacttgattcttccctcccagtctggggaacaggtgttccaattgttatctacagactgtggatgtgacttgtccaaaatcaccctgcttgttagtgatagactcaagagaacaaggtagccataaagtccagaaatataggtgacgatacataaagaatggtttataggtattaaattacaacataggatacgttttaaagtgttgtgacacagtccgtgtattgtccctcattagcaatgcacagttcaaattgttgtgcaaattgcaatgaactcagtcattgacacaacatttctatcaatccctgaatatgcatagcccctagatatttgtatctatgattttcactgaaataaatgcatttttattataacccaggaaaagtgttgaaaggggttcaatctgaaaaaaaaattagacacatacacaagttgagcatccctaattcaaaaatctgaaatctgaaatgtttcaaaacccaacatttcctgagtactgatgtgacactcagaggagatgctcattggagcattttggattttggatttttggactagggatgatccatctgtgtgtgtgtgtgtgtgtgtgtgtgtgtgtgtgtgtgtgtgtgtgtgtttccaggattaatggccatcctacagagttcagaacttcccatttctagcattgtgaatacactctcatcacactcaaagaagactaagggcttatactgtcaaaataaagtagtactataaataggtcaaccaaactttcaaacccatagccaaacagggaacacagtgaccgttccaccttctctttcattatcttacatttggggtaaagtaaaatgtcaaactatgccagaatttgaaggaagagaataaaaatccatcttctcatcaaaggggactagatctattctacattaaagacatggacttagagaatcgtaaaatatgagaaagggaaggtatcttagtaagcttcacatcttatttgttgattgtacagaggaaacagacgcagaagaaaaattacttcctgggatcacatagcaaagtgatgacagattccaggcctttatctgggtcctttgatttctcatctatttacgtcaccagcttatctactgctgcctctcacggaagacatgttcactgtagccaccaagacccatgccctcacctctgaaacattctagaaaaaaaatttcacaataaatatatgaacacattcttgaataacatgcaagcagtatagacaaagcaaaaatctctcttggtgctctttcagtgccattattgtctttcttatctttttccatacataatcagagatatgtacacgtatgtctaaaaatagtctcattatctgattttcttttccaaaatagaattctaagtatatattctgggccccttttgtaaacttaacgtgtccttaagatctttttctctaccccatagtttaattcagccacccttttgacagctacttaggttgtttctaaatttttgctatttgtaaaatggcagagctacagtgaaaatcttagagtaggcctccttgtgttcaagcatagatactagctcaagcatagatacatctctagcatagatactaaggatcataattacctggtagaagggtaatagacatttttaaccttcaaagccattgacaaattaggctacaaagtattctccaatttatattcccatcagcattgcacaaaaatgcccatctttctacacccttgccaacacttgatatttttgctaatatgatgagtgaaaatcattctaattccctgagtttaaatgtcttttcacatattacctggaaattcatatttcttctgtgaatttcctggacatattctttagccactttcctaactgatgattcttattgacttactttacctctgcaaagatacagcaaataaaaatgacccaaatcgatgcaagtgagatttgaggtttgacacaaaggacatttcctgatggattgtggcagggtgagaagcagttagacacaacaaccaggaaactgagaagctctgggctgtttgttgggttggggagcctttaaaagtagaaaatcttatatatctgatcggaggtcagtcctacaccaggcaaacatgcctacagtgatctcattgttaagcccctggctaagattttgatctctggaaatggagggcagtagatttatttcatgaggagccctcatttaggtttcaaacatctggagccttagtctggcttctcttttgaaaacatctgagtggctgaggggatggaggatggaggaaattagaatatccctgcacagatttttacctcaatatttaaaagacacagactccacactgtcaaatatgttcctaaaaatgtatttgcaaagtctaaagtttcaaagaatgtttgtcaaagttactgaaccagaccaagccatatttcatgagtcaagagcaggaatgtcctatttcccaaatagataagaccgatgctcatgcagaaaactgaacgtggatgcttgaagcaccaccaggtcctgtttagtcatcctccctttcctcctaccttcccagggccaagcagaattgtttaaattggccccagcactattgaccctgcaggacagcctctcagtaccccttgtgtgcagatgtcagaaagatttgggactgttctccttagctgagcagagggcaccatttatatttcaagctgttcctcttgagctgggagggcaacggaacattgggtcaccctgagatgtgctgcagcccttggcaggcctgccccctgccttggggaaacatcaagcgcatagcttgctgggcagtgtgtacttttcctttgccaaagtcctcttgaactgactaggacatttacacaacacctagcactcctgcaaaactgcaatccaaccctttttggatgaagctatctcaaacagatttctcaaaggtatgccctgcctggtaaaagtccctacctaatgttggtgcactgctttgcagtttccaaaacatcttctttcaggggctgtaatcctgtatgtatgcaacaaataaagaaactggtaagtgacttgcgcaaggtcaccagcctgctagtagctaaaccttatttagccaactttaagagaatggcaatctttaaaaatgacctgcctcatagtgttaaataaacactatgttcagatttgaacttaatatatgactttcacttttctttcttaggagttaggtgttattatctggaagaactattctttcgggttgttctcttccctggtattttttttcccctgccacttgatcaaacaaaacattttaggttgacatttccaacacttctctttttttccctactagatctgaaagctatctctgcattatactccatcagtgtgtgtttgtctgaagttggggttgggaggagggggcagtttgttttcttctgagcctagtattccttaatactcttttagagttttccctgttgtaacattgttctggtgtttatctaaaacatggtgaccccctaattatccatgccatctaaagaagcattatcacagataatccaaaaccatggggaatgcttggattgccctctaggtaaaggctgtttgtcccccattttatgacttgggactttatgcctagcttgagagtttatgaagttagcctgagtttcatgagaaactgagcccaagtttcttaattccttatatcctgcctacatcctgctgttccactgccgcaaaatgtgtttcccatgaattccagaacctagatgcattaacaactagcccttcaatttattctcctcctgcaaacatctggcattccctgtgtcagctgactggtgccatggctaccaagaagcctttccattttctccttaattaggaaattgcaatgtacatctttcctcctccctgtgtatcccctcatgtccctctcctgactacccactacaacacacaccaatgtctttgtcctctactgctccaacatgaaagctcatattttatatcacctccttgggtggccaggcctttctccagctgcctgcacttaagttttgtgccttatttcatgacaaatatttgccctctcactcctcagacatttgtgggctggccctattgctgacactaatcactactaacttacttgttgccaaatccaatggatatttttcattccttatcttccttgatggccctgctatataagacaccttcttctctcctgaaactttctgttcccttgaatgttatgctatcctttcctagttcttttcctactgtgattgggatcccccagcattctgtcctcatcccacttttcttctcagtgtaggcctctcccagggtggttttatatactgcagggatttcagccaccatccataaaatgataaatattaaatctctagctctagttcagatctttcttcttagtttctgattggcattgtcaatttcttgctggatatctctgcttagatttcactggcaccataaacatgtctatacagaactccattaccaacccccaccagatgtactccttcctaaattctatctatgtcttccccatcacaacaaatggcatcaacaagcactgagctgctcaagccagaaaactgggagtcatgcttgtcttctctttcctttccctactacctccaatccatcattaagtcctgtccatttgtcttctgaaattgaacttgaatacatacacttctctccatacccatttctccaatctaggctcatataatttcttgccagaattacctcaataacctcaagactgatctctcagcctctaatctcactctcccccatcaatttgccactgtcctgccataatctttccaaaacacaaatatgtatcatgaaactcttgcttaaagtccttcaatggctcccccatggacttcacaataaaatccgaactctagaaaacctataaagtcctttattacctggccctggactacctctccaatattatctctcattattaggaaccctcctcacttcagaaaacaaaacaagacaaatattttcaaaaaacatatgagttcactgaactatttatagtcctcagagctactgtgttgtttaatgtgttgcaggttttatacttgccaccccttctacatatactagtcttccactagctctgccctttctctgttgacttgcttctatttttccatcctttaaaactgagcacagatttcacctctttgggaagatttccatgatctgccaggctggggttgtctactcttaccatcatttctcttcacttgtctgctctccactatcttaagaacaattaaagggcagagacagtgttcttagactctgcagagtccgtaggcactacacactgtctcatgaaagactgaccaactgaccaagcaattttgcataggtgtggttctagccctactctccacatccaggattagctgttaggatgctgtgaagttgatgggaagtctcctgttgagggagtaatccctgctgctgaaagaaggcaaagagctggggcagtcattttcacatcttctttagctcctgttagctgcaaggaccacacatctgatttcgatggttttctctgggattctgctttccttaactcctctgagtttttgacctggcctcttcttttgcttgattgcttcttactctatacctaataatgcaagggacttggcaaaatgcttatcttttacttccaacaattcattctttctccaagatgagaacattaatgaataattgtgtcaaaggtaatccctaactttctttgtgacgttgtttccaccctcctctccaccaaacctttcattaaaaacctcttaaccttttgcaaagttgatggtcttgttcctcttccttgtgggaggggggaagtaacgtctgagcagagaagtagccactaggtggtagtaaaggacggggtagaaaatcaggggtctttgtatatttacatatggttctttcggttcaggataattaatgatagtgttaaaacatgtgtctctgcacagaatcaagatgcaatcatagccctgcagatgttcgtggttatcttaatcatttatttgattgtattgtgacattacaggatttatggaatatattatatgtactagtgagggaggcttctgctagagaagagccaaggagctggagaaggagatagataaatacacagctgtggagacaagaacactgctttaactatccagagacctaagtgtcatgcgtgagctttgccaactggatgactttggtttggtgctttcccctctcaaggtctcagttttcccataggtgggatgagagatttgggatgtgtgatctcaaaggacctgcaagctctgacaatctaagtcagacaccacattactgtaccctgatggttccttgcccctagagtgcattatcgtgctttctagtattgaagtgagatacggaaggtgatgtttgacaatgtcctatcctctgaatggtgtcttggcagctgcctcagatataactcatttgctgtggcttctttactgctgctgcttctagatgctcctgacagctgaaattgtgcttctgcaggaatgtgcaggactctccttccttggtcatctggatggtgtgatttgaagagtcacaggaatttctcttcaccaaaacccaacaaaatcttccctgccttgcctaggagtcattctgcttaccgttctagctttagaaactcgctctttaaatgaagcattgccctgtccttgcattgcttgtataaatctcatgtgcctctctgatgagaggagccatgctcactctgcatatctgtgtgcacaaatcacaaattttgggggaccactcagttttccttttgctgtccctgctaagtcatatgacagagacatcagatattaagacatgagtgagcatcttgcaggtcaacaagcgacatattatctcctcctagtctaccccctccttcagttgccagatgtgtgcccctttttgcttcttgttcttcctttcctccctagtctctaacttccccttttctccctcaagacttccttccctcttgctccatttctagctttccatccctcattcctggtttctccaccatggcctcctcctcacctagtttctcccctctgccttcagttgcctgggattgcttcctatgtcacttatctttgactccagtttctattttttgtcatttatcagcacacatgaaaactgcagcagcaggatagcagggaggagttgctgcaatgtactttatagaggcatcccacttatccaaagattcttaatctcagagcctgaataagtggtctgcaaattgggggggtggaggggggagggcatgcaggtcaatttgttgggtatagaagaaaatatgaaaatttctattcacatttaatttgagagacactagaaagaaattaagatttaggattaaataatttatataaagtgtttaaagctgtgtggttcactaaatgctatgtattagactattattattactattatatgtaacatgtgtattttcactggcatcctcatcaggtgagttggctttcttcggctttcctgttgtgcatactctgtaaggtatcctgagggaagagtgggggctccacaagatggaggggtgtccttggggcccttactttttttcctgaatgtataccagagatattgatgtttccttggacctagttaagtagatttatggatattatctaactacatttaaccctcacaaaatggacaagcagcttaagaagattcctgcaaatagaccatgtattggagataatactagtaatgtaagcacatggcagagctcacacttctactcctaaaatgagatttttatcagcctcattatgaagtaaaaaccatggtaatctaattacacctgacaagaagtcagcaaaaacatattgcaagaataatgaagactatatgaaatatggatttatgtcaattctcaatgatgaaagatcttgccctaagtatataattgtgccttaaggtattagctaataatataataaagccatcacaattaacaagacatttaacatgctgtttatttcatctttgtctcatccttttacactttttatttattgtgtgtttcattttatatatattatcattaatatatgggggagagattaggacatgtgtatgatttatataattgttaacaatgtataaatatacatgttttgaggaagcatgctcaaagcttttctaattgaaaaagggtgtgcaatcaaaaggatttggagaccactggcctaaaccatacttaaaatagctgggagcccgcagacagaggcaaaagaactctggataagagaaaaataactgtcacaaagtctcttgctctttccttatagcatagtcatgcaaccaactttagagcttcaccttgacaatttcacatagaataaagcaatggagatctcaggaactgggagaagtgaaacaccaaaggaacttataaaataataaaattgcaaggctggaaggttggatccagccctcaagaggtacatcgtaggttacaaaaggctttcctggcatgcctatgaatgctctttccctcactttaattatgaatgggcttggaagaaagtttcagagagattaagagactgtcccaagatctcttgtaagtgacataactgagatttaaatcaagtgttccattcccctccatagtgttctttccaccatgtcaaatggcctctgaaacctttgtggccataatcagctgagctccctgcattactcgttgcagtcagattgttgtgattggaggaatacttggagtggagaaaatctgctaggaagacatccacgagatatcaacaaatcaattgcccttcgtcctccaccctagtgagtagtaattcctgactgcatgtatagcatccatttatatccctgtctgggttttaaagtgtttttctaatatccttctcttttaaaggtttaagaaatgaattccaagcttaaggaaagcatgttttttatatgtgattacaagttctgtgaggagtcatgtcagttttcacagctgtaatgtgtgtctgtccctttatgtaggccactgactgtatgaaagttcactgcaatggagttagaaacatgtggagatgaaattaccaagtatatgtcagggaagtaatttggtgtctactttgagaagactcgcattaatggaagtcttccaagaatgtttaagaaaattaattgcacagcaactctctaagctatagtaaaagttgatggaaaaatgtgcattgctttgcagaaatttgcttcactatcatcttttcaaaagagcttttattttaacaaatgaagcacatagccaattatttaatgaccatctttacttttagaggtggaagtcctagactatgttctgtgttttcttttatctcattgtgttttgtgaggttcaagccccctagaaaaacatttaagaaagtactctgggggctaaatattggtgcaggcactgtggggaatggaaacatttcataagtaccagacttctacttagggcggctacacacacacacacacacacacacacacacgccaatgtttgactacccatcactgcatctgattaaaagtctaaatggtaaatcacgaaacctcaaatggatagactggtatggtctgtagtaattaagctatctctttttaaaaatattatgacaaaaaatatttctttaggaatattaatttggtgagggttatccagggtggattggagtaagagacatgataggcagacactaagctccctatttttagatgtaagtggcatgtccaagaccccctagcacaacagaatggaaactttgttttttctgctgcttagatgctttctttcagtggttttctctattcctgaatacacacacacacacacacacacacacacacacagagagagagagagagagacccaaactagtgatttgatgatgtgacctagtcttcactttagatgaatgtatgacattttaatttttaaaaaattagctggaaaatagttctagctcctttccctcacatttgtctaactctttggaaaccagtgtccccattggttagtccctactaattccacttaaggagaattcatcataaaatcaagtggaattggcatcactgagatgatcctgtcttgattccagaggtaggactattagatgcttttctctgtgggatgttaaaagctcctgtaattactatgatgcccagggagaaagaccaactcaaagggtcctgaaagagcatctgtttcctacctgacaaattttattgtgggggttataagtataaggcagagtttggggaatcatgaaagaaggaagtcattgtctcatataaaacagattttaaagcttggtcagcagaaaagtctgcagagtaccttagaattgtgcccttatcctgaattactggctgtgaccatggcaggctcctacggtggacttagctaagccctaggctttgctatgacagcctttacaccttttatcctcagccttataagctcagttttactttttaatttttgaagaccaaaagaaaaaatgctcatttctttagccccaagaaagattaatgtatgtttggttatcaaagaaattgtggtctctgtccttgtacatgtctttgctagttcaagtaattgtagtgactttgcattccattacttcagttaggttctctctcagagctgacacgagtcagtgattgctacccccttcacaagttgttgggggaatgccaatacagctatgagcaagggagggagctgtggaggaacatgctgtggggcccagagaggaataaggggtaaccagggttcaggagccaggtttccccagagagagacaaaaagaaagcaaacaaaaggaagagacaggtctaaacaggctccccagacagggcccctttgctttaagaacagagccttaaacttcacaaagctcagggaggaaaggaagccaggggttaaacgtggcctttgaaattcagttgaagaattattaactgaaaatatacagagagaaaagccacacatatacacagcaacatttgctattcttaaaacccattcagacactctatgaattcagaaatgtgcttaaacctgcatatccacatagatactaatattgacccctcaggaaccacaaaggtaccacaaagacacagataataaacataagaagaggctcaacagcaggaggacacagagtcccaagatgcctaacgtgggttgcttttggaggcatgtggcagacagtttagtgatctgatgcgatccattatcagaactggggtcccattgctcctgtaattggtaccagagtaagaaatttaaacttctccctgaattttactttttaaatcaagtccaaactgagccagagctctgagagcagaatagaagcccgtctctccctcttcctcctccttcataaaaggagcaaggagacttgaaggcctccaaggtcccttggaggcaccagagcctgcaatgtggcaagtccgcctgccccctccctgcatttacagtccaatgacccaacgcccccagaccccagacagtttaaccagcccccgcagggcctccttgagagtttcccagattcctgaggggaacctgatcccgccctgggatcagcatgggctcttcacagcatccccgaaagatccttgctcctcggggatccccgagaacagcacccgttcccacacacagccatccctgcagcgccatcacccacccgtggctgggaggtgacctcccagggtcagtggtgaggccgcccagggagagggcccggaggccaggcgggaaacagagcagaagcgacagaaattccccctgccagcccaggctgccaaggtagccctggacaatgccctgtctgacccgccgccccaccaagccaggccacggccagagccagagtggccttcggccctgagcgacaggagaaggcagttctgaagcaaacacggcacaaagacaaacgcagcctgggaactttgcaccagcttctacactggaaggcctaaaacgtcccttgttccaaacacccccctcattccccccaacaaaagtatttacctcatgaagaaagggagagcgctagactcacagaacagttggcagagccagaagggcaatcatctagtctgaccctttcatcttacatatggggaaacaggcccacagtaaagaagagacttaaactctgaagagtgtttttgaaaagtctttccttgattatgaaggcaagatgtgtgtgtgtgtgtgtgtggtgtgtgtactcacacacacacgtgagagagagaaaaagaggtgtggggacgagatgggatagaaaggagaagacaggagaggggagggaagggaagagaagcagaggggaggggagggactgcatgcaagcctgagccaaggaacttgtgagcaggaacactaattgcagtgcaaacaaaaatatctttgagtgtaagttgcccctcactctagagaccagattttcttcccacttcccaggggcccacagggacccagaacagggtagagaaatttgccatttggggaatacaagtaagggcagtggttgagagcatggattttggagtcagatagctaatcttttaagccctggttctatcatttactagatgtgtaaatgatacacatttacccattgattctcaaccatattgccccccagggaacatttggccatgtctgggaacatttttggttgccacaactggtggggtcatactggcatctagtgggtagaggacagggatgctactaaacatcctataatgcacaggacagcccctcacaacatagaattatccagcccaacatgtcagtagtgccaaggttaagaaactctgcattaggtgaatggtttagctattttctgaacttcaatttatttatctgtgacttgagaataatattacctatctttcagggttgttaagataattaaataggctaatacctttaaagcaattaacatagtgcctggcacaaagtaagcactccattaattattagatttgagtattatcaaaccctcccttaactccaccatctcctatagttaccatcctatttccctgttccccttatagcataatttcttgaaatatttgtttatactcaaaatttccactttcccaattctctcttgaacctattctaatcaggctttcgttgctaccactcctttcttataaaggtcacaagtgacaaacacattgttaattacaatggtaatctctcagtcctcatcttacttgacctaccatcagcatttaaaatgccttttcactctctcttttttgaaaaactttctttgcttgacttccaggatactattcctttgattattttcctaccttggtggacaaagcttcacatttcctttgttccaagagtagagggcttggtctgatttgttttgttgaatgaatgaatcaacaaataatatttactatgaagattaaaagagataattgtttaaagtgcttagcacacattaagtactcaatagtcatcaccaccatcactacgactgttagcattgatgttattgctattacaattattctcccctactgattatgagccccttgaaaatcagactaatggtactttgtcttggttctcctttgtatagagctttgttcaatagaacaatatatagccaatatccagaaaacagtttccaatgggcaggattagctgaagatggcgtgagaggagaaatattttataaagagttttactgaggttagaggtgggtggctagaggctcagaggaacagacatgcagtaggaggtcataccctacccattttcactctctgattcagaaatgataggaccacgaaagggaaggagtagcaattctcacccattaatcatcccaatacctccttgcctaggtatggaggagaagtgggcctgtggccaaatattagcatgaacagagcttatctgttgggtttgacagagtgaacaacataaattcacttttctcacagtactggattaacttaattttcagtcatcttgaactttgagtaactttatacactttcctgctcctaccaccatctttacaaatttgcaagtggcatttatattacccagagaatatggtcccttagggatagtcattagagaaagcacacaacccaaatctattagaaaacttttgaacactcaaagcatccattaggtgttgctgatcgttctgataacataatttggcagcattttcagttaaaatgaggtaataaccaaataggatctttgaaccaagtttcttttttccactaaaaacagaatgtctagatttttatataatattcaagccattaactaccaccaactgtggcattaaatggtggctagtctctcccttatccactttaccactcataccaagaaaacatccataatttggaccctgacttggaaacgtcattaaataaaacccatatgtttccaatccctgaccatccaaaaccccactcctactcacttgcattatcacccatatgcaataaccaacttgctttgcagatgggtcagcctatctgtaaattgccagataggacctgtccaagtgcagagaaaaagtttagtccgatttgcataagcaaccaaagaaaaatgtttgatccacaaaacccaaaccattaacctcaaaaggaattatgatgatacaactttattttcaaaacagcattttttcacttttttaaacaacagtcttattttttaagccttccagtaggtgcttaataaatatgcaagtgacataaaggccaccatgattttccaattggcttggctattggtggctttggcagttctactattatttgtcaaagatccttcagtatccatctgggcccacagaaagccagagctcccgaaagaagtgttgatagagcccaagggggaagttgcaattcattctggaaaggtgacccagctgccagcatcccctgagcctcctgtagatgccaaatgagctccttgtctagtaatcccatctgtgatctaaatgtatacagaaactgcccgatcatctcctcctcttgactaatgtgcacatggagatgtatttgtcctactaagatacagagattgctgtcagatctattaaagataacagttgtcatctttttaatcatcattattgtaaaaatgataaggataacacataataatgagatagtaatagctgttgctatctgtatttactctatgtcaggcattgtgctaggtattctatatatgtctcatttaattttttaaatgagatataaatatcataccataaagctcaccccttgaatgtgtagaattcagtgctttttagtatattcacaaggttctgcaaccatcaccactatctaattccagaacatttcattaccttgtctcgtttaattttcacagtagccctggggaataaatatttattttaaaccccattttgcagatgaggtaacatttacagaggttaaatgatttgcaaagctcccatagcacataagtggtggaattcagagtcaaagacagatctctctggaccccaaaccgaagcgtctctttctacctccctgatggttctttatttgtgccatggtctattttcattttcattcataggaacaccaaagggaacaattgtaaccttcttgttttgctcttctacttcttccccttttctcctttgttccttaaggaattgatggctttggtgtccctagcaactgccatcctcctgcctacctacaccacatacacacacacacacacaccaaaaaaaaaaaaaacacaattgccctaacaaaatttattctcagctagtgacattagtttgcaatgaagatcttaaacacttataaaaccttaatttgttaccctttgttagacctacttttgtttaatagaaagtcattatttagcatagtgataagaaaagaacttaggtaccaagcttggattttacgtttggtctggtttccccatactaaacatgttaccctgggcagttgacccctgtaagcctcagtttcctcagctgaaaatgaaaatagtaatcctatgtacatcacagggctgctatgagggctaaattgaatatacatgctaaatgtttgatgcaatgtcttgaaacagagtacatgctcaataaatgctggtagttattttggtagcatcagtgagtggatagaatgtggaattatagagtacttgtcaagttatatggcctagaatcaacctaggcagcctgcccacaaggcgagttttgataaaaagcatttattaagcaaggaagtgcatgccaggtagtataccaattaagttaaatagctcctgcaaattcttgccagtttaatcaactaaaaacataaagataacttttggctttaaatcgctgactgctttcctcatggcagtcacaacattttcctctttaagaatctacaatgattcccaggtgtcatcaaaaaaaaaatcacttgacctgtagaatacctagtataacctggacttgtacagtgtcaggttgggtataacctgcctgagtaaaccaagtagcctcagcagacctgtatggttgggtagaatccgaagtcccaaatatagttcagattataacccatgggctattttagagttagcaggttgggatgagaatctggaatagatttcaagccaggttatcatttaaggttttaagtagcttccaaaatccattctaagcatgggcagggtgggcagttggcagaggtccaaataggctgcctgaacacaatgtaagagcaagtaccagagacccaaacttgactaataataatattaagtacttatcataggtgagacactttgctaagggctttattatgtattaattatctctttattcttacaacagttttgtgagaataagtggtatcatcctctccattttaaaaataaaggaaatcaaaggtcacataactggaaagttgtgaagctgagattcaatcccatatctgtctggttcaaatatgcataccctcaaccattatactgtaataatacctcccaaaacactaaagtactgctggcaaccaaaggcttggagacttgggcacaaggataaaatggtcccggcaataaagctggcttgctgttttgctagacaattattgaagtggaaatcatggctttttttttttttttttttttttttgcttttttccttctctttcctttcttttttttttttttttcctaagagacgggatctcactgtgtcatccaggctggagggtagtggcatcatcataactcactgcagcctcgaacacctgggctcatgaaatctttccacttctgcctccctagtagctgagacgacagtgcttttccttctactgtgtggtggcagcagtaagccaagaggctgagatgggggctgagactttcagggaggggctcagagaagccctgagttggattgaaacagattactgtggtgatttttcagggttttatttctcttgctgttgtacacaagttcactttgtcctatagatatgtccttggaattttgtcttgattgcttcacatattctaattttcattgttcacatatagaataatagcttctatcactctacctttaaagttcttatctccttcccttcatctagaagagaaaatgcaacaagcgggagaagatgaccctttcactcttaaagagcttcataaactcctaataaaggaaatgataacaatctttctaagaggcggccccattttgcaatgatgaagtctagatgctacagaaatagtcccagcaggaaatagctgaaggcggaaggcagtgttaaacagaaagcatgtgttgaaaaccaccttggtccctttggaagatgaaaatatgttgtaagctactgctgaatgttttctcccctctagtggtcagtggaaggaggagacaatggtggtataagtggtgcctactttttaactgtaaatgcaatattacaagtgatattcgaagaaaattgcttccataagaacaatgctataaatggaattatgtttcagaccaaggatactgtatcaaaaaaattaaaaatatgaccaacagtttgtgatactaacaaaggtacaattacagtaggagtataataattctacataaaaaattaagttgtatgccttatattgggcatagatatattctatacagtgattaaaaagaggcctctgctatatcatgtttgtcatctaaatctaaaatgccacctacaataaacaatacaatacacattgactaagcatttcattaacaattttgtttgccttcttagattttaactttaaagtgctctccaaggtaatctaagttctcaccacagaaccatttataaaaagaagctccacattcacccagatattgtttaaagcgtttccaaatgtgtctctaaaattaatactggcaatttcccgtctcagctaatcctctctgcatttttggcattttgtatcaataacattaaaaatgttcacagtctttaacccaggaattctactcttatgaatttaattgaaggaaatacaggagtaagaaagatttataagtgaagatactaatcagagccctatttgtaacagtaaaaaaaaaaatagaaaaagcctatatgtcttacaataggagaatggttacttaaagaagtatggtatatcccttacagtggaatatcatatggtcacataaagtaatgtttcttggaagaatgtttaatacttgtaaaaatgcttatggcataatgttaagtgagaattatggaaaacaagtatttatacaatatgatcacaattttgtaatgataattattctacacccaatttttaaaaaaggttgaaatgacatgcactaaaatgttgtcagtgcttatcaccagcagagaggattatggggaaattgttggacatgcagagaaagagaagaccacaaaagagactgagaaagtatcagtaaataaggtcctaatgagagctgaggaaatgaggtgactggagctagataatggagctgggtaggtcctcttggacagaagcctaggttgattctgtgaatgagagggcagacccaactagagtgactagccaccctggtttgcacaggactgagggctttcccaagacatgggacttaatgtgctaacactggaaatgtcctaggcaaactggaatgaattggtcaccccagactcaagacgtatctgatttggaaggccctatgtgatctccaaattcaacctctttctttttcagattaaaaagcacccaggaactgggagatgggtagtgtcatgaccaaagtcacacaggtagcagagcacaggactgagagttcaaaggatttagctctgctctctgctgtgctgcttattaacaagacatttaatctgaggtttaggttaaggacataacaccttgcgtgttcaccagattatgacaaagaccaaatttaattattcacaaatacaaggagttaccagtaacaataaacaagtattaagcacatactacattgctttgggctcaattctaagatcaaggaagtattaataattccaaatttatagaattatggtaaagtctaattgagattatatttctaagcaaattagtacaatgtttgccttctacaaaggactcattaaacgttagctctgatgattatatgtcacattttaatacatagatgtggaaatcccacaccacttaatagtaactgtgagacaggtacttttattaatgatcccattttagagacaagaaaattgtggcccagagaggttatttgccttgcttaattttatacagtcagcaagtgacaaggccatttgtctcctggtcaagccctcttttctacttcattaaattccactcagtagaaagcctttttggatgagagcacagtgaacactttttctttttacagtaaacttccttcttcctacttacatcttcagtttaatgaaagcctcctcttggactaaatagaggccaccagggagccttccatgagatattttgttagcaatcttctgagaatttcaagatcctttagaaacattgtaaaacaattatagagtctgcagaatatcgcttacagggtaaggattaaagttagggatgctctggtaaatgtttaaccactggctctgggagagggtgagagggggacactgattagtaacatttgcagatatccatggtgtaagtatttccagcatggctgatttcaaactactgacgagattcgctcctgcaaaccagtgccagccaatgcaggccagtgcaagccagttccagcacaccactggaagcagaattccatgaggccattgctatccttagtttatataaattcaataagaattaaagtgtgagcgttattcagggagcttggttttaatatatgcaaaagggagagagaagtgagtgcaggccaatgggctgggatattgcagagagtaggacaacttaagggaatgcccagaggaatggaggttgctgcctgcaagtctatgtctggcccttcttgaaaccttttaggaacaccaaagcttgcacctacaataattagagaagtttttttttaaaacgaaaacaaaaacaaaaacaaaaacttggcacaagccttttgttttcctgccaactttttaatttgaacattttcaaaccttcagaaaagttgcaagaatagtacaaagaacacccatatacctttcacctagattcaccaattgttaatatttttccacacttgctccatctctttatttctacaaactatttgagagtgagttgcagatatttgaattttcacccctaaatacttaagcatgaatctcctaagaacaaagacactctgatacacacacacacacacacacacacacacacacacacacacacactatactcattgctcttgggaaatataacattgataaaatatacaggtttagagtctgtagtcaaacttccccgttatcccaatgatgtccttataattttgttttttcaatgcagaatccaatcaaagattatgctttgcatttagctgacagcctctttgatctccattaatctagaacaattccccagacccccacttttattcttttgtcttttatgatgctgatatttgttaagagtccaggccagttgttttgcagaatatctctcagttagatttgtctgattatttctcatgaatacattgcagttaaaccttttagtttactaccatgttatgtccttctcagtgtctcacatcaggaggaacatgatgtcatttttccaattattggtaatgttaaacataatcatttggttagggtggcgcccaatatatttctccattgcaatgataccagtaaagcttatcatttgtgtgaatattcagttccaggagaagcttctttacactgaaagtataaattacttggttcactgcagaaccatgggttgaaaaggcattatccctaattaaatgaaaaaaaaaagagatttatttaaaaataagctggcactaagcttcttagccaaattcatgaactattcacatgacaagggaccttatctaaataaggagttccatatctaaattgtgaactcctggtagagtattatgccccagtctatacacgcctttatgtctagaacttagcctagtgcctaggctatagtatatgctcagaaaaaggttattgaataaatttctgtccaattggaattactgtctccatgaatgagaaattaatcatactaaacaaaaaaaatgtactttttttgtcaactggcaccagctggaattgatttggctgcttaagtactatgtttctcatgggaaatgacagagcttttcgttttcatccaggtatttgaccttacttaggcactattcaagcctttggctgctctaaaaatcttagcttttctatatcaaaattagaagctgttctaaataaattaaagatcaaccctgtgcttgttaagattatatttggctacaaatgacagaaaacccaaaataacagttaattaaacaatacagtcatttatttctctctgatataaaagttcccacttttggccaagatggagcaacaggggctggacttaccctcatgcctaaaacaagtgaaaaaccagacaaaaggaaaacaatggttttcagacattggataccaggccacaaggaacagtgattcctgagagacaggaaactaacaaggtgagccctatgatgaccccagcttattacctggacagagtttcccggcagtggtacaaggacagggaactgaggcaaagcccagtagatgaggagatgcagctgggaatccagggagacctagacaggtagaatttgcagaacaagtattagagaagagagagctgcatgaaaagagaactccggagatatttggagtcctccttgaatcttcggttgagcactgagcaacacatgtgtgtaaggaaactaacctagactggggaaagaactacccaaaaggagcagaaggaacaatcctcagagatcatatagggctgtaaatagtgcctgccccaccagccagaatagaaaactttataactcacatagcatcagagtactaaaaggatcatgcctcagtagcagtgccaaattagccctaaactcaaggctgctctagagctgccaaataaagttttaaaacaagccttgaaagaatctgtttccaagtaagttaactgtgtcacagagcaaagccaaggagtatttacagaaacacaaaatatccagcacccaaccagataaaattcacatctgacttacaaacaaaaacgaccaggcatcaaaaagagcagggaaataggactcctaatgagaaaagtcaaccaaccaaaactgacccagaaataacacagattataggattacaagacaaagacgtttaaacagttattataacttttggtgtttttaagaacctagatgaaaaattgagtatattaagtcaagacatgaaagacccgaatagaacttctagagtagaaaaattcaatgttgagatgatgtaagagtccatgtaggtagttgtgggcttgaatggcatctccatgatcatcagggacccagactacttctatcttctttctccactattctcaacatatgatttccaattcagggtccaaaatggctgctctagcttgagccatcatatcttccttccaacagcaccatgagagactaggggaaaggagtatgcccctccatttaaagatgcttagaaatctcagccagacatgatcgctcacaccttaatcccagtgttttgggagacctggatgggaagatcacttgagcccaggagttcaagaccagcctgggcaacatagtgagactttgtctctacaaaaattttaaaaattagccaggtgtggtgatgtgcacctgtagtcccagattcttgggaggctgaggctggaggatcacttgagcccaggagctcagggctgcagtgcactatgattgtgtcactgcaccacagcctgagtgacagactgagactctgtctctaaaaaaagaaatatctcatgacatcccttttgcttacatcccatggttcagaacttagtcccagggtcacagtcacctaaaagtgagatcaagaattgtagtctttattctgggtggctatgtgcctagctaaaatgtcagagttatatcatttaatgaagaatgggaaaactgaaataggggaacagctagccatcacatctcaagttcagagcctgctcatagtgcagaagaggtcctgatccagtttgaatagcattatgatccctggcttaaaaataacttgaataagactgcccctcggtgtttttgttacctagaaattaaaaacttgtttgtggttgtttaaattccagcccccacacttctatatactttcgggtttatctcaaacaaactgccagagttgcttcattttccaaatcagtgacaccaagctagaggtggagcttaacattttgtttgacttatgcacatgtttatcattgccaagaaaccagggtcacccagcctatttataccctactcctgaaagagctcactttctttctttcctaataaagtcactaacacctgcagctgaaacaaacattcacaggagcatccacactgcattctttagaacaccagatccttcttcctgatggagaaaaaattggctcataatagatacaacccttttctatgggaccacctcactcctacccagaatttcttttggttagccatacagctattcctcaatcttgaatcacctggctgttacaacttattggtcctttttaacagcttttcagtgtttctgggtatattattgctctcataatgccaaagtggatgccattcttctcaagagatggtaggtgggcatacagttgatctgtttttatcaggcaagactgtattgctgaaaaatggcagtttttgcaaggtgccatacaaaccaagtgtcatggctggctcactgagtgttcctgcagagcattttgcactagctctgtgtgctgtcttgagcaactcagacccaaaaaaaatctgcaggaagtcaggcctgggtgctttccagttgctgatggctttgattgctttaacaaccctccgctcagacattgccatgtgacatttccactttaccccgataaaagctttctcatcctgtaatcacactgcttctctatgattagcatcacaactatcattattctttacaccaggtaatggtgaattgtgaagtataacattcacaggggttttagtatagccaactaacaatctagagaaatacttgggtggaagagattgggatagaacttccagtgctgatttggactccagattgtgacttcagaggaagattctttcctcttgggctctcctactgtgaacctgtccacagaggcatgatagaatatgcccaataaacacactcactgacctgctgtgccctatctgatttgatttcccactgggcacccagtagacccagagtatacagcctgggccgcttgggaaagaacaggtggtttttgacttgacaaaatgctgtttgtcaggtacaatttcgttttcagtaagaccttgctgtttggataaaaggaaggataggggtagaaagttgaggtaaagggaagataacctgtgggattggccaggtgtttctataaagaggaaatggacactgagaggctaagttattttccaggtgaaagtaagaagtaaacctttgttagacatggaggcacgtttgaagcttgatgctttatgaactcgaaaaactaaaactcggttccatttattttaagtaatccttctttaatcatgactatcaaaagattggtgtaaaagcttgaactgccaatgactattaatactgtaaattgcaaacatttgctagctgaatgcctgtctttctgaccacttttttattgattgggaaagcataacattctttaaactggtttgctacagatctgtaaagtgtctggatccaaatagtgattttctccagttgaggcaaatcaaagagttttttggtagtttgttttgttttgttttattttgtttctgtatgttgtcacctgtattcatgctttactatattggatcatgtctttttctttttctttttcattatactttaagttctggaatacatgtgcagaacatgcaggtttgttacataggtatacatgtgccatggtggtttgctgcacccatcagcacatcatctacattaggtatttctcctaatgctatccctcccccagccccccagcccccgacaggccccagtgtgtgatgttcccctccctgtgtccacggttctcattgttcaactcccacttaagagtgagaacatgcagtgtcagttgtctttaagtaaaaaacttgagagtttcacccaattatataaaaaagaataattcagctttttaggttttgtatctttcttttcagtgggttaaacctaaagcacaagagctgtctgtcttctgccagtcaggcagagcaatggagtagtattagcaaatcaataaatataacactaaacctactgaatgtattacagttatttctgcctctgtattttgggcttcatcatcttgctcacatttctcaagtgtgacccttcttcagatgttgtcctctatcaccagagcatcttttcaaacagcaaattagtatccatcaatcttcctcccccacagcccaccttttattaaagaggctctaccttcctcccaagccctctttttttcttggaagaccattttttcttggaagaccatgtctaatacattcttgtcactttgtatgcctttgtcatggtagattttaaaggctttcttaagtgctccagctgtaaagcactgtgtcctgctgttctctgtaatcaaggatgtcagatctcacatgatcagctttaggtactgaagagaatagaaagatagtctttgagactcattccactccccgcatccccgccgccaacccccccccaaaaaaaaaacttagggggatcaccctctggccaaaggagaatgttcatcttaaggtacagatgctctaaggcaaacattatttgaactgacaggaacatagcaagtacttactgaacacttagaagtgtacagaattgagctaggtacaggagcggaaatacaagactggcatggtatggttgtcgccttgaaagatgttctatttccagcttagggaagagagaaataaactgcaaaactgtaagagtaaacagtccatcttataaaccatcaaatgttagagttggaaaggacctttagttatcatctagccaaactgtgttttcaaactgtggatcaccaagccctaagattcagcagagtgcctcaaaggctgactatctgcccttcttgcctctatacctttcttttttttatttttttattttattttattattattatactttaagttttagggtacaagtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatcagtaagaatatgcggtgtttggttttatgttcttgcgatagtttactgagaataacaatttccaatttcatccatgtccctacaaaggacatgaactcatcattttttatggctgcatagtattccatgatgtatatgtgccacattttcttaatccagtctatcattgttggacatttgggttggttccaagtctttgctattgtgaatagtgccgcaataaacatacgtttgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacaatgtaaaactgttcgtatttctccacatcctctccagcacctgttgtttcctgactttttaatgattgccattctaactggtgtgagatggtatctcattgtggttttgatttgcatttctctgatggccagtgatgaagagcactttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattttgtaggttgcctgtgcactctgatggtattttcttttgctgtgcagaagctctttagtttaattagatcccatttgtcaattttggcttttgttgtcattgcttttggtgttttagacatgaagtctttgcccatgcgtatgtcctgaatggtaatgcctaggttttcttctagggtttttatggttttaggtctaacgtttcagtctttaatccatctcgaattaatttttgtataaggtgtaaggaagggatccagtttcagctttctacatatggctagccagttttcccagtaccatttattaaatagggaatcctttccccattgcttctttttctcaggtttgttaaagatcagatagttgtagacatgcggcgttatttctgagggctctgttgtgttccattgatctatatctctgttttggtaccagtgccatgctgttttggttactgtagccttgtagtatagtttgaagtcaggtagcgtgatgcctccagctttgttcttttggcctaggattgacttggcgatgtgggctcttttttggttccatatgaactttaaagtagttttttccaattctgtgaagaaagtcgttggtagcttgatggggatggcattgaatctataaattgccttgggcagtatggccattttcacgatgttgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtccaatcaacacctaatttattgagagtttttagcctgaagggttgttgaattttgtcaaaggccttttctgcatctgttgaggtaatcatgtggtttttgtctttggttctgtttatatgctggattacatttattgatttgtgtatgttgaaccagccttgcatcccagggatgaagcccacttgatcatggtggataagcttttcgatgtgctgctggattcggtttgccagtattttattgaggatttttgcatcaatgttcatcaaggatattggtctaaaattctcttttttggttgtgtctctgcccggctttggtatcaggatgatgctagcctcataaaatgagttagggaggattccgtctttttctattgactggaatagtttcagaaggaatggtaccagttcctccttgtacctctggtagaattcggctgtgaatctatctggtcctggactctttttggtcagtaagctattgattattgccacaatttcagagcctgttattggtctattcagagattcaacttcttcctggtttagtcttgggagggtgtatgtgtcgaggactttattcatttcttctagattttctagtttatttgcgtagaggtgtttgtagtattctctgatggtagtttgtatttctgtgggatcggtggtgatatcccctttatcattttttattgcgtctatttgattcttctctcttttcttctttattagtcttgctagcggtctatcaattttgttgatcctttcaaaaaaccagctcttggattcgttaattttttgaagggttttttgtgtctctatttccttcatttctgctctgattttagttatttcttgccttctgctagcttttgaatgtgtttgctcttgcttttctagttcttttaattgtgatctcagggtgtcaattttggatctttcctgctttctcctgtgggcatttagtgctataaatttccctctacacagtgctttgaatgtgtcccagagattctggtatgttgtgtctttgttctcattggtttcaaagaacatctttaattctgccttcatttcgttgtgtacccagaagtcattcaggagcaggttgttcagtttccatgtagttgtgcggttttgattgagtttcttaatcctgagttctagtttgattgcactgtggtctgagagatagtttgttataatttctgatcttttacatttgctgaggagtgctttacttccaactatgtggtcaattttggaataggtgtggtgtggtgctgaaaaaaatgtattttctgttgatttggggtggagaattctgtagatgtctatcaggtccacttggtgcagagctgagttcaattcctgggtatccttattaactctctgtctcgttgatctgtctaatgttgacagtgggatgttaaagtctcccattatttttgtgtgggaatctaagtctctttgtaggtcactcaggacttgccttatgaatctgggtgctcctgtattgggtgcatatatatttaggatagttagctcttcttgttgaattgatccctttaccaatatgtaatggccttctttgtctcttttgatctttgttggtttaaagtgtgttttatcagagactaggattgcaacccctgcctttttttgttttccattggcttggtagatcttcctccatccttttattttgagcctatgtgtgtctctgcacgtgagatgggtttcctgaatacagcacactgatgggtcttggctctttatccaacttgccagtctgtgtcttttaattggagcatttagttcatttacatttaaggttaatattgttatgtgtgaatttgatcctgtcatgatgatgttagctggttattttgctagttagttgatgcagtttcttcctagcctcgatggtctttacaatttggcatgtttttgcagtggctggtaccggttgttcctttccgtgtttagtgcttccttcaggatctcttgtagggcaggcctggtggtgacaaaatctctcagcatttgcttgtctgtaaaggattttatttctccttcacttatgaagcttagtttggctggatatgaaattctggattgaaaattcttttctttaagaatgttgaatattggcccccactctcttctggcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggtagttctcctggataatatcctgcagagtgttttccaacgtggttgcattctccccgtcactttcaggtacaccaatcagacatagatttggtcttttcacatagtcccatatttcttggaggctttgtttgtttctttttattcttttttctctaaacttcccttcttgcttcatttcattcatttcatcttccatcactgataccctttcttccagttgattgcatcggctcctgaggcttctgcactcttcatgtagttcttgagccttggctttcatctccatcagctcctttaagcacttctctgtattgattattctagttatactttcgtctaaatttttttcaaagttttcaacttctttgcctttggtttgaatttcctcctgtagctcggagtagtttgatcgtctgaagccttcttctctcaactcgtcaaaggcattctccgtccagctttgttctgttgctggtgaggagctgcgttcctttggaggaggagaggcgctctgctttttagagtttccagtttttctgctctgttttttccccatctttgtggttttatctatttttggtctttgatgatggtgatgtacagatgggattttggtgtggatgtcctttctgtttgttagttttccttctaacagacaggaccctcagctgcaggtctgctggagtttgctagaggtctactccagacactgcttgcctgggtaccagcagcggtggctgcagaacagcggattttcgtgaaccgcgaatgctgctgtctgatcgttcctctggaagttttgtctcagaggagtacccggccatgtgaggtgtcagtctgcccctgctggggggtgccttccagttaggctgctcgggggtcaggggtcagggacccacttgaggaggcagtctgcccgttctcagatctccagctgcgtgctgggagaaccactgctctcttcaaagctgtcagacagggacgtttaagtctgcagaggttactgctgtctttttgtttgtttgtgccctgcccccagaggtggagcctacagaggcaggcaggcctccttgagctgtggtgggctccacccagttcgagcttcagggctgctttgtttacctaagcaagcctgggcaatggtgggcacccatcccccagcctcgctgccaccttgcggtttgatcacagactgctctgctagcaatcagcgagactccatgggcgtaggaccctctgagccatgtgcgggatataatctcctggtgcgccgttttttaagcccaccggaaaagcgcagtattggggtgggagtgacccgattttccaggtgccgtctgtcacccctttctttggctaggaaagggaactccctgaccccttacgcttcccgagtgaggcaatgcctcgccctgcttcggcttgtgcacccactgtcctgcgcccactgtctggcactccctagtgagatgaacctggtacctcagatggaaatgcagaaatcacccgtcttctgcatcgctcacgctgggagctgtagaccagagctgttcctattcggccatcttcgcctctatacctttcaaccagtggtacttctttgaaattctctaagattttgtttggacaaaggttccattgctttcgaaaatttccatgttattaatctagtccagctttctcatgatacagatgaagaaacagagccccagaaagtaagggaatgtttgaggtacatagccaattaaaggttgaaatcctcagtatcctgattctagtgatccacttccccatgccacctagcagccaagcagcaaacacctttaaaatggcagagtggcttgctgccttaggaagagccacctgccttaggagcaggaagaagttgcctttggttatcctgagccaggtgctcaggtctgcattactctaggaggtcaaaaaaaggagagatcagtaagggatgtagtttagccttccattttgctgccctcaaatgtcctcatctttcacaggggataagagtacctagctggtagagttgttgtgaggattaatctagatcacacatgcaaagtatctgggacatagtaggtgctaaataaatggtagaacttaatactataactatttctttggaacataaagtgcctatcttctagctttgtggctcccaattattctataagcaaagacaatgagaatctgtgaatcagaatccaggtccaaagtttacctggtttaccagctaaatgtcaatttcatgtcagttggtgggatcaaggaacagccttaacttgccagagagcttggcatgctttggcaaggtctgtgccctactctgccagaacaaagtgctaaaaagaagatgtggtattagggcttgtttaagacataggtctggaaaatacaattctttgctttgcctctcataatctgactggcataaatgagggagataattgtcataagggatggttgtttttcttggataaattccattcttgagaaatcacgaatgaaatttcctcacttggaactaacatttgtatacattgctacaaagagatctaaacaggaggaaccttctgttttagagaaatggcctggaagacatcatggatggcattgcctgctttcatagagtatgtgcttcctgtttagtgtctgtgactttggctggggaattttccaaggcaaaggttacattttgggcttgaacttcaaagctctactcatgtgcacccgtatgccaatctcagtcccacacgattgatttcctcctgaaggcatatgtgctttcatttgggtttcggccttggagacttcaattccagtgtttgtactctgctaattcccccttagattatacattgcatcccctcttctttcaattgctttatctcctttgagcagtgatcctgatttattaaaggttaaacagtttaccccaattgcccagttagaatgtggcaagagccaagaatagaaactaggtaatatgactctagaatttgggagcttaacctctatactctattgctcagggatttcaaaagcaagaggaaacacctcatggctggtggaatcaagaattaactcatacaggatagagcaatgggctttgtgggatgcataggattttaacagaaacgaagcagtggagtaatttgagtgtgccatacagataggaaaacacaggataaatatgggccagggtacttggcttgtcttgaatataggattgcttgaaggaggtattggtagataattccttgaacatagttgaaagtatcttatggagaaactgttttgatagaatgaactatgcttagttttggaagcaatagaaggttcttcctttcttccttatttaccttttcttcccttccttcatttccatttttcttcctttcctcccaagtaatacaagtgctttatagaataaaaactataaaatttcaaaatagaataccacttgaaagcagggatgattagtgttaacatcctaatgtatatacccctagatttctttcttattaaaatatattaatataaaataattctgtgctatggaagacaagattctaagactcccacccccgcctatatgacctgtataattccctcctcttgagtgtgggtgggacctgtgaatatgatgggatattgctctcctgattaagttatgttacatggcaaaggtgctagaatagtcattcccatgattatattatagaaaaatgtccagctggctttgaagaaaaatcttcatgctgtgagagggccatgtggctgggacctgagagtagcttctaggaactaagactcactcccaacaggcagccaacaagaaaacaaggaccctggtcctaaaaccacatggaacttaatttttcaaacaaccaatgagcttgggtcacagtcctggctgatactacaattttagccagttgagtgtattaactatattttcttattttctgtattcctgatgctctggcctctggagcttcactgaatgggaagagattctccacggctagctgtatcttagagacagcaaataacttgcctaagaccatgtatttcatatgtaagccaactaacccagagcccacactctgaaccacctcctgcgtctggttcttacataccagaaggcaatattcttctgccctgatcatcgcagagccagtaaccaggaaactagagaccatccttatacccaagacccactgaaatcattcaagctagccaatccaaaacatgcttatcctgccttgcctttcccatggaaaccacaataaaggctctgggccatgctttctcctcacttcttctgcttcctgactgaccctggtgcttccccatgtagccccatgtagcatggcaagctccctcctcttaactgtgagcaacaaaacagcttttcagtggcacttatctcttgctctgtagacctcatcatacctaattaataataaaacctacatttcaggacagtgagagttcctaagcagagggcccagctaaaacatgttcacacttcctgttcatggaaactgtgacaataaatttgtgttgttttaagctgctaagttcatggaaatctgttacacagccatagaaaactagtacacatgaaaaaaaattatatataaacatactctatctttctctaacctatgtgttcccacttaatattagcatgtatatctccatgccattgaaagattttgagtaaaggaatggaacaattgaagctgagatttgaaacagcagtaaaatgtgggacacgtgagaaaacatggcaggagattatagagatcatctggatccatggtactcagccttggaatcacctagaaacacttttaaaatacagataccagcttcatccatgtccctacaaaggacatgaactcatccctttttatggctgcatagtattccatggtgtatatgtaccatattttcttaatccagtctatcattgatggacatttgggttggttccaagtctttgctattgtgagtagtgctgcaataaacatacgtgtgcatgtgtctttatagtagcatgatttataatcctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgctgtttcctgactttttaatgatcaccattctaactggtgtgagatagtatctcattgtggttttgatttgcatttctctgatggccagtgatgatgagcattttttcatgtgtctgttggctgcataaatgtcttcttttgagaagtgtctgttcatatccttcgcccacttttagatggggttgagaacacttggacacaggatggggaacgtcacacaccggggcctgtcgtggggtggagggagcggggagggatagcattaggagatatacctaatgtaaatgacgagttagtgggtgcagcacaccaacatggcacatgtatacatatgtaacaaacctgcaagttgtgcacatgtaccctagaacttaaagtataataataataaaaataaataaaaaagaaagtaaaaaatatatataaaataaaatacagacacctagaactcactactcatagatattttactttaattaatctgagatacaacctgggaatctggtattttaaatctccccagatgactctaatgcaaagccgaggttgataaccattggcagatagaagtagagagtgctatctcgaattaaagttgtcctactgaaataaaaaatgagagatgggttaaaaaaaaaaagcatttctggagaagccactgataaccaaacagtaagaagactgggaatcctactgcttatctcgcttttgttgttgttgttgtttgttttgttggttgattgcttggttttaattaaatttccactcatctcatttttattatgaagagaattttcatggggagatagaaatttgaggctggctatgcatacatggagtgacaggattgttgaggaggtctcaaggaacattttaggcaaaggaagtggtttgagtaaagtctcaaaagtgagaatcagtgttctaggtaccagcctgaagtgggttgacacagtgagtgaagttcgagtaataaggctgctacacagaggctttgatgccataggaaaccaagagtcattcatattcctttaaaagaatgagaacgaactgatttttctaaacagtagctcagcaagatgacctgagtgcaatataaagaaaagttagagaaaacctagaggccaggaagtttataggctgttacagtaagcaaatcatgagggaacagagcctagactagggcagagcaatggaaacagagaggggcaggacagatctggagatggacctgaaaaaaaagcaaatgtgaaagacctattggatatgggagtgaaagatgacaggggttgcacttgggcttggtacaaaggtaataaggaatttgattttggcattttggttagaggaagggtaaactggttaattagctttcagatgttattgtgtatacccgaaggcagctggataatacaggaaatacatccactgtagactctctcttgcccagggtagctggatgaggaatggatttcacaagagaaacatggtgtaaatatagtagttaaaagtagtttgcttctttctccctcactgtaaaagagagaacttcctttggactattgcatgaagtgagaacaatcacaaccgccaatagagtatgatttttttccctttatagacccccaaggtagaactttctaggtccatatctggttatgatttgtgtttttcgctggggttcaggccttggcatgtgacatgtaagctggtcactcatacctggagcagcagatggttgttcctccctcccttttatggctgagtctgctctgaatccttaggactgtaaattatttactcttcatctgactgaatccatttaatattatttcttaaaatacccctgcctgcactcatatttacttatacttttcttgccaagattttctaaatatcctttctgatatttattttatcagtggaaatactggcctgacacaaattttgaagtaaattgtgaagcataggatcatctttagtcagcccaatgggatttttaagtaccactgtccctctcccttgggggagtcttgtaccacaaacaatggtgtgagatcctgctttccatcaagagtttattggttaatgaagcttgtggctggtgtggttttcctgtgtttagcttttggagctctcagaaacagttgcttggaagagagctggcagaattattgcccagcaaacttgccggccacagcccacaagacttcaccaacgctgacaaattttatggctgatttaatgaatagaacaagtatttgaataaacagagtaaagagctgttggcatcctgctccatcgtctgaagaggtctgaaagtcttctcattaaaccatccttactatctccttttgctctaagccgcgttgccttttctcaagtgcctgaacaggaactcatgggcaaccatagctttgagatgaggtcattgggatggatcctcgggacttagtgcccctaattttaattgaaagggaactctttcaattaaaacctacaggaaccaaatatgacctaattctactttactttagcattccaggcctttaagttacttacccactcttagaacaataatttgtacagttttttgtgtaaacctttgaaaaaaggtttgaaaatttgaaaaaggactcattctttaacacatttaagattcataccacctctatgagttaatgtatcaattagctgtcaccatgtaacaacccactccaaaacccagtggcttcagacaattacttctcaccagtctgcgggtttgctgggcatcagtcagtctggactgggctcagtcattagtccaggttacctgatctaggctgggagtggctctgctgcatgtgttcctccttctcttcctaggaccagtgggcttgcctgggcagattcttttcatggttacagctgacatgcaagagcaaacaaaaacatagaatgcctcttaaagcataagcttgtaactggctcactgttttcttccatatcatcctatctgctaaagcaagttacatgattgaacccagagtcaatgaatgggaaatatactccacctcttttatggaaggaatgagccaaatgacatggatagagtagggggcaaagaattgggggcagtaatgcaatttgccacacttagaaggggcaggtatgacagtttccattttacagatgagaaacctgagactcagaaagctgaaattatttgttcaaggtaacacagaaaatttggacagtgctggaatgcaaaccctactctcaagacttctctgctttttgccacactgaattccaagattccataagaggctgtatgaactagttaaaggcccatggctccaaaggacaactccaaggatgactccttgtggcctgctccttttttctttttatcttatgtccctgggttttggcccatttgcctccttcatagttgtcacctactcttccatttgaacctgtttgaggtaggggttggttaaagttcccctactaaaacacaaattcttccacccctgaaacatacataccagtctctctatttttaataaaaattgatttttaaaagaaaatccaaacgtcacatgataattgaaccagaatggcctcaaacaccaaaatactatagttctttgaagaatgggagtattgtaatcatctgaaatgtgtcaacatgcttattactgacactgagcttcacttaaatgttaataggtctgagctagttttctgttagcccttccctgactgcctttgtagagttccttcaatggcccttgaattgtgaatctgccccatcctgcccagtctggtctgagtcaaattttagaccgagttgctcaaatctagcttgaaaagatttgagctagtatctctgagatctcaagtcattatctgtgagattttttcaggtgtgagtctccatggcaactctatgcctctggttttcagtacatttgcactcttaaatctggcctccagcatcctacaggtagaaaatatcattggatcttaaatttacctcctctaggtttccagctgatctgcactgacagtgtgctttgctctcacgaaccttctagacaaatgtcctcatgagtgcaggctccgaaagtcccttccttttcattggcacagtttgctttcctgatctattattttttttttgtctgcagcacaacttgcagctactgaatgatatggctggccggctctaccatttcagtgaggttctgcctaatctcttttgattctaaggggtaatgtggctcagccacagcaaggaggctgagttctgatgttctctttccccatacttctatggaagactggaagacagattacttgcagtgatttctggaggcagaagataagcaagtggcctctatgatggtagaaccaagaaagaatgatcattgcccttaagccttcagagatgacagctaaatccagagggaaaataaatagggataagattgtaaaaaaagttgctgctggagaaaaaatagctgctgctgataaagaacctcaataaattcaaacaatgtctgcgtttggccctcaaatgtcatgctggctcattgctcgggagaaagagccgtacaactaccatgtcagaggagatgaggaagcaaagaagtctgactaagggcactgccatggatattcttgcccctgctttggaacaatctatcattggattgtggagaggaagcaaggaggcagctggcagtgtgacaccacgtgctatgactcatgactgttttgcctgatggttggcaacatagtattggcacagttgtgggctctagagtacctgggcctgaatctctattgatatgtgccatttggcaaatttctaaactctaagtcttagctgtctcatatacaaaatgggcataatacatcctccctcatatggttgttgtgaggattaataaaacagtgtttataaagtgcttggcacagtgctgaacacatagcagtaaataaatattagtcattattaatattagctgatgcacatttgggggcaatttcaagaaagaattgattacaatagtaaattcagactatggcatctattgattgttcctttttaaatgaaccattttaaatacagtaaaagccctcctccctggcctctgcttaacttcctttatggagtaagtcgatgtttttccttcctattggaatatacactggccaatgctcagggcacaatggaagctcatgggcaggtaagttacttctggtgaacacttatatttctgcttccacacaacaagttgatcacttaccaaaagttagctgtgtttttgccaagcccatttatggcagttgtactcgttattacaagtaggtaatttaatgtaaatttgtgaaatatgagtataaaaagaaaactattattttcatgaaaactaagttcaatgctttggaaagacttactaaagaaaagttgcttttgaaaactgccatattgttaaaaataaaacaaaactgaaagtggaaatcaaatgtgatgcattaggaatgtaacttacgtgaaaaagagtctgtgaaatcccagggtgtggcctcacgctcaaagaaaaggccttggccttacaacacatcaccagagtggtgaatgaatgtacctttgtgtgttttaggttgaaataaaatgttttatgtatgtatatacatgtgtgtatgtatgtacatgtgtgtctgtattgttttatatgattcctcactttaacaaattatcacttactctaagggctattcaagaaagcttctactgtatagtcaatgttctatgttaagtactttacgtgctgtgggcttacaagaagggagcacagtccagtagaatgtatttaccgatttatggattggagcttgtggtaggcagaataatgcttccccttctcaaagatgtccacattcctaatccccagaacctggagatatatcatgttattggcagggggcaattaaggttgcagatggaattaaggttgctaatcagataaacttgagttgaggagattatcctggatcatctggatggtcccaatgtaatcacaagggtgcttataagtggaggaggtaagctgaagacagtgtgtcagaatggtgttaggtgacaaagacttaccctgatggtgctggctttgaaaatggaggaagaggccacaagtcaagggatacaggcaggccctagaagctagaaaatacaaaggaatggatttccccctagggcctccaaaaagaaatgccattctgccaatagcttgactttagcccagcgacatccatttcagacttgtgacctaaagaatagtaagataataaataaatttcttttgtctggttttaagcccaggtttgtgataatttgttatagcagcaataggaagctaatacagaggttgagtcaagttgatgacaaaaaatcctatccctaaatccctattccaaatgtactcacaggatatctaggctcttcatgctttcacatgccctaaacataggatttacactaatatctgggtctaatcttagtagcaccatgttcattaagtccataccatttgccaggcaatatgctaaatgcttcagcaaattattgttatatgctgtttatagtaatgcttaaatatattctgtttcagaattctatacttacatattatatgctatttatagcatataacaaattaccaccaatgaacaaattaccattagtgaacagcatagacatagggcatgtctttattgagctttcaggttttgcccaagtacacgttttgaaatgagaaagataatagtgaaaatagcctgaatatctttatatttcaggaaagataatagtgaaaatagccgcaatacctttatatttcaggactgaggaacacctgcagtgtttgggggttttttgatcttttgtaaaacagaagatttaagcattactagctccattcttcctttagtcctttccctcagttggcctgtgattgtgactctggcatctgctctttcacctatttccccatcccaccaagtgattttctgaaattctgtcagcacagtcttccaacatcaaaatagcagcaaaacagatatttccaccaaggaaaaggaagcactcttccctcatgctctatcttcccaaggttcattttaagccaagttcacttcaagctttccactgcactcatatattttcttgcattcaaaataaaccacctcatcaaaccaaagtctctcccagttatcaaatgcagcttatgtctgcctccaaggatgccctccccagccctagctgctcacctttgcctctatagtacatatagttctgagtcatgcattaatatcccttattatttactgtgttgttttgttctgtttttttttatgtatgtcatctgcattttgacattttcctgaccagatatcccttcagtggtttcccacttccttcaggataaagtccaaactcttcatcatagcactctaggtcttcatgatctggtagccctgtctttctcttccaacttcatcccgtgccattatctctctctctatcctcagcagccattctgatatcttcaaacattgccatgttctctttatcctctggaccttgaacacactatttcgtcttcctgaaatagtgtttcatcaactgtttctttgtccactcccacctctaccctctccacttggcttcctcacccaacagttcacaacttgaatatgacttactgtaaaagttacccttgtattagacctccttagatactagcctccctcagacacgtaatcccttagcaccatgtatctttgcagccccaggcatttatttgtagtacttaataacttgtaattatttagagtttttgtcttcctctagatataagttccatgtttgtcaaaaaaaaaaactgaataggtgaatgaatcaatgaattaatagtcttttagtcacaagtttttaaattgtttgctgtcactctcctccaactagaatgcctgattttcaaacccaaacccaattatgattctttagatccagaatctgcattttaacaagccccccctagatcattatgatgctgaatgtccaggaatcatcttttgaagaaggctaatatggattttgaatgggatgtcaaagcagtatagggacctctcaaataataatatcaagtaccactgatggttactgtttgtttgccaggtactgatctaagaagctttatagaaagacattacctaatttaatcctttcttctagcctatgaggaaggtactattgtaatcccctattttgtagataagaaagctgaggttaagagaggttaagtaatttgctcagtgtcacacagctagtaagtgatggagtgattcaacatattctgcctccaaagcccatgctctttcccttaattctaggctgcttgttcctcacagagttttcctcatttgcagacttcaggatccttggcatgcttaatgtgcacttacctctccagtcctattagaattacgatctgttgcctttaaagatgcttctttgtaggttaccaagaggcaaaaactctgtctccctgcagttctttgttctgcacttgttgaaacaacaggccccagggaaagaagcccttttttagaagaaaaaaaccatgttctttcttctttccccacataccatattaattatcaagtacagaagaaactgctgaaacttctggctcacttggctcttctcctccaaagcaggaagtagcacagcaagagacaagtttaattctgaagctcaagcgctctcctgcataccatggcctaggagaaaggttcagtgaactcggtattagtccatgataagacaggcttctataaggtagaatgtttatggaaaatagattgggatatacaaacaagaacatagaggatcccatcagggatttgaggtaaacattaagtgaactcctttcatgtttggcctttcctgtacacttggtgttaggaggtcttacagaggtcctctgttaacccaatatgtatacagtagataaattactctgcataaagctttctacttttaacagaagctgggactgaaagtgcttcactgggtagtagaggtagctagatgatagatctctctattgcacccacctccggcttttaccttctcctacttcagaacagtgtcctggcagacaataatctcgacatttaagtactatccctagaaacaaaacccaggaaggactctctagaagtcattaactttctgccagactggatcgaagataaagatagcaaatagtagttgtatgcccactcaatgcatgggagtggctgcctaggacaatatagtgagaagaattatgaggccacatatgggcactatagggattgattattgatgtctgccatggacatgaaaacacggagggtcagcaaacaggctaccttttatccatccttgcaccaagccagtggctcccaaacctaattgcacatagaattactgagagctatttaaaaatattgatacctgggatctacccccaaactaattaaattaaattatctggaggtgagattcaagcaatcaggcattggagcaacaaaggttgagagccactgctgtgcacagttgtagacatacagatgacttaattcagtagttaccaaatgcatttcttccaatcaggacctgccaggatggcttcataagaattatgtgaggagcttgtaaaattgtggattcctgggaccaactcctaaaaattctaatttggaagtatgggggtagaatacaagaatctgtattttttaaaaccacacaggaagatgttgatgggaaccacggtcctaagctattctcaatgcctcaaatgaatgagaactttgagcagaaccttgtactctaggacaaaagttttcaaccctaactgtacattggtatccccttggaaacttttttaaaacaccaatgcctaagttcatcaattaaattggaatctctagggtggaatctggatgattcgaatgtgtaggtaaaactgagaatcactggtctaagaagtggagcacaggaatctcatttggggacctcatcagaaagattttattgttctttgtctatagatttagtccctgagttagtctagtagcttcagcttgatattagatggtagaactgcttctgttccctgaaccttgtttacaaccagaatctgtcattcatgatgtttgtggtggtctcatgaattatcctggacttagtaaacattggctgcaatcactcacccatgcttttaaacaaatggttatggaatgtaccttaatgtttgtgaaatgtagattccaatatcttctactagtctaaagaaaggtttttgatgagggtttgtttatttttaaaaaaataatcaaatgaaatgtaggacaactgatggtcttaagagacagaggctttgtaaagacaaagttgtatttaaacttggaatcttgcaaggcccatcaactatgaattagtaggggcaaatagacatcttaaccaccaatccgtgattggtcctactggtctcttttgaagcaactggtaaagatataatttctttctcttagaagctttgcctgtatgtttatttgcctcacattagtcgtgtaagacagccagacaacctcagacaatcagccttgcatggatggtcatgaagtggtgagactggtagagttcagcaggactctccttcttcttcaaaatgcatttttaaaaaattacacccagttttttcacttatgcttgaatttccaccattagtgattaatgtatttggtttaaacattccctcttcagattactgtttctaaatataaacagaaataacacattaagtccctccaatactctcaggaaggaagagccatgactgtcttggaggacctcacaaatacagcctgaggttgagaggaccagctcttcatgttaatgcaagaattcaagggtcaatcctaaggagcaatgggaggacagtgaactagggcctattcatctctctagccccaatgtcttacattagcacctggttcagagtagtggaaggaatggcagccaaagaaaatataccatcttagaactgccatgagaaattttgaatccagccttggactcatccaaatgagacccagcagctgaacctccagaagacagcctcaccagccttgtaaacaagatcatttcctttacccccatggaaaacaggacccaacaaatcccttgctgatgcaataccacatgttgtaagaataaaccattgtgtttttgccaagagttggttatccagtgactaatgtgttcctatacatttacactcactgcagagtatcctgggacatgtttatagttaagaaaggttagtattaacattgtgtcagaggattaatccattttaattgtaaatgccaagaacaaacctgcttccttggggcccagatgtatgactttggttaaatatttatagatcagatggaatgtttactcttaattctggagctaggtatttacttgcataattacatactcctcccctgcctcctcttgatccagtgtcctcctgatattttctctctgaaatacaagtgtgttgtgggagatgatgaaaacatctggccaatggtttagagctactgatactggtgagaggtgactgtgggatagtagagtaactaggaaaatgctctatgtatataaccaggatcatggaatgagcaggggccacagaagcaggaaagctggattctagttccaactctactggaaattagctatgtgaccttctctgagccccattttcctcatctataaaatgagagagatgaattcaaatttttaagacttcttccagagatgagccttcatggcagctttctctaaaccatcttggaacccctacccactccaggtataatacttatgctttctagggcagtaacatccaatagaactttctgcaataaggaaatattctacatttatggtgtgcaatacagtagcctctagccatatgtagctattgagcatttaaaatgtggctaatgtggctgagaaattgaaatttcattttgttttattaattcaaatttaatagctatgcacaactagtggctaccatatagggcggcaccatgctaaatgattagcaatcgtgttggccagctccttgaagaaggccattgtctgtgctaatgatgtcttctaatttggggatgattaaagaggtagttgaaaaatactgctcagtgggaatcctttttctccaatgtggaaggtaggatacagtcaaatattgtagatgccttgaggttttcaaaatgcacaactcctgagtttttatttattccactaaaaagtggaaaggggtggcaagtcattgaactaattttcctttttttctatctgaaaactgttaatatgcttctagccacattatgttaaattaggaaaacagtatcaccatagggcattccaagacatacacagcagattccacagaatcaacttcaatcatcccacattaaacatttttcatacaaaaaagaacgtgtttactgcattagtccattttcatgctgctgataaagactgggcagtttacaaaagaaagaggtttattggattcacagttccttgtgactgggaggcctcacaatcatggcggaaggaaaaaggcacatctcacatggtggcagacaagagaaagacaaagcttgtgcagggaaactcctgttttaaaaccatcagatgtcgtgaggcttattcactatcacaagaacaccatggggaagacccgcccccatgattcaattatctcccactgggtccctcccacagcacgagggaattattggagctacaatatgagatttgggtggggacacagagccaaaccatatcattcacttaatttgcaaaatgtttcttttccatttaatagtttgttgatctatttcccatagcattgatggcagagagttattaaactgtctgacttaaaaacagtgacaggtcctcattatgcaactcattgagttgaaaatcagctatggaccagtagatagatgctgtttctggacttgacttttctgctttcaaatttataataattgtaataatatagaaaataattagtattattattaaatattagtattatagctaaataattataagcatttcttatctagtcgagacttttctgtcatactttttagagagcatacgacactcatgataagttttagtgcatccgaaaaaaaaatactaaactttagctccataaactggttagaatggaggcttctaattagtatgattcagttcccaagtgatagtatctatatctggaatggtaaatccatcgcacgaaaattgtcatttctcacctcttcatttgtctttggcattctttcctgctgagtttggacgtagcctcagaattcttaacacagcattttaggcagctagcatcaagcagctagggcatttaaattacaacatttaagattaaagttattttccctctctaatctttgcaggtggttgtgatcaatttgtaagagataaaaacacaataaaatacatacagtcctagagctgaaagggaccttagagagcactcaaccttaatcctcttattttatagatgagaagagcaaggcttaaagaataatggggaattgtccatggttacacagacagttggtggcaaaaagtgggactagattccggcctcctaactcggagagaatcccgcaagacactgccttgagcccaccatgtagtagtacttgtacattagatgtttggtagatgattataatcacttttaagtttactggaaatgatttctgcttgcctggaccattgaggctagacaggcctggctattaaactatgataaactatttatttgtggggtggtcatatccaaatagattatttggtggattttcccataagttagacttacatgttttccaggcatctgtgtccagtgccacctgattagaagaaagaaatagcagcccattaatttaaacgatgggattaactgtggggtcttactgaaagaggagctgcttatcagggtctgctggaatgtgtagctctgattaacaaatgcagtttccattattataatgagcaactttctggatgtttgcctctgttaatgtgttgttctccacctaataatttactcctcttacttacggtctatgccttcaatagggactattcttattccaaaattgtgtttattaagtgtactaacattgatatcactgtcaggcaatatctaagagtttagccatcacagtttcaatagagaggagagaatcctgctattccagtcagaggcaacagtgggaacataggagtcttggttaccagttctttaagttgttttttatgacctaaagttttgaaatgttaagtgatttctaaagtgagaaataccattattatttattaaatactataattactacaaatggacactcaggagaggaatataattgtggttaatggcattatcatttaatttgcaggtgcatctgtttctaaacaaatattcagtgcctctgtttagaacacatgtttatatcctaaggtttcccctgctgctgaacattcccactgaagatcaagttgtattcaggtagtttaccttccctcctttttatttccttttaactatttgttgtgtcttaaagattccaatcttgtttttgcagttggttccttataatcctttaagtaaactaaatttcaatgtgcttgaagcagctcagttttccaaagtcattagtaagataggcctgatcccccagtttccactggaagactcactctttagctaagtgacttatacctctagttttcattacaagactggcttgtcttttgccatatcctgaggtctaggaagaagtgggtaagacacccaggtttctttgacagaaaagagggtgtgagtgtcctctccaccagagccaaagtgtaaaaggtaaagttgtaaaagtttgtttttttcatatcatctcagctcctcctttagtcaggccccagagttcatccttaacaagctgtcttctgttttgcagatcatctcctttaagctattggctcctaaaatgttatttctcccagaggtgtttttagcttgggggaggtccctcctgaagagcattataagtgtacactcataaaaaggaaagtctgactgccaacattagccccttcaacttctgacaaacattcttctttctcgatcttgctgccattcccttccctattttcatatagaatcaaaaaccttttgactattcaaaacttaaggtatcttatccctcacttctatccttctttacctcattacccacgcgttactcttaacctcaaatcattcaaccatgaaatatttccagagtaaacatcttcactcatacagcaaagcatgattggggaagaaccttttattagtttggtacctctgtagagcagcttccaagatcgtattaaatatgcaagagatcttccgggggaaggtgactttgagagaaaaaaaggaagggagccagaggaggtgtgacttatccgaccacagggcaggtccaacctctgtggaggagagaaggaaggaaagaggtttggacaagcagagtctcagattggagcacagttctaagaaagtttcagccaggccaatagagttctgaagccagaatcagtgatcagaggagttttctgtctcacagtaatgggtctaccttagtattcttaccatgcacagtcattagctgagaaatgcccactggacacgtggccttggctcaagtgcagtgatggactcaaggggtcagcaactaagtgcatggatcaaatatgctccctaaagcaggagatccaagcatgactgctacaaaaccctaataatcactgggcttggttcactggaacatcataatctccagctgctactctaacttaagtattacaagtaaatattatttcacccatgtcaatgttgtggctcacagcaaagtttgtttgaatcaaccatctctttcctcaaaacccggtcagttcctctttccttaaaacctctaccatcactaaaagctattactcatgttttgtcatacaggcaaaaaattaaaaccctcaacttcttgccttggttcgtctttctttgccttttccagttctttgagagataaccatcctcattttcctttgggacctccaaactactttcttcccctcttgtgtttccataatcttaaactgccttcctcctttctgctattagatgtatccatgcttcttcaatcttgcataaaccttcactctacctcaatttgacatccaaattattttcctctcattccacacttgctgccattggttcagtatagtgtagtacagtgcagtatagtctagtatacactcaaatttgaataagaaactcaaatctgaatcacctgctgggcttggaaaacaaagattattagactccacctccagagtttgtgattcagtaggtctcggggtgagtacctgataatttacatttttaacaagctcccaaatgatgctgatgctcctggtccaggaaccacactttgaaaagtactggtatggctgttaaagagtgtgtcctctagattcaattagcccaagttcaaatcctggctctgactcttaagatgtgtgaccttaggcaagttcctagcccctctatatctcagttgcctcatctataaaatagagataacaatgatccctacctcataaggttgtgaagattgcatgatttaatatacatgaagtgcttagaacactggcacttgcctgacacataataaatgctgtaaagtgttagttattatttcattgactcaggatgctagagccagtaagaaacatttaagcccatcattcaccaaatccaagtcaaaatgtgcataactcttgctatatgtagtatttattattttaataaatgcttttctttaggttggttctcaggtttacctgaataaatttatttcagaatgaaactgggaatggaaaaccagtgttttgctaatgtaaaataaaatacatacaatacaattagaatacaaaagatttacccgtgtggtttgtgtattcctctttgcaaaaactctgatttcactatataattcttcttttttcaaataaggaaactgagatacagaaaagggacttgcttatgatcacagaaagttggtggtagagctgagactaggtctcctgtctccctggctagtatactttacgtaccacctcttgaagaaatgccccactcctccctcctcctgccttatgatgactccatggcagctgtatctctaatgctgaagatacttaattttctatgaagccttgatcattcaacttaattttgtatgttctgtgaaggtatatgttgttatagcacagatgttttggctgtggttgattattgtcataagagcttggagttgaaagagagtccaaatgtgctggctgctagatcattaggtggaagtgtgaaaaatgaacatgggcaagcaaagagtcagagtttgttaacagggtgaggttggcagaaccagtgacaagagaggactgaaaaacagattcagggtacgtacagaacttggctctaaacaaaattaggggaaagaaaagagaagaatgaggaggaaaaatgagcctctgaatgctgcattttttgtggcagaccttgggcaggcaagggaaaagtatattttgccactgagtccctttattgaactatctttctctcatacacacaagttccttcagcccccaaggtcatcctgaccttccctttgagaaatgctgctttacgttttaaagttactaaagtgtggagcactaacacagactcttctagataatgtagcctctctccttggtccaattcaaacagcaggctatcagagcagaactttggagaaagctctcttcaggaagtagcccccccacttccatttgaggatgcctttccttttttttttttttttttttttttttgccccctgtgggactcagagtggcttgagcaatcagcaaaactaatactgggggttctttgtatatttgctctcaagatgggtagagccttcttaaggcttccaacttttggaaagctttcctggcagatctagagaagagtttatacaaaacttgggcagagttcactttttccctgaggcaccattttccattgttacttttttaagatcactatagttaagaagttaggatttgcccagataaggttaagtaaataaaatgttttactccactagtggtttctccaaacctaacttctcctctcctcacctactcccatacctccaccccagccaccacattcctggcatgtactcacctctgacctctattccattccacacaattcccccaagataagcaaaactaatacaagtaggtatatttagagtgcctactggtatcaccacatctattgatgcaagatttagataagtgtgtgagccatataaaatggacattccagcctcaaattaatgtgcatttaacatgtacaattgattgatttcactttttcttccctaggcagcaactcattattcccacttgcattttagcaaatcaacctgtcaagttgtttgggactaggagtgtgttgattcaaagtgaaccaaaaaaaaacaaaaaacaaaaaacaaaaacaaagtgaactacaagaattccctgatgtcaactgcaactgtctagaagtgcttttgttgaaaccctgtttctgccaccttatggaagaagattgtagaatgaaagtaatttctcttaaattaagtgtgcccataggattacaggtatgccaccgacatgctcagtaaaatcctgataggctagaacctttgctatctggaatgtttgtggcattcctcttttaggaggaatcatataccataggaaaatgatctaagaaaagatcagggatataagccaggaaaaaaaaaagcagcctccaggtagtgtccagggatcctcagtcacttagtctccctcctatacctcttatacctgcagtctcagacaatggaaaataatctactggaaaataacttggcaacacagctagtcctcaaatagcaaagaaagattttctgtcatctccacttgactgtaccttgtgaggcaggaaggttgtgtctgacagtttagaaagattttcatcaataaaagttttccccttaggcctcagtgaaccaaacaattctgtaaacttgcacggtctattctccaagaggtcccattatatgaaagattcactgtaatctctaacaaatgccttaataaagtaatgggctatctgacagatgggggccataggaacccacaaatcctagaataaaattcccaaaggcttgtgaatcaagacagtgccatatgcacttaggaaagaactaggggttatggatacgttccatcctgtcctggactccactgggctggatgcatcctttattcttacttggttcctgggcttttacatgcaaatcaccaagtggtatcagtacctacacagggctctaggattctcatttcaacaaatatccctcaaatatttcttgaacacctaactgggctgtatggatacaaagatgaataagacgtagtccctgccctcaagcagctcattacatggtgatagaagaagaccaggatattaacaatcacaatttagagaggtaaatatataaaggtataaacataatgtaatgtgaacatgttttgttgatttaacagacagtgggagtatctataaaactgattatttcctttgttgatgaccactttgttattatgggttaagatcagatttatctgaacaataatttttaaaaagatagatttttgtgtcctacaactttgcttaattcatttattagttctgagagtttcatagtggagtctctatggtttttttatataaaatcatttcatttgcaaatagggataatttgacttcctcctttccaatttggatgctctttgtttctttttcttgcctaattgctttgactaggagttccagtactatgttgaaaagaagtgctaatcacaagtgggtatccttgtcttgttccagatttttaagggaaagctttcaactttttttcattcagcattatgctagctgtgggtttgtcatatatggcctttactgcgttgaggtacattccttctatacctaatttgttcacgtttatttttatgaatggatgttatcaaatgctttttgtgcatctattgacatgatcacatggttttgtccatcattctattaatgtggtttatcacattgattcatttgtatatgttgaaccatccttgcatccctgggaagaatcccacttgatcatggtgaatgatctttttatgtgctgttggatgttgtttgctagtattttgctgaggatttttgcatctatgtacatcaggaatgttggcctgtagttttctttttttattgtgtcattgtctggttttaatatcagggtaatgctggccttgtaggaacagtttggaagaattccttccattaactatttggaatagtttgagaagaattggtattagttctttaaatggtagaactcagcagtgacactatcaggtcctgagcttttctttgatggaggacttgtttatcacaatcttactactgggtgtatatgtaagggaaatgaaatcagtatgttgaagagatatatctgtacttccatgtttgttgcagcactatttacaatacccgacatatagaatcaatctaattgttcatcaaaggttaaatgaatttttaaaatgtggtatatgtacacaacagaatattattcagccataaaaaagaatgaaattctgttatttgtgacaacatggatgaacctagaggacattatgttaagtgaaataagccaagcacagaagggtaaataacacatgaactcactcatatatggaatctaaataagttgatcttgtagaagtagagggtaaaatagtgattaccagagtctagggagagtagggagaaggggagaaggacattggttggtcaatgggtataaacttatagttagataggaggaaaaattcttgtcttctattgcatagtagggtgactacagttaacaatagtgtattgtatatttcaaaatagctagaaaaaaggattttgaatgctcttaccaaaaagaaatgacaagtgttgaaggggatggatatgctaagtaccctaatttgatcattaaataatgtatacatgattgaaacatcacactgtaccccataaatatgcacaattattatgtgccaattaaaaacaaaacttttaaaaaaggcaagtagaaaaagaaaaagaaacataattcgtcataaccatacactgtagaatatatattgaccagcataaaacttgttgcaaaatatgtttggcatggaaatttatgtttgtgcctttatttactctataacattacttttgtttatctgtctctcctcctataatgtaagctacttaagggtagggaattttgtctatttcattcactgttgtatctacagaggcagtaaatgtataataaatatttgttgaacagatgagcaaatatgaataatttaaaattatgataagtactatgaaagaagttaacatatacgattagagattataacaaggggatctgatgtagactggggaaacagtttaggcctctctgaggaagagacatttaggcagagacatgagagagagagaaggagttagccaagacaatcagacaacagacagctcacatctggcttgcaaaggtctctggaaatctgatgatgtttggtttcaaatgactcacatttgcaggctacttggttgatacattagggaatcagtttgattgacatattagggaatcagtttgattgatagcaatttttgtgtttttcctgttcaaaagatgttttcattctcccatctatatctaaatctttgggtttaaagccaaggaaacaaagttcagactcaagtttccctcctgcctcagtccgcatgtggaatcctgagttagacttagctctgtgcatttggccccttgaaactcccctgtgacccgtttctggctagcacctcagctcagaaggctcttatttcttggtttgcctggcaagagatgggttcaccatctggagtcaaaaaaacagcctgccagccactgaacagttcagcctaggccccggacaatgagaatcaggcaatagccaattccttgtctgcaatttgctgattatcacaccccagggtgtgggattgtacagccaggactgctttgctctgcctctcatcaaggcagaatgaacacagatcctgacaggtcaaatcttcccccagacctcagaggttgctgtacaaaggaccaggcttaatctctggccaagtgtataattcatttatctgcacggtcatgaattctgggctctcagaattctgggctctcagggcaggaagcatggggcattgtgactggttctacaggcccagggagtcacttaagccttgattgtattgtggagggagggattttcgagacaaagggccctgtcctcccgagattgagcagatttgaaggggagcctatgcacacaaaggaatggtgctttagggagaggttgacagccttgtcatcaatgtccatgaacttctctagatcatctaagtgatgacaagggggctagaattaattatttcatagactttggccaagaggaattgagataaataaagagttcatctcaggatgtttgcccgatgctcattcgccactttgtagtggagggaagttttaaacaccgagaaacgttttctcactcggccccttctcagaaacttgttgggggtcttaatctttgcctccagctttcagagctcctttactaccaccagaaagacttgaagtaaaaggcagtactctatagagaacagctacattaaagcgaattggaaattgtttagaaatttatagtttcccaacttggccagctgttttgctttctctgatcctccagacttcctgctgaacagagatgggacttggatgccattctgtgttcctggagtttcgtttgcacagttccacagcctgaggggggttgacccattgcaataaatccagcttcagattagttatttggattttgaagtatttcaagctccgtgtccctcatgtcacttcactgcaacctaccttgaactttgcaatggaagacattttaatcatggattgtatattatacaactgcagactcctgaaagggaggaagtggatgttgtggaaggcagatagcgctggagaggaatggagagaacagaggctctagtgcttactcttacctcggacagacatttcacctctttgtgtggttaaaaaaaatcctgatgctcctccatttttccttttctccctattcatttttggggtggatgtgaaggacatgaggaaaccccaagtgcagacctccccagctattcctgacaatcattcttcacccctatgaagatatctgagtgctgtcattatctgagattgggacactcattaaatacattatcagtcattaatgctttacccctcaaatacatttaataaattagtctcagcaaaaattggaacccctggggaaatggactagaagtataaagctttctgggatggctggacaggattgtgtttgctcaggctttttactctttgacacctggtttctagatcatcagcaataactaaagattccctgcttcatatgagtttcctcatttgccagtcaatagccttataattagtagaaatatgagaggactctatatcctgttgtatcccaagcagtttattcaggaagtctctactaaacacttgttccagcactgtactaggtcctatagagcagcagtctccaacctttttggcaccagggactggtttcatggaagacaattttaccacagaccaggggtggggtggtttcgggatgatatgagtgcattacatttattgtgtgctttatttctattattattattacattgtaatatataatgaaataattacacaacttaccataatgtagaatcagtgagagtcctgagctgcttttcctgcaactagatggtcccatgtgggggtggtaagagacagtgacagatcatcaggcattagattctcacaaggagcatgcaacctagaccccttgcatgtgcagttcacagtagtgtttgcgctcctatgagaatctaatgctgctgctgatctgacaggaggtggagctcaggtgataattcctgtgatgggaagctgctgtaaatacagatgaagcttcacttactcaccctctgctcacctctcactgtgcagctcagttcctaacaggccacagactgataccagtctgtggccccagggttgggaacccctgctatagaggttatgtcttcttttaatgagcttgctttctagttgtggaagatatgtcaataataaaacatgtaacatatatatctaagaaccatctgcttaggtaatacaatgagtgttagacagagagttttgtagtggtgtagcaggtggatcagtcagaaccagcttcttggtggaggtgagatttttcctcgagccttgaaaaacagatatcattttaatatgcagagaagaagggagagggcagtctgtgcaaagagaagcacataaaccaaagtccacaggtgggaatgagcccattatatatgtggaagttcacatgaaagagtaagggtagaaaaaatagcttcagaccacagagtgaagtgcaaaggaatatttatttgatcttttgtagcagtatcctcaaaacctttttgatcatacacacatataagaaaaatagcacaccctcaatatatgtatattcatatactgtatacttatactaatatattagtacattataaaacatacacaaaatcatacaggatgatgtaatacaatgaacaaaatagttctgatagtttcttctcataccccagaaaaccatcttgtactctccctggggtatctgtacccctactctggataccactgctttagagcatctgttaaacattttggggaccacagacccctttaagaatctgatggaagctacatatcctctcctctcctcagaaatgtatgcacagatgcttaacattttcttcatatagttaatttcaaggaaaggagtgggctatggacctcctgaagcccattcttataccccagtttaagtttctctgggtggagaaaggcacagaaggcttttgagtagcttagtggtacatactctttaatcttttaggaagttgaatctggtagtgtgcaaaatgaattggtggcagtggggggcaggtggacaaaaagtagaagcagggaaacaagttaataggctatttcaaaacttcatgccggaaatgcaaatgctatgtaaatagaaaagagaggacagatacaaatggtatttcaaaggaagcataggcagatctcaatgatcaatagtggatgaagggagaagggagggaagagaatcaatggcaagtctgaggcctcaagttgggggtggtgggggaagggtaattattaactggttcagatgacagcccagcaccccagcagacatggtctgagggcagggggaaatgtggggataaagctagggagaataattggataggagacacagattggggtgttgatatggtgagagtagaaagtttatgagaagagagagaataaaaatagtaaacacttatgcactaggcgttgttctaagtgctttatatcaattgatgctgttaatcctcattatcatctctggaaacaagtgctcttattaacatcgttccattttataaacaggaaacagagataaagcagcttgcccaaggtcacaggctaggaaggatcagagtaaggattcaaacctgagcagtctccagaatctatgcctgtgagcactgtgccatgctgcctctcaatagtgaggggtgagaggtgagttgtgggaaagtccacaagggaaaggggaaaagggaggaacagaggaacagactagaacctatcgagtgtccacatggatcaggcattgtactagtgctctaatattaataagcgtcatcatcattatcaccaagagttttccatatgcaaggccctatgtcaagaactttatgaggtatagtgaatatttgtcattttttaatcactcagcaggaaaatgcctttgctagttgaaaagaatccctcattgtatgagtcttgatgtgagttggggcccacctctcactgcggaagccaaaggagttcagataccccccttcctgtccctgtgtagataggaagtggtcataggtcctaggctggactaataggacactttctctgtggagcaactgaagctaagatcatgagccagagttcaatcacagtagtagtcagcggctgcgattatgataccctggccagattgttcctgctatgtagcttcaaaagtctccttcaccttttcatctgttctggaagtctatatcatagattggcaaaccataaatctgacccatcacctctttttctaaataaagttttgttagaacacagccacatccatttgtttacttattgcctctggctgcttttgtgctacaatgatagagttaagtagctgtaacagagacagtattgtccacaaagcctataatatttactattggactcttagcagataaagtttgaccactcctgctctttccagtaaatccatttttggcttaatatattcagagttgacttctgttgcttgcagccaagaactttaactgatataaatggattatctcatgtaatccttataataaccctcccaagtagatgctattgttaatcgcatattgaagataataaaacagacacagacaggttatctgcccaagatcacacagatagtaagtaaaatcactgaaattccaacccaaatctgactctatcatacatgaaagagataaagaaaatggagatggagcaattagcagtcccaggcctcttttgagatactggagaaaagaatcattttcccccagtagttcagaggaacccaagtaatcagggccatggaaagtgagaggaaaaaggaatagagatatcagtagcttggttctgacacatttatctccctcttggccacttctatacagtctattgaaatgttggtttaagcctctgtcaaaagggtacactaacctatcaattctcagatcatctgccagctttttgcttgctaagaaattcagaattcatttgagttgcatctcagaactatattaggccgtagagcttgaattccttcttccagatcactgggacctacactggatccagactgacagtagccaaagtcattgtttcctctgctaaaatatgcaccctttgaggacagggtgtaaggcttgctcactgctgccacctgcatatcgaaatatggagtctgtaccctctttcgaggtggctcaagtgcagatgaccacaaaagtttatttgataggcaatcctccatcgtctcagtgtggctggggcagattaccactttcactccaggcttagcaatctcgagcttttgctttgctaaatgctaagatacttgccaatacgtcacagctttgggggagtacgtgggaggaggtttaagcatatttagcttttcagccttacctactagacccagagttccttccatgtgattcctgtaaatgctgacaataacatggtgctccctctgctcagtgcaccatttaattgagctaattagtgacaaaaatatctcacagcagtgagccttctgttggaagcatctgaagggaaggaggatcaaactgcagagtggtgaagaagacttcttggataaaggcattgggaatgttatcggactgacctttttgtttgtgtgcacacatgcacgcacccttctgttaaaatagtcttttaaactaggtgggaaagttcatgaaagacgtttgtcttgtcacatgtactgatgaagtgttttcctctgtgattttacccccagcaaacttctctcaccagttaaagcagaaaaccctacttctgccaagttgttgtttgcaagagaatttgtgaaggcctgccttttgtagcacatgacttgtccctcaggaatatctttttagtctctgctaatgtaagggaacatctgaatggtgtctgaaaagagaaatctcttttccttgggtcaagcctagccctgtggccacctgatctggctcttttttggatgagtccctggggctaacaagcgaaagagtgaaccttaggaaattgttagatattttcatgatcatttcttgattatctgcatctgggaaagaagtggtggttaggacagttgaaccaacctaaagcttactcattccaaccatttcagcaccctcaaacattctcatgacctaatcatcatgctatggtcttgttcacgaagtactgaatccttttctaaagcccttttccattgaagattcagacttaatctttacagcaacccagtgaaagttccatgatgaggggcaacgctgtagttcagttggttagcaggtcaaatgcttaggtgtgtgtttctaggtgccctgatcctaagacgtgaggaattgcagcattattggtcagccaagaagaagcagagcctaagtaaactgagctcacagtagaatgtttttgtgattagtggccaatagcacacagtagatgaccaaaaaaagactatgggttttcgccctaatcctttgattttgctataaaagtctttcaaggtagatatattcttttctgatggaattcaatgttgatttcaagaactccagctctgagaatgctgcttagaagtgaacactaaataacatgttatggcagcccagccttgcttggtgtgatcagagaagagtgatagctctcttatcattctcctgtgaattaagcaaaaaaaaaaaaaaaaattggtgaacatacctgaagggttattcttcacaggattttccatatgcccactcagaaaaaaggatcatatgtcttggttaagaaaatacaaataataacattgtccacagtgtttctcctgaagagaactaaaagagaaaatgtgaccgctgtccttttataaacatcacataagctctcccaggttttggggaagccactgatgtccttgatgaatatgactaagttgtttgtgtaggagggtgttcatgtctatcctgtaattaactggtgaattgggttgatgtttctccaagcatattctgtagcttttgtgtatgagtgatgcatgggtatgtgagtgatgcatgggtatgtgagtgatgcatctttgacattgcattcagttcaactactatttagagcagaggttcccaaaccttagctgcacattagaatcaccttaagagcttttaaaaaccccaatgtccaggccatgccttatcttagtcagattgaactgccataacaaaattccatagactaggtggcttaaacaacagaaatttattttctcacaattctagaagctggaagtccaagatcagggtgccagtgtggtcaggttctggtgaggtctctcttcctggttttatggggtggcctggttttatgctgtgtcctcacatggcaagagagaactctggtatctcttcctctccttataagggcaccagttctattggatcaaggtgccactcttatgacctcacttaaccttaatcacctccttaaaggcctcatctccaatacagtcacatgggggaggggggcttcaacatatgaatttgaagggaacacaattcagttcataacataccctaaaataattaattaaatcagactgtctggaaatgggacccaaatctcctaggtgattccaatatgcagccaagttaagaactactattttatatccttgctgttcaatgtgaagtcgcttcagcagcatcaacatcacctgggagcttgttagaaaagcagaaccttgagcctcccgctgaatcagaacctttttttttaacaggattcctaagcgatttgtagacacaggacagctgagaagaactgattgagagtatctagcatgtttctaatctagagagtcttcttctttctttattttgccaaatacttgcaacagtagctatgtgagctttttatatgctatgggattgttctcagaacaaggtgcttgactgtgcagtcttccaacagttgcttaatggtacagaatacatgaggtggtgcactggtgagtttgagagggccaccgaagacatccagactgggtaagtctcatcactcactcaggtgccatgcacattgctaggtaactgccagggagtgagtcaagcgaccacttttaggttctcttctgaaaacaggagtatagtcctcttgttcttcctggtgatttgtttacttttggattgttttcacagaattgtgtcttctaaaaaccatttatttgcagcttcttgttcaggctatagatttcactcaaataggttgcttagcttattattgccaaatatttatttattaagagggtttaccactaactcaatctagatgttttctacatattctgtctggtcttgttacagcttagtagttaattgtgcggtggtgtttctctgggctccagctactctggactacaggttttctttgttgttgtgaaaatttattttactagtttcagttggagtaaatgaaaaagatctggcaatggatggtggagacggttgtacaacagtgtaaatgtacttaatgccacagaactgtatacttaaaaatggctaaaaggaccaattttatgttaggtatttttaccatgatcaaaaacaaatttcagtgcattttattaaatgtgattaggtatcctggtttggattctggaacagaaaaagggcattagtataaaaactggtaaaatctgccaagcacagtggcttgcacctgtaatcctggcaattcaggaggttgagacaggaatatcacttgaggccaggtgtttgagaccagcctgggcaatgtactggcatgtctcttaaaaaaaaaaaaaaaaaaaactggtgaaatctgaacaaaatatggagttttgttaatagtatctaccaatgttaatttgctagttttgatgaatgtacaatagttacataagatgttaacattagtaaaaccaggtgatggggttaggggtgtactggaactctctgctatctttgaacttttctataaatctaatattattccaaaatagaaagtttttttaagaaaatggattctattttgacccatcattttggaaaggaggtagaaaggaccattagaataatctggcagaagaccaagaggtagaacccttttcttctccagagcttccaggttcagctccttagaaatgatggtagctaaggtgcagtagagcacccctcaccaagctatgctactctgaaaacagctcagtcagaacactttttgttcagggctatatatatatatatatatatatttactattatatattatattattatgtatatttattatatatgaataatatataagattatatataatatatgaatcataatagcactatttcctggatggcagttcagcatagtgattaaaagtacacaatctgcaatcagactgcctgggtttaaatggtatttctaccactttccaactgtatgattgtgaatagttatttaacttctctttgcttcatttccctcatacataaaatggcaatgataatagtacctacttcataagcttttctgagcattctatggtaccatctttatgagatgcttagcacaggcctgagttagagtaagtgtaggtattattattatgtgtcaggcattatattaagtgttttatatacatttatattacttgtgaactgctataatgtctcattttacattttttataacttctaaattatatgatatttataggggcccaaatcataagcgtaaagttaacatacccaagtacccaccatccagatccaagatacagaacattatcatcaccccaaaatttcctatatgcccccacccagttattacccaccaaaattaactccatttgtttctgtttctattcagtttcagagatacttccccctccatttttcataagttaatttggggattgtagaaaacattagcatgattcaaaatgcaaaaccatagttagtaatgtttttcctctcccctctgtttcctccaatatttaatttgaagcactatggctaatttatttttaaatgagagtcatgtgacatttttgtcagaaaattgcatgaacagtaattttcaaagcattctgaagtgcttcacagcccccttcattcagttcaaccaatattgagtgagcacttaatttggcaaagcacagtagtggaaagaaaggtgaaccaaacaaaggcttgtctttagatgctccaagcccaatttgggaaaaaggcccttagacatagaattctagtccaaagcacactctgaatatgataatagaaatgcgaagttctacatgtaaaattaccatttacaataacaacagaaaaggaaacctgtaacatatcttttttattagtaatttacctgacaaaaagtatattggacattttatagataaaaattttaaattctacaaacagatgtaatagatctgaatcaatggtgggatatacaacgttaatggatgagatgacttactgtaaagatgtcaatttttcccaaatctacaaattcaatgccattcttttttgttgttgttgttgttgttttgtttttgttttgagacagagcctcactctattgcccatgctggagttcattggcgcaatcttggctcactgcagcctctgcctcccgggttcaaatgattctcttgcctcagtctcccgagtagctgggattataggtgcccaccaccacgcccaactaattcttgtatttttagtagagacgaggtttcaccatgttggccaggctggtctcaaactcctgacctcaagtgatctgcccacctcagcctcctaaagtactgggattacaggtgtgagccaccacacccagccaaattcaatgccattctaatgaaaataccagcaggatattttaaggaactttaaaaacttattctaaaatgtagatagaagaataaatgtctatgaatatttaaattgatttttgaataaagaacaggtgactttcccctctacaatttgagaaatgctgcaaagacatattattattagtaataagtaggagtgcacagtaaaaggccagtaaaccaattaatagaatatagagctcagaaacagatgatgagataaaagtaattttacatcaagggaaggatggatttttggtattggaatgggtagatcatcatgtgacagagcttccaaaccagtgtgtcacattacaagctataaatggactataggtttacagagctattgatcttcttgacccttaggatatccaggaagaacctaacgtggccagagctcccaggctggtggcttccacgggtgactatgagcagtcctaccaatttaccacattatgctaagcatatgctatcatatcctcttggttcgattacctgaaaaagaaaagaaaagcactgttatctggagaaaaatagagttggattgctaccctatatcacatacaaaggtgacctctggatagattacaaacctaaatgtgaaaggtaaaactgtaaatgtaggagaatttctctataacctgaaatagtgtagaacttcttaaataagaccccaaaccacaagacataaggtggaaagtcataaattttactacatcaattttgagacttccggttcaatgaatgacactatagacaaaggtaacagacagatgatagactgggagaaggtatttgcaatgtctaaaactgataaggcattgatagctacaatgtccaaggaactctggtaaatcgacaagaaaaaggcagaagacacaattgttaaaatgggaaaagcatattcacagaatggacagaccacagaaggggagaaactgcattggctaacaagcctatgaagagatgattagccttgctagtattcagagacgtgcaaattaaaataacagtgagatatcaagttatacttatcagattgacaaaaattttaaagtcagataacaccaagtgtttgttagcatgaggagaaaaaatgatttttcatgtattgctgatggaagtgtaaactgttacagcttacaatctgacagcactcattggtattaaccatgtattcctatacccagaaacctcagtgctgcatatatatcctgcagaacctctccatggtttgaaaataggacacttacggggatgtttttcacagaatcatttgtttatcacagaattttttgtgtaagggattagaggcaaactagatgtctatccatagagagatgtacatgtaaaatgtggtaaatgcatacttttgaatattacataagggttagaagcaacaaagtagttgtgcaaatagtaatatagatcttgaagacattcttgagcaagaatgagaaatagaatgtgatctataacccaaagacagcaatatcaatttaaaatacacacacacgcccgggtgtggtgactcacgcctgtaatcccagcactttgggaggccaaggtgggtggatcacgaggtcaggagttcaagaccaacctggcgaagatggtgaaacccccccatctctactaaaaatacaaaaattagctgggtatggtggtaggcgcctataatcccagctactctggaggctgaggcagagaattgattgaacctgggagctggaggttgcagtgagccgagatcatgccactgcactccagcctgggtgacagagcaagactccatctcaaaaaaaaaaaacacacacacacacacacccaaaaccagatagatagatagatagatagatagatagatagatagatagatagatagatatagagaggtgataggtagatgacagatagatagagacacatagagatagaagatagacagatgatagataacagagacacatcgagattgatgatagagatagattttagatagataaatgatacatagatagatagatagatagatagatagatagatagatagatagatagatgatagagacagagggagagagggaaagagaaagggagagatagttgttagatatcctggactcatatcaaatatattaaagaagatacctgagagggatagaaatgagaatggggatgtggatgaaggaaaagatcttttcaaaatgaggagctggacatggactaatgatgacattttattataaactaatagatgtaattaacttggctctttatagctgagtcattcccccaaaatttttaagtgattttggaagggagacatcaactccaaccagggaaatctgagaagtctgtttggaagagggcagatttgagctgagctttgaaagatggatagagccttggtagaaagttctggaagagaagggtatttttggtgaggaagcaacttggttggaagccacgtggtgagagagtacaagatgggtttaagtatcagcaaggagattgtaatttttgaagtctagggcaggtaggggtgttttgcggaaaataagcctgcaaagacaggtgggagttgaacggtgaagggctttcaatgtgtgattaaggagtgtggattttattttgaaagtaatatggagtggtttacaatttttgagcaggagagcaataggaccagacctaggacaattactgtcacagagtgttagatagattgctgcaatgtttgactggacacagagataactccagaggctgttgtcattatccaggtgagagctaatgagggactgagctaggttttggttattggttcctaaagggtctaataagagtggcatggcaggacctgagaaataaattagaatgctgtctcatctttatagcaaaggtggtggaaattgtaggagatgaatgaagtcaccatgagagagacaagagcctttgggcaaaatggaaggggccagtgaagacgatgatgaagggacaaaggactgaagagcccatagtatagtgcagtgaaagccaaggagggggtttcagaagggaaaagagtgttcggtgatgacaaatgctgcagaggtctatgggattagaatttaacagaggtcactggttactttccagagagtactctcaagagagaggagttggtaggcccagattgccagggattggagagagtgaaaggagaggaaatggatgcagtgagtgttggctggtttaccatgaagtttgttctggaaaggcaatggagagatgggatcgtagcttacagggaacgggagtaagggagtcagaggaagcatttttgtttgttttattggttagtatcaggcactccagagcatgtttcgaagatgaaaggaaagcaaccagtccagaatagttactggagtagggtcccaagggctaggatccctggagcagctacctggcagtgctcactgcaagctagccttgctgtatcttggtgtgcaccttccccctaattgtgctctttagctttgcctttgggagatctttcctcttgcagatacacttactagagcttctcccacccccgtaacaacccctcactttttcttctcttgggttccggagactggttgaaactggactaacaaagatacctgcctttgtcaagtctgcaagtcaagggatgtgattagctgcttggttctcaggccaaaggacctgaagcactcaaagccctgaaggggaaagtacttgaagatttgttttccactcagctttaagggacaagtgttgctactgttggccgtggcaggcttcataggggactttatctctacagaattctgtattaactttttctgaaagattgccagcacccgattcaaaagcttttaaaatcctcataaaactagagaatgaaaaaaagcaataatggaggtggaaggtaagcagaacatgggacttcctgcccagttcaccatccggccaggcccctggtctggccaactccttttcacctctttttctcccccagatcgtaggatttagcctgttttgcttgcttttctgactgccacttcccccctcctcgatttcccatctagatacctttagggatggtttcctgatttatccctagctctgctttctctaagaaccagataatggactgttaatttgtttaaagtgttttcattgctacaaactctaaggaaacagttgggcagagtgagatataaccaaaagtagatgacggtgtgaaagttgggaaggtacagaggatgaagaaccctgacaaaacatgagtctttagtgagctgtgaacacatgagctgcctactctcctccctatacaggccatagactctggcctgggagttagcaccattatctccccagcagctgaaaccatctctctttgagttaaatgctagacaaggtcttcagcctgaggtagatgtggggtgaggttgctaacagtctagtggatttttcccacatgtgaatcctcaggttgctctctctgactccagatttgtcttgacagaacaggctcaagtactaaatgttgtacataatttatacctctaggtggttcaagcatctcactttgagcaagggcaaattttcttataaatcattgtttaccaggaattgctggctcccctctggctctctctccagtctggagcccaagatcagctatttccacattgttcttaccttcctcctattggacttatccctctccctcacctgcatcctcagccccagtacttctgatatatttgccagtgcccagacctggaaaaccccaccacctgctttgcttcctcctgctcctaagctgccaactattgtttgaggaagtttcctccacacataaaaacatgttctctagtgtcgggggagctctcagtgctgattggtaggccttcacacttttctaacaattgacatcctgccacatcctccatagcatctccttctggccctccccagtcatcctcgacctcaaatacctcccctctctactcatgacctcacttcctacatttgttgagaaaattgagatcaatttgaaatagacattctccacttccctcttacttaccaaaatgtgtcctgggtctttttctttatacatcttctactctctagtttggaagaataaaaagccctcctctatctccaagataaacccatcaacagtccttgggttgagaatcatatccctcctgcctttctatgccttatggtatatactcatgtgcatgcataacttctcttttctaacttggattgagagttcctcaaggacaaggcccatgttgcattcatttctgtgtttccagcatgttgcaccatggcatagtcagcaatcaacaaattgcctgatttatctctaaaaaattgcctcatcgatttactgaaccgatgagttgtcagtggaacaagtagactgatttgagttctttgtcctttgtgcatctacgtaattgattgctaagggtgccactgggcagcaagaagaattcagggaagagtcaagaggattcaatacactccagacccagggtttttggtggagttacatgacattttatctggaatttttgaccaagaattgacctatcactttattaagggaatagttggaaaagctgctagactcagactaaagatcttgctctgctgcccataaactgcatggccatggacaagttaacccctgggtctcaattactttctctagtacattgaggacagtgttgttatgagcattagatggagtcatacatgtgaaaacactttgaaatctgaagcacttcaccaacgtaaacttgtaactcttagacctgatgccaccaacagctctagagcttctactctaacaataccacagctgccaccacctccactgcccatctttcctgttgcacacagaacttgatctcatctcagcttccaactgtccatgatggaaagggaaaatatatcacaaatgtggagatctcattcccttcccatctttttgcctgcgtgtgtctgtgcagagggctttactagtccatagggactactatatattgatgtgagggtcaagggaagggagctgtgtcatctcatcttcttgagttcaaatccatgattgtctatgataatccatgattatatggcaggctatgccagagtaccagcaggccctaccattttagcaggctcttgtgcctgtgggcatgtgtgtttggagtggaatgtgtatccctttatcagcataggtgtgcatattaatgctcctctggttctaaatgaatacagggatgtgagtttgcatgggaacaacactgaaactatgtaagtaaattgcttccctctcttccttgcccttccatctcagagctccctgagttctctgacaaggaggtcctgacataatttctttgatcctaccctttttttactccttctatttagggaatagtagttggttgctcccagttacctctcactcccaaaacttggtggcttttcaccagagaatcagggaagtcagcattgatccagaagcaatcagctcccaccagctcagtattggaccaaaggttgtatagcatatcaatgatgggcaatatattatgtcagagaataatgccaaaagtatcccttgtctaatggaatagatacactacagcaaaaatcgctctgaagtgaatttctggcaagtcctgtttcactttgatttttattataaaaccatagctgtgttttgctagaaaaactaaaagaaaaagattggctccagattgtaattaaaccatgtatttttaaataaaccgtacatttgtaataatgtagatctaatcattttaaaactgaaatgagactcctgtgaaagacagtcaatttgctcccaactttcacagctttaaattctgctcctttttttattcaatcttttttctactgaaagctcttccttgagggtttacggcctcatgagtctagcaaatgaggtttgtttgtttgtttgtttgtttggtggacaattggagtttggttattcgagttttttctccaaaagcaaagttttgtcagtggaatgaaactatagctccttttcacaggcattgtctcaactgatgctcaaagcaacctaggaaatgggtagagcaagtaatatccccattttgctgatgagaaaacaaaggcctagagattaattaactttttcaatatcatacagctagaaggttggagcagggaattgaatctaactcttctgcttcaaacaggagacttttttaagaggcaaaggtgacatcaattcaagtttgctagaaaattttcaaatcaaaatcattctcaaattaagtatttaatgtttttccaacaggtatattagttttaggttaaattcatcccaagtaaacttgtatttattttctcatgcagtctggaaactcggtacacactggggatctttgtatagactgaatgcccattccaagtgatatgggggctcattcaaccatttataatagttacaaaggtgtttagttgttctgtttttatttttatgtccaactattgatcatatttacagttttatgtgatttttttattcttgcaattcccattaaatatcacaaaagggaagtttgatatggttcctgataatagttttatgaatgtgttatggaggaaaaggagacctgaagattcttccatgaatttatttgcctctatctaggcatctccacttcatcctattttaacaattattgacatttcccaggggtaagggaaaatatgacatgtctaaagactagttctccaatttctgctcaacctaatgaccatcaagttagcatactgtgcctatattccttctgccactaaactaatatgctagcattggagactcatagcacatcagaatttgtctaccagagcctagataaactaaccattacccactgaccaggtaagaagaccactttaattgtggaaccagaagaaatcccccatcttttaagttctagggagtgccattccttgaagtgcatcttatttcttaatttattaattatattagtacatttctattaaagagtacctattccaatgaaaagtgtgggtaaattgagataaattgctttggtatcaatgaaaataacaatattttctccgcagtgtagctcttactgctcctgttcatgggtttgtgtctctgcgttcagagcatcattcaatgcagagacagtgtagcttggtggaagaaacagaggctttgatatcagcaaattggcttcaccagttgcttgctgtgtgatctcaggcaagttccttaatctctctgtatttgagtttcctcatctgtaaaatgagattaatacccacctgttggggctgttaaaagaatagaggaggtgaatttaaggaatagcactttataaactcttggtaaaagaaagttattattatgttttagaagagaaatatcagtaaacaggtagaagaaatggatgcaaagtcttgcctagcaagagttaactttatcagtcgggatatgtcttccaaaaaatttcaacatgctgacaataaccagtggaatgggtgtatgtatctttgaaaacaaaacgtgtagatgcatgtcttcatgcctgggctggctgcttcaaacgctgattatagatgaagaactagaaaagaaatgtgattccatttgagtgttgagggggagactctgatactatttattagctgtggcagacctgaaaattgcctttgcaagacatcagtcactatgtatgtatgtatgtatgtatgtatgtatgtatgtatgtatgtagatggaaagggtcactgctcttgttggtaaattgtaggtgatgttaacattatcaagctgatccaaaacttcttgggccacaaaataggtctctatatctgcatgatatgagtctttacctgccatatgctagacacattcttcaccaccagcattctttcttttttatttacttctgcaggcaatgctagttcattagtgctgttactaggagagtgaagtgtatggctctatggatactcatctccatttgtttcaacagagagagcacagagttgactgggaggctctgatgtaactcttccactgtgcagctgtgtgacattagccagcctattggctaactgctttgcagcttggtgcccttcgcctgccttgcagatgtattgtgatgatccaaaggaatggtgaaaagaaaactgctgtgaagtttaagtattctactcatgggggtgttattattagtatctttcttaccacatttcattgctaggagaaagatccctggctactgaggtaaagtttgttaagttcttgcatttccccccaaccatcagctgaaatgagaatttcagttgtaaagcaaagacaaattgtaaaaatcaagccaccttgtttctaggctggaggtcaaggatctctgctcccccttctcaaaaggccacaaggagttttttaggatagtgacattcttttaattccattttgctcctagcaaatgagacttggaagtggccttctcaaagattccccagtgcatatttaattctctattttcattcatttcataattatgcattttccccacaattatgttttgtgtgtctactgcacaccaaatactgcatctccggggatatggtggtgaacaaacctcactctgtttcctcaaatcttcctgttttgtgggaaaaatgtgctaaacatctccctagatgtttgcccaggcatcttaaattccacctgtccaaaggtgaattcctcatcttccacccaagactcttcttcctctaagttctctcatgtcatcaaagagatccactcggttgcccaatcaagaaacattggagtcatcatttgcactttcctctgttttgctcatcagttccaatatggcactaaatccttatagtttttagcctctgaaatatctctcaactatgtcttttccctgtctccactgccatgaacctagtccatgtcaccattatttctcttcaggaggtcatagacccctcatggggttccctgtctccagtcttgctactccatccactcctttcctcttgtggtgtgtcataatgaggaagaaggagaggtgccctaagtcatagtgataaaggaatgctgagggcctttcagagattgtgaactccaaacctgcacaagccataatcatttgctgaataataatacatcaataacaacaaataacttttattgcacatttaatatatgcaaggtgcaatgctaaatgatttacaacagggattctccaagtgtggtctttgatcctgtagagtcagtaccacctgagaacttgttagaaatgcagatttttagacccagccggcactactgaatctgaaactccggagctgaagcccagcaatctgtgttttaatcacctctgcgtaagtctgatgcatgctaaggagcgaaaataatgatctactcgaattttcttacttagtcttcataattaccctatgaagtagacactgatattatcctcacttgacagctgaagaaatttgaagatgccatttgtcccaaagtcctacggtggtgaagagggaatttgaatcctagacttctgaactctgaaccctgtacacttagctagcatatcatctcacttcactaaattctgaaccaaactggaagccaaactaaagtttaaaacaaaacatgctaatgtaccagattaaacacctcagcatctgtaaatttttgtaggttattctctattgccctttcttactgattctctgtgatctcacctctgctccagccagacccaggcttctgactggccctcgcttacagaattcgctgattcccatcaacatgttgttcttcatgtttagaatgcattcactaacagtttgttgggtctttctttgcccctctgctcccttgtcaattcacacgtctctgaattcctcttggacttgtggtatatacagtataattttaaaaatgcattgcatatgactggtatggtttggctatattcccacccaaatctcatcttgaactgtagttcccgtaatccccacatgtcgtgggagggacccaatgggaggtaattgaatcacggggctggttacctccatgctgttttcttgatagtgagtgagttctcatgagatatgatggttttataaggggcttcccccacccttcactctgtacctctctttgctgccaccatgtgaaggacatgtttgcttccccttctgccatgattataagtttcctgaggcctctccagccatgctgaactgtgagtcaattaaatctctttcctttaatgcaatgaccttatctccaatactttttgtgatatggccttatctcccccaacaagcttaaatgttccttgagggcatgggccatgcagtgtgtttcttttgtgtattgccttctcagcccctacatgtatattcatacttgccaagcacaaaactcagcatgagatgaaaagtgtttaattaggttggtgatgggccatgcatcatctgttttcaagggataacataactataagtttcatgaatgcagaaactatgttttacctgccatcttaacctctgtgcctggcacagagtaagtgctgaataaatcattgttgaatggatgaattccattcaggatgagaatcaaagccatttcactcagagatctcagagaacaaagaatgcccagaaactacattagatgtagaccatttctgttttcaaaggctctaaaaggtattgttttaaaagtctacagtggatgttgtatgaacttgggtaagtcccattctctttctgcccttcaacttctccatcctgaactggatcaattcctgagtcttatgcagctttcttttcagtgattctgtgatcagatgtttcctgattgcactctattgcaactatcataaattaaagttaaaattctaaggtccccccaaccatctgaatggatccgtcctcttggctaggggctttccaaagctaacctggaaaactagttcagtccatgttaggaacaaggaaccagacatgcctcattatactctcctcccttttggagttactgatagaacagactctttacgtctgagaagaaacatttaccatctattctctccgaagcctgctacctggtggcttcatctattatgatatatccttggtttccacaaccccttattataacccagacattctcttctattgataataactctttcgacaaattggtaatcagaaaatctttgattccacctatgacttgaaagcccccccaccctgccccaggcttccagttgtcccagctttccagactgaaccaatgtacatcttacatgtgttgattgatatctcatgtctccctaaaatgtacaaaaccaagttgtggcctgaccaccttggccacatgttctcaggatctcccaagggctgtttcatgggccattagtcactcatatttggctcagaataaatctcttcaaatattttacagagtttgactttttcctcaacactatttagacttccaaacaagatactgctgtacctgggccactggcttctcagtcatttctcaatcatttctccactcagcaaacatttactgatgcccactgtgtaccaggcatagtgctgagcacaggtgattcagtaaagagtaagacataagccctgtcctcaaggagttcagtctgttgggaggtatagacacataaacaggcaacctagcccacacattgggtgggggtaatcatagaaagctccctggagaagctgatatcttggttagagcccaaaagatacagaagtggtagccaggagagcagagccatatacaaaagcacataaaaaggccctggagtaggaggttaggagagagtaacgcaagattggaggtcacagaccatttggcagactgtggcaacactccaggcgagagatgagaaagacttgaactaagaccatggggctagagatcaatgaacaggtttcagttagattttggaggtagaattcacagtccttgctaatggatcggatgtgggagatgagggaatggaagggtcatggaggacccctgagtttctggcttcatcaactttatgaatggtgccatttactgagttaactcagaaaaagggagctggtttggagaatggggttgaggagaagccaatgtggttcagtttggggcatgttgggtttgagttggaatatttatttgaatagatctcttatacgtcattgactataaggatctggcacaatcagaagagaaatctgggctggaggttcaggtttgggagtcattagtatgtagattaaagcccttcaggaggaaaaataaacactgagaagccaagtaccaaggagaaccaggacaccattgctatgtaaaaggagaaatgctctcacagatgtggggtactggcatacatgctcatctattcccaagcacacatctctgcccccaaagagggtcgctcaatgatgtctgtgcatctccaactgaaacttaagagaaggagcattggtgcccaatcctaaactctccattttgccataaatgatgcctaaaggaaaaagggaactaatgctttcattctatctgccaggtgttttatatgtattaactcatttaaatgctgacaataatccaacgtaagagctattattacacttcagcccttgatactcaagatggttatatcccttgcccaaggtcacataacttaattggcagtaaggagacttcatttaaagtgtacctaacagcactgcatcaccttctacaatacaactggatccttaggaaggcctgtgcacacccttctcccttccctgcttcataaataccatttgcatcccctagcttaatgctttgctttacaaatccctctgggaaaagcaaagctctaagttgtcagtcattaacgcctcagtgggaatgagtttcagattcttcctcaggaacaaatgttaattttatgggagaagaacactggaaccttaacggaggtataaaaaggcagaaagggactaagttatgaaaagtcagccccctccaccagtttcaccgtcctgtctagtgtgaggcatatgcttttaagattcttcgatgatatatctacatatgtctactactttataggcagccccatttctgggtcttttaccctagttatctgggtctgatcagaggccaccttaaacttcacactgatcccaactcactgtggttggcaggaggcagccagcctgggctgtggttgcagacctgcggttcctggccttaagcacaagtcccaactcattcccttgagaattagaccctgatgtgcatatttaaaatcctgagcagatggaagcaggagagctcattggaaagacttggaggagttccttctgccctgtctgggtctatttgccaaaataaatgacatgtatcagaacagggcattagtccaagcccattgaaattctgctagctgtccaaacagtgatggtgtttcagattggttctgtgaaatgatcagggttaggaaaaaagaaataatgtgtgagcatctggctgctgcagcctactgatggggacagtcccaggggcgggcccagggtagtggaggggcagcctcaaggaccccctaagacatctgccactggcaaacagggaaacagccacatactggcagcaggtggtctgtttagttccatgccgttcctactagctacgtgacctaaacaagtccttcctcttctctcggccttcccccttccccccgccccccgccccatgtataaaataaagcccggattgaatggtctctaagggcctttcctgctcgaacattctgtgacttctctgacactggtttgatttctttttctctgtagagggagaggcccacctacccacctgcttatctgtagtctctatgttctcacactgacctctgctggccattatgaaaaatgtcgctgatagtgtcggggtgggaaaggaaaggaattcaccactgatttagttaatattaagctttagctgtatgggtaatgaggcagaaatcctgtgcattagagatgaggaaaaaagatcatacagctataagcacaaagtaagcgtatctggatgacaaaacaacccgcagaagaaatgggtctgcctcttttttttctcagtcaccttcatttgttcccggtgttctgtgccagtgtatgaaaggacatccatggatgggaaggctttttgtctcatatcctatgactgcaggctccataagagcctcacaccatgctgaggggacagttctggatgagcagaagcctagaaacttcccacaggccctgcttctggcccttgattcaatgtgagaggtttcaaactgagctgctggcacgcccgccaacccaagctggaacctggggccagtccagaagtgcatgttcctctagggggtgccttttcaaacttctatttggaaaaagaattagaatttaaaaaatatatgtgagttctttaggagagttcctttcagctctcttgttggaacacaggggtcaagaaattctgcatgcccaccaagccaggagaaaggaagcaggctgtgggaccctgtcttttctacatggaatcagagttccagttaggcccagccctcgagttgcctacctcctaagtctccttgcttacccttgctgataagcatgtgcttgcaaaggtaagagaccagaggtagagggtgccagtccctgtgcctatgctgggtgctgctgggactcttctctctaatggtgtgagcaggatgggactgggccacatcacaacctgctctctcagtagctgttcagtgatttactgtcctcttccccttccttcccttgatgtgggaaaacttttgtcagggcttggatttgggtcaagcattcagtgccctgactggatcctctctgctagtaataacatggcctctgcaagcccatcctgccctccattctcccatcaagcagctccctcctcctcaacagctgcttcttatctgcctcccttgtcccagcctcaggcaggcagccctggcctcattctgacatacacatgttatcctgaatgcttcttgatgactttcagccctgaaagaccgctcttctcccaactctcccctgttcccaaacctctgagggttccctgtgtcctgccacatcacgacttcgacttttctgcggtgctttccaggcccgcttcagctggaacctttccaatcaacctttccagtgcggcccatgacttcccccagccatgggcaaaatgtaagccttccacaaaccctccattgccaactcttttttcatgttcccacagcacttaggctctgttccaaatttgtactgtttgctgtgattttgtatgcattagtcttgaaacctaggcccacattttctttctttttttaaaaaaattatacttcaagttctaggatacatgtgcagaacgtgcaggtttgttacacaggtatacatatgccatggtggtttgctgcacccattaacccgtcatttacattaggtatttctcccagtgctatccctccccttgcccaccacccctcaacaggcccgcatgtgtgatgttcccctccctgtgcccatatgttgtcattgttcaactcccacgtatgagtgagaacatgcagcgtttggttttctgttcctgtgttagttttctgagaatgatggtttccagcttcatccatgtccctgcaaaggatgtgaactcatttttcttatagctgcatagtattccatggtgtatatgtgccacattttctttatccagtctatcattgatgtaggcccatgctttcgacctcctactcattgtcaacagcaccccagcactattttttaagtactgctctttttatattattaatatgcattatacacacatatacatatatacacacatatttattgattttgtgaaaatcccaataataataaataacagaaccactgtaaacaaagttccaacaatgggaggtaggagcctaaaaattgaaagtttactccacccccatcattcccagaatgaagcctgttaaacagtttgcaacctatcattttttgtaggccacatgttgggtattggaaaaggttaagtggtaggtggtgcccaagagaactgcatttccttggacagagcatcttttacttccttgcaagggtcgtaggtcttcgtgggcctgattgacactcaaaattatactccaaaggatcatcacagctggtggccacttgcatctccagtacttaactgtagccacagcataaggcatctgtcccattttcagccttttaaaaagtaagccttgaaggtgaacagtaaagggcatgcttaatgggcttcttttcaaagtttttcacagatttgtaggaaatgatggacagtcagtaaaggggccaagaggtggagatgggaagcatttatgaaaatggactttctacctgatacggtgttgtgctctctgagaggtaatgcatattactaatggttttcatttttctgccaagaaaattcagtccctactgggatttgttctaaatgatagaccagcctgcctgtgttgcacccactagggttaatactcagtctgagtccactttaaaatgtcagcctgaactctcagacttaattgttacagacattttataagcagggcatttaaaatcctcaggctgttccctcttgctatcataattgatacttaatagatattcttaggcttcttgtattttacacattcaacactttacagattggagaggagaggagagagggataggaagaaagaacaaataagcaattcatgtgtgtatatgtgcatgtgtatgtgtgttttccctgtgaatgtctgctactaggtgcagtgatggagtcctgggatctgccaacgaagatgagctcttgcaggtttgtcagcctgtaggtttctgggcccactctggccccctggggcaatgttctttagccacagccatttctggatttcactgcaagcacatggttggccatttggacgtgagttataaaatgtcatgatgctctccagcgctctgttctttcactattttgacaatctgatggatggcctggcattaactaggaagaggacaatattatccatcctgaataactgatttcctaagaagtacaaagttgaaggatcttggtgcacatgaatcttattaaatgtgcttataaaatgtgttctatccaaataagcttagcaatccctaaaatagccttttctgatccgtgtctggaactttggcgtgcctcacagatctcttagccaaaattattcagtgaagttatgacagtgctctttgtgcgtgggaaaatgagaagtattaatgctaagtcctctattgactaattgcactccttctgtccaccttagggacgacctggaccaattggaattcaaggcccaacaggtcctcaaggattcactggctctactggtttatcgggattgaaaggagaaaggggtttcccaggccttctgggaccttatggaccaaaaggagataaggtaagaccagcaaagcttgatttctctttgatgcatgggccacaaatgtaaagatcagaagttctccatcccagttctgctcatttatgatgtcattcctgagtagtttggtgccaggctgcatttctgcatttttttttttgagacagagtctcgccctgttgcccaggctggagtacaatggcgtgatctcggctcactgcaacctctgcttcttgggttcaaatgattctcctgcctccaccttccaagtagctgggattacaggtgcctgccaccagctaatttttgtatttttagtagagatggagtttcaccatgttggccaggctggcctcaaactcctgatccaccagtctcagcctcccaaagtgctgggattacaggcatgggccaccatgccccacccaggctgcatattttaataagagatgggatgggtgatggcctgccaatggatcagcccacttctggaaggactcccatagcaagcacaccataaagtaaatgtattagctgcttgctaaacaagtgggctcactgtggtaagaagtcaggtgggtttgaactgtacatggaccggaagtccaatcacctgggcagcacagatcaggaatccaagcaaggatacagggaagaaaggggtcagagtgcttagaagcaatctaggccacaaatatagggaaagagctgcaagaaacgagagtgataatgtcatggtggcaggctgactgttcagcagctcagtttatgttccctgcctactttaatcaccttctattcgccctgttggtgagggaacgattccctcactaggatcatggggatgactaaagatatgacacctgacactgggcagatgaagttgacagcaatttattagtcacatatactcacagctcaggggaggaagataccacacaccacatagggccacatagggatagcacttgggaacagagtttagaagaaaaggctgtgcaaagcagactttgtagtatcagtagggcagggtgcccctggttcctgaaggtggatgcaattggcttgtttgaatagtccagtaggccagcaagaaattgaaactgctattccaggataagcaggaattgcacctggtccatttgataaggagagttgttcggctaggggaccttatctgtagaagcataatggagagggaaacttgtgattaggtcattcaaggttctccagttttccccagatggcagcaggtaatagtaagccttaattttaaaacctcgactatactcccttaaaaaaaagagctggtttcggaacaaagacctgtctaaggccttaggtagaggtaaatggtcacttcgaactgcagtaggaatcaagggaatacaatatggggaggggggtacgaaacacttcttaaaaatgtaggccattgactctcataaacctactgagtctaacaaacatcagttggattgtgtcttacattcctctccctactcctttttttagggtcccatgggagttcctggctttcttggcatcaatgggattccggtgagtgtgtccacagatgaatttttcatatcctcctttaggttctgcctcatattttggacactttgacctcagcaacatcctgtctcatgcaagcatgctcaggaacaagtgttgagatatgtatggtgaggtttaaagggcagtggtcacacacaattgcccttggattcaggcacaagcagccctatgtcggatgattggagagcggagggacctgtgtagccataacatcaatatcttagccaacatgagttaagtcttgtgggttgagtggagctttgattggagatgaggaactggttctaaggtgtaaagacagagccacattagaggatatatatcctcatatagggaaattaagatggtacatgaaattagagggtaaaatccttcatgatatcttgatacattccattttgtaatttgttctcttcagacatacctcatttcagagtgaattttcctttaaagtttttacaaagtgactactccaaagatcacttggaggcagcctcttgcaaaatttgtcctgtggacctctgctctgcccaagagaagtggaaggtttggaacttgcagacatttcttttttccatccacccagcctaatcccttagtttctctattttcatcctgtatctgtgcctatcccaccactggtgattccatggtagcattgcaccagcctttaaaatacaatatttggaacttactggctatctttttttagtttttccctttgacacttctctatatatttaagccatagtctgggctatgtttgtctacagcagcagttttcaatcttgtttaatagaagaacagaatctcagcatatagaacagaaaaaaacagtgcagctcctccatttgtgggaggtcctagagcctgcttttatccttccaacagcctctcagagattgttctgaaccttatcaaagcatggtttttggaggccctataattaacagcttttgtgttatactcaataataatctaatgtcaggaaaaggggttcaaatctctttttgccaatctatagatatttaacgtgcccctgctgtatgttagcactcaaccttgggtatacagaggaatcatgtggctctgccctgaaagatagtatcatctgattcattgtctcctctgatgtagtagaaatttatgaatttgaagaactgaaggctcacttacctcgtatctgttgcatgtatcaacaaatcggccatcagacttcagcattttattcaactgcagagtctgcaaaaatgcccagaaatagaccagtgggaaaataagcggacagggttggccatccttttgtgatgtctcctgacattttcttatggctgtgttcctatgcccctttagccagagtctccacccagactgtgtatcttctgggagccactgggtaagggaaactagcaaactggaggcagcctcttccattcatcctgtggacctggctttgccagagatgagtggaggacttggagctttccgtcttagtatgcccttcctcctgcagtcttgttttaatgggagctggaaggaagtgaatcctgtgaggctaaggctgtttccaattctgagctggaaacggccccagagtccagctggatactcttgcctccaacctgtggccaagagagccctagagcttgcaggagttgatcacttctcttcgaggcttcattgcttggcagaatgagttgcagctgttcagacccctcttaatgagcttactgctcccagtagaagtccccactccctgtggggtatccacatcttttacttaggccttatccttttctagttttcttgcctgaactcctgatatttcctttccttgaccaaaaattgtatgtgttttcttttgacttctgattgccctagctgcaggctccaaacctcattactccataaaatcccactttcttgttgtttctctctcttgaagcctctcaagaagtatttgttgaacatcttctgttcagtgcttacctcttccttccatttctaatctcccaggagtcattggtacccgtctcaaatactccagtgcctcactacctacagcctacagccctatgggacttagtgatagatagttttttgtgatagtctcatccagctcctagaaagcagagattatatcttccgttcctctcagaagcctgagaggcccatgaccaaactctgcatagagtaaacactctaaagatattgcggtggaggctgactccaacctctagtgcctagcaatagttcttagactgtcagggctcccccagacagaaaaacacagacaccataggcctagtcagactgattattttgttcaactttcagtaacacatattaagcaatttggctgaaaccaacagctttcccaacacatcttactaaactggatcactgcacagatctgcttcccctcttaatattagctgattgttaacatatgtgtcactagctttgttctcaaaactccatttttgctgtcatgtagacaatctcaacatgagtgggttagtcgtcacttcatgataacctaagtctttgcactaaagggcacagcaactaatcaagagagtgagcaaacaagcattcctaagatagtcaacattagaacaacatagactagggacagtagggctgtggcttttaatgatatcccagctgtgagttgggcctgttggcatccacaagaaatgtgtgtttatcaaatgttttcagttcaaggcagttgggagcagagattttcactttgcaatttatgtttagctttccccatggagtcaatcctgaatctctagttccctgcctggagacttgtaaatgagcacatgagatttatatcctcaaagtgaacacacaccactcaccaaatggaaacttttcctttgaaactgggttctgaggaacattgctttagcttttctggaatacaacagatcctcctattccatgtgctcagtcccttgaggcaatatagaactgtggtttcccccctcaaagagctatacgctcttggagggttggcacacacatatgtaaaatcattagctataagaatgaagggcaatgtgccagaaattctgtggttctgagaactgagaggaggtagagctcagtcctgtggtttacccttgctgacttgactgagagaagaccatttattgagctcctacttagtaaacctagtctcacttattttaaccataacccagtggaataggcattattcacttttaatgctgacaatgactctataaggtaggtattagtcatcaccatttgacagatgagggaactgaggctcaagctggggaagggaaacagtgggattggagcacaagtctaactggctcaaaacatgccttgtctacccattccttggtatcagctggatgaaaaggggctgatagatctgagtcagaggtcaaagatttatttccagagaattcagctaaggtaggaaagtgtaaacaggtatccctgaaatcctacaggtaggaaatatcaggagttcaggcaagaaaactagaaaaggataaggcctaagtaaaagatgtggataccaaaggttaagaatccagacaaaggttttggtgtcaaacagaaacaagggctcaggagtgaggaagactcctggcactgagccagcctgttgttttgcatcaatttatccctgtaacctagctgagagataacccctagcaagtttggctgggacattttataatagtggtgatcaggatcccagcaggaaacagacatttcacctgaagagtttaactgaatagagttgagtgaaggctatatttaacagatgtgggaaagattaagggaaacaacaatggatggtggaacgactaactcaaagctacccctagacccgaaaggggaaaaaatggaatggtaattactggagtcctctgagatctggaaccatgaaaaagctgttgccgaataggaactaagactatggaaaaatttgtccatttccttggaatatagccaaggagggagggcatgggagaaataaataacctgtgtctttctcgtcctgctttgatctctccagtctgtgtctcccagtggccaaatacaactggaagacagaacgaaagggagcctaggttgcctccatagaggccaggctcctaggacatagatctgagggagatagagtgtagatcttcagggcaaacaagagtaaccatcccagttactaataaaaagttgcaaactttagtgagctgcatcagcttccccagtgcaactaaaaatcatcacctgagtctgcagaggcacagattgcagcaactttgttgtaaagacaagtttattgaccattcctctggacttcgcattccatgagtccagtagtctagactcacacttttgtattaacagtgtgtctagctcttacaactataataacaacgaaaatgaaacagaattctatagaatattttctctataagaatttgataaaaggttgtttcctctaataatttgaaaagttcatttttgaacatatagcatgtttctctcaaatcattaaatatatatacttggcttttaaagtgtgtttgcatcggcaggggggacatctaccttttattgacctgtctatatttctggtctttctggtcatctctttgctccatgcccaacacacaattggcttttgatgaattaaaaaaggtatattatctacaaaagggtagactctatgtaccaaggaagcccaactctggaaaattattgaattcagatgaattgtatgagaatgattactaattccccagcaaaacaactgcctcagtcgttagtacggagaggaaaacatacagttttctaactgaagcaatagcctgatgtgtgagcatgataaaatgagattgaaaatgtgattcttgcaggacttgcttattttggaccaagcaactttcaggagagggggtgctgtgggaactgcttctgctctgttaaccaaaatccagcatcatttcccatgcagagcttccaatactgaatgtcatgccaggctgctcaggttctgtctggcctgaggaatcccaaggcctggcatgattccctgttggtatcacttcagctgccagacagctaagcccaattttagtacatctttgtatacaaggaaggtaaagttgcaagaccttgtgtatcccatctgttcatgcttgatccctttggtttcagcttggtccctattaaagcattcatccttttgggaggggcaacattgagctatgattagacacatatgcttgagtataaaggaaagacatgcaaacatacatgatggggctaagggagtgaacaaggagccacagtttaatagcatgcttggcttttctcgctgtggagccatttagaatagctgacagtcctttggctaacttgatcccttcttttctctttgaacagggccaccctggacaaccaggccccagaggcccacctggtctggatggctgtaatggaactcaaggagctgttggatttccaggccctgatggctatcctgggcttctcggaccacccgtatgctgccagatatttgcattttatttcaaatggctttgcttgtctctacgtgtgccctttttctgcctctctggaaacctcaagattttgtggggcagccactacacacccttgtccaatgtaggagtcaatactggcagcaccacaacagtaaaagtctaaagaagaataccagttgcagtggggtgtgcacatgctacactgcttagggttgccttttttttaatgcagcttgtgaaattggcaagattgttaaaaggctgtagtaaatttcatggcaaaatacacacttgggctatttgacatggtcccacatcagacaatattgaggaatgtttggaagacttatatgggatcatggaagcactaaccaaaacccaaaggggcttgcaagcttggtctataccagtggtttttaaccagaggtgatttttgccactcaggggacatttggcaattactattgatattttgaggtctcacaattggtggtgtgctactggcacaagacagccccctccccaacatctagaaatcatttggctcaaagtgtcaataatgctgaggttgagaaaccctactctatagtaacagagtttgtggctacactcccacatcataacccttggttatggtattgataaggtatttattggattccagtgtcaccacttttatttaattctattcatccagatagggctcagatattttgatctaagggatctctagtaaatacaatgcccttccaggctgattttacaagtggctggaaagagtaaaataacacatttcagactcattgtcaacctcccttgaaataatctaaactcatgagggcactgatctgagatatttaactagaaatcactccattcatgagacatgttttatagctacatgaattaattgacacttcattggaagagcagcaccaccaccttcagtgaccaggttggggtgtgggtatatgtgtgagaaaatgagatagatggacaaagcacaagccccagattggcatataggactttgacacctaaggaccaaatcaatatgccggggggtggggaggtaaggaaagatgtattgctaacataggatgagataagtgggttacaaagttctccaaagattgccatggcaaccaggtatagaacaaaacatttccatgaaaatccagcaaagcaaggacatgctaccccctaaaaggagaaaataaatgttgaggtaataaatacccattgacaaaggacaaaggaaaaaacctagttctgtctcttaacttaacctcaagcctaaataggaacttgggcatgtattttactaagtggagatgtatcctttgctgaataccaaacagatcattcagttggcttttttgaagcttctttcaagacagtagtggccacaagaataaagtgaaacaggcagtgttaggaaaaaaagtgagaaaaaaaaaacggtttctgctcctgggatcacgttgttgttttatgataccaataatccctgtgctgaaggaatcaatcattcaataaatgcttcagtccacaaagcttagccctaccccacatactaatcctgacttccccttaggtgtagggacgttgattatccccaggtgtacaaactctaacagatattagccagcatctgccagtaagacagcaaaaaatctagttgaaagattggaattgtgtactttgaaccatttttcatgttagcagtgagatacaccagcctcttagacagactttgaatctgaagttgtgtggtagaagtacaggatgaaggtagttttgtagatatcttttagaccagaggtctacaaactggaccacatggcctttggcttgtggcctgttttttttttttttaaataataaaataaaaagaaagaaagaagaagagtataaaacagagtttagatatgacccaaaaggcctaaattatttactatctggttcttttcataaaattttactaacctctgtcctagacaaaggttctgtcagtgacctatacctgtgaggggtgaagcagcgaactctccattacatgagttatttgtggttgttcagaccagtactctgaatagatgtaaagtatctgactttaacacatttcagacccattcaaaccctttccctttacagacttctggcttggggattgggagggcatatagctctgaatcagagcacccggtcaaggaatgtgttttgccccttagtacagccaattttgccatagaaaaagccacatggtttcaggctcttgctgtcccatcctctatctgatcagataatgcaattaaaaagactgtaagtgtgtgtatttcttcaattttttaaactattttactcaggggcttcctggtcagaaaggatcaaaaggtgaccctgtccttgctccaggtagtttcaaaggaatgaaggtaagaacctgtaagtcagatagctgagtaggctataagctgggttccccagcattgggccccacctccagtgaaaacatttccagaactagcatctgtgtctctatttaaggagcagaccaagctggattcaaaagaatctggagctttttgtggtggaaacattgacataaatgtttgcaactatactgtcaaagagatttgctctgcaggatctagaccaaaaataggagacagatcagcaaacaaacagtttgcatgggtatcattttctttcacaaaccaagacatttcccggaggcagataccttttatctactccagaatccttgttgtctgtattccttggtttgaagccatgtatgtctctgcccatctcaacatggcctttagccaaagatcctggttctgcccttctctgtcactacacaccaacccatcaccctagctgggcccctggatgtctgcaaaaattgcccatcagccctgaggctggctggaatctttcatctctttccagaattgacaagaaccttctgtgttcttgtgactgtgttgcctgatatcctgcggggcctaagtaaaccctggctccaaatgattggccctattcccttgcagagtggggcaggagtccatcatttccctggtagcaaatgagaatgtatgtgcccaacatctgaggagaagatgcaccaagttcactcagctaattgatggcacttttctgtcttccattagtgcatagagcctggaacattggaaatcactttggaaggcagtgatgggggtgggtggctggagagccggacaagatttagggtatgggcttctaactatagatgccatagtagaagatagaatgtttgagttggaaaggacctcatgattcttggactcgtattgctcattttacagatagaaaaactgaggtgtactgaggctatgtgacttgctcaaagccagttcactaaagagctaaaactcaggcagtgctctttccatgctacagagagctgattttttactgtaagccaagtggagtaagactagcaggtgtcaaaatttggtcattgtcttagaaaacattgattaaatggctttgccaaatatcaaagagaccctggatccagtggaacacaacaattttcacaagatggttatattactgattcatgcagtaactaaacatgcagcaaagtaattaaaacataatcagagagtgtatgctctgttgattttcccttgaaatgaccgatttgcatcgtatacatatgggcacagaatctttggggatgaaggcacacaggaaggtagctttgctttcctccaaaaggagtaggaaaatcactagcccacagaagtagtttctaattgataagtacctagcaaaggtgaaaattaattaatccaagtaaaatgtgaaatcctgttcagccaaggctataatatgtgtcttctacagtccagatttttcttacagaaaaaataaacaatctaaacagtcgaatatgtccaattcatacattatttaaaacacaagactttgacagaggaggcccaaggttcagagatgtgtttttgtccctataaatgttaggttagttatctgaaatattgcaggcttaatttattaaactcttcagtgtcctgcctttgtttctcagggggatcctgggctgcctggactggatggaatcactgtaagttgttatttatgtgttgagctctcagtgttgactaaaaatcactaatggtgcattttcgttcttctctatgatgttctaaggtctttgtagacctcaaggaaaatctagacagttgaagtagaatgggtcacagtattgacattttccaaatgagaaagcactgagaggatgaactgtccactgtcaagttgcatgacaagcaggctttcagactttaggccagagacatgtattcactgggatgtactttcccctaggaatgtattttgcctttccttcagcaagcacttactaaatgttttctgtttgtcgagtgctgtgagtaaatcaaaagaagtagagcacattgctttaaaaggtattccacacagaaattccttttagggactcttgataatggtgagtccatgtaaggctgtgagttatgttaataagagcattatttttctttgagattccacattgtcgtcactttttttttgaaacagcttaagaaaaaaacctttctttcctcttctttctttccctttcctgtattcactctttctttcttcgctctatcttttttcagtaatctctgagacaatgtagacacagtccctgcccccaagggtgggaaaaactagtaggaatgtggcataagaattccacagcaacttagaggaagagatgccattcacttaaggatatgtcatgtgagtctttatgtctaagagacagaaggtagcttgtgagaagtgtgaatggtgtttagctggcagtgggaggagactttctaaatagagagttacggagtttcatgagaaaaagtaggcaaaaaaatgggatgtgtgcaagcacacacaaaaacagagatgaataaggaccaaggccatacatattccctagggcaaaacaattggcttagatagtgtattcattaaatttacagaacaacatccactgtacttgctgcatagcttctcttaggtacttgttttcctgcccacaaaggctcaatgtttgtccacatacacaggcatgatatacaaactgcttcaatttggggagagggcatttggtggctaagatatttgtgatcagcaaggtgatcacaggtggctagttattttcaaaacaatgttcagactatcatttatttctggaggccctttgaacccctcctttctcttcctcctgtctgagttccaacctttcttaccctctccgccccttatccaggcccatgtcaagttattcctgctccacaattggaaatggacccttgcatttcaccagaccatttttctcttgtgatttcactgtcttatgtttaacattgttgttatttgattcaaaaattttctaagttcccttatgattttttctttgacccatggaatatttagaagtgtgttgcttcgtgtccaaatatttagtaactttccagctatctttctattatggatttctagtttgattttattgtaattacagtgaacactgtgttatttcagttcttttaaatttgtcaaggtttattttatggtccagcatacagtctatcttggtgaatattccatatgcacttgaacagaatatgtattcagctgttgctgggtataatgatattaaaaatatccattaggtcaaggtaatggatattattgtttggatcttctatgtccttcctgactgatatttttgtctagtgtttctgttcattatggaaggagggatgttaagatgtccaactgtaattgcagatttgactgtttctacttgaagttctgttagtttttgcttcatgtaatttgaagctctgctattatgtgcataggcatctaagattgttatgtcttcttgataaattgacctattttatcattttgaaatgtccttctttatctctgataatattatttgtctcgaagcctaccttatctgatattaatataacttttgcttttttaaaaaattttttgtttttttataacattctaataggaaaaatttcaaatatagagcaaagtagagtgaattttgcaatgaacacacataccattaatattttactatacatcatcccttggtatccatgggagattggattcaggacctctcatggatacccaaatccatgaatgcacaaatccctcgtataaaatggtgtcatatttgcctgtaacctatacacatcctcccctatacttttaataatctctaagtcacttataatacctaatacaatgtaaatactatgtaaaaagttgttacactgtattgtttagggaatagtaacaaaaaagaatttgcgtatgttccatacagatgcaaccatccttttataaaaaaaaaatttcaatcagttggttgaatccacagatgtggaacccacagatacagagggccaactgtacttgctttatcctccttctatctatctatccatccctctctctgtccatcaatccatcctatttttaaatttttattttaagttctggggtacatgcacaggacgtgtaggtttgttacataggtaaacaacgtgtgccatggtggtttgctgcacctatcaacctgtcacctaggttttaatcccagcatgcattagctatttttcctgatgctctcccttcccctaccccacccaccgacaggccccaatgtgtgttgttcccctccctgtgtccatgcattctcattgttcagctcccacttataagtgtgaacatgcggtgtttaatccatcctatttttaatgaatgtcaaagtaaatagtagacaagagttcagttactcctaaatcctatagcatgcctatctttaattagacttcaatatttgtttgcagttctttctttttatataaaatttacatacaatgaaacacctaactcttaagtgtatgtttgctgagttttgacaaatgcatacttgtatgtaatccaaacctctattcaggtatagaacattactatcacctcagaaagttccctcctgctcattccctgtcaatctctgccccaattcaccccaaaggcaaccacaatcctgatttttctcctttatgccagtcctagaacttcatgtaaagggaatgatataaactctagccttttgggtctggcttttcacttaacacagtgattttgagattaatccacattgtttcatatatcagtagtttgctacttcttattgtaggcatttattccactgtttgaatctatcagagtttatccttgtatcattggacaactggaacatttccaatttttgactattatgaataaagttgctatgaacattcttgtacagttctcgtggacatacatattttcatttttcttggaaaactgccttgctttttgaacttggtaaaaacttgcctctctagggcccacaaggagcacccggatttcctggagctgtaggacctgcaggaccaccaggattacaagtaagatcaatttaagcctagtttgtgatcacagtgttcacatggttgttttccctacatactatggattcaatgtaaacctgtgtaatttaggtcctcctgggtgagcaagggcaacctccattcttggagggttaaagtaaagcatgctcttgcgaggagctattggagttatttatcagagtctatctgaccatccaatctgtgcctctaaagcctcccaccctagctcaacctaaagtatagcccagggatggcagatccctgacacatttcttgccaccttccatttcctcacccatgacaggtattgctaattaatcataccaccatcactatcacccaccctgaatactgaagaagcttcaaattccttcctaacactgcatcttgggcagctctacctacctacccatttttctgacacaaaacctgtttatcatcactggtagaggaaaagcatagccagtcatctatgtggttctgggaaagctgtgtccccagattgttctctccagtgcaagaaatcccattactcagtactttggcttagcttcaccaaaggtcatcattttaaaatttctggcctgttgggaggaatgacacatgaagtcttcactaccttagcattaatgtgattaccaggtcaatttgggggatttcaaaggagataaaagggaaccataggaaagacagctagaatctactatgccaaagcaggaaagatggctgagttactggggagtgactctcaacatgccgtgttctttttgactgaaactaacaagtgctaactctttcttatttttaaaaaaaatctagggtcctccagggcctcctggtcctcttggtcctgatgtaagtatactttgtcttagggcattttgcttcctactcctaagtactctggatttcccagagagatactggtttggttaaccctactttctggtaaaaaagattgcattccaatttaagttcccagagcttatttagtaatcgattttgtttttcctccctatatccctattccctaggggaatatggggctaggttttcaaggagagaaaggagtcaaggtaaacagcttttaaaaaatacagtctgccttccatatgctgcaagaaatgtgtctgattacacacatgtgcctgcttgtgtaagaggatttgttttttcgccttgggaaatgaatatttcccaacccacatagatcctctggtgggatctcttgagggctacatgtgtacatgccacacatgggctattgtggttcttttcccttcaaaatattgttatttccctgcttcctacctgtgaaaggtgtatgtcttacaaacatattcccttgaaatagattctttctcttccttccatctgggtctttccttggtgttttgtgtattctgttgccttctctttccttgtctctgcttcccctcttctctctaccctttctcctcctccccctcctccacttcctcctccttttcctttttgtcctcctctctctctgtatctctctctctctcctctatctctcttctttaacctctctttcaccattctcttttatttccctccttctctcatttctctctttacaaattgcattgtgatttcagagcctcaagcgaggctgagaacttgccattcccacccttctgttacaattgcactgccttctgaaggaacaactcttgcctccaatgttctaacatgaacatcattgcctctgattgtgctctttgcaaggattagaccacttagagttggatcattgttgccaagaggtagccattcacctcgttctgattccttttttaatctcttctaaacatcctttcatagcaaccatgaacttaaagtttccttctatccatcttgctcttccctctgcagtgctggtacaaaattcactggtcgggcttataattcttctcaccctttggcagtgagagttttgtttcctcattggcatgagggtgaagaggccaaagtaagagacagtttatttgtgagttacatccagaggacaaacccccactctggaaaaacggtcggtgtgattgtcactttgcttaatgttccatttgatcttacagggggatgttggcctccctggcccagcaggacctccaccatctactggagagctggaattcatgggattccccaaagggaagaaaggatccaaggtagtgaacatttaagaataggaaaaaattaataaaacttttcctataattataatacaagaacttaactctaataaccagacaatactggaagaatagagggttctgggtaatggatttttgtttagaagtgagagtaaaaagccttctttgttttgccccttatgaaaagctttcttaaaaggctgagtatgtttcttggtgtgtaggtttgagtgtgcctgggcatctgaatattcatttaagcgctattttctctgttttagtgttgcagattcaatttttgatatgatgaataacataaacattaaatagttgtgtttttcctcctaactcccaaccctctcaatacttatggtgtccccaaagtactgtgacagaacacatagggtatgaatggttgctcttgaattatctttttaaagaagttatttgctcttaaaacttgaccctgaaaataggatatactgtcaccaagtggtgacaagagatgccctaatttaccagatctgaactaccaaggcttacactatagacctgtttgactgaaatattttacgatctgtatttttatgtgagtcactgtatactacctacatggttgtaattgaatggccgtgtactgttaaggtgtgcagatatctttcagtaacttgcatttcctgccagggttcctttaagctttgtgattcagttcccatggccaaggggcctaggcagggaaatgtgtttagtctcctttctttaaatttgtcttcgtggaagctgtaacaactccaagcccctccaggtttacaggaagtagtcgttgatttgggaatggtctggcaacatgaaagagattgtctgcttccttgatcattcccaaaacttagggagcttttccatggcacgtatagataaattcacatatcagggaatgacagatcagatggttatgtgtccctatccaaattgtaattgttacccttttcccaaaactatggatttctctgctgcctctaatttgctataggaaattgtactgaacagcttcttccactagaaagaaaacagacaatcatcctttctgtctcccaattagcctcagtatttgacattctgttttagacagttatggtccataatccttctcccacagcaaagagctccatgaactaagacatcctggtacagctgctagttagggagcctggggaatctgcaccactctctgctaccctaatcttgatacttcattggttccccactcctcagtccaagtacatgtggagagccatcctactgtgcgttcactgcttcctgatgctacttactaaccttgggctgattttccagggtgaaccagggcctaagggttttccaggcataagtggccctccaggcttcccggtaagtctctctatttgatcaatatgtatacaagggtctgattggacaaaagctgtagcaatagaaggctaacagaaagacctcttcccatggatattgtagagaatgccaccatctttattattagaaggtatttaaggagatgttcttgtttctcaaacacatggagacgtaagcatggttctccatgaggctgtataccttagaggttattagctcaagctctatagttaaaacagacctaggcttgactgctgattttgccagtttctaactatgtgaacctggataagtttcttaacttttctgagcctcagtttcctaacctacaaaaaaggggagaatgatggggtggttatgaggattaaatgagataatatgcatgaaaagggcttactacatgtctagcacttattattcagttaatggtagctaatcttagtaatcctacctccactttcatatctgcctttctagcttagatccttacactcatcagttaccttttgagggtccctatgtgccaggcattctgctggacttggaggttacaacagtaactaagtaaaagtccctgtccttgagattacattgtaatgggggagtgagggaaaaaacaaacaagaaaccagtaaacagatgaatctatagcaagttcatataatggttatataagttcatatatataaaagatgaaagaagggtaaagtgatgaaatgtggatggggaacagggtggtctacttgggacagagtggtcaagaagggcctttctgaggaagtgatgtatgagctgagacctgcatattatgagagagcacgtcttgtgaagatcagaaagagggtttaaggctgagggaaccgtaagtgcgaagaccttgaggttaagaaaacctcagtacttttgaggaacagtaagaaggtgagtaagtggaacagagtaagcaaggctaataattccagacagagaagtaggaaccagatcttggctaccttcataggtcaatgtggtgttttatttttaatgtaatgggaagccgttcaaaggctctgacttgtattgttaagatcactctggctgtgggaggaaggggagagggaatgggaagggtggaagagcaaacacagagggtattgcagtagtccaggcaagagatggtggtggtgacttagactatagtgacagcaatggaaatggaaagaagtggatagattcaaaatgtaaaaatgttcaaccttgttattagggaacatttcaaacatttacaaaagcagagagaatgtcataatgattcctcgtgtacccatcacacagttttaataattagcaatttatggccaatctgaagcaaatcatatcatttcatcacaaatacctctgaatatttaaaaggtaagggctttttaagacatagtgacaatatcatcatcagtaatttgtgatcagtaattaatatcagttaacaaggcagaattcaaatttttgattgtcttataggtatatatatatttttacagttgccttgtttcaatgagaggccaaacaagaccaatacattacatttgtttaatgtgtcttttaaattacaagatatgttttgaaacagctgacaagattttcatggattgggaatagggatcaggtgggaaatggatgaatcaaagatgactaggcctgcctgtgcttgctgggccagtggggatagatgactccattccttccctacagtactttgagatagtttgggtctctctgggtggccagaaagcagagccagtggagccagtggcacaggttccttctatgatgattcttattactccatagaaataaagggggcatggaaaatcatctgttcaatgcacttgattttaatcacctctgtatctaatgaaccagaaaggaagagaaccctagtgttggagacagaacacccaaactttagacccagcccctgctctgggactttggcaagtcactgaacctctctttatatctgtaatttgacaatggtcatatttatactttttattaatagaaaatatttctacatatttatagggtacatgtgatattttgttacatgcacagactgtgtaatggtgaagttagggtatttaggatatccatgaccacaaacatttatcatttctatgtgttgggaacatttcaaatctctcttctggctactttgaaatatacagtacattgttgttaactgtagtcaccctactccactatcgaatactagaacttattcattctgtctaactgtatgtttgtacccattaaccaacctctctccatctctccccccaccccacactcacaccatttccagccactggtattattcattttaatttctacctccatgagataaatttttttagtttctgcatatgagtaagaacatgcatatagctactcttttaagacccaactaataatgtatgcgaagtttctttacaaaatataaggctgtcctgttcaataagataacagccagccatgtgtggctactgagcccttgaaatgtggctgatctgaaatgagatgtactgtaagtataaaatacacaccagatctcaaaaacgtagtatgaaaagaaatctagaatatctcagtaacattttttacttgtgttaaaatgacaatatttattatatatttggttaagtaaaatatatcatttaaattaatctctgtttactttgcttttttaatgtggctactaggaaaatgaaaataacatagtagctcacattatatttctattggacagtacagatataaagtactttgcaagtgagtttgggaataaggttttcacctttctttgtagagcatttcacatagattctagccacctggcattgtccctgtgaggtaagcaaggtgagccaggcttatcttccttgtactgatgaggaaaccacagcctcaacgggtgaagaggtttgtccagaatcacgcagctaattattagcagagctgagattgaaattcagctttcttgaattctagccaatttggtggctttttccccataccatactgccccctacagtccagtttgctctaatccctgccgtggtggggtttttatctgtaaatctctgaaaaggattttatgatctcctctggtgttattggcttcactggctcacactgcctccctccccttcccttccacatccgaacccagagtatttcccctgctgcaatttcaacccattcccttttgtcctgtaaaagaaagagactgacgacaatgcacggtgataaattgcagtaccatttcaaactcagtatttccagtgtttcagagtgtgggctgaaaaatagaaaccccagttgattgtaaagacatcaaagctagaaaataacccctttacatggaacagcatgttttcatacggtgggaattaagaaaccagagttctcagcccactttggcacagattcaatgtgtgaccttggccaaatcaggtaactccttcagtcctcatatctctatctgtttaatgggaacattcgtaggtactttatatgaatggcttatgacagaaaagttatgaggagaaaggtggtaatgtatttgtgatactctgggcttttcagaggaaatgtgcttctcaaatccaaagccttcacatcagctttcaattatccacactcaccgagaaacaaggcagcactgaagacagaaatctctagggaatccaaaatgttccttttaactatttgttttcttcctatatgagtccaaatctttgtaagagacaaagtgcccaacctgacagatttgccccttaccttctttctcttggcccctctgcagtgaccaaacatccctgattttctggctcagtcctcacctcacacattttatcccattgtctccagcaacacactcacacttgtaggccacaggtccttccatggaggtcatcagagagaattgtatatccatgtgccctctgttcaagggactagcaaacacaggggaaggcaaaaatggaatagatgaggggagggataagagaagaaactggcaaatcctgaggtaactattgagtaggtcaatagttacccacacacctacccagtaggggtaactactaggtaggtggggttcttcagttgagcctcctgagaaccaaagagcatcaggagtccagagcccaggagagcaggcctggaaacagttaacctagccccattgaggctttccaggccatgggtaagtaggagtgtgggagcagcatttgcaagattactcatgaggaggactgactgtcacggggccagtcccagggcatcttgctagaacagcttgttcagcagggtccctgtacagtgcctccctattctgggagacaagttgaacctacagcacagccagtgtcttgccaagctatttatcttttcttggctctaacccccacacaaatttgtctttttttttcctttttacatttttttttacatatttatttttgttcacactatagcataagctctcaggccctctgagaaagcaagactcttctgctttctggagaaggagtacaaggcccccttatatttacaactgagggcaagatagatgggggcacaagatggttcctgaacatcatttccttcaccctttgcaacagttttgttctcttggccattattccattcagttcaacaagtatttactggaccaccttgtatgtgttcagactgtagtaatgggccttggagaaagataaaagagagtgtaatataggtctcatgcttacaaaactttcatatgcaaccattctttgcactttaagagtttcgggcagcatgggctgccacagatttcatggacaggtcagagaaggcttcctgaagcgtttgacctcagaagccaatagacattccaccaagtcgcagcatgccttggtttgatgcagaaaaactcatattttaaataagtttgcattcagtttaacccacgagcctttcacattagaaatttaatgtagcatgaaggctgagctatttgatgcacagttatactaaatgcagaaaagagaacaggtaagtacgggaccaaagcctgctttgaattggatcctacacacacacacacacacacacacacacacacacacactcctcccaataaaaagacaatgaaaacaacccacattaaagaaacaaaaacatgactagccaaaaggaaacagaaatgaaaaaccctgggcccagaaagccaaggggtccttaaccagctttcagtactcatgggagtgcactgagtatgtatgtaaaaggaagaaaaaggtacaaatgggatttgagcaggtgagccaggtcacattaaagggacaacagatgttccacaacatttagtgccttttcttcattgcctcctttactttcataataagccaagatgttgtttgctaaatctatgctccaaaaagtacaattttaaacaacaacaaagtggcctcatttaagttttctgtgaaaaacattattcactttagtactgaactattctgtatcttgggggcccagacattttccctggacccagagggaagttctctcttactcactctgcttcttggagttcctgcttttccctagagaatccccaagtcatattcatggctacaaaccctcacctctgatgagcagggcaagagggcttggagaccatctcacagtcccctttggactatctctagggccaggcaagagccctacagtcccagtacaggagctgcagggtttcagtccgtgcctagatagaaatacttcttaccactgaaaaggatgttgtgctcattatgtctccaaaggggaaaagctcttgctcttccccctagtatcaacccccaagaatttgcataatcctccatttgtgggtcaaatcatcaagttcctagatgatagaaggcagcttgttttaatggaaaagtccccggaatgaaaaacacaagatatggctttctcattcatttttaacccatctagatgttggtttcctcatctgtaaaatcaacaaggttagatatttaatcatttctatactgttagcccatgatactataaatacatggaacagtgttgtgggtagggggagacattacttctagaaccaaaagggaaccttgaatgaatggtccaatttatattcagaccctatgtgcttctcaggcagtgacaagagacagcatggtgagcctccctaaggggagagtggagcttaattaaaatagcctccttgctttggatgaagccaggagaccgacaagaaaacaaacgttataacttgtggtttcttttttcatttagggccttggaactactggagaaaagggagaaaagggagaaaagggaatccctggtttgccaggacctagggtatgaacctcgaatgttacttgcctgggtctgtcaagtcatctagtccattttctttcctgtttgcttctttatgttttgcaacttgattgccacctaagcttctcgtttctcctcaacccaatggcaggttcctaagacctccttctctcttagccccattcccttgattgaatggctcccttgaaaaggaatgaggcaccccctactctaggtggctcctcagcctattcatctccttgctctcatgtatcattgtcttctgggctaaagaatgataccaagaaagaatgattgctaaagaaagcaaggcaagtgttgccttgctttcattccattctattctgagggaattgagcagggaagtggcacaggaatggaagaaagagggccaagtgcaacctttataggacagaaacaagcctggaaagttctagaacatagtgagtgatgtttggagtcaacagtttccaataataatctcatttgaaatggaaaaataactattagcctctctgattcctagcttcgggcacttaggtcttgagctagaagcagtgggccaagcttagcctcaaagaagtaacattttagagaattgtgttgttaagttgactatgaagtttagtaagagtcttttgagtattcagccatacttatccattaccctgccatttctttctctactttcccccgctccttgtcttgaaaatacatataatcaccaacaaagaatgcatttgaggtggaagacgaggccctcccataatctatttaaagatctcctgacttggaactaatgcagactaagtataataccacccagcctttctatcaaattccacctactacttaaactgtttccatttatttagatattaaaaaatgctccatgtggctatttagcctgatggattagagcttagaaagaagtcattaggccaggcacggtggctcatgtctgtaatcccagcactttgggaggccaaggcgggtggatgacttgaggtcaggagttcgagaccagcctggccaatgtggtgaaaccctgtctctactgaaaatacaaaaattagccaagcgtggtggcgcacgcctatagccccagctacttggggggctgaggcaggagaatcgcttgaaccctggaggcggaggttgcagtgagccgagattgtaccactgcactccagcctgggtgacagagtgagactccatctcaaaaaaaaaaaaaagtcgttaagctaggtctaggaacattcgcttacctgattttaggagctgctaaatcctgaactcagttggataactttgttatataagtctagtggctttttctaggtagcctattgctgtttctaaggtgtaactattttctttacagggtcccatgggttcagaaggagtccaaggccctccagggcaacaggtattttggttaatatcattaaagccttggggtataaaatcccaatcaaaagtcccccttgctttacctaacatggccaaagggagacattacttataatgcaaattgttcatctcccttttttttggtataatcttagccactgtcctcttttcttttcactcaagaacatgggtatccagtgtcaaattccgtgccttgccatgccatgctgtggtcatacatctttggcatgctgtcagggactagcaaggccagcctgcttgtatccgtgtctagccttatggcccttgtacctcctaatatgtaaattggctacctactgccgtattgtcttctggaagattttacagcttccagagtcagatagaagccacatataccctgcaatgtcatccaagatccctgtgccatttgccctggcttaatccaaagaccagactctcttatgctctcatactttccacttagtggtaactatgtttctgtcacagggcaagaaagggaccctgggatttcctgggcttaatggattccaaggaattgaggtaatgttgggaagtgaaaaatccagggttggtaggtagaagagtgaattaccacaaatgtctgtatataagatgaagtatttttaatattttgaccttttaagtttcaattttttcttaagaaatgcatgtaatctgctttgaacacacaaagctgctaatgagcatttcttagatactacttgatcagtggtaaactaaggggcaggagctggtgggagcaagttcatcccgaagatgaggaaaattttattcatattgcttagaattgccaactgttggtttcactattgttttaaattctctacagacaatgcatcccctttttgcctacacctggagcatataactgccaccatcacaccctgaatatgccactgtatgtgtttttggtacctaaatccctctttggggagtattagaattcctttaatttcctctgcctgacatcatccactaacaagggttgtgatggtagtagaggcccaggcctgttgagagtggaaaaaagttaaaactctgttctctccttagcactacttaggtacagccaaggcccagagcagactgtccttgagtagagttgcaaaataaaattgggatcccttgtccttgacaggtttccaattgaatgttaggcctctggcctgctttgtgtcaccttcatcttaaatttatgggactttgaaattaacctatggactagttgatcttgaaaatctggggttatagaaggaagaacctttcattttcctagggatgggctttaatggcacatagatcttgggtaataaggaaatggaaatatttgtgtttaatgtacttaatctttgcagggtcaaaagggtgacattggcctgccaggcccagatgttttcatcgatatagatggtgctgtgatctcaggtgcaacttctcattaatttgagtggaaaataaagacaggaagttaaatcctatatcccctgtaattattaaaaggatactttgttagttactcgattgttgctaaacttgacacacccaagagcccctcatggctcctgagcttggggaataaagctatctccaatctcttggtcagggaagccaagcccagcaccccatttttgtgttcagtccactaagcctaggatttgggtctgcctgggcctgaatttgatgaaaatggttctcctggcaatgctttgggaaggattgataaccacccccaagctgggctgacttcagtttgatactatggaatactcagggcctcatgtaggtgattccatgtatgcttgagcttgacaatttcataggaagtggaaaagtacctttagttaggggagcaagtggctgagagccctcaagagtgtgatgcttagaaagtctgtcttcacctctccttgtcctagttattttgtgtgcccaactcttccctttaccttctccaaagactgagatgcccagtatctccagctacctcttgtttgaccaaaggcttctactgtagtgactcttccatggatcttccaacttatccctctcctctcatcctctaaggcccatgccctgtttggtattaatatttgacagtggcttcctgtgtaccactcccaggaaacatatatgtataacgtaaatagtggacttcaacatcttaatccaaatggtagacattttaggcattacagcagattagtggtagaagaagaagaagtacttaccagagcttatcatgaaaggcaggccttggccagaacaattcttagtacactaattttggctccagaaggccccttggctccagaagacccattatcatgtgaggccattagcattagagacttgggaaaggcatgaaaggcacttctaatgccaggacagctcctgcacctcttcttgggcattttgtagcatctgtgggcctcctctgtctttatttactattttctttcattacaatgccaggtaatcctggagatcctggtgtacctggcctcccaggccttaaaggagatgaaggcatccaaggcctacgtggcccttctggtgtccctggattgccagcattatcaggtgaaaaaaactaacccatttcctacacagatcagtcctctatacactgtggttcccagcattcccttctatacctctgggtcggggcacacacctagccaaagtcaaacaagaggtagactgtagtcagtaggttcccgactgccagcccaaggctaacgtatgtgggggtagtgagggcctgggtgagcagcttttgtttttggcttaaataatgtatcatagctggacaggcaatcctagactgtcactgaggtttgcagcaacaagaggagtcctgggttgagttgctggagctgtgtcaccctcctgtggatgtgccatcccagctgatgcttgccaagaggggctagcaaaagcccagaggaagatttgtacccagaaccttgctgtaggattcagccaggcactgaatggtcccaggatcttgtgggtaacactcttgaactaatcacatccatatgtcattctatagtgacatgtgggaaaagggcatgccagagtctgggaggcagtgatgccccagatataaagttcaacttttacttttaaagccaccagtttctaaattccttggagatgggctgctgtgaggatacctatgtttttaaagcagccacctggaaatggtacagctggccccaggaccaagttggaaaaaaatcaagaaatgaaaggctagagacccagattttcctctcaggtttgccactgagaaatgctgggcccctgatcatgtttcctctcttctttgggtctctgtttcccaagaggttaggctaattgatccctaaggatccttctaactctgatacaagagaagggcaaatgcttccctaaattcttccttggatttgtttccaacatatgccacagataggaatactccagagagtaaggtgatataatgagcatttgtgtgtgggcttattcttccaggtgtcccaggagccctagggcctcagggatttccagggctgaagggggaccaaggaaacccaggccgtaccacaattggagcagctggcctccctggcagagatggtttgccaggcccaccaggtccaccaggcccacctagtaagttactcatttctctttttggtctcaagattcagatgtgatccagactgcagaacagtcatgatttttgagggggcatctcacaggtgaaacagctaagccaggatacatgataattgcagaggggcagccatgaaggccccgtcgtctctgagtcagatccctgcctctaccagttattgataacagcagagtgttctccatcaaggaacaagcaaactagggcctaatgccttccaagttttgtacccattcccactccatctttcactgttctcagcccttaagcctttgttttttcagctcctaaagaagcaggattggttcttttgagcttgccctggtccacaaggctccaatggggtgggctgagagactgagaaaaaaagaagccaagcctggaccctcgaggtggctgctaaaagcctacacagggcttatccttcttagatctcctacttgagtgtgagattctagattctgagagaaaagctggaaatgttgcccagaatgtttctctgtaccttaaagcccatgtccactgcggcttgcacctctttcctcttttgtcctaggggaggtttctggggtagacattgggactgctgagttttggaagctaccttgttcattcctctaaccccactgtctaatacggtgcctggaacataatggacattctgtaaatattagtagagtgaattgagccaacagaggtcctgttgactccttgctgcagatttggggtcccggtcttgaattttatttttttgtctctgctctgttgttcagcctcaaggacttgggccttggtgattgagctgctgtgttgagtcagggaagtcatcaggcttatacaagttgctaatcctttatcttttttttacccaaaggtccagaatttgagactgaaactctacacaacaaagagtcagggttccctggtctccgaggagaacaaggtccaaaaggaaacctaggcctcaaaggaataaaaggtgattttgtccccttgagtttcttggtcctccaaactccttagagaaggcttcctggggaatgagaaaaccaacagcctcgggaacctaaacagaagcaactgtggatcttgtttggggctttgattataggattgttagaagtgctatatttgggtctctaagactgaggctggcaatggaggtcacacaggaccaagttgctcacaggcttctttttctttctcctccacctgcagcccaggctgttaaccagtgcatgctgctacccctcccagtttgcaaaaccaaggatgtaagccacttattaccttcagccttaagcaaagtgctctaaacaggtcaagacctgggactctgaaaaacccaactggctccaggagaacaaccctagcccccactggtgttggagaactgatcaatgaccacagctgcctttgggtcatttcccccttctatcacttactctgaggggaagatgctcaataagtcaattaattatggttgtggcttaggccaggggaaggaagaagtgaaactactgactgaagaggggttttgggatggcctagggttcagttatgcaagatctctaggaatgaactgctttcctcagcctcaaacagagatgttctaacttactcctctcctttctcattgctccatcataaaatgtcattacctaagtatatagagtctggttaagaaatgcctgaaagcttgttctctgctattcaggtcccaggaaaactatttgatggaaaagggcattaagttaacttagatgttaattttggcccttacctaactcactacaaagctgatgtatttcttgataccattcacagtcctaaaagagggacatttctgatgctccccattctgtatttccatggggctgaaagattttctctaagtatggaatagtgatagggattatcaagcttcattatacatgagaatcacccaggggaggttattaaaaattagattatttggtctggcctcctgagactgatcgattaggactgagataggacccagcaagctgccttataaataagcatcacagatgattcatgcaggatcacactcaagaaacactaatctgaagaacagactattctcttagagttttaggaatcatcaattttcttaaagtaagaaggggcccttcagaatcttagggaaactcagggtcacctatgttggcaccaattcttattttccagacaataagcatggaagatatagggagttagaacatagtgctagtgactccttgatacctcttcaaaggtgctttgctgaaatccctatcattatttatttggcatttgtctcaacatttacaaaaatatgtacacatttgtgtcatatgtacaaaagtcaggggaaaagacattttggtaaagaaaatctttgagcggcttgaattccagactctcagctggttagtagaggtcagtggttctcaactatggctatactttagactcactgatggctgagcctcatccctgactaacaaaatctgaaccactaacacagacatactctgctggagagtgaaccaagttcatttgagtgtgttctctgcaagccttcagattccctctatggagttgttcaagtcacaaataaccatgatcaattctttattcttcttggaaaaaaatgacccacttcgttctatgttgtctttttctcccaggagactcaggtttctgtgcttgtgacggtggtgttcccaacactggaccacccggggaaccaggcccacctggtccatggggtctcataggccttccaggccttaaaggagccagaggagatcgaggctctgggggtgcacagggcccagcaggggctccagtaagtcttgccaaactttgaccctgaggaagcaatggaatctttcaagtgcccttcaatccccccagttacttttctaaagcacatacaagagagatgggattaaaacaaagttttggggttttgatctacaacatgaaatctgactatagagtctcttaaagtcctttctgctttaacctacctattttcccttttctctttccacaatttcttccttccacaacattgtttacctttgcctagcaatgtgctggcccatgaagataaaataggaattaaggtgaggtttacatcttcaaagatttcaaaatttacaaaaggtgcagaaataaatgggcaactattattcaagattacaacataatcagtgtctagaacagtgccaatatgtacccaaggttctgctctaagtcataatgctaggtgccggaattctatgaagtctacatcttctgactactccctcttctctcttttctttgtcagggcttagttgggcctctgggtccttcaggacccaaaggaaagaagggggaaccaattctcagtacaatccaaggaatgccaggagatcggggtgattctggctcccagggcttccgtggtgtaataggagaaccaggcaaggacggagtaccaggtttaccaggtctgccaggccttccggtaagttgatcgttcctaggtgattagctctacagatcttcacacctgactttgttggggggtctgatggccactggaccatgaaacagggaagaacagagtctagaggaccttgccctgcctctgccactgaaactttttgctttttgcttttcctttatgtaaagtgggaatcattttctcagaatggatcattgtctcatttgataaatgctagtaacacctgaccatatgacttaaaaatacttcagcttctcagtgacttttctcctcaagtaatctagccactttctgtgatctctggggttgttattatcctgctcatttcttgccctgtctcctcacccctatccagaaacttttgtgttgttagatcacccagagtagacaagattcatatccactaactaaagtcagaggagactgatagataaactatggtgatgatagataattttaacaaaacacaaagcattggtcacactggctacctctttcctgtagtcagaggactgtccagataaatctctgagttgaattttcattctttgttttatatgttgtctagggtgatggtggacagggcttcccaggtgaaaaggggttacctggacttcctggtgaaaaaggccatcctggtccacctggcctcccaggaaatgggttaccaggacttcctggaccccgtgggcttcctggagataaaggcaaggatggattaccgggacaacaaggccttcccggatctaagggtgagtcatagaatcagatggctttggacttggaaatttgaccccttgtagagtggttatgactcaggtgcatgaaatgtatcataagaagagacttgtctgaccataatcactactttcaaccccctgaaggatttgcatgtgaaaaaaagtattataattgtattgtggtaagcttagggggcagaataacatagatttccaccctacttcgtgaagaacttcctaccagagcagtctgaaaatgtaacagagctactgagggaggttatgagctcataatccctgggagagttcaagaagaagatggatgaccacttgttgcaaatgtcatcaaagcaatgagtgggagattggacaaggtgccctctaaattgtgtggtaatatcatcagctgggaaaaacctttcctcaactcatggaatctcagattgggcagaaatctagttgcttatagtctaatcccccattttatcccttaactccttcctctttatataacttctttttctacttgaattttagaaattatgtgtaacagtcctgcttatagtttatgaaggtgctatgctaataactaatcttcttcaatacagccagaacagctgttcatcccaacttttgggtttccacaacttctatgcttccattagtgacaccacacttataataatctgaagtttaaaattttgagattatctcttatttcctttgcaattcctcttatattctttccttctcttattgctactaaactctcattatctcatgcctagtttttcaaatacctatatgcttgttggagtaagtggatggttggatggatggatagatgagtgagtgaatgacaacaacttcctaagtagtttttacattcaattctattaagaacactgcagccaatttaatatctgtaaagtgccaatatcatgtaactcccctagttcaaagccacatatggtaccaattgaacagagatcatataatgtccaaactcctcaacttggaattcaaaagtctccaaacatggatacaaccaactttttcaaccttatatcatgctcttaattgaaacaaaaaaactaagacaccagtcttcttcactatacccaaacacaatatgttcacttccagctccaaaattttaccatgttgccttttcctggagtgctcttcctctttgtgtagtcatatcatattcctctttcagggttcaagataaaccccacttcttccattaagctttcccttgacctccacagtatgtcattgctacttaaattatatatctccttctattactgcttttactttccccaactgcattgtaagtctcttgatactagggatggtaatacttcttagagtttctttacatgcctagcatagtgcagtgttccataggagactaatatttgtttgcagaagaaagagccttcccaataaccaaggggctatttcttaaacatatttctcctgtttccaccttatcatcttgaagaattacaataaaagaagacaggataccaggtcttgcaaaattttatttatttccaaatctatttttgtgaatcggtgtaataaggttgatggtagatggtacaggttaaaacttgataattcaagattctttaaaccgagtcaatatatcatttcacaaattattgtgaaggttgtaaggacattttccttttttttttttttctgaaatgaagtcttactctcacccaggctgtagtgcagtggcatgatcttggctcactgcaacctctgcctcctgggttcaagcgattctcctgcctcagcctcctgagtagctgggattacaggcaccctccaccacacctggataattttcgaatttttagtagagacaggctttcaccatgttggccaggctggtctcaaactcctgacctcaagtgatccacccgcgttggcctctcaaaatgctgggattacagatgtgaaccactgctcctggccataaggatttagcaaataaaatcattctgcctgttggaagtcctagtgtcagctatagctttgcttctagctctgttcccagagacattactcatggtcattctactgctcctcccgtaattgggtcttcattgtaggttaaaccattttgcaagcaacaaggttttaaactgagttataataacatgacacctataaacttacacacttccaagtcttctggctattagcaacattttaactatttgagaaccagctgagtgaacagaaggaagcttgcaggaccatttttatcccaaacatcactagtccctggatacagaaagttattaggaatatgatatggtaagctatagcctgggagatgccttatgcagaaaatgtttgtcttattccattttctgttgctacaacaggagatctgagactgggtaatttacaaagaaaagaggtttatttagctcatgattctgaaggctaggaagtccaagattgggcagcccatcagttgagggccttgtgcttcaactcattgtggaaagcagaagggcatatgcaaaagagtccaaacactaaagcaaccttgctttataacagcctgctcttgtgggaactaatccattcccttgagaaataacccagtctcccgagaaagagattaatccatcctaacaacctaattacctctcagaagcaccacctcccaacacagccactctggaaaccaagtctcaacatgagttttggtggagacaaatcatattcaaaccatagccatgtccttcttgcagtatgaagagtttcaagaaattactttaataaagagcattagctttctttttctctctatgacaaacaaatataatttttcaaacctacctttcttctgcacaattttaaaaacaaataacctgtggtccccacacatttgcattgtagccatttctgttgctagaaaaaaactaagatgctattcctgaatgtgcccactccaatcaatggtagcccagactaggacagctgcattgccaggaaagaggatgcaatcatcagaagcctttcagcctactagtgtgaattattaaaaactttgggcaagcagacaactggctatttccaaagaggctctgttccagatgctcatagtaatcaatcaccctggttattactgaactgtggtgactgtgtgcttgatctcatgtgggtgcaagtgctctccactaagttcagacaagggatttggttggtgggcatatctgggctgctgagaagacttcccttgggccccaaggaacttctgtcctagtttaattttcttcttcacttgattgctctaggtgactgctgctgtagagaggttggtaaaggagacttagacacagagagaggtgagagctagctaggtctacaagctctcagacactagtcttagctaaacaccccttttttgtttacctttgtctcagacagtcacgatggcctgagcaccacactggatgccctgtttggggagtggggagtctaaggctgggatgcaaaggctgacaccaacactgcttcagaggctccttagcacatacctcttacagcaggcagtacgggattgagtgggcatgcagtctctgagaggggctgatttccttcaccatgcatgtcgatagcttggctgatctctaccttaagcaaattcattttctgaacttcactggggccataatctgccttgagaggtacctgaaaggatccacacatgtctgaactttattcattgggcccagaacaaattgggatgttaaaatcttgggaaccagagactctttttattctgaagatggatttgggcattaatgggaaaaattctgaataattaggtcatttgttgcaattactaaacagaacatgggtagagcagatttttgctttgttgagaaggctctgaattcaggaatgtaaagtagaagacagtataaaggaaaagagccagataccaatatgacttgaagtccttccctctcaccattttgaacctctgcttacaatacacaagtgtggtgtggcatacaggcataagacaaaattattgagagaaatatgtcgttgatttcctctggtttctaaccatctttcctttgaccattgtttttctcatcccggaacctttctggatgcctgtcctcagcttcatattctaaaggctttgtttttatctggctgtcacagatgaaaagaagcaattaaatcagtctgataaattaaggatgaatggcttaatagttggacccagcccagggatatttttattttactaagtttgtttcctaagacgtaaaacaatggaactgtaatgttagagtttgacacattggagccaatgagctattgagattgttgagggcaggagagtcttttgcaggatccctctcatgatacaccctctggaggaaattcttcagcctaactcaaagagcccaggcctgagccaagcacaaggttgaaaaccccctcccagtgaagcatctcaccataaagtgttgacctgtagagcatatttccatagtagggaaataactatcagaaatagctctgtcatcttgatgtctggcagggtggaggtgggtttgaccacctacggaggaggatccaggcctatggccatctgttcacctctggaaatataactgtagaaacctgaagtctggaaggcagaaagtgctgcccagactacaagcagtgtcactaacctgaggatggccttgcaggagctctactgagtactcattcttacataagataatagttcaagataataagaactattattaattgagcatgtaccagagtgctagacactgtgctaagtgcacagtttcatgtaatcctcacacacaccatatgagaaaagtagaagtagttcccattttgccatgaggctcagagaggtttaagtatcttgtccacgcagctggttagcagcagaactaggataccagctaaggtctgtctggcttcagagcccaacttgttaaccaatacattatactgttcaattcccaaccttgatttaagaaaatagaagtgggatcaggggaggatgccagcgagttcagtaagcagtttgaatcataggatgtgtacatatttttcagaaatgtaatttgtgatttaagtacaggcaaaagctatagatgtttattaaaactgttggctctgtggtttaaagcagaccttgggggattgttttaatgaataggcaaggcttatttaattagcatagcaattgtttgtaaatggcacttgagggagcccgcaaacaatttgttcaccagtattttattaaacctcccctctgtgatcttatagattctttttatttgcattatgaatgggcaagggagaatttgctaggggaagggctatgcatgccaattttgacatcttgaatattaaaattgctactttttctccttgagcagcagagttgacagtttcaaataaggagctgagggaagggtcaccacttgcctgtcacggacaagagagtggtcttaagtgtttgcatagtacagtcatactggtacatttgaccaaggacaatcaataggtttcagcagatcccaaatgaagtgcatcaaaagaacccagtggtttggggaaaacctcattccaaggaaagggtaaacatgagaacttgagggatcttggcttcaaaccttccaatctagtcaaataagcataatggacccttaggactaacccccaacacccatcctagggagaggctctatctgagggcagggtgagtaggcaattgctgtttgctgctgttcctgcacaggcaatctctaagaaaccttgttaggtaacatctgctgcataggtgactgtttgcccactgggcatcagtggtttgataagtgatatcctagcacttggacactaggagcattctcatctgtaagcaactgtactggttgtaactccccagagctaatgatgccaaggttttccagtgtgggctcccagctgctgagtgggaagagcttggctgtcctattaaatggaatagaagtaaaggagcgtactagggagaaatcttccctaactctgggttcactgaatgcacacatgttaccatttacaggaatcaccctgccctgtattattcctgggtcatacggtccatcaggatttccaggcactcccggattcccaggtatggaatgaggccagagaaagccactaaacactcttgtaagggccataaggcaaaggaagcagaggatagcccagtagtatttggggatccacattcctcctgagggcagccttggggattgaggaaacaggatggctgctggagagggcagtgtggggaggtgagacaaggagaggctctccaagagactgggattcttgactgaacatcacaaatcatacctagcacaccgactttcctttcccctcattgcttacatttgggttttcaggccctaaagggtctcgaggcctccctgggaccccaggccagcctgggtcaagtggaagtaaaggagagccagggagtccaggattggttcatcttcctgaattaccaggtaagaaaaggagtgtctcctcacctgcttctctttgtgtgtatgtgtgtgtgtgtgtgtgtgtgtgtgtatttgggttgtggtagtcctctgccaattacaggaagccaagtttgctctctggtgtgggtaggattgtttaattttataccctggcaagacacagcatacagccatagaatgacagcatattagagcaataaggaccattcaaaatcagctggggcaaccccttaactttcagatgaggaaactgaggcccagatgggaaatgacttgtccgagatcactaaaccactagtgacagagctaggactctgccaggttgtctgtctgccagttctatgagtttcctggatcaactccttaagggccagtgaaagagattgagatcagtcagagggaagttgtccatttctatcccttttctcacactctcttgttccaacttgagcttcatgattcttcactgtactagtggtcctcaaactgtactccatgggccagcatcagcatcacctaggaacttgatggaaatgcaaattttctgcctctccacaggatctgctgatcataacctctggggatgggcccggtaatctgcttgttaccccaggtgattgtgatgcttgctcagatttgagaactgcactgctctagggctcggggctcatcttggaccatgtgctccagggtcccctccagtaccctctccccacccaagaagaaggaggcatgacagcagaagctagagaactccagaagaggttgaacttttctcaggatgctatggggtggcgtgtgttcttcaacaactgtaggaccctcaggaacagtttgtggacctccgcccacagccctgcctcccagaactagaacctcctccaggtcgcagggcacagtccctgcctctgcacaaggccttgcaggaacagagactcctgaccttcaagagaagtgacatatattattaatatgttagctttcatattagaaaaatctgtctcagagatctgtactcagacaaattgcttctaaacagccatggtcttttatgttcgcctttttacgtttaggatttcctggacctcgtggggagaagggcttgcctgggtttcctgggctccctggaaaagatggcttgcctgggatgattggcagtccaggcttacctggttccaagggagccactggtgacatctttggtgctgaaaatggtgctccgggggaacaaggcctacaaggattaacagggcacaaaggatttcttggagactctggccttccaggactcaagggtgaatctttttgccccaattatttaacaatctacagaaagccttatattaattcgtatacttccatgaatacttgcatgaatctggggtgatggtttaattaaggggttaaaatgaaatattttattctgtccctcccttttgtgaaattttccttaaatagcctgagtcgactttactgtcttagtaattccaaaagtgaccataactaatagtcaaatttcttgcaaagactgggttacggctgggaatagcaacaaggctggagctgagaagacagtggcacctgggataagtcctggaagttggtttgctgacccactcactgctatctctccaggctgtgatcatttgcccttttcttttatcaggtgtgcacgggaagcctggcttactaggccccaaaggtgagcggggcagccctgggacaccaggacaggtgggacagccaggcaccccaggatctagtggtccatatggcatcaagggcaaatctgggctcccaggagcaccaggcttcccaggcatctcaggtaggtccttcagaggaagagtcccaccttgacagacttcagctaggccctgggcccagatgccctgggggggcaatagcagtagtgggacatggtcagaatttagaatgagacttgactttcctaagctctcaagtttcaaatctcaagtcacccttgcagtaccaagcagaacagattgctgcaggttagcttccaaactgttgccacaaatctttcccctccccccgcctcctccatggcctcatgcccagttttcaggtttcaactctcccgacctccccagttagagaagccaccctcatcgttgagggagtctagtccatctccatgccttcactggtgctgtgggcagcctgcttttggttggggagaagcttgagcagagtgtgaccacaccggcagcctgcctctcaggcgagcatgcctccaaggacccatggccaagtgtcttttactcagcagtggggcctgacacttgctgcttccagactcgtgtttgcagctttgcctttttctcgcaccaccctcctcaacctgcttcggtgactgcaccattcccaaccgccccttactcctggcctagtgactgaagctgagttatttgcagagccattaatgtcctttttattccctttgtctctctgtgtttctgagatcttcacataggctgcctcagtgagaaaacacagcacacaagctcacagactaacacccccaatggctctgccactcaggaatgtatctgattatacactataacatggccttgcttacaaggccagggatccctgagctcctgctgtggggttggctcccattgaatttttcccttgttgtggagttcccttcacagcctcccatttgaatcctggggcttgcagctacttgatgcttttcaatccatagaaagccaagtcagccattcatttgggtccttggggacccaaatacctctgtcgtcatgatttaatcctttcgttttttaatttccttgctttgtacctgaacattccactttggcagcagctcaggaggttaatcccattgaccaactttaaagcgtggtgaaagacgtctcagaatacctaggagaccaaatgggccttgtgggtttctacagtacttggcactagggggtctttcaaccttaatgccaaggaactggctgacttaactgattgcttgagggattaaaagggcagccctgtatccaaggctccctgggaggctgaaacaacagctcagctttaacctctacttcaccgattggctcaggaaacagccattgtggcgtgattcagactggaagtaccaggaaactggagcctacttgccaccctggcttcctagagctccattcaggggctaaagtgtaaaccacattcacaaagagacaaaaagttataatcagaaggggtttgctctccctgccagctaatgtgccatgctggaagtaataaccattggcgtggcactctgggtagtagatgctaacgcttcagccaactaagaactctgcctgttagcagtttgcatgtgctattgttaaagggccatttacaaaacctaacaagccaaaccaatcagaagctatgatataggcagtggcccagatctggccagagcctcacttgacagctgtcctgtgttctctcctgtgcttattcaggacatcctggaaagaaaggaacaagaggcaagaaaggtcctcctggatcaattgtaaagaaagggctgccagggctaaaaggccttcctggaaatccaggcctagtaggactgaaaggaagcccaggctctccaggggtcgctgggttgccagccctctctggacccaagggtaagtgaagtgatcagtgaagtgaccagtggttgccaaaaaggagcatttcagctgcgcagcttgctccttcctctctgcctaggaatgggaaatggggagggacttggacagggctttttgtgtcaagatagttggacaaggctagtgctaaagggggacctctggtcaaggtgagtcaccctcactgcctgctgggtggaacactaggctgagtatcatggtcagcaaaaccctgggcagtaccagccacactgggtttactcatttgcatagtcctaccatggaggctgatagcactcacttcctatgattgccttgatagccattggtagttgggcaggtggtatctccatttaaaaaaagggaaagtgagtggtttaaggtcacacaactggttagcagcagaacgaggctaaagctcatctccttgcctcctggccctaggctttttttttttttcctgtatcacacatgagctataactcggtgaatcataagagaggggcccaatttttttttttttttgacagagttttgctctttcgagtgaagtggcacgatctcagctcactgcaacctctgccccccaggttcaagcaattctcctgcctcagcctcccgagtagctgggattataggcacccgctaccacgcccagctaatttttgtatttttagtagagatggggttttgccatgttggccaggctggtctcgaactcctgaccacaggtgatccacccgcctcaccttcccaaagtgctaggattacagtgtgacccactgtgcccggccgagaggagcccacttctttcctttgtattgtgtagtgccatgtccctattcaggaaggtagtataatatgtaataaataagagtttggtaatgactaagactttggaattagagaaacctgggtttgaattccttctctgcaacttccttgctgtatgactttgggcaagttactcaacctccctgagcctccatttcctggtatgtaaaatgggagtgataataaaagttcttgtttttcaacaggagagaaggggtctgttggattcgtaggttttccaggaataccaggtctgcctggtattcctggaacaagaggattaaaaggaattccaggatcaactggaaaaatgggaccatctggacgtgctggtactcctggtgaaaagggtgagctggggaattgaattctggaactgctgcccatgcttttcaatatatatattttgtttgttgacttggttattcctgtggtttgtaccaaatctatgttagataataaaaatttgggcttctgaattaagtccttttaaaccaaaagacttaatcccctcttagttaacactgcatgttaaaggccatgtgtgcccattcccggaagaccagtggaggaaggatttgaggagagtctaaagttgctgatagacttgggatttgtagaagaggacatacacagaaatgtgaagttgggggaataggggtggggaataagatggaaaggccccaaaagagggctgtggtggtatgggaagaaatgatgtgaaaggtcagcctttgcctgaccctgcgtctaagctctctttctcatgctgatctccatccctgcaggagacagaggcaatccggggccagtcggaatacctagtccaagacgtccaatgtcaaacctttggctcaaaggagacaaaggctctcaaggctcagccggatccaatggatttcctgggccaagaggtgctggggcaggggatggataggagaaatgctcaagagaggcttcataaccaaacttggcttccttcttgagcaaaggccctcaagtacagccccccatcgccaacctcagagcagcagtgtggctggcagcaaggaatccaagaaggctgcctcccctgggcctgaaggctgcctggactttgagactgccatttgttattgccactgtagaactgaggttttcaaccacaggcagtggtacccctggaggaccctgagcactgtgctgctttcccagtggtatagcagaagcaactctgtcgatgccccataagactgaaagcatctctccccacttcacctttacctttaagctaactgctccctgagcctgcacttggcctgcgacctggggcacctgcatcttggcaagctgggtttttcttgcccagtgtctttttccaagtctttttatttcttttacaggtgacaaaggagaggctggtcgacctggaccaccaggcctacctggagctcctggcctcccaggcattatcaaaggagttagtggaaagccagggccccctggcttcatgggaatccggggcttacctggcctgaaggggtcctctgggatcacaggtttcccaggaatgccaggagaaagtgtaagtgtgaccagatctttgtctttataccagaaaaggccccccatctcacggggatatacccccactgcccacctctctgatcccagcttacttctcagccccttctcccaggacatcctcagaaagagttctctccttgagtctgacaggtcttcccaccctttcctgaacatctcctcctctgttcttttgttcacatctccctgaaatggcagagccttctcttgcctttacaattatccaatatctgcctgcccttcagtccccagcccaggcaccatctcctccaggagtccctgagctcccacccagctgccactctatacttatcactgctgacatcaattctagttgcttctgtgtgggtctgacttcctcaatgagattgttacagcttgagaacaagaactaccttacatgcttttttctctgcaccccactgccagcatttcatgttgagcctggcacattgtaagaattcgtaaaaacttcttgacgttttgctagaaaggtctttgaagctccacaaggtgcaacgactagcaaagaatcaagtccagcttatctgggctcatacaaggcaaggtggaagaggtggcttagcaatgagaccaacctggatttgaacctcagctccattgctcattagctctgtgatcttgtgcacactgtttaccttacctaaacctcactttcctcatctgtaaaaattgggaataatatttaaatagccttcagacagtagggagggttaagtgacatgactcatgtaaagctcttaacattgtgtctggcacatagccggctctgcataaatagcagatgtatcaaatggtctcaatgaattgaatcacagaacacctgggctccttgcaggcaaagtccctgaacttcaaaagtgtcagtccatctgatggagagaacttggtgtgtgcgtgcacacacacacacacacacacacacacacacacacacctgaagcaattgaaaataaatagttctagactggatagtcctgactacttacattctagggggatgaaaacaaagtgggaatgcattctaggagaagtcccagcatgaacagaggctcagaattagaagatatggcaatgtgcctgatgaagccgggcaaggaagcagccacgatggaggggtgtcctgggtagtggtccagtgcacacagtgacccagcccagtactcagcctcctacccaaagcactaagtggcataaatctttactggatactgggtaaatctcaaaatgaaccaaaaccataacagatatcaagaaaagaactttgctgatggcagctgacatggccacttcccagactcagatagtgtgttggacattagccagtgaaggcagattttcctctgaaaatggtaacatttgcccaaattcagactccagcacctgcacacataccacctgctacctggtggcagaaagaacttgtgttccttgcggaacctgtggcagagggctaaccctgcagggtgaagtgaaacttcttcctatgcataatggctccagagctttggcaaggacagtggtagccaactgtgtgttgagtccattgagtgcctggcctgtcatcttctgcattttctgagagactcgctagaatggccacactgtgactttctaagattcccattttgataagcagtggaatcgaatccttcccctacaaaccctaagtatgtgctctgccctttgttcatcaccttcccgtttgcaggacataacatccccacttccagcccacagtccacccttgccacagaatacatgatggacatctctcaggcagtggctcagtgaggggtgaggaagtaagagggtgggcagtcctgagctctgggcagaaatgatgattcccatattgcttcgaagggttcacaaggtatcagagggtcgcctggactcccaggagcatctggtctcccaggcctgaaaggtaaggagcattttttttttcttttaatgttttcttctagagcaaggtagatttctagcaggcccaagggtctctctctttttttttttttttttttttttttcttttttaggcagagtctcgctctgtcacctagtgtcacctaggctggagtgcagtggcgcaatctcagctcactgcaacctctgcctcccgggttcaagcgattctcctgcctcagcttcctaagtagctgggattacaggcattaaccaccacacccggctaatttttgtatttttggtagagacggatttcaccatgttggtctggctggtctcaaacttctgacctcgtggtctgcccacctcagcctcccaaagtgctgggattacaggcgtgagccactgcacctggccatcccaagggtctcttgcgagggtagcggagagtctgtgtttaggggaaagtcaattaatttacattttccctttggccaaaccccttttgcagtccttgttcctcacagacaatgcaacaaacaatggtacttaccaagatctctctctgtggctttcatggatccaaggaaaaggctgtcctttggctttgtggttttgcccatctgctttccagacttagcagcgaggagaacctcggctccagtctcttcccctgataaacccagcccactaggcaggaaaatttcccattcttgctggcatcactgttccattctggtgatgtttgagggccctgcctaccatcttctctgcccatactgagcctagtgatgtgtttcccaatggagatatgctgtatgtagcagcatttcatgccagtagtctggtagcagcatcccagctcctggatggtggttcatcactttttacccaatagataattttgtcaaggagctcctctggctacactgaatctgaaaaaaaaaatgtgttcaaaagatctcagtggtgcaaaatgagctatagcttctcctggccatttaaacaatgtattggaatcctcaggagacaacggccagacagttgaaatttccggtagcccaggacccaagggacagcctggcgaatctggttttaaaggtaaggttgctatatttttgtcttgtttgcctcacagactccacaaaactgaggattagaaggaattttggaggtcaaccccaagttctgcaacttctatccagtgcagaaaatttcctatctatcaattccccaagcaaatcagcctactcttccttcaagactcatagactggcaaagacctttgggataatggcctacatccccttagtttagaagttgttatctaaactgtccttcttgaacatttccacttattgctcccacttctgaagggatactcataacaaatttacttgcttctcaattgtagggcacctttctaatgtgaaaacagccaccactatcttttttagagtttcttcattgggtctagctccttcagcaattcagaatctactctttcccatagaggaatacactgctagaaatatggcctaatcactcagcatttttcttggttttataggcacaaaaggaagagatggactaataggcaatataggcttccctggaaacaaaggtgaagatggaaaagttggtgtttctggagatgttggccttcctggagctccaggtaccatgccacatgataaccttattctgaaagagtttggattagcttcaagccatgccccattctgaacctctgccttggtttcacatttaggatttccaggagttgccggcatgagaggagaaccaggacttccaggttcttctggtcaccaaggggcaattgggcctctaggatcccccggattaataggacccaaaggtatgtgtatttgggagcaggcagtggggaaaagtctttccctcgatgaaggacaccaactactttatcttagaagatactagctagggttaagccatgcctacaggagtcattggacatgaggaatcatgggaaaggaagatgaagagtaatgaaggcaggcaagcatgagtgtgaagagaagaatatgggatccatgaagagaagagctagcaaggaaggcaattgccctggcatgtgtagcctttccctgacttagagattgggcagtgagtttctggaaccagtctctgggagctgacaactcaaggtcttgacattgctactctgagttcttcttcaagatacctaatgagctgccatcttactcctaaagctgtattggtctctgataagagtcatgagaacctgtggtgtaggatataggttgggagtgttttcttctcccttagggcattaagtaaatgcctcaaaaaagaccaggactttaaaataaggacctcgcaatgcctttgggggcaggtagctacctcttgctgatgcttcatgattcagagttgctggagccatttttgacattctctcccctcaggcttccctggatttcctggtttacatggactgaatgggcttccgggcaccaagggtacccatggcactccaggttaggaagaccctcagggtgaagaggagggcatcagctcttccagaagcctggcaagggctggccatgaattctcgactgtggtgtatcccatatccttggactcatagctctccttattaacctccaatttgaggtcccttgatatggagaagaaagaggatgggtttttttcttctactcagattaactttctttcttgttacttcagtactctgcctctggtgtctgtcagtcaggcttctcaggccacaggcgagtgagttaggcaggaaggcctcacctccactgaggtctgccccctacccctgcatctcctcctaggacctagtatcaccggtgtgcctgggcctgctggtctccctggacccaaaggagaaaaaggatatccaggaattggcatcggagctccagggaagccgggcctgagagggcaaaaaggtgatcgaggtgagtccaagtcaggccttgtagaggctgagtgaggccttgctgggagagtcaggtttagggtacagcagggccatgtggctcacagggttgggctgtgagtgtcttcacatctctgggagtctcacaacccagtgggaatgactgctgagaaagagaggttaggctgtgcttagcattttccagtgaagactgtcagggcacagttcaccaagtccattttagcctccagattctcttctgttcctccttactaacctcaagcctctctggcatgcttggtcagagcttgcaattattggtcctgagggacagggcttgtccatttagtgagaggttggctggcatttcctcagcgtccagtgtggatggcactcccagggccctgggaagacagtgtggctgcgggaaggatcccaagactaagatgatacaagtctccaccggacagaaccacagcataccctcaactagaatttgttgggtttactagaaagcaggttctaccctaatctcggcccctgactcatcacatggcctgaagtccctttctgagtctccctttccccacctctcagaaagtaagaatgacttgtgttcttcaacttttcctcaggaaagttccaaaaacccgtgtacattccactccatgttaaccaggaaatgaattcaccatagcatcatggttaagagtatgggctctgaaatcagactagctgggttcaaattcaagctatacctctcactagctatatgactttaaacaaggaagttacttgttcctcaatcccaaatgagcccttagttttccttttccataaaatgaacattataacagaacctacctcataggttttttgaggaatcaatgaggaacgaggtaagatatacaaaagctcagtgcctggcacatagtatatacttaagaatattattgcatgttacctggggaaatcatatttgcaaaatttcctgtttctctctgctctggggcttgaggtctcaccgcattttgtttatgtgcatgtttgtgtacagtgtgtatgtttccgagggactatattcatatattaattcatttcctgctgcattttaaattgatgcatctgcagtttctgtgtttgttcttccctttgatctggaccaaactgttcttttctgaaagccagcagcttctccagaggaagggctcaaagcagggtccgagcctgcccagagactgtcttctttcatgggatatagggaaaaggggactggataaaaacacagggacattttcttttgttttcaaatcttgatggtcattagattattcattttctttagctatctgagataataaaatcacaattatgcatgtagtaaacagcacaggtcaagaaggatacatttcagcaacatagcactaaacaaaaaacaaacatgtcacagaggaatacatttggtatgattccatcaataaatgttcaaaaataagcgaaaccaaccaatacattgtttagagatatacatggtcaaactgaagaaaaaggaagaggatgatgaacaaaattcaggagtgattgcctctgagaggaagggaaggaagagggtggagggcacacaaggaaattcaaaacaagtgacatcttcttaagttgagtggttgaaacacaagtgttcattgtatctgaattattctttgcatattataaatattatgtcatatcttctcaatatctaattaaaacaatttctttaaaaagaatacaagaaatatcataccacgccccaccccacccccacaggaacctatctttgatttgacaacgggagtcagtgcaatatgatgatttactcctaagaaaacatcacagagtggttgggtgcagtgactcatgcctgtaatcttagcactttgggaggccatggcaggcagattgcttgagcccaggagttggagaccagcctaggtaacatggtaaaaccctgtttctacaaaaaatacaaaaattagcagggcatagtggtgtgcgcctgtaatcccagctactcgggggctgaggtgggaggattgcttgagcctgggaggttgaggctgcagtgagtcctgaccacatcactgcacaccagcctgggcaacagagcaagaccctatctcaaacaaactaaccaataaaaaaacttcatagagcaatccctctcattacagtactgttatctaaataactttcaatgatactatttgttttcatatttgcactaaatacgtagaggctgcatttatgtattttgttttttcaaggctttgacactggactgagttggaaaaatgggctgttttgcattttcatctgctcatttaaagtgttttattgttaaagaaatgcatgagctttttgcaatacttgaagtcagtagtgcctttatttcaggtttaataacacgtaagtgtaattataaaattaagaaacaggtaaagggagaaaaagtctccaaaaactgccatgggaacttttataatttgtgtactgcccaccactgcctactctattacacatgtggtgtcttgtttattagttttgcataatttcagtttatatatataagctatacatatatatgctttatatgtatatatacataatatatgtgtagagctgtattttcagaaaaaaagtatacaatatgtctttcttttcagatttttaccctggggataaagaaaaatatttcaaaggttcaccaaaccagaagtaacaatgctatgagtaccaccacgtggcttagctactagttttctttttgtgttttttcttttttccggacctaagaaacctagagagacttttctcaaaatttattttttctttgtctaaatttcaagattcaattaattaatgagctatttaaaaacacccaaatctaccatcacttttataaattttcatggatttaccttaataagagaaattcagcatatttttgcatttttcttgtcacaaaagataaaattcgatattaacatttttggattttcttgtcgcaaacaaaaattaagaatctcaaccaccagaacagtttatcaaccagtttgaatccatttatcttcatttgaatatcttctagaatatcccaaagtaataaatatatatcttccatgctacatgtataatatcaacacctacatttgtgttttcccatcaagattaccatctatgtatttgatatgtgaacattaaataaatcttctgtgatcagatgaaagttttggttttgaacatattacaatagaaatagttccacaaacagaaaacatgtaaagcagtattaaaattagagcaaatgagtattctgtatctattgtaataagtggttattctctttggccaaaaaggggggagggatttagtacagagatatttgttccataggcaattaagcaatcacttggctcatatcatgaatgacctataaaagattgttttccagtttgcctagaaattgcagaagatagccctagaagacacagaggcaccgcattcttgctgcctccattctgatcggcctggtgtctgttctgactggctggggcctgtggcctacgttctgtaacctttgtgcagcatcagacataactggctaacttaagaggtgttttttgacacagacaggtttaaaatcactttggaaacttaaaagtccaggtgctcagtcatgccttcttttctttctggtgtgggggaagttggcctaaaatatttccattaccagtgaggtaagggagctagaactttccaataaaatgcagctccagctggaaaaggggagtctctgagcccttgtcagttagtctgctttctgggaaggaaggattagggaagaagagccctctgctggcgttctctggtctggctcctacctaactgcttccattttctctgtgtgagcttccattttctctgaaagagcctggccatcttctgggcacacagagcctatccagccccttttatttattctttacaggtttcccaggtctccagggccctgctggtctccccggtgccccaggcatctccttgccctcactcatagcaggacagcctggtgaccccgggcgaccaggcctagatggagaacgaggtaaagacaggaagcccaaaagagggctagccaccaccttttgtctgacatttggggaagtcatgtatacagcgcagccaagtccctgttgctggacatatgtgggcgtgtttggcttcacatccctccccgagtggggacacaggggacttgagccaagtgcattttgctaaaatggtttgggaaagtctgggcactaggaccccaccgatggtgagggaacattctctgtcctgggaatgggctttggagtcctgtcagtccctaggccttctgcagtggctactacctgttcacctgcccctcgcccctcttccgatcttatccctaggccgcccaggccccgctggacccccaggtccccctgggccatcctcgaatcaaggcgacaccggagaccctggcttccctggaattcctggacctaaagggcctaagggagaccaaggaattccaggtttttctggcctccctggagagctaggactgaaaggtacggctgctcggctggctgctgggcccttccccactccacggccaggactccttcctgcagtcctgtgaagagaggccggtggctgatgttcttccctacctcacccctgcctatcctccacccctaccacccctaccatgccgggacctgacttgcttcctttgggctttgtcaggcatgagaggtgagcctggcttcatggggactccaggcaaggttgggccacctggagacccaggatttcccggaatgaaggggaaggcagggccaagaggtaagttgagagcatgtgctgggctgatccagagctcgagggaggggcctggtggtaaggttccttcaggcatcattgctcaccacgccaagaaagtctggatgtctaaaacagctggatcaaggtaccccagagaggcagtttctctaccttggggatccttcagcctctatcacctcccaggactgaagaccactgctgccttgccaccatggatcctgctactgactgcctctctgtgttaatctctgcattagtgggcattgggtttgcactcagatcaccacccacccgtttgctcaattcagaaataaagaaccgtcttttgcatcctttcccaccctcactcacacacatgcaatctagtagcaagccctgaggcttgtacctcctaaatgtgccttgcatctgttcacctcgcagtaccttggttgctacccccagatccaagccaccaatagttctcatgcagcacccttcctcccccgaccctagtggtcacttttccacatagtggccaaaaagagcttataaaaacataaatcatccagtggcttcccatggcgtaggaatgaactcaccgtggcacgcaaagccctgtgtgatgcctccctcttcatcctcatggccagcccttcccctttgctgctcactgtgctcctgccatactggcctctttcagttatccaaaaacaccaagtcctggcctaccacagggcctttgcacatgctacttctacttcccagagtgcacttgcccctctactctttaaatagcaaagtccttctaatgttttagtggtctcagtttaaatgtcattgcttgcaaaaggccactgatcattctctaaaacagatgcctccaccccataccaccctctgctccctcccagtgtccctgtgttagtcctttcctccacaacacttctcccaacttacactcagattaacagtatttgtcgagttaggcattattcatcttcatcaccagaccataatctccataaatgtctgtcatattcattgctctatccccagagctaccaggaccctggcatataataagcactggggaaatatttgttcaatgacttactaagcaaattatgctattagaaaggcagctggctggcgccgggttcctaggctgggatgccaactgaacctctggggttagaagcgtcccctcagcctccttggcactgtgctctaaccagtgagtaaaccagccaccccagccctgagagaaggctcagctcaccatattagcagcaaatgcttctggactgcctgtcacccactgggcacaatgctgggccctgaggagacaggatgaatatgacccagttcctgccctcttggagctacccaaccactggggagagagatggataaagattgtataatatcacacagtgccatcctggagatacccgggtatcctgtggggacaaacaggatagaaagctgttgattgcaagttagtaaagaaggcttctggggcccccgtcacctccctctgcctcagcctgatgttcttatttcccccacctgcccacaggctcttctggcctccaaggtgatcctggacaaacaccaactgcagaagctgtccaggttcctcctggacccttgggtctaccagggatcgatggcatccctggcctcactggggaccctggggctcaaggccctgtaggcctacaaggtgaggagggtgccagaaaaaggagatttgttggggagttgagacagtttggctgagaggctggcttggatgtccacctccaagggtgtgtcttcatcaagcgttgcctctcttccttcacaaagctcccaagcttcctgttggggagaagaagggccagcaggaccagcagggtggttgtacttggtacttggctttagaggatgtgagggcagagcaaggttgctactccagaccactcgcccctctctaatgtgctgcagagagatggagggagtgtggtggtgaataaagggccacacaagacaatgaaaaaagtccaaggctgggggacagaaaacctggcctctaattggagtaagttagaagtctctctgggtctcagtgtcctcattttcttcctcttcttcttcctcttcttcttcttcttcttcttttcttcttcgtcttcctcttcctcctcctcttcttcttcctcttcttcttcttcttttcttcttcctcctcctccttcttcttctttttatttttttttatttttgagatggagtcttgctctgtcaccgaggctgagagtgcattggtgccatctcacctcactgcaacctccacctctcgaattcaagtgattctcccgcctcagcctccggagtagcggggactacaggtgcataccaccacacccagctaatttttgtattttaaatagagacaaggtttccccatgttggccaggctggtctcgaactcctgacttaaggtgatctgcctgctttggcctcccaaagtgctgggattacaggcatgagccactgcgcccagcctcggtgtcctcatttctgatatgggatgctcgccgttgccctgcataatttccattgttgctaggaggatgagaagaagggaggaggaagtgggcatgaaggggctcagaaaggctaagttgagggcactgccccagggcagagatgcccccatgaactaagaactagcccaggcggctgcagccttgatgtgcagtgtgcacaccaagtcgacagccaagtgcatcgtctcctagtgagtcttgggcatgacacataagtcccctttcctggggaaggtgcctggggaccctctacattgagtaccctcctttgggctttctctcctgcaggctccaaaggtttacctggcatccccggtaaagatggccccagtgggctcccaggcccacctggggctcttggtgatcctggtctgcctggactgcaaggccctccaggatttgaaggtctgatgatgccacattaggaggcgggcggggcggggatggtggtctgggagggtttgaggctgggggtgagtaaaacttcaagtctgaaacttaataaacccagtggtagagcttgacactcctaagatgctcaaaaactgggctctaagtccattcactccccactaccctctgagcctgtgaagggataccctacgttctggaaggcaaaggactgttccaaatccaaatccttttctgggctctcttccagtgcttaaaaggtctgactttatactacagatggccccctgccctttacctccccttttctacccagggattctgacacacatgagagggggatgttcaagggataacaacacttgagttaaggcgtggctgtccatatacctcttctatttgtgtcccactttatattggggatgacaaattagttgtcctgagtagagaacagttcagaggctcggtgggaaactgtggcagttgatttgtcatgtctgtcatgggcaggagaggagggcaagattttaccctgctaatcctaaccctgctttcgatgactctgattcagcagctacatagttatctcctatgagggcctgcaaggctggacctgagaagtatccctctccacaccctaatccccactcagagagaccccaaggccaggtggctatgggaaggaagcctaacaatgtactttgaaaaatggggcgtctgtagctggatacatctgagatagagttgtagctctaccacttactagctgtaggacatctgagcctcaatttcttcatctaaaaattggggtggtaataccattttccagggtcatcgtgaggattgagtgagataatacatgtgtataacatgccttggacaatgtgtggtacaatgtgagtagctgatgttgtcattagctgcaccacactcaccttttatgatctgtctctctcaggagctccagggcagcaaggccccttcgggatgcctggaatgcctggccagagcatgagagtgggctacacgttggtaaagcacagccagtcggaacaggtgcccccgtgtcccatcgggatgagccagctgtgggtggggtacagcttactgtttgtggaggggcaagagaaagcccacaaccaggacctgggtaggtaccagctctgacagccagccctggtcacctgtccccacaaacaccaacagccaacccctctcttctcccagccctttctaggtccactgttgtgtagtgagttacaagcatcagctctggagtcaggtggatctggattcaaatcctggctctatcacttactagctgtgtacactgcattagttattcaacctctctaggctttggcttcctccttaatggaacaaagctaattctagtatctatcacacacgctggtggaaagattgcatgaatcaatcacccaatgtaaattgcttagagcaacatttggcatttaagcatccattaaatgttagcaattagtagtagtaataataataatatgacctgcagggcaatgatgattacctgagaattaattgttgtctgcaggtgtgctaaatcttaaaagcagactcagtctattaaacgctgtttctttcaaagcagattaattagggcagaattatacagcttataaaaagattcttgttattatcaaatttccctggtgcatttaaaatagaatttgctcaacacacttcagcacatgtacaatgttacaggattggaaggagagggctgcctcagtctggtgcaagtggttggatgtaaacccaaaccaccatctcgtcaaagcccctcagccagacctcccctgcccttgcccactttctctccttccaggctttgctggctcctgtctgccccgcttcagcaccatgcccttcatctactgcaacatcaacgaggtgtgccactatgccaggcgcaatgataaatcttactggctctccactaccgcccctatccccatgatgcccgtcagccagacccagattccccagtacatcagccgctgctctgtgtgtgaggcaccctcgcaagccattgctgtgcacagccaggacatcaccatcccgcagtgccccctgggctggcgcagcctctggattgggtactctttcctcatggtaaggtcctgcactgtctcctcccccagttggaggcaaagggccccttggactggttcccaggctcaagggacaccaggtagaaagcatagagtttgaaaagaagagaaatgcttggactgggcttggctaaagaatggagaacccagttctgcatgaatggcaggtagttatgggtgtagcggaaagacagcagtttgcacccagtggttcaggggctagaatatctgtgagtcataggtcaatgccccgccgtctccatgcccgcttcagttatgccacacccaagggaagagcaaaacacactaagatctgggaggacagtgagggagaggctgtcaccacttggggccaggacacagtttcactaatcagtccagccatggcactgtcccctcttctctccaccctcccagatccctctggcctctgctgtctcctcccaaaaggctttgatgagtgcatgctgtgtttatatgtccttgctggtatttttgctgcctctccatttcggtgtgaaggcagcggccagccatgctgtgtgtcttgctaagaaaaagaatatctgcaggcccaaagaggcatcaagtccctcacataatatcctgtgaatacctggggatgtttcttcaaataaaaggtcaggtttagggtcaggacatcccccagagaaaaccactgtggcacccattgaagtactctgccttgccagagcttctctgttgaattgccaagggtgagatggtgagagagtgtctttaaaaatgaccaaagctgcaggctccccaacattagcgtacctacctggggaaaggtacttttccttgttatgctgtgtctttggacattggatagtttatcccagtgtaatacagaatcacctcacctgtccttctgtcctgtccaccaccctgaccaggaaataagaagaggcccctgagcttccacaggaaatggtacaaatgctgtgtactaaatctcatgtgccctgcttatgggagggctcttagcccttattcagaatctctttactcttcctttacacattaattctaacatactagaatattattcctgaagatatgtaagggtgagaagttggactgcctagcaaggcatcttgaagcaatgagacatacctattaaaaaggagaaaataattcaaaggaggcccaaggattctacgggccgtaccccttggtgtggggctcttgcataatcatcccccacaaaaactgacattcacaatgacaagcctgattcatctgcaaagtttaaaataacctagtgtctgctacttagcaaagcaggaaaatgtgttgtgcatcttagaaagtttttgattctcagggtcaaagtgaggaaaattttgatgcttcggttgtcaggaaaggtcacctgaaaggtcccatgcagactctcactcttgcaaagttctgcaaagtaaggagtccctgtgtgccaacttgggcatttgtctcattggccatttgctgacacggttgtgtattaggcctcttccctatctccttgtggtccagatgatagcccggctaaagtgaagagaaacaggcaggagtgtggagagacaggagctgctgtctatgtgaatagtaactgaaaaccaccagctcatgtgtagccctgaaactgaatactgagagagccctctgaggtgagggccagggtatttgggccaaatacaacaaattaaggagaacttcagtaggttttggactgtccttctttcccttcttagagtacaatgcatggttgagagagggctctgagaaccgcagtccagaagcctattgaattttccttcactcagcttttctcagatccatttgtccgaggaaattttgcaagggggtacctaacacacctctgaacccagtgggacagtagcagtttgggaattgctgcttgacatgtagtcattgcccacataatgggttaggagggcactagggagcttggaagggggcactcttggccctgaaagctgctatgagggaggacaagcagcccctgcccctaaaacacagctcttggtatgctggcttgaactgggggctgagacaaggaaccagggcttaggaatggagctcatgtgcccctgtagcagtggagcacccatcccctccccacaccaacccttggcaggcacagctcatgcactaatctcctgtctgtttcagcacactgccgctggtgccgagggtggaggccagtccctggtctcacctggctcctgcctagaggactttcgggccactcctttcatcgaatgcagtggtgcccgaggcacctgccactactttgcaaacaagtacagtttctggttgaccacagtggaggagaggcagcagtttggggagttgcctgtgtctgaaacgctgaaagctgggcagctccacactcgagtcagtcgctgccaggtgtgtatgaaaagcctgtagggtggcacctgccactctgccccttgccctcccctgcccctcacaacagtcacctcacaaacctgaatggtctgaagaaggaaggcctgagcccctttgcctgtcaagttgtacattggagtctcatttgggctagactaccggacactcgtcaccccagccctcgggtccatagagatgagcccaccctgctgagatctgctgtcctgtttctgtcaagctggtgctactgtttgatttggatgattgtgtgactattcatggctacctcagaaagatttgatgggccacaactgtcttagactgctagctttctccttaccgtcttgatcggaaagctcttcctaatcgctaatcagtcatttcttcatgtacagaggtcagcacacattatttggcttaaaccagaacccagtgtttccacacttaaattctctaaccgaatattcatggatggctcaagtctgcacagagcaagtcctcactcttcaaggaggcccactgtgtctaggcaggcaagagaattgaaatgaggtgccacccagtagcccagagtgagctttagctctctctagaatgagcaagactgggccccacatggcttagagaggcttgaaggccagcagctgggttgggggtggtggtcattaatggcatatggtcctagacaaaccatctcctccttgccggctccccctccagccagagacagaggatgtggcctggttcaaagtaaagcagaggatgcaacaaatgtggccaagcctatcaaaggaaatgagaatgacagccttttttcctgggccagaagtagaggggtgggtgcgtaaggatgtgtgagttttgcttttgactccaggaacaaaaaggtaaatcccacatcccagtttctcagaagtccctgtttattccaaatgccatccagatgtgtgcaatgtggcaaactgaagctgcacagtgttggtttccttgtattctgaggatgttaaagactttgttaaatggttatccaattgctctttcacaggtagcctattaaactattttaatatgtttttttaaacctcataaaaatctagcacactcttctcttgagcagttagcagacctaaagcaagcctgaattggctatgcagtacattgtattctgtttgggggaatttgttttagccattttctttaattaccagttttccagaacactcttagctatgttgacatgaggcagttccttccaggtgattctgtttccttaagtattatataaactgtgccaatacagacaaagcataatcaatataatctgaattattgttatctttacctcctgagtaataagcatggtgtcagttttgtacatagcaaataaaataaatgaaatctgaa

SEQ ID NO: 1191 - DNA, 257795 bp, mus musculus
gaggggggccttgcacggggaagagagggaggaaagtagatctgtaggaattgagtgaagaaaaagtttgcaagtctggacagaagggaaaagttctcctgagagaccggctttggggaggggaggggggaaggaagagtagctccttcttcttcttcttttttttttcttccactcttaaaaagcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggtaagtccttcctcccctcccccgcgcccatcaccgctctttcacgctgaaattaccttttttttggggggggggtccctttatcttccttttggcgttgactagggaattcaaatttgctttctcatgtttaggaagaaacgttatttgcaacaccggtaactcaagccttctgaagtccaacggagaggtttaagtgcttaaaaatagggctgcttgcttccctgcagctagctcctccgggggcaagagcaaagtcagaagtgggggacgctaattaaaggctcactaggctgtggtgggtatttaaaacttttcctcccctccctccaccgtcgggtgtttccctgcctggcgactaaccttttcactacttgtacccagcccactctttgaattttgtctgtagtttaatattttggctcttcgaaaatccagcttccatcaaagtgtttttagcgcctcagtgaagttcgtcccctttgctctttccttaagcaacaggaacctacccccacctcaggtcattcaagccactgacctccttttcccttttgacatccttgttacaaatgaaatgctaaggcaacataccaagaagagtgaggtaaagtctcaggcttcaggtcttttgcgtctttttgttgttgttgttttttctaaattatgggtttttttgtttgtttacttttttttaaacctaccaaggcatctgaacaaattgagaatttgcccatcacctattcaaaggaaaatactcctttttcaaaggagaatcagtgttccagtttaaaggaaagtgggggaggaggtacatgtgaaatagcagcaaaaagctccattcagttttaggaatgtagaattcaaacctcagtatatctcttagaagggtatctgggtagtcccacccactgtcctattggggatgagggccagatgttaaaaaaatgaatggctttgtgagagaaaatgttctccagcctgaagcccatcatctttaatttcatataacctctgaagaataagtgtgtgacaaattatttaaatttatttgagtgatcattatggatagttttaaaaactgtttaatatgagatcatggcttaggccttcacatggttgagtgaccgtcaattctttgtaagcagctgctatgttacagctcatctgggtccacttttaagttagctgtctagcttccctatagcacttagcatgcctcaaatcacatgtcctctttctatccttctgaaggtgtgtacccggtgtatgaaaactaactttcatattactctgagcacaacataattataatagcaaatttgctgaaaaaccatgcatatcaaatatttttactatgcatgccataattttcttccatcaaagtagacaaatgatttaaaaatgcttttttgatgcagagcatcttaatgggggtaaggtttagccagtcaatagggctacagacttggataaaactgcaattgtgctgttgaaaatagttcattttaaaaacatcttcttggtgccctctgtttctggcatttggcccagggacaaagattttgtagatgtttgattaaatatatatatgttttttgatgttacttttaacaaatttgcaccagatgacaactatacaggtatgtatagcaacactacacatcaattaatattaaatcaatttatgttaacaatgaggtttctttttattgacaaaacttgagagcaagcttgttttcttggattcttaaactaatgagtattcatgaagtcattacagctctttcccttttcctcctatataatttttaaagaacattttatatccccttttcctatcattaggatattgtgcctctattaaaaccaagggtttgtttttcctggttcatacataaatattttaataggctcaaaaatatgaatgatatcggctctgcatacttgtgctggagatatcggtgaccatttctagagtaaaactggttggtggtagggctagtctttgactggagtagtttagtattggggtttttatatcaaaaaagtgttgctatttaaagtgctttactcttttataggtaaatgatttctttatctctgaaatcatgccaaattggtacatcacaaatatgtggaagatcttttttttaggtagagcattcattaggtggaataaagtaacctctatgccaaaaggttagtaataagagaagacagttttaagttggaaatataatttttagtgatggaaataacatttttatgtgaaggtaattatacctgtactgattcactgtcagtgggatatgcacttagatttgtggatgtgggtagtatgtaaaattatgttagttttattttacatagttagtaagttgttttctgtgcagtagattggatatttttgtctactttaaacgtactatcttccttgtgaccagcggcacgaatttatcaagggtaggagtgttgtttgtagccatgaaacacttcatcctctatgaagtatattgctccataggaaaaacttgtcatcattgtcatcattattaatgtagataacataatgagtgtttactatgtgccaggcactgtgctaatatgataatacatattatcatatttaatcttcagaacagacttatgagacatataccgttattatcctcactttacagatgagaaaactacaaattacagacgttgaatacattcccagaaatccagtcatgtaggcagtaacttgtgaagctggaaaatttgaatccaggcagtttgactctagaatctttgcccttaatgactgtcctatactgcctactttgtatgtggtctatagagatttactggtgtgtaaagtatttggatctctgccactttttttggacacaggaggtgaaatggaaatgataatgggggttacatgtcttcctgctgatgttaggagaagcagcatggtgtaatggaaatagctttgggcctagaataaaaagatcagagtttgacctctgtatctgtatctagagtgagattatttaaaagcaatctaaaagcaaatgctgttgaaggttttatgattttatgtaatcacaatatgtaaacatttcaacttatataactactataatttgtgacagatgatttgttttgaaggaagatttgccttatgattatttaattactcagttactgcattaattttaagtccaccaaacttttcaggagcatgtctattgtgaaacaaccgggtatgtgtgtatggtaacacactttacttaacatgcttaatttagttttgttctttttttgtactaatttgcctacctatcatatccaattttattcacaaactatatagatatatatctttagtcttatgcatatatctatatatgtatctgtcccatggcagtgtaagagtttgtattttttcatgtgtttttatttaccttttgatgtctatacatgtaagacatgagactctttacatccctgaaagcttggttaagatggtgtctgctaggtttattcactataaagtcactattttttcttttgtaattacaaagtgagactatgcagggcaatattgtgagacaatgtaaatatcctgtttctcatcatatatttgcccactaattttagcatatgttgatgattctggcttgaataaattattgttgtgacatttgccagacattgatttcaattttcaacatttttacatttattaattgattgaattatactgtaataaaaaactttctctttacgcttaatgtatatatttattcagctgtttatagcagtatggacttaatgaatatttgttttattctataggttataatgaattatgctcttactactttttgtttttgctgaaacccagatttggccaacaggagccccttcaaattggctcctgtgtcctttcaacatgtctccatcattttttaagcaccctcttactttctggcaccacagatgttccagactcttttttttttctttttttttttgagatggagtcttgctctgtcacccaggctagagtgcagtggcgcgatgatctcggctcactgcaagctctgcctcccgggttcacaccattctcctgcctcagcctcccaagtagctgggactacaggtgccagccaccatgccgggctaattttttgcatttttagtagagacggggtttcaccatgttagccaggatggtctcgaactcctgacctcgtgatccacccgccttggcctcccaaagtgctgggattacaggcgtgagccaccgcacctggcctccagactcattttttaatttccttgccccaactctggaatcagaatcttttctccaaggagctctgattctttttattggagaatggtatgtagaagccaagatctgggtgcttggcatgcttattgctactgaggtgtcattgcctctaggccctctcagcaggcagaactaggaaatatatgtatatatgcacacatacctgtttctatatcgatttcttgaagtccctctttatatatgtcaaaatcatggattcataatgatacatctgattccagtccaagaccctagaataaatatacatgatctcattctcttctggtatttctcttcacacgttttgtggactttgtagaggtcttatacagagtcttcaagaggttggcctctgaagtcagacatggaatctgactggtagatgtgtaactttcagcaaaatagtaatctttgagacttaatttcctcattggcaaaaggaaggccgtagcacctatctcacatatttttttttttaggatgaaatgagaaaagttatgtaaaacatatagtatttgacaccatagtaaatgttaaatcaattttagatttcattattgtcattatatttattgacttaccatttcttactacatcaactctcaaatctcctgtctgattttcaaggcctatcatgatcttttcccttatccaaccttatttttcattacagtttataatatactccctccagtctagcctaggtaagctttcctacaatcccgtgagcactgcatacacattttggccctccatcttgattagaattttgtggattcaagtctttgctcaattccagcaaatgtttacatttattcagcagatatttattcagcaacttctaagtactcaaaaattctatttatgctgttctatttctattcatggaggtgtactgcctacaaaatcattttgtgctagacactatggctaaaaccaaataaagacaaggttcttcccttcatggtgtttacatactggtgagaatagctaaatagtcctgtgaaactttcccttattatagtatcaaatactgattgtacctttctttgaacatttgtaatatttagcctctcccagtttcgtatctgcatgtatttggtcttataggcattttgttttatgacattttatctgttctttttatttgattaaagtcccttttgaagcaataactatatatttgttcattcaaccaattcatatgttgattttatatggtaacaaaagtaacagctgctcaatgttggaaacttgaaaaacataaagaaaataaaaatatgtccacagttctaccagcaggccagaactgtgctggctgagcacagaataatggtgtgtgttttgattattgttgtttttactattttctttcctatatatataatatgtttttaaaaataaatttggcatagaacaatgacttgtaagagtacaatttttgaattgtaaatgatatgttaaggtttggatgtgaatcacgaaactctaagcacaattcatgtttcaattgctatggtaaagttttcatttcatgaagatactgaatttttaaaatactaaaaaacctgattaaataaacactagctaataactaaaaaaaaagttggttaaaataaaaaagtaagttgggcttattctacatatagttttatttcttactgtttgatcacttatcaagcagtttcccatgttaacattcttagttttaaaacgttattttaaaatgattacatacaacttgtatttatacacactccaatttatttacctgttcacttttgtagagtatattttaaaatgtcaagatttgttagccatcgtaagaagtgctgccatgaacatttcttattccatatttttattattttattgctacagccgccttcatggggaattagtgggttaaacgctataagtatttttcaagtctttgatacatacagtagaccctgatatttaaaaaggctatatcaacagagaaattatggtaacttttttagtggttactatgttatatcctgttaggtagctaatgttatttccacttttatatacaaggaatcagaagcccacattggttaaataacttgccaaaggtcgtgcagttgatacatgattgggccaagatttaaaccaaggctctagaacctgctcatgagattctcctcaatccctatttcatacatggtagataatagagaaaagtaaagtcatgatgaaaagttgaataattctcattgccctttctgtaaacccttctgtgactggtcacttaagatgattctgaagaaagactctccattggctcatcttttaataagtctttaccataactgcctaggccgttcatccttaagggcttaaattttaattttgtgcacaatatatcctcctacttttctcccctgggcagaaggtggagcttgccctccacaaatacctctcctactgatctcttcccagctataacagtggtataacatactcaaattcattgacattctccctcccccagaagagttttgtgcatatgcatctgaaatgagagccccttctgaccactttccccacccctctcaccagcccctgcactgtagctgtctttcaggcttacacttaaatggctgtgtctttacctagtattgtccctagctttcatctctcccttagtgatactcagaaacttcccttcattaattcttaatcttttttttccactttggggagataatatcacagcctcaattccctctttttagaaaattaaactggttagtacatacggaatgtgaggtcccccatccattttgtaccactcccaatttgtaacatactcactttaccttctcctcacatttcctcagtagccaaatgacatcattgcctgtttgccagccctatagcttgcgcaattgaaatttatttctctgcaaagtcacaaactgttatgcattgtggtttttccaggtggcatttgaatagctgaactttaagctcctgagtgatagggatctgctcttgccaaattactttccagaatggttttaccaattatactcctatcagtagtgtataagagtgcctgtgagacagacttaatttttctttcctatctactacagtgactatggaattgatgctcaattgattgccagttggttggctgatttggtcttagtctctaatgattttcttttacaaatgtaatcattccatcatctcatccccttgtgatgatagcagctacggaacagaagtaatttttgaaaatgtattctttctaattaacattataaatgaaccacccagacacttagctaaatctttattataaagatttgtttttaaatagcagtaattcttgaggattttagagaaacaccttcagtgtgatatgtgacacataggcttctttcattttaacaaaccagattctcattttatgcaacttgaacttatttacctccatagtctgtccaggtccacccacactttgtgcctttagcagcttctgctggcctttaaccaaaagggcagtctatgatggtacttgctaccctgttgaaatgggaaccttaaatcccttgcttttcattaattaaagacagtcaaaggcaaatgttataaaagaaacaggcttttgctaaatttaatttttaacttttttattttaatgaatctgttataaatgtcagatgcttactaacttgtagagaatgtaagtaccatttacaagcaagttctattctggttaatggaattgtgtttttgacagtaataaaataagacttcaagaaattctgttaaggaatttgtatcatgctataattcaatcaaataatatttttcctgtatataggagaactggctggtttgctttcaaaatttcttacagtgtatatgacattaattgagtactgaaagagatatggaactttgagaggggcagtggtattaggagtgggacatgactgatgaattatttagtatattctgtgtttacaagccctccaaaagcttgctaaaggaggactggtccttctctgtccatattctcacaatttaattgatgtagtaaaatgtttctgtatgtggaagatagtcatggtggtgtctgtttatattagataggttgtttttcttgcaagtgctaaaaaacactatctgtcttaaacaataaaaacaatttttagctcacataacaagaagtttggaggttgattatctccaaagttaattaattcagccaaataatgacactagtaagggccagagtttgttccatttttctgtactgccatactctgcctatcaacttgccctctaatattagtgcccctcatactctcaagatggctgctgcagttccaggaatcacatgcagacactgcaatgcccactagaaagagagtatgaactattcatgtgtatctctttttactagcaatggaaactttctaaggagtcccacagcaccaccctgaaaacacctcttatttatcattggttgaaatcgtgttatatgtatatgcctacaccagtacattggcaagtggtatacggacataaacgtagagttagtccagtcactcacacaaccacctctccctgccctgcgtctggccaaaacacattgctacctagaaaagttggagggtggaaaatatgtaaataaactcatgatgttttggggggaaggaagaaacagtttctatttcacaacctcatgagtttgtcctcaggatcagttgatacaaaagatttgtaagaaactggtgtatttgttaaatgtgatatattacttatctagggaaacgaatgttttgtatagttctacaaatgaaagttgttgactgttcataggcattttagagctggagggacattagtgatcttttaggtcagtagttctcaaactgtggtctgtggacccctacggttcctgaaatcctattagagaacatgaggaatattttaacagtaatattatcttagtctgtttgggctgccataacaaaatacctcaggctgggtggcatataaacaacaaattatatctcattgttctgaaagctgagaagcctaagatcaaggcagatcaaacctaagattcagtgtctggtgagggccctctttctggttcacagatgttatggtctctctgtgacctcacatggtgaaaggggaaaggcgtttttttctctggagcgtcttttacaagggcactaatctcattcatgagggcttctccccgtgacataatcatctcccaaaggccccacctcctaatgccatcaccttgaagattataattttaaaacatatgaatttttttggaggggacataaacatgtatcatagcaaatacgaagaatgtttacttttctcactatgttgacatttgcactgatggtgagtaaaattactggtgcagtgtaccacattttcttagtagttgtattcgtcatactctcaggggggagaaagccagttttacctcagagggtcctcaatgtagcattaatttatattaattgaattttgacccttgagtgtatgtctttttaatattacatatgacaaaattggaagtatacacaaagcacttatgtacgctgaagtaagatagttgtttctaggaaaagcacttgtgcaattgtttgagttacgagctgaaccagttgatttttgcatggaacgcttttttgtttgttttagatacagggtcttgctgtgttgccccagctggtcttgaactcctggcctcaagaggtcctcctgcttcagccccccaaagagctgggattacaggcatgagccaccaagcccagccaaaattcatttttacttgaaaaacaactgagacaaactgtggttatttatacttgggtatttggcgggcattttcttgaaaatgagtagaattagcctaccacttcagggaaaactactggcagtatttgtggccaatgaaaaatttgagcttttcaagtaagaatgagaattttggaaaacttgaacctgacaccaagagtgtgacagcttcccaaatcttagacttttctaatgaagctggtaattatattaatgtgtattttttatattgtacaataaattgtgttaacatttggaagctctgcataggtcagtgaactaatgttttccaaatgactaatacacagtgttacaaaatcatgcatagggaaaagatcccttcaaagggcaagatagatcgagtttaatgtaattgaataaaaaaagctagtttttttatttttattttttatttttattttattattattatactttaagttttagggtacatgtgcacaatgtgcaggttagttacatacatgtgccatgctggtgtgctgcacccattaactcatcatttagcattaggtatatctcctaatgctatccctccccactccccccacccctcaacagtccccagagtgtgatgttccccttcctgtgtccatgtgttctcattgttcaattcccacctatgagtgagaacatgcggtgtttgattttttgtctttgcgatagtttactgagaatgatgatttccaatttcatccatgtccctacaaaggacaggaactcatccttttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatagtcctttgggtatatacccagtaatgggatggctgagtcaaatggtatttctagttctagaaccctgaggaatcgccacactgtcttctacaatggttgaactagtttacagtcccaccaacagtgtaaaagtgttcgtatttctccacatcctctccagcacctgctgttttctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgccgtgcagaaactctttagtttaattagatcccatttgtcaattttggcttttgttgccattgcttttggtgttttagacatgaagtccttgccaatgcctaggttttcttctagggtttttatggttttaggtctaacatttaagtctttaatccatcttgaattaatttttgtataaggtgtaaggaagggatccagtttcagctttctacatatagccagccagttttcccagcaccatttattaaatagggaatgctttccccattgcttgtttttctcaggtttgtgaaagatcagatagttgtagatttgtggcgttatttctgagggctctgttgtgttccattgatctatatctctgttttggtaccagtaccatgctgttttggtgactgtagccttgtagtatagtttgaagtcaggtagcatgatgcctccagctttgttcttttggcttaggattgacttggcgatgctggctcttttttggttccatatgaactttaaagtagttttttccaattctgtgaagaaagtcattggtagcttgatggggatggcattgaatctataaattgccttgggcagtatggccattttcacgatattgattcttcctacccatgagcatgacatgttcttccatttgtttgtatcctcttttatttcattgagcagtggtttgtagttctccttgaagaggtccttcacatcccttgtaagttggattcccaggtattttattctctttgaagcaattgtgaatgggagttccctcatgatttggctctctgtttgtctgttattggtgcataagaatgcttatgatttttgtacattgattttgtatcctgagactttgctgaagttgcttatcagcttaaggagattttgggctgagatgatggggttttctagatatacaatcatgtcatctgcaaacatggacagtttgacttcgtcttttcgtaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcctgaagggttgttgaattttgtcaaaggccttttctgcatctattgaggtaattatgtggtttttgtcattggttctgtttgtatgctggattacatttattgatttgcgtatattgaaccagccctgcatcccagggatgaaacccacttgatcatggtggataagcttaaaaaaagctagttgataaagtttcagattctacattacaactaaccttatcttaaaaggctattagaatgcacacttttccagctatataactattggaaaccagattttcttcatatattttaagtaaagcaatgtattccaacagaagaaatgcagaagcagataggaggattcagcttttgtcaaagcaaagaaatctacaaaaaaagtaaaataatctctcttcccactatttttttttgttttggaaaatataagtaattttcataaaaattcataatatatgttaacatttaatgggtttattgccacttgaaaatgaataaataattttaaatattactcagttttaatttttatatggtatatgttgatagatgtaatccagatgatggggtcttcaatactttttaagagagtaaaaaggtcttgaaaacaagaagtttgaaaactactgctataccgaggccaactccatcttttacatgaaagtgattaatgaaagatgataactagttatttagttgcagaggcagagatggaagctgtattttctgaatcttattctcgtcctctctccagtatactacattggtttagggattggtaaattgataatatgatgtggtaattttgttcatcgtggtagatacagttaaaataccaaacagaaaatgtagatactagattgtactcgtcttgcctaccattttcaatccaattgccaagtcagaaacattcttgctacacaaaccacagcagaagagacacacacaaaaaatagctaaagttgcagttacttttaggtactaaattggaaaattcatgaaaccagagttcttatcttacatatctttgtattcaccacagtgcatggactggtttcttctatatagttatctctcaggaaatagttgttgaatgaatgttgaatttggggaaggagtagatttatccggataacactaagaggcaaaacttagaatcaatgggttaagttacaggaaccctggatagcaataattttcttttttcttttcttttctgttttttgtttgttggtttgttttgtttttgttttgttttttgttttgaaggaatcttgctcttgtcgcccaggctggagtgcaatggcatgatctcagctcactgcaacctccccctcccaagttcaagtgattctcctgcctcagcctcctgagtagctgggattacaggcgcccgccaccacacccagctaattttttatttttagtagaggcagtgtttcaccacgttggccaggctggtctcaaactcctgacctcaggtgatccaccctcctcggcctcccaaagtgctgggattacagtcgtgagccaccatgcccagccagcaataattttctaacagttaattatttgctacttagtaatggaaatgtctcattagtaataggaatgttcctttactaaaaatgctcaaatagaaggtggatgctgctctgtctgccaacatacccatgaggtccctttggactctaagattctgttttttctggtaattagaaggaaaatactttcttactgagctcaagtctacttctatgattttatcgagacaaggtctcctgctgcctaggctggtctcaaactcctggactcaagggatcctccaacctcagcctcccaaagtgctgagattacaggtgtgagccaccacgcctggcctacttctatgattttaaagcaaattttaggtataattgacatacaataaaatgcatatatttgaagtgtacaatttgagttgtgacatatgtatacacctgcgaaaccatcacaacattcaagataatgaacatgtaaattgctccaaaagatttttattcctctttgtaatccctcccttcctacccccatcctccatccccaaataaccactgatctgctttctgtacagtagaaagtttcattttctagatttttatataaatgcaattatatgatatgtatacattctttgctctgacttatttcacttagcataattattttgagattcatccatgtcatggtgtgtgtccatagtttattattttattgcacagtagaattccattgtattgatacaccacactgttgatggacatttgggttgttttttgtttgtggctattaaagttgctatgggcattttcttgcactttaaaagtactaaattgagctataatttccataaagtgatacacagtgatcttaggtgaacagctcaattattacttaactcaattataacttaacaaagtgtataccaatcatatatactttggtaactaccaaccaagtgaagatgtagaacgtttccattaccttggaaaggtccctcatgcccgtcccatttcaatgtcttttgtgtcttgtctgaataagccacaaggttgtgaagatacatgttttcttccataatctgtatagcttcagattttgtatttatgtccatttttcttatatagatacccagttgttccagtattgtgtatttaaaagaaaaattcctttttttttcattgaattaccttgaggactttattgaaaatcaatggaatgtgtatatgcaggtgtaggttgaaactcactagtctgttctattcacctgtttgtgcatccttatgccagtatcacactgtattgattactgtggcattactttggtagcataagtcctttacatttcttcttattcaggattgtgttagcttttgtgttggctatttattccatataaattttacattaatcttgccaaattttgcttaaaaaccttttgaggttttgataggaattgtaacaattgtgtagatcaatttaggaacaactgaaatcttaaaattattatttttttcaatccatgaacaccatatacctctccattaatttaggtattctttaattagcttcatcatagaggtcatgcacatcatttgttaaatttcttcctatatgaataattctattctaaatggtatcatttttaaaattttatttttagttacttgttgctaagatgtagagatgtgattcatttatatattgatctgtttatccaaagataaaatgctaattaattttcttatggtatgatttacatactgtaaaattcacccactttatgcacagttctattatttttgacagatgtatacagtaatataaatatagtctctaatcaagatatagaacagcatttctaaatttattcattagttctagtagtcgtgtccatttctttggattttgtatgtatacaatcatatcatctgaaaataaagagggtcatagtttttcctttccattacctatgtctttttgtcctggctatcttattgcactggctaggacctccagtacaaatataatggaagtagtaaagaatgactttttttttgctgtcttttaaggaagatactcaatattttgctattatatcagctgtaggttttccataaactttacagatcgaggtggtcctttttcatttctatttgctgaaaatcttttttaaagtaatgaatgttaaatttcatcaaaaaataatttgtatctctttaaacaatcatattgtcaggagctcagccgagctgctaggtgtcagacaccaagccaaaatcaaaataatagtcaagcctttaatcacttagtgtgattatataaacaagaagctaaaccggagaaagtgctgaggactgtcctcacttcccagttacatttttccccatggtagattggaccagcacaggcttcgggggtctgtgttttctcactgacaagggagccccaaacaaaaggctctggcagtgttagggacccaggggtttgggggaggaagaaggaaaaggctaggtgtggaaaaatacctagtactgagtcagagtggaaagaagtgtcttcaacgtttgctcccacttcctctgctgtgaatatttgtaaacaagtctttgggtagacaaatgctttcattttccttggataaatatcaaggaatggaattgctgggttgtagcattagtctatttttagctttacaagaaactgccaaattgttttcctaagtggttgtaccattgtactttccactgaagtatgaaagttgtagttgttcctcgtcagaactgtgcataaaatgggtgaattttacagtatgttaatcataccgtaagaaaaataattagcattttatctttggataaacagatcaatatataaatgaatcacatctctacatcttagcaagtaattaaaaataaaatttttacctgcatttgatattgtcactctttttaattttagtcattttgatatcttagtattggtatgttcttgtcattttcttatagtcaccttttgtttatattgagtaaaattcgctatctttggtgtactgctctatgagttttgataaaagcatacaacctttaactactgccgtaatcaagactcagaatacttccataacctcaaaatgtttcctcatattgctatgtaattaacctctctacttacccacagtttctggcaatcactcatctattttctgttcctataattttaccttttttataaatgtcttatagattgactcatccagtatgtaaaattttgagtctagctttttcctcttagcataatacatttgagatccatccatgttatatgcatcagtagtccatttcttttttatttgttttcttataattgagtaggaagagctttttgtgcattctgcatataatatattcatttcatacatacatgccatgcggatatgctctgccatttggtggcttgcgtttttgttttcttacctataattttcagagaataaaagttgaattttgatatagtccattttatcacctttttatggttatagctttctgtcccctttataagaaatctttgacttccccaaggtcaccaagattttctttcatatttgcttctaaatgattttatagtttttgcttttgatccatttacttatttttgtgtggtgtttggtaagagttctggttcagtttttatcccatgtgtttagttccagcaccatttgttgaacagactatcccttccccattaaattaccttgatacttttgttttgtaggtctgttttgtattctagtctgtttcaccaatctctatgtctatccttatgccaataccacaatgtcttcactactgtacttttatgataaggtctgaaatcaggtaatgtaagttctccaaatttgttcttttcatattttggggtctcctcttcgcccccgcctccttctttgaatttctatataaattttacagttaccttggcaatttgtacaagtaaaactcctggagttttgaatgggattgtatttaatctataggtcatttttgggaaaaatgatgtcttaacagtattcagtgttctgataagtgaacatggtgtatctttccgtttattaagatcatctttggccgggtgcggtggctcacgcctgtaatccgagcactttgagaggccgaggcgggtggatcacgaggtcaggagatagagaccatcctggctaacacggtgaaaccccacctctactaaaaatacaaaaaattagttgggcgtggtggcgggcgcctgtagtcccagctactggggaggctgaggcaggagaatggcgtgaacccgggaggcggagcttgcagtgagcccagatcgcgccactgcactccagcctgggtgacagcgagactccgtctcaaaaaaaaaaaaaaatcatctttaatttctctcagcaatgttttcagtgtgcaggtcttatatgtactttattgaactcatcccctaagtattcatgtatttgaattgtactataaatggtatcgtgttttattttctttcaattgtttgttgttggtatatagaaatacaactgatttttttttctattgacctgtacactgtggtcttgctaaattgattatttttagtagctctttcatggattatttataattaactacatacatgattatgtcttctgtgaattaagatagatttgcttctttctttctagtcttcacactcctttttttccccttattgtactaattagggcctgtaggataacgtttaatgtaagtattaagaccccagttctttgctgccttttcccaatgtttgaaaacatatgcttcacacattttgtacagtttcctagttgtttgtagcaagagggcaagtctagtagcaatcattccaacaaaatctgctttcagttttttgatatttataaataacaatgatgtgaacatttttgaacgtatttgcacttcagattatttcctttgaacagagttctaaaactatatattgtaatctatatacatatatctgtatctatctctctgcctgcatatttaaacctacagtataagagctacctcaagagcagtgactatatttcaaatttatataccttgcatcatctagcagacagcctttcattggattaatggaaagtaaaatctttatgattaattttctcatacccagagtatctatttaactatagcatagagatatttctaatcttgcctgtgaagtctaaaaagactgtgatcattaccatagttttaatttactattactttattttgcttcattttaactgtcttatttctctttgataatgttgtaggaaacaagaaatatgtaggtcttaactttggccactgttaaaaattttttttaaaaaaatataatttggtttattttgagaaagggaagacatttttcctaactttcctacattttgtgttaactttgtaggatgttgtttgagcaatgaccctgtaggacgtggccttacacattttgagttcatttgagttaatttagtttcaggaaggcttctgaaataggaagcatttattcaagctttagtattccttctgaatagttttgctagctagctataaacaggccaatttgccctagctctaagtttatgttaattttcattactttgtttcaaaataaaagggccaattcccgttacattttgatttaaaaaattaagctatacatttttcttagatgtgggtatgttaaagcttttcaatgtctggcaaaattaatcaccctaggccgtggatttccttgcccccaactccctccaccccctaaagatacttgataatatgttggaaggagagaaataatagcttttttcttccagttcttatggtcaggtgagttcctagggtttttgtttgtttgtttgttttgagacagagtttcgctcttgttgcccaggctggagtgaaatggtgcggtcttggcacactgcaacctctgcctcccggattcaagcaattctcctgcctcagcctcctgagtagatgggattacagatgcctgccaccacgcctggcaaatttttttttttttttttttttttttttttttagtagagatgcgatttcaccatgttggccaggctggtctcgaactcctgacctcaagtaatccgcctgcctcggcctcccaaagtgctgggattataggagtgagccaccacgtttggctgagttcctagggtttaaatgttttaaaatatttttattcatagtatactcaagttataggaatttggttaatagtgaataaattcattcttagcaccagcctctctcaattctatttgcttgcttatcttttacagcctatttagacatatcatttttctccacagttgcagtaaagacttctttctgttatagcgcaagcttattagaccttatcacagccttcatgccttcatttgtgtatactatataatgggaaaaaaaagactaatgttgtaaattaacaagtgagatcaaactgaaaaaggtcacctttcttagaggctgaaaaagagattcattttctggggcctggatttgtttttctgactaattttactgccacttttgaatttgcagattgacaacctttatactaaaaatatttatctgtatcctagtagatttccaaatccatattctcagttttctctactccatgatatgcagatatggaaaaggaggcattttttttcccctcagatggttaatgttataatttgaaattggtaatatgctaataaacaaaggtaggttcaaaatcagatctttctgatttccatgaggcattgtaaatattatattacttaggatttgttttaaaatcaggttccaatttaagttggaaaaaactgaaaatgtttagaggtaacagtgattaaattatttcagattattatatttttcttagttttccctacatgtctacttcttcatctgttgttttactttatggtacttaaacattctataaagttttttgtttttttttgagttggagtttcgctcttgtcatccaggctggatggcatgatctcggctcactggaacctcacctcccgggttcaagccgttctcctgcctcagcctcccaagtagctgggattacaggcatgcgccactacccccggctaattttttgtatctttagtagagacaggttttcaccatgttggctaggctggtctcgaactcctgaactcaggtgatccgcctgccttggcctccaaaagtgctgggattacaggagtgggccaccacacccagcctctataaagatttgtagtgcgtttaaacattaatagaatgaaaaagtattataaaaggcaagaatatagacataggttctcattaaatcacaattaatggaaatgtatactcatagcaaaattaattatgctctttttgggtagaatattctggagcctaaagtttcatctccttttcataccactgtccttaaaaatgcaacattagcttaaacatgaatttgtttatattaacataaaacttctctataataaatgtttattcaaaattgaaggaggaaaaaagatttagagtaagatacatactaatattaaatactagtgctgagattatgagtcattttttcttatatgtattttctgttacctacagagaaatagtaatagtaaatgcctattactattacaataaaatgattttaaaatatttaatattagtttaacatatatttcaacagttttttgatttaaataatttaacaacatattttacagtcatagggttattttattttatttttgtttgtttcttttttcagacaggatctcactctatcacccaggctggagtgcagtggtatgatcatggctcactgcagccttaaccttcagggctgaatcaatccttccacttcagcctcctatgtagctgggattacaagtgcacgaccccatgccccgctaatttttgcagagacagggtctcactatgtttcccaggctggtctctactactgggcttaagtgatccactggccttggcctcccaaagtgctgggattacaggcctgagccattgcgtcccttcctatcctccctctcttgtaataaatgttttaggtagtttttaaagttttcttttacttggctttcttaaaggagaacttcagttgcttttttccagtaaaaaattccagagactgccagaagaagcctaatgccagtaataattctgtcattgaacataatggagaggagtcatcttaatttgtatgcactcttttttatatcaagtgtaacacatattcttcttgtccttccctccaagtgggttacaaacagcttttctctttcactttaccaacattaaaaagagtgattttaagaatgctggatccacctttttccacttatatttggaatgaaatgtgtaatttatgtatgaaacctttaattttaatttaaggtctcgtgaaagcaccaaaactctttagataaattgacacggagttgctttaagatacaaattccttcttagtaaaaaaaaggaagaattttaaaactttatgttttaattgtttctagttgaattcagaatattaaagctttgttatatatgtggtaactctctaataaatacttcaagaaagtatctcagtatttaattaattatgagtactataatttattctaaagccttaataaaatcaaatttctattagtttatgcttttctcaatgttcattgaaaatattgagtcatattacctattactgccccaatccccagcccagcttgtaactttcctgaggaggaaaattgagtaaacctcagtgattatttgacagttgactccatagctaagctggaagacagggtgttgtgggagggagataacgcttttagggttttactgaagaaaggatgtagattttctgattctgttttgaagatgatataggtggatgctgctgggagaaatgacagtggcatcccattaggcctgtcgtgcccatccccttttaggattctgcatatctcttagtttttcctttgtcaggtaacaaaggtgtaacatgggagatatattccacttctccacattgttagcttagtgtagtactctatccagcaaattattggaaagagcaggatttggaagttagactagattttattgcttgggtagagagagaatgctcaagagagcttatcctggacaccagaggatgagcaattggaaagatggactgctttatcatttttgtgttattttgcaatagatagggcagattcccctctttttattgcagtacaaaatccctttaatagctagctctaacgttactatggcactatagtgtaatggtttagtttagagtatgggcatggatgtcagactcgacttgtatcgagactcttccacctaccaattgggctaacattattagtctaaagtgtcttaatgcctggcgtagagtaagtgttcaataaataattttccacaggatctatagtgtcctcttccaatataatttagttcaatcttaagcctaatagtttgttttccttcctgatcccctttcttcatctctagcattttaccataggagggaaagatgtcttagaaacacttttttagtttatttctagaggtattggctagacttcatgtcagttatatgcatataccaatattttatatattaaaaacaaatataatccctagaatagcattgtctgattagagataaaatggtctcaaaagaggacaggaaaatagggaagtgggagtagtagtaaagagaaatgtaaaccaatgtgtaaacaagaaagcaggtttatctgcaactatagggaagaactgttcaaattaccttgcacatttttatttcttaggaggcttcttaagattttaaattaagttattaaactatttattgggttgaattaaatatttagataaatgcagtatatagatatgtctgtctgtatgcatatatgttaaatacacctaagtttcttatactttaactaattttgggattccttctcacccaaaagaaatttaaataaatactttggatatttctgtaaatacagcatgccatttagcaaatttaagggaacaagtgaataacttagctatgccaacaatgttttgcctccgcattccttggcgcaaacagggacctcagtgaagcgttcctcatgggagttgcctggggaaatcttactgaagaagtctaggtcccaattcaggctcctttcccttctactttctaaaatatcaactttattgaggtatagtttacatacaataaaatgtactagttttaagtgtacaatttaatgattgacaaatgtgcacacccacaacattttcaatattgagcagtttcatcaccccaaaaagttccgtttgtttttcttcccagtaaatctttccctatccctgtaccctgaaagccactgacctgctgtcactatgaatatttgtgtacaagtcattttgtacacataattttcatttctcttgggtgagtgcaaaggaatagaattgctgggctgcataaatatgtaatgtattgaaccttacaagaaacaaatatgtttgcaaaataataggaatattttacattctcaccagcagtttataagacttttttaattatagctatcctggtgggtatgaagtggtatcttgttgttttaatttgctttttctgatgttgagcatattttcatgtggttattggccattcaaatatcttcttttgtgatgcatattctcaaatctttgcccatttttttcaaaagttggattacttgccttcttataattgtaagagttctttatttgtcatgtttacataaatatacacacacgtatattatacacacacctagtatttttcccattctgtgggtcgtattttctttttcttaatggtatattttaattagcagaattcaaaaattttatgaagcgcagcttatcatttttttctttgatctttattgccctttgcattataaggaagaatcctttaactattaatacactaaagttttaaattttgcctgctttcttctagatatttggtgcttttaacttttgataaacttagtgttattttggtgtgcagtgtgagttaagggtcctggtttaatttttaaaaaaattatcaaggtgaaatttacataacataaaattagtcatttaaaagtgaacaatttagtgacatttcgtatattcatcatgttatgtgaccacttctacctagtactaaaaatttggtttctctcactccaccttgtccctggaaaccatcaatctgcattctgtctctgtggatttacctattctggatatttcatataaatgaaataatacattatgtgacattttgtgtttgacttatttcacttagtattttcaaagttcaacttcattgtacatcatccctttttatggctgaataattttgcattgtatggatataccacattttgcttattcgttcatccattgttggacatctgggctattaccactttttatctattgtgatgagtgctgctatgaacatgtatatatatatgtatttgtttgagtacttgtttttaatatttaagggtgtatccttaggtgtggtattatgggccatatggtaattctatatttacgttttaaggaaccaccagactattttccttggcggtttaaacattttacttcgccaccagcaaggtatcagcatttcaagttctccacaatcttatcaacacttgttatttttgttttgtttattttaagttttaattttttaattatggccatcctagtttgttatggagtggttcttcattgtggttttgatttgcattttccgaatgcctgatgatactaagcatttttcaagtgcttgttggcaatttgtatatcttctttggagaaatatctattcaagtcctttgaccatcagtatttttttttttagacttaaggtcttgctctgttgcccaggctggagtgcagtggtgtaatcatgcctcactgcagcctttaactcctgggctcaagtgatcttcccatctcagcctcctgagtagctgggcctgcaggcaggtggcaccacatggccaaggtggctttttttttttcttttagaaatggggtcttgctatgttgcccaggttggtctttcttgcctctgcctcccaagcagctgggattccagccctattttcaagttgggccgtttatctttttgttgttgaattgtaagagttatttatacattctgaatactagacaaatacataatttgcaagtattttctcctattctgtaggttgtttttttcacttttgtgataatgtgctttaatgcagaaacattttaaaatttcatgaaatccaatttgttttttttcctttcttgcttatgcttttggcgtcatatctaagaatccattgccaaatccaaagccatgaagagttatctctatgttttattatacaagttgtgtggttttagctcttatgtttaggttgttgattcattttgaaatagtttttgtaaatggcatagaggtccaactttattcttttaaatgtggatatacagttgtcccagctgttattttctcattgactagtctaggcacccttatcaaaaatcaatttaccattgatgtatgggcttatttctagactctccgttctatctcaatggctatgtttatctttatgccagtaccacactgttttgcttactgcagctatgtagtaaggtttgaaatcagaaagtgtgtgtcttccagctttcttttactttttccagattgttttggttcttagggccccttgcaattccatatgaatttgaagattgactttactattactctttctgcataaaaggctgttcaatagggatttcattgaatctgtagattgctttgggtagtattgccatcttaataatattaagtcttccaatccaggaacacaagatgccattcattcatttaggttttctttaatttctttcctcattgttttctagttttctgtgtacatgttttttacctccttggccaaatttattcctaggtgtgttttattcttttggatgttattgtaaatggaattattttcttaatttcctttgtagattgttcatttgggctctatagaaataaaactaattttgtgttttgattttgtaccctagaactttgctgaatttattagctttagtagtttatttgtggattctttaaggctttctgtatacaggttgagtatctcttatctgaaatgcctaggaccaaaagtgtttcagattttggagtttttcaggttttggaatgtttgcatatacataatgagatatcttggggatgggacccaggtttcaatatgaaattcgtttatgttttatatacatcttatacacatagcctcaaggtaattttatactatattttaaataattttatgcatgaaccaaagtttagactgcgtttttactgtgacccatcacatgaaatcaggtgtggaatttcccacttgtggcatcttgttggcggcactcataatgacttgaattttggagcattttggattttggattttcaggttaggaatgctcaacctgtatgaaaaaaatatatctgcaaagagagatagctttgtttcttcctttccaatttggttgtcttttatgtctttttctagcctaattacttagctaaaacttccagtactatgttgaatggaattggtgaaaccaagcatccttagtttgttcctgatcttataggaaaacagtttttcacctttgagcattcagttagatgtgggtttttcgtaagtgtttttttttttttttatcatgctgagactgctcctttacattcctggatttgagtgtatttattaggaaagggtgttggattttgtcagatttttttttttatcattgagatgatccaaatgttttttcctattggttctattaatgtggcatattgcatcagtgggttttcttgtattgaaccacattgcattcctgggataattctcatttggtcatggtttataattcttttagcatgctgttggatgtggtttgctagcatctgttgagggttttttttttgcctctatttttacagggactattaatctataattttattttctttagcatctttggctttcatatcagaataaaactatatttatagaatgagttaggtagtgctattctgctttttggaagagtgcgagagtaattggtgttgttttctttaaatttttggtagaattcactagtgaagctatctagctatggactttacttcgttgttaggtttttgattattgagtcaatgtctttacttgttatgaatcttttcagattttctattttttcttgagttagtttaggtaatttgtatgtttctagaaatttgcccatttcatctaggttgcctaatttactggtgtatgatttttcatagtattttctctctctctctcttttttttttttttttttgaaacgggatcttgctctgtcacctaggctagtctcaaactcctgagctcaaaggatcctccttcctcagtctcccgagtagctgggactacaggcacctgtcactgtgcctggctaattttttaatttttattttttgcagagatggggtcttgctttgttgcccaggctggtctcaaactcctgggctcaagtgatcctcctgcctcggtcttccaaagtgctgggattacagggatgagtcatcatgcctggctcatagtattttcttataattctttttatatctgtaaggttagtagtaatgtcttcattttcattttttatttcagttatttgtatcttctccctttattttttagtttagctaaagatttgtcaattttcttggtcttttcagagcactaacctttgttattttattttattttcaagttttctttttgctttaaagctataatagtaaacaacataatttgcacatatattcaggctcattttcaaattttattttcatttcaaagggcacatgtgcaggtttgttacatgggtaaattgtgtgtaactgaggtttgatgtatgaatgatcccattacccaggctacctcctctagtagtccccagtgtttattgcccctctctttgtgtctgtgtgtactcattgtttagctcccacttataagtgagaacacgtggtatccggttttctcttcctgcattatttcacttaggataatggcctccagctgcatccatattgctgcaaaagactcgatttcactcatttttatggctgtgtagtgttccatggtgtatatgtaccacatattctctatccaattcaccatcgatgggaatctaggttgattccatgtctttgctattgtgaatggtactgcagtgaacaaagacatatatgaaagtgcatgtttttggtataatgatttcttttttggggggtatatacccagtaatgggattgctgggccaagtggtagtcatgttttaagttctttgagaaatctccaaactgcttttcacagtggctgaactaacatacatttacaccaacggtgtacaagcattcccttttctctgcagtctcaccagcatctgttttttgttttgttttgctttttaataatagccattctgactggtctaagatggtatatcattgtggttttgatttgtatttctctaatgattagtgatgttgagcattttttcatatatttgttgcttgcatgtatgacatcttttgagaagtgtctgttcatgtcctttgcccatttttaaatggagttatttgtcttttgcttgttgaattaagttatttgtagattctggatactatacttttgttagatgcatagtctgttaatattttctcccattttgtaggttgtttgtttactgtgttgatagtttcttttgctgtgcagaagctctttagtttaatgaggtcccacttgtcaatttttgtttttgttgccattgcgtttggggatttagtcataaattatttcccaaggctaatgtccaggatggtggttcctaggttttcttctaggattcttatagtttgatgtgctacatttaagtctttaatccatcttgagttaattttcatatatggtgagaggtagggattgagtttcatttttcttcatatggctagtcagttatcacagcaccatttattgaatagagagtcattttcccattacttgttattgctgagtttgtcgaagatcagatggctgtaggtgaaaggctttatttctgggttctttaccctgttccattaatctatgtgtctgtttttgtaccagtaccatgctgttttggttgctgtatccttgtagtgtagtttgaagtcaggtaacgtgaggcctccagctttgttcttttggcttaggattgctttggctatttgggctcttttttggttccatatgaatgtataaatagtctttttctaattctgtgaaaaatgacattgatagtttgataggaatagttttgaatctgtagattgttttgggcagtatggccattttaacgatattgattcttctcatctgtaagcctggaatgtttttccatttgtttctatcatctatgatttacttctgcaatgttttgtagttcttcttgtagagatatttcacctccttggttaggtatattcctacatattttttggtgactattgataatgagattgctttcttgatttggctctcagcttgaaccttaccagtatatagaagtggcaatcatttttgtaccatgattttgtaacctgaaactttactgaactcgtttgtcagctctaggagccttttggtggagtcaatagggttttctaagtaaagaatcatagcatcagtgaagggagataatttgacttcttttacaatttggatgccttttatttgtttgtgctgcctgattgctctgcctaggacttcagtactatgtcgaaaaggagtggtgagaatgggcatttttatcttgctctggttcttaagtagaatactttcagcttttgcccttgcggtatgaacttggatgggggttaaagaaccaacttttggtttcattgattgtctcgattgtttttatattttctatattgcttatctccactctaatctttcataatttcctttcttttgctagctttgggtttagtttgctcttccttttctagtttcagaaggtataaatataggtcatttatttgagctctttctcatcttttaatgtaagcatcgactactataaattttcctcgttacaatttccttcactacatcccataatttttagtatgttgtatttttattttcattcttctcttaagtattttctaattagttttgtaatttcttctttgacctattggttgtttaagggctacattatttaatttgtacatatttgtgaaatttccagctttcttctttttattgatttgtagtttaattccattgtgattggagattacattttgtatgacttcagtttttgatattttttcagacttattttgtggccgtacatatgttgtgtcttagagaatgttacatatgcacttgggaggaatgtgtattttactgttgtgtattctatatatgtctagaaataggcttatgatgttgttcaagacttctgtttccttattggtcttctgtgtagatgttcaatccattattgaaaattgattttcgaagtatccaacaatcattatagaactgtctatttcttttttaaattctgtcaagatttgcttcctatatttagaggctcagttacttggtgtgtatatgtttataattgttatatgttgacgaatttacacttttcaataaataatattgttgtcttttgtaacaggggtgacttaaagcctaatttgttggatattattataatcagccaccccagctctcttttggtcattattttcctgggatatctttttttctttcttgaaatttcagcccatttgcatctttgaatctaaggtgaacctcttgttgaaagaatcccttcagaatgctaatttcatttcctttgggaatatacctagtagtgggattgccagatcttatggtaataacacttttagttttttgaggaaccgccatactgttttccaaaatggctgtactaatttgcagtaccaccaacagtatataagggctcccttttctccacatcctcgctaacattcatcttttagctttttgataacagccagtctaacaggtgtggggtgttattgtggttttgatttgcatttctctggtgattaaagatgttggacatttttttgtgtatctgttgaccatttgtatgtcttcttttgctaaatgtctattcaagtctttagaacatacattcctcacatgtttgtggtgatgctggtttaaaccaattgcagtgctagtcatataaaagtatagtacatacaattatttatagtatgtaatataataagtcactatgttactggtttatgtgtttaccatactacactcttaccattattttgttatcactacttcataagtagaaggagtgtattccttcttctcataacacaaaaaagttaactgtaaaatagcctcagtcaggtacttcagaaggtatttgagaggaaagtattgttatcataggaggtgacagctccatgcatgttattgcccccaaagaccttccagtgggacaagatgtggaggtagaagacagtgatattgatgattctgaccctgtgtacgcctagactaatacgtgtgcttgtgtcttagtttttaacaaaaagttttaaaagttaaacaataaatacagtattttaacaatagaaaaaaggttatagaataaggatataaagttttatatatatatatatatgtatatatatatatatatatatttttttttttttgagatgaagtcttgctctccagtagcccaggctggagtgcagtggtgcaatctcggttcactgcaacctctgcctcccaagttcaagcgattctcctgcctcagcctcccaagtagctgggatcacaggcacctgccatcacgcctgggtaatttttgtatttttagtagagatgggattttaccatgttggccaggctggtctcaaactcctgacctcaagtgatctgcctgcctctgcctcccaaagtgctgggattacaggtgtgagccactgtgcgctgccaataaaatatttttgtacagctgtacaatatatctgtgttttcagctaagtgttattacaaaagtatcagaaagctaaaacaattctaaaaagtttataaagacagtcaaagtaagctaaggttaatttattattgaaggaagaaattttttatgaatttaatgtagcctaagtgtacagggtttacagagtctatagtaatatgcagcaatatcctagttcttcatgttcacatactacccactcaactggttcaaccagaacaacttcaagccttgcaatgtccattcatggtaagtgccctatacaggtgtaccatttttaatcttttatatcatttttaaaatcttttatatcatattttatatttcatatcatattttactgtaccttttctatatttagatatttctagatacatacttaccattgtgttacagttgcctacaatatttagtacagtaacatgctgtacagatttatagcctagaagcaatagattatactatgtagcgtaggaatatagtagactataccatttaggtttgtgcaggtacactctatgatgtttgcacaatgatgaaattgcctaacaatgcatttctcagaacatatccccattattaagtgatgcatgactgtaattgtttcctttgctttgtagatttttagtttgatgcaataccatttgtttatttttccttttattgcttgtgcttttggggtcatatacaagaaattgctgcccagaacaatgtcatggagctttccccctatgttttattctagtaattttatagtttcagatcttacatttaatccatttggggttgatttttctataagggatgagataagagttcattttctttcttctttatgtggatatccagttttctcaacgtcatttattaaagagactgtcctttctccaatttgtgtttttggtgcctttgtcaaaaatcaactgactgtagatgtatgggtttatttctgggctctctatcttattccattggttgatatgtctgtttttattccagtaccatgttgttttgattactgtagctttgttatatatattgacatctggtagtgtgacacctcctgctttgctccttttggtcaagatcgttttgactatttggggtcttttgtggttttatattaattttattattgttttttgtatttctgtgaagaatagcattttaattttgatagggatggcattgaatctgtggatcgctttgagtctttgtatacatgtttatggtatatttagttttttaggcctttaagaacttattttagcaatgttttatacatttcagtgtacctgttttattatttcttgtagtagtagtagtattagtagtagtattcgtagctttttgtagatttttcaagatttttaatatgcacaattatggtgtctttgaaaagagacagtcttacttctccctttcttccctatatgcttgttatttgttttccgtgccttgttaaactagctaggacctccaatataatattcaaaagaagcagtgagagcaaagcagtgagatcagacatcctcaacttgcttctattattagtgggaaggcattcagtctgttaccattaaatgtgatattatctcagtggttctcaatgagtgggggatcttcacccaccagaggacagttggcaatgtctggagacattctttgttgtcacaactgggggctgttattggttttttaatgagtagaagctcaccagagcccctcttccaggcctagagccccttcatgttttactaactctggcaccaaaactcaattgatcgcaaaaactgatgggaacgtatatgaaactacttatagtcttgatccaaccttaggatattcataagttttactgctaaatattaatttgttcaattacaaaatgttatgtaacttgtacagtatataaacctctctaaattctgattttcaaacagtatatagacataaggatttcaggatttcatttaagggtctatagagatgctgccaaacatcctacaattcacaggacacccactcacccagactctgcaacaagaaatcatctagcccaaaacgtccatagtgttgctgtggagaaactatgtactacctgtaggttttaagggatatcctttaccagattgaagaagctatctcttagtctgctaagagttttcatcagaaatggctatgaaatttatgtcagatggtttttcttctaattgtatacgcctttatactcatgtattctatgaatataaaaaataccttgatttatttattttaaatttttaattaaaaaagtttttgattttaatttttatgggtacatagtaggtatatttatgggatatgtgagatgttttgatacagacacacaatgcgtaataatgacatcatgtaaaatggggtatccgtcccctcaagcatttattctttgtgttacaaacaatccagttatactctcttagttattttatatgtacaattaaattattattgactatagtcatcctgttgtggtatcaaatactaggcattttctaactgttcttttttttttttttttttttttttacctattaaccatccccacctcctccctaccacaacctcactacccttcccagcctctggtaaccatccttctactctctatctccatgagttcaattgttttgatttttaggtccccaaaataagtgagaacatgcagtttgtctttctgtgcctgacttatttcacttaacataatgacttctagttccatccaccttgttgcaaatgacaagatctcattccttttatggctgaatagtactccattgtgtatatataccacattttctttatctattcatctgttgatggacacatggttgcttccaaatcttggctcttgtgaatagcgctacaaccaacatgggagtgaagatatctctttgatctacttatttcctttattttgtatattgcattagttggggttctcttagagggacagaacgaataggacaggaagcatacagcatgggagaaagatgtaggctgggaggctaggcccatctctcattttcatgtttttctgcctgctttatattcgctggcagctaattagattgtgcccaccagattaagggtggatctgccttccccagcccactgactcaaatgttaatctcttttggtgacaccctcagagacacgcctaggagcaatgctttgtatccttcagtcgaatcaagttgacaactcagttttaaccatcacaagtccaccccttgtcaacttgaacccatacacatctcctgggatcatacataatcttcaaataaagacaataataaggtcataattacgcctaacataatacagctatccttcatacaaccagaaacacaacaatccccaacccaaatactattacataaagttaacatacttaaatgctgatatgaagtcaataaatcgtacatcacatgataaaggagaaaggaaataaaatgaagatattagtacaagtgtgtacatgcacaaacatgtttttaacaaaagaaagaggaaaggccgggcgcggtggctcatgcctgtaatcccagcactttgggaggccgaggtgggtggatcacctgaggtcgggagttcgagaccagcctggccaacgtggagaaaaaccctgtctctactaaaaatataaaaatgagccgggtgtggtggtgcatgcctgtaaccccagctatttggaaagctgaggcaggagaatggcttgaacctgggaggcagaggttgcagtgagctgagatcgcgccactgcactccagcctgggcaacagagagagactttgtctcaaaaaaaaaaaaaaaaaaaagaagaaggagaaatactcatgacaattagtccccatttctgtagctggtcacatggttgtagctaatattgatgattaccttgttctactacctattctgtattccctttgccttcagcaagcagcttagcaggtcgtggttttttttcctggtggagtgacccaaaccttccttcctgaagggtctgggccatttgtagtcctatctggattgcattgttgtagtttcccattgaccttaatcacagagatggtaataccctaatggatctcctgtattccatgcatactctttcttacctccgttatggagtagtacactgaattcatcttgatagtatgggtcagtcaccccagccaacactgtaactcccttcttagcttgttgacttaaaggtaggaggggcccaaagtgtccaggtggcaatcttgacttacggtttaatggaattgttgttgtgtctcctggtggcagctttcctccctctggaactaagacctctaggccagtagaacgtaatgttgtgggaacaggaagcaaaaattttgctagtggatcactaggggtgatggtgagtgctgccacttccacttccaccccttgattcctggacctgtgaatcctggctatggagaaagagtaccatatattggatgctgattcagatcacacacagccttctggagaactttgcctcagctctgcaatgtattgtcacctagttggcattgtatttgtgacttcaaaaggccattccaccgttctatcaatccagctgcttcaggatgatggggaacatggaaagaccagtgaattccatgaccatgagcccactgccacactgctttagccaaaaagttagtgccttggtcaggggcaatgctgtgtggaataccatgatggtggataaggcatttcgtgagtccaaggatcgtagtcttggcagaagcattgcgtgcaggataggaaaacccatatctggagtaagtgtctgtttccagtgaggacaaacctctgccttttccatatggaagaggtccaatataatcaacctgccaccaggtagctggctggtcaccccgaggaatggtgccatatcgagtgctcatttttggtctctgctgctggcaaattgggcactcagcagaggctgtagccaggtcagcattgatgagtgcaagcccatgttgctgagcccatgcataacctccacccctgccaccatggccagggcccattggtgatgacaggggtggctggggaaagagactgagtggtgtccacagaatgggtcattctatccatttgattattaaaatcctcctctgttgaggtcacctgttggtgagcaatcacatgggatacaaatatcctcacagtttttgaccactcagagaggtccatccacatacctctttcccaaatttctttgtcaccaatttcccagtcatgctttttccaagtccctgaccatccagccaaagcattggctacagcccgtgaatcagtatacaatcgcacatctggccatttctccttccatgcaaagtgcacatccagatgcactgctcaaagttctgcccacttggaagatttcccttcactggtgtccttcagggatgtcctagaaagggaccgtagtgttgcagctgtccactttcgggtggtgcctgcatatcgtgcagaacgatctgtgagccaggccctggtcttctcttcctctgtcaactgatcataggaaactccccatgacaccatcattgcatgctggggaagagaagacagggtggcaggagtgaagaccatggtcatttgacccacttcctcacgtaacttacttgtaccttcaggacctgctcgagcccaatcacgtatataccacttccatttgatgatggattgctgctgtgcatgaccactttatggctagatgggtcagaaaagcacccagtttatgacaggcagtttaagttgcacagtggcttgatgacccatagtcaaatgttcagtttccgccaaagcccagtaacaggccaagagctgtctctcaaaaggagagtagttttttgcagaggatggcagggtcttggtccaaaatcctagaggcctctgccgttactcacctatgggggcctgccaaagggtccaaacagcatccctatctgccactgatagctcaagcacaattggatctgctggatcatatggcccaagtggtagagcagcttgcagggcagcctggacctgttgcagagccttctcgtgttccggaccccactcaaaactggcagcctttcgggtcactcgataaatgggcctgagtaactcacccaaatgaggaatgtgttggctccaaaatccaaataggcccactaggcgttgtgcctctttcttgattgtaggaggggccaaatgcagcaacttatccttcaccttggaaggaatatcttgacaggtcccacactactggacccctagaaattttactgaggtagaagttcctggaattttagtcggatttatttcctatcctctggcatgcaaatgtctcaccaataagtccaatgtgtttgctgtttcttgctcactgatccaatcagcataatgtcatcaacataatggaccaatgcaatatcttgcagaagtgaaaagcaatcaaggtctctctgaataagattatgacacaaagccagagagttgatatacccctgaggtaggacagtaaagctatattgctggctttgccagctgaaggcaaattgcttcgggtgggcctcatgcacaggaatggagaaaaaggcatttgccaagtcaatggctgcatactaggtaccaggagatgtgttaatttgctcaagcaatgaaacacacctggtacagcagatgcaattggagtaaccacttggttaagcttaccataatccactgtcattctccaagatccgtctgtcttctgcacaggccaaatgggagacttgaaaggggatgtggtaggaatcaccacccctgcatatttcaagtccttgatcttggcactaatctctgcaatctctccacggatacgatattgttgttgacttactatttttctaggtagaggctgctctaatggcttccatttggccttttccaccatagtagccctcaccttaccagtcagggatccaacgtgggggttctgccagctgccaagtatgtctatgccaattatgcattccagaactggggaaatgaccacaggatgagtctggggaccctctggaaccacagtaagttggacctgagctaaaactccattaattacctgactttcataagcccctactttaactggaggaccacaatgacattttgggtcccctggaatcaacatcagctcagagccagtgtccagtagtccccgaaatatctgaccatttccctctccccaatgcatagttaccatggtaaaaggtcagaggtctccttggggaaggatgggaaaaagattcactgcataaattgttggtaatgtagtggggtgcttcctcaaggggacccagcctccccttcattcaaggggttctgagtctgtaaactggctcaagtctggaaattgatggaggggttgcgattctctgtttttataattcaaattaggcttttgtctattcaacctagaagttttctctgtataatttaagtaggaatgaagtaggcttcctatcagtttcgcttctaggaacactgtgattgattagccaatgccagaactctacatgagtcagactatgctgattgctgcttcgcttttgctgtccattacggtaggtacacccaccttgcctttggcggttgagtaccaccacttggccgctgccacctcaggatccaattattcccatcgaatttaaattttgtagttgagtgactgcagttcccaccattagatctgacatacagagatgagcaattacagggctctttgaagatgcatgttctgccctcacaaatctatttcacaaggcattggtcaagggtatatcttctggaccctcccagctgggatgagtaggtctaaaatgactaatccactccaccatcccaatctccctaagcctttagatcccttcctctacataaaaccaagggagatcaggcatttccatcttgctcacagtgggccatcttttaatccatatttcagctaaccaagcatataaactgttagaaccatttttaactccccgagctgaaacactgaatgcagagtccctaagcagtgggcccaaatcaacaaattcagcctgatccaactctgtgttccttccaccattatcccatacccttaatatccattctcatgcctgttctccagattgctgttcttatataaatcacagaactaaaacagttcttttctagtgtagtgcacctcctcatgggtcacactctcaaactcacctctagtggccgctgggactttaatctaattataggtctagaagcaaatggaggtgttgggggtagcttctgaagagaatcaacattatcttgcctggcaattgcctcaggggaggccatcactgttgcttcaggcagtgtttatctccttagacaaaggtggaaaggctgatggcagcatgggtcagggaggggatgttgccactactggggatggggaagctattccttctggcaaaaaaggttcatcagagtttacaaactcagtgtccccagctttatcagggtctccccacacatccccattccaagttgcagggtcccattattttccaatcaatgccctcactttaacagtagccacctggagaggctgtgcatgcatctttcattgcaggccagtcactcacataagagcttgtgtatgtttttccacaattttagctctttctctacaagggcgaagactctcactcaggacaatcttagcagatttgaggctcagtatctccttctgaagccaggaggcagaatccctgagttccttattttctttcatcactttgtcctctgaacttaggagcaaccaactggcttcattatgttccttggttctccacataaggtcaaatgtattatgcatagagtcactaaattctttgccactcatgagtggtgaatcaagagtgtcaaatgcatttattttgcataattctctaaatagttcatgccaaagactatcattgttctccatactatttgaagtagagtccttagcattttggggtctaatcatattaagcagccaactccagaaacctccaaaagaactccatccttaatattctgttcctctagaaccactcctcgtaccagaatctgtattagtcaggattctcttaaagggacagaactaataggatatgtgtgtgtgtgtgtgtgtatgtgtgtgtgtgtgtgtgtgtgtgtatgtaaaggggagtttattacgtattaacgtacatgatcacaaggtcccacaatatgctgtctgcaacctgaggagcgaggagaaccagtctgaatcccaaaactgaagaatttggagtctgattttcaagggcaggaagcatccaggataggagaaaggtgtagactgggaagctaggccaatctctccttttcaggtttttctgcctgctttatattcgctggcagctgattagattgtgcccaccagattaagggtggatctaccactgactcaaatgttaatctcttttggcaataccctcacagacacacccaggatcaatgctttgtatccttcaatccaatcaagttgacactcagtattaaccatcaaagatgtctacctaggagtggaattgctagattatatggttgctctatcttgttttttgaggatcctccaaactgttttccatagtggttgtactaatttacattcccactgacaatgtacaagtgttcccttttctccacatcctttccagaatttgttattgcctgtcttcttgataaaagccattaactggggtaaggtgatatattattgtaggtttcatttgcatttctctgatgaacaatgtttagcactttttcatatatctgtttgccatttgtatgtcttcttttgggaaatgtctatttagatcttttgcctattttttattcagattattagactttatcttgttcagctgtttgagctccttatatattctggttattaatctcttgtcagatgggtaatttgcagttatttctttcagtctttgggttttctattcactttgctgatagtttttttgttttttgctgtgcagaagctttttaatttcaatatgtcaattgcattttcaactctagaatttctgcttgattcttttaaattatttcaatctctatgttaaatttatctgatagaattatgaattccttctctgtgtttgaattttttgagattcctcatcacatctattttgaattctctgtctgaatggtcacatatctccatttttctgggattggtctctggtgctttatttagtttggtgatgttttcctggatagtcatggtgcttgtagatgttcatctgtgtctgggcattgaatagttaggtagttattgttcacagtttgggcttgtttgtacctgtacttcttgggaaggctttccaggtattcaaaagcacctggctgttgtgatttaagccgtatctgcattagggaacatcccaagcccaatagtgctgtggttcttgcagactcgcagaggtaccaccttggcggtgttgcataagatccagaagaattctctggattaccaggcagagattcttgttctcttcccttatttgctcacaaacaaagggaatctctctgtggtgagccacctggggctggagatgtgttgacacaagcacccctgtggccaccacccctgggattgtgctgggtcagacctgaagctaggacagcactgtgtctcatccaaggctcaatgcaacgacttcttggctaccacctatgtttgtgcaaggccctagggctctatagttagcaggtggcgaatccaggcttgtgtccttcccttcagggcagcgggttcccccaggccccaagcaagtccagagatactgtcagggagctagggactggaattaaaaatctttgcactctacctggtgtgttctattttactctagcagatttgaccctcaatccatgaggcatagtctttcccactcttctctgcccttatcacaggcagaggagcctcacctcatggtcaccaccaccacaggcccacggggactactgccaggctaccatctatgttcacttaaggcccaagagctcttcattcaacttgtggtgaatgctgccaggcctgggcctcatgtttcagggcagtgggctccccattgtcccagggcaggtcccaaaatgctgtgcaaaagccaaggcctggaattgaggaccccaagagccctcttgttgttgtaccccactgtggcagagttggtacctaaagtgcaagccgaagtcccctttacttttccctctccttttcttaagcagaaggagactttcccaatagccaccacagctgggaatatattgagtcttacctgaagctagtgtatctcagtcttacccaaggcccatggtgtactacctgggtagctgggtattgctactggttatttagggctactggttatttagtctgcaggtgatggatcctgccaggacttggcccttctcttcaaaacagccagttcctttctggcctggggtgtgtctggaaatgtcacctggggattaggacatgtaatggagtcctcatgactctgactggagccctatcctactgtgtctgagctagtaccccagacacaggcaaaactcctctttactcttccctctcgtctcctcaagtggaaggaagggatctgtggtggacgagtgatctttgcagcctggggttgagggagcggtgacacaagcattcccttagctgcaccaactggtgtctcagtaagtcgtgtgcctccccacccccaaatccactgtctccaagcccagctcagcactgggacttgcagactttgtggcctagattttctttcaagtttatttaatgtcccagagcaatttagcctgcagtggtgagccttgctggaactcaagttctagtcacagggatgggtgatttcctctgactagggctggtttgaatgctcccactgtaggcgggtgtcagctgtgttcagccttgttttgctttctgctgtgacagggcagcattgaattcaatgcaacatctcactatcactgcagcctccttctcctaagcacatgtattctctctcagtccacatggctgctgccaatgggtggggaaggggtggtgtcagtgattcaagactcttttctaccctctccagtgcctccttcagtgatatgaagttaaaatcaggtactgtgagtgctcacctaatttttaggttttttttatgaagatggttttttgtgtagataattgttaaatttggtgttcagggcggggatgatcaatgcggccttttattctactatcttgctccacccccaattgattaagtttcaatttatttatttattcaaatagatttttgcggaacaggtggtgtttggttatatgaataagttctttagtggtaatttctgagattttggtgcacccatcacccgagcagtgtacactgtactcaatgtgcagtcttttatcccttacacccctcccaccctttcccatgagtccccaaagtccattgtatcattcttatgcctttgcgtcctcatagcttagctcccacttatgagtgagagcatacaatgtttgattttccattcctgagttacttcacttagaataatggtctccaactccatccaggttgctgccaaagccattatttcattcctttttatgactgagtagtattccatgctatttatataccatattttctttatccacccattgattcattgattgatgggtatttgggctggtttccatatttttgcaattgtgaattgtgctgctgtaaacacaagtgtgcaaggttttgttttgttttttctgtttgtttttgcttgtttgtttgtttgttttttgtataatgacttcttttcctctgggtagataaccagtagtgggattgctggaaagaatggtagatctacttttagttctttaagaaatctccacagtgttttccatagtggttgtaccagtttacattccccccagtagtgtagaagtgttcccttttcagctgggtgtggtggctcacgcctgtaatcccagcactttgggaggctgaggcaggtgatcaccggaggtcaggagttggagaccagcctgaccaacatggagaaaccccatctctactaaaaatacaaaattagctgggcgtggtggtgcatgcctgtaatcccaactactcaggaggctgaggcaagagaatcacttgaacccgggagatggaggttgcggtgagccgagattgtgccgttccacttcaacctgggcaataaaagcgaaactctgtctcaaaaaaaaaaaaaaaaagaagaaaagaagaagtgttcccttttcagcacattcacaccaacatctattatttttttatttttttttaattatggccattcttggggagtgagatggtatcacatggtggttttgatttacatttccctgatcattagtgatgtttatcattttttcatatgtttgttggccatttgccaactgatatgttttcaaaggcaaaataattaaatgagattgtttattccacttaaacgaattcaaaaataatgacttacaaagtagtaatataattccaccgcccatgtgtccaaaatgttgatttatttatgccagaatgttgtttctctgaccaaatattgtcttttggagctggaggatctccaaaagggaaagctcttatagctaatcaagaagtttcagtggggaaacttataataccatgaactaagcatcagcctgattagctactgattttgtgactgaaataaaatggtacctttcgttcttaccctgccccaaggtgttttttagacaggggaaattaggtgtaataatttcctctgaaaggtgagttatgctacttttgattatttttctttttacttctttgtattttttcctcttacatttatttttgattaggtaacacattcatgtggttcagaatttgaaatttacaatagagtgtacaattaaaggtctcacattctttgtgcccacccccacagttcttcccagaggcaaccagtgtttttacttttataaatattttatgcatacacaagcacaggcacttgcaaacatgtgcacacattcttccccccagttgtttttacacatttttctgtactatgctttagagcatttcatatcagtgcataaggagctatggctacatggtattatttgtttgtatagagatgacataatttatttaacaagtcccctattgagggatgtttaatttgttgcctgtcttttgctattgcatttctgcagtaagtaatcttgtaatacatcatttcagatgtgtgctatctgtagggtgaatttctagaaatggagctgttgggttggatagtatggacccttgtcattttggtagatattgccagaatgtcctctatagaagttgtgcccaatttacactcctaccagcaatgtataactgtgttttcctaaccctcaccaacacattgtattatcaaacattatatctttatgaatatgatatgtaaaaaatactatgtttttaatatgcatttctgttctgaataaggttgagcaccttttcatatatttaagatcctgtgatatttataaaaataatttccttttttataatggctggaatgctgcaggattgataggcacaatgtcttttctccttaacttatacctgcaggtatattcttttacacagcagtatgagagtgattccaaagagcatatttaggttaaataaataatccaggaacactttgtgttttaaaatttcggtagcattttataattcactcattatacaactaacatattatagttgacaaacaaatgaaccaacatcccctagtaactttaaatgatttaaattactcaagaaatttaactcagtggttttgttacttcttaatatacaccatactttataattttttcatattccaagaaaaatagaattatcctttatttaggaagttaccagtgtgttagaatttgcacggagttatcttaaattatggtctgtttacatttgcaatatgtatttgaaattttcttccttaatacctaagccacattgcaggaaggtgagaagttcagtgtatatttaaatgtgttgactgattcataaatggccccggactcttttgcatcacacaacaaatttttgtcagatctttgtctatggcactgtagatcacctctattatagcagctatcaaagtctgtcatgtattgtcattatttatttatgtgtctgcttttgtcactagattatgaacttctagaggatacaatttgtattcccctctagcactggtctggagctttgcatatatttcagacttataaaatgtttgttgaactgaattgaatcacatttatatagaggttctgaggttgccttttaaaaaacgtttttccacgtattgtttgcttttttaaatgtaaagtcttattttaataccgcccaagtttgctttctgctaatattattgaatttgtattgagaataattattcaaaatactcctgtaataatatcagtgaagaggcagatttttattgtgcatatttcctagctgttcatagttttaaccatcagagtcctgctttaattttagcctcaggcaattctaaatatttagtgagcaaagtgggaatattagacactttagtgcgggatgttatttgtttcatctcactaagattcccaatttatataggccatttgaaatgtgcaattaaagttctggtcattgctaatattaaggaatttagaaggttctatagcagagtaaacagctttacaaatgatagtggtgttttttaatttaaatttttattgagatatttgtggattcatatgtagctctaagaaataatatagagagatcccttatacactttatgcatttctccccagtggtaacatcttgcagaacagttgcctactatcataaccaggatactaatagtaatataatctgccactctatattcagatttcaccagttttacttgtgttcatgtgtatgtgtgttctgtacaattttattacctatatatgttcatgtttccaccaccacagttaaaatactaaacagttccaacatcgcatatattcagaagtatgctatctgtagggtgaatttctacaaatggagctgttgggttggatgtttgtacctttgtcattttgatagatattgccagaatgtcctctatcgaagttctatcagatttacactcctaccagcaatgtataactgtgtttgttttcctaaccctcaccaacacattgcgttatcaaacattgcccttttataaccaccccctgacccctatcatcctaaatcattgcagccactaatctgttctccacttctaaattttgtcatttaaaaatgttatttatttagaataatgtagtataaccttttatgattagccttttttatcattatcaagtattatgtactttgcataattgtatgtgctatactttttaatgagtatttttatgtaaatatttaaaaatttatcttattttaggtttgggggtacatgtgaaggtttgttacacaggtaaacacgtgtcatgggggtttgttttacatattattacatcacccatgaattaagcttagtacccaatagttatcttttctgctcctcttcatccttccaccctctgttctcaagtagaccccagtgtctgttgattccttcttggtgttcgtaagttcttataatttagctcccacttataagtgagaacatacagtatttggttttctgttcctgcattagtttgctaaggatgatagcttccagctccatctgtgttctcacaaaagacatgatcttgttctttattatggctgcataatattacatggtatatatgtaccacattttctttatccagtctgtcacggatggggatttaggttgatttcatgtctttgctattgtgaacagtgctgcagtgaacattcatgtgtgcacatgtctttatggtagaatactcatgaaagtgtcttggagctatttggacaaggaattttaggatcttgggtactcaaattatgatatggaaggggaaacacaggctttcagtggttctttcccttttgccccacagactcttcctctctgaaactgacagcagctgaggaatggctagagtggggtctgctacattggagagcatctcttgtccatgtcaaagtgtgacgcttcatttattaattgtttgctatgatttaactactaaatgctattttaatttttttggcttgaaaataagtcttaagatgtcatcaagcttgatgccagcaaatatggcagagtagggaaccctcaaaatttatctttttttacaattgcactaaataaactggcaaatactctcagaatcaactttactggcattatggaaactaatcaaaagtttacagcaaccagacaaatgcttaataataaaaaaagttgaatctcagtaggagagatttgtggcattttagcttacccttgtcccaccccctgctctctagcttggcagtggctctgaagacaacagtctacatttcactgtactagtccactgagtacaggttcttagtacctgagggagtagaagtaaccttattcttaaataagtgtgtttgttggttttgatctgtgttgtggatctgagggaccagttcagaaggcttgcctttattttgcctaactcagaacttttccaaggttgaggcagctatgggggtggaggagagatttgtgaaaacatttacaggcaaatgtattagctgctacttcctaggggtagggataaaggttggtcaaacagtaaactagctaaaaagcttgggaaaaaagtctgggaaatgagatgctttggagaattagagctttgaaaagcttcaacatattcctggtaatttcgaaggccatgtgcccccaaggctatgtggatgctcagaaaagacctgagaacgccctaagctttcacctctggcttatcttcagggtctcaactagcaggaatttaaggctaatgcagaatagtaaacttcctggctgagtgttgaaggtgtgcacatctgcaaagactgggaatttattgttgttgttgttccaggcgttttaggaaatttctgtttcaaatcactagatgctcactacgataatgaaacagatttcagtggccacacaacaaagaatacagactttacaaaattagtttagaaaaagtcactaaacaaacaaacaactactataataagcatcaataacaaaccctggagagggaagagaatctgattttcagatttgctgcatcataatattcaaaatgtcctatcttcataaaaatatgaaccatgcaaattaaaaagaaagtattacacataggaaagaagaaattactataattccccaaagaatcccctggctgtagtatgggagagtcattaatctgctatttagctaattgaacaagtaaaatggacaaatcgaatattgagcactactagaggatccccatttactagtaaaacatgcttttatagagatggatagctgttccaaaaatgtctggccatttttattgcattataaccttaagttaaattttagttttcattttatcttgtgatatatgatatatggaagctaactcatttcctatgagcaaatgaattgatgagttttgctcaactgcagaaaatcattgagtcttttataggattttttggtctctgactttagataaaatggtatgtatgaactctttcccaaatagtacctggatctgctatgtttctctttctaccaagcagatagcctaattctcaatgcctggctgtctcacttgtgtcttgtgctggatatttttatttgctgaatattatgttaagtacagttgactatcattttcatctttataaggaaatcattgtatagctatattaaaaaatgagtagtttttatactgttttaactatagacccttagtggttataaagacttagcaaagggccaaagagtttttaaaatgatatatttataagcaagtatagagaggaattcaataagtgagtctggcattgtgcatctgttttagagatttcattcattagaaaatagagaacaccatggggaaagactctcaattttattaactaagtatggtccatgcatatgaagcgacttcagtagaataagttcaaaggaaaaatgaatgatgtcaaagagaaaagtaataattttacttcataagttgccaactcaggtagttgtcatttaggaaatatactgggacagcctaaaggtaagttaacttttttcttaattaagccttctttgaagaagttaagtttagtgagtaagatgcttcttttttataatggtttttatttacatatctcatgttggtgaatcatgtgttagtagaaatcataagggaatagatatgctgctatttaacttcagttctgttttttcaaaaaaataataaattaatggataatgtagcttctcacttatacaggggttacagggacctaattcttggatctacatagccatcaactgtagtaccatatttctcttgagggagctccccaaatgaatgggagagttaaccagcatttatatggcttaccttgtatctcaaatctaaaaagaaaaaaaaaaaaaaacggatgtagctaatggtatcttttaaatgttctttgacatttaatcaattttcactcttaatggttctgtatatcttattttgctcggaaagggtcaaagccatgcctgaaagaccttaaaataaaatgttaaattttgactatgctttggtaactttgtttattttgatattgcctgatgcacagaaaatgataaaaatttccataagaaaatagattgcaactatttaagtctacaatacttttccttgtttttataaattaaaatttaaatacaattttaagtctattttttgacctaaacaattgtaatactgagttctttgtgtatttcttaagaatttctttgcaggtccaaacagatctagcattattgagactgaataaaagatgcttctttcaggtggcccctaatttaattgtttgtaatgattattctagaaaaaagcaccactctgacacatggattttcttgtaggtcagcattttataaaaagtatcctaacgacaaatggatgataggaagagcaaaagaggaaaaaatatccgtaagaaaagatgtaatacaattagtacaaggggcaggaggtaacaggaatttggttcttctttctatatttttttactttgagttcctcaaatattttatatgcaagaaaatatttcaagttttaacacatatgtcataccattttcttagtttgtattccatcatgccataagcatttactttcagaaggacttttggttttataaattaaaggcctgattttttttttttcagtgcacttctaagttagataacgcagagggaggtttatgtggaaatgatcgtttttctaagtgaatgttcaaacactgagtcactcacaagttcttaaaatcctatatgttttaagatatattagaggcagattctatactgaagaaatagtgcaaattttgcgcagttaacataaaatttagcatttttcatcctcccattatcttcagccccatgattttgtgtctttggggatgaatacttagactttcacttgatgcattcaggctctgggttagaaaaagatgcttaaagactgagtcatgaatattggaaaagaatatagtgggaggaatcactctacatgatattatgacctactatatagctgtagttaattaaaacagttgcagtagtagagaaggaatagacacatagatcaatatgatagaagggagaattaagaaatagacctttacaatatgcccagctattttttgacaaaggagcaaaagcaatttaatagaggaagaataactttttttttcaacaaatgattctggaacaattgagcatccatagacaaaaatatgaaccttgacctaagcctcacaccttacaaaaaagttaactcagaatggatcatgggtttaaatataaaaagaaaacaataaaacgtttagaaaaaaataaaatcatcacctagagctagatgaagaattcttagacgtaataccaaaagcctagttcatgaaataatcaaaatttaaaaatgtttattctgtgaaagtccttgttaaacagagaatgaaaacactagctataaacggagaaaatatttgcaaaacacatatccagtagaagattattatttagaatatatatttttaaaactcccaaaactgatcagttcaataaaacccccccaaatcccattagaaaatggacaaaagatatgatcatacatttcatgtaagaggatatacatggaaggaacattattgggaaattggtgacaaagaaatttggagaagagatgtgtgaatagacctccctgaatgggcaaaaaacatgaagataattgtgtctcatcaaagggcaacctcagcagaggaggattttaatagccaagtggataggatgacccgttctatggatatcagtcagtctctttcccaaccactcctgtcagtgcccaatgggctcatgagcaaaatggccatgatggcagggatggaaattatgcatgggttcagcatcctggacttccactcaccaagaccaaactggctatagccattgctggatgtccaatctgccagtagcagagaccaacactggtagcaacaccagatgaggcaacattgcctggagtgatcagccaactctctggtgggaggttgattacatcggaccccttctaccatggaagaggcagcgttttgtctttaatggaacagacaatcgggatatggatttgccttccctgctttgcagtgcttctcccaaaactgtccatgaatggcttcattttgttttttcctctccagtttctcaggatgtagctttagattattgaattgagacatttcttctaatgtatgcatttaatgtaataaatttccctctaagaacattttagctacacaccactcatttttgacatgttatgttttcgttttcattttaatttactcaaaacagtttttttcaataattttactttgactcatatgttaatacttggaagtgtcttgtttcatttgcaaacatttgaggatcttctcaatatcattctcttttttgatttctagttcaactctattatgatcagataatgtactttgtatgattgctattttttaaatttataatttttttatgtcccagaatatgttctatcttggtgtgtgttctatatacatttgagaagaatgtgcattctggctggatggaatattctatatcaaattggttgatagtattattcatatccttactgatttcttcatattttttctgttaattactgagagagaactgatgaagtcacaaaatatagttgtgtgtttgcgtttttttccttttatttctgacaggttctgcctcatgttttgaagctctgttagttgtatacacattcaaatattatgtcatcttggataatcgatccctttattgttatgtatgtttcctctttctcttggattatatttcttattctatagtgtcaaaaattaatatcactattacaactttgttttttgatagtcgtttctttttgaaaaaagctttattgacttgtgattcaccaatttaaaatgtataaatcaatgtttattagcatattcacagagctgtacaatcatactcacagtctaaattttgagcattttaatcactccatagagaaatcccataccctttaccagtaactctcccgtaatcccccaaatcttggcaaccactaacctactctctgtttctatagatttgcctattctggacatttcgtagaaattgaattatacattacgtggtattttgtgattagtttctttcacttagcagaatgtttacaaggttcagccatgttgtaacatgaatcagtattagattcattttcatcactgaatcacattacattgtatggatataccacattttggttatcggtttataagttgatggacattcaagttgtttcctcatttggctattagaaataatgctgctatgaatatttgtgtaaaagtttttgtatagatatatgtttttttaatcttgggtatatacctagaagtagatttccacgtgatgtggtaactctatgtgtaaacatttggggacctaacatcctgttttctaaagtgactgcatcattttctattttcaccagagagcctggtggggttcctggagaaggctgttagagagtgtgagttcctctatgtttgtgggccccagaagtttcacattatcttattagcccacacctggcctttagcaattagttgaaatgtctaattgaatcttcctacctgcttgtattctgtattgcattctatattgtcattcaatattcaattttcttataagtaaggaaatgctctggacctatttctctctggaggttttgggctgattctttgctgtgatctctattatctctgataggtccaagaaaaattgttactctgaaacctgcttgacttttttcttattgcaagtttaggagtaacatctttctagctctctacatcttcaagctaaaaaatgtcatttaataatgagtttacctgttttttatatattatggataccagttctttattatatgtacatttcacaaaagttttcttccagtttgttgctggcttattctttttcttaatgattttttgatgagcaggtgttttacattttaatgaatctagtttatcattctttcttttattatttgtgctttctgctgcctaacaaatatttttctatgccaaggtcacaaagctgtttcctgttgttttttctagaaactttaaagtattttatatttaagaacatctttgatcttgaagtaattttttgaatggtgtgaattagaggttgacgtttctgttttaaaatatgggtatactgttgtttcatcaaaatttattggagagatttcctttcccagtgaacttttatgttaccattttcaaagatcatttgactttatttgtctgtgtctaattttggactctccattttgtttgtttgacctgttcattcattaataccacactgtcttggtattgtatagtgagtgttaaaataaggtagagtaaatattaaatataaatattaaaacttccttcctcttttcaatattattttggatagtttatgttctttccatttctgtataaattatataatcactttgtcaatttttacaacaatatctctgatgattttgatgggtgttgtagtgaatctatgggcaaattttgggaagattgttaactgaagaatatttcatctccagtatatgagtctagcatatatttccatttacttgataggtatatatttactttacattacatttaatatttctcagcaatgtttttatcattttcatagcataggttttgcacatctttcactaattttatctctaagtaatttatgactttggatgccattgtaaatggtattagtataaaatttttcattttataatgataactgatttactaacttcagttttataatcacttttatactgtgagtatacaaaatttacttgtttaaattttatggctttttaaagattacttagaagtttctacaattaataatcacattatcttcaaataagagatgattttgctcttcccttttcaattattttgcatttttccttatctaattgcggtggatgagctcaatggcaaatgctaaataaaagtgatgagataagatatttttgtctgtttcccaagcataaggaggaaaaacttcagtatttcactattaagtattatgcaatatgtatgtattttacatgcacatcatcagattgaagaagttccctctatttttagtttggtgacaatttttatcatgaatggatattgaattttgttcaatgatcatataattttacccctttaatttgttaatgagtaagttttatttgttgatttttattgttaagccaatcttgcattttggggattaaattctatttgagcaagatgtagtatccttttaatatgttgttgtattctatttagtaatattctattaaatatttttggatctgtgttcttgagagatatttgtgtataattacattttcttgtaattcatttatctggttttcatatcagtgtaatataggcctcctaaatgagtttgaatgtgcttcctcttccttcattttccaaaaatgcatttgtagtattggtatttttctcttaaatatttgattgaattaactaatgaagctgtcttggcctagatttttctttgtgcaacagtacaattttgtattgtgtttatttaattaacgttttatcatgggcacttttctatttcattaaatatttttcaaaaccaagatttttcagttacataatactcatttgaataaatatactgtaatatatgtaactagtcccctacataactgttactttttttctcaaacatacgtctgtgtgtatgtgtgtatttgtatacaaacatatgtatacgtttatatataatatgaagtatgcataatatagtatattgcatacatagtatacatacataataaatacatgtatgtataaaaatgtacatatgcatgcccacacacatagacccactaagagaggcagacagactgatggactctagaattagatatatcagtacattaacagagtttaactttggatgttgggagtttgggcactttttactttctttcacagttttcagtattcctattcttttcagaccaagagtgttactctataattagaaagtaaatacctgaactgttttcattcttgagaattaaaaaatggataatttcttaagctagcacaggcaggtagggaaattaccaaaatactgcgtggtaattaaaattatagcaatgttcatgtttgtgatccccaaccacccaagagcggaacattaaatgatgtcggaggaggtgcagtctttcaggctcccatgagaattgccaaatggggcacttatgctttttgggacgaggtccaggttttatttttttcttcttcaaaagtcttaaaataaatgaaaattgtcacagcaaaatgcattttccctttcatttagagcattgaaggctacgcaacgtcaggtgacactggaagaatttggcttgaatttttaaagttgcttgataggggaaagggagatgaaaattactttgaagaattatctagtcacatttggttaatgtgggcaatgatagaataaagtaaaaattttagacatgtaatccattgtgatggctccagtttttcaggacaattaagaaatagcctctattgctcaaagtctcaagaaatactggaaaaaaatgcatggatactttattgggtgcttgttaaattattaaataggtgacaacttaggggtgctggctaaactttttaacttcttgtttggccttgtacagtttataaattttagaagtaacactgagaggacagaaaatatctagaagactttttaaaggtgcatacatatatatacacacatgcatttcagaccaacgagtgagggatgagtatggcaggaggagtggggacagaggaccgaagaagaatgagaggatgttgggaggtggagagagagataagaaacaaaataattagagaaaaattaaaaggtgtatttattaggtatagggtgaaaaaatttgcctaattcctgaatttggatgatttcagagtgttcttatctggttctgtacccaaaataatttattcttagggattctgtgagggattaaatgacactagagacaaacgatgaggcaatgagaaaattatgaagaaattaaggagaagagcaatatcttcttatttgctataattcataatacatggatgtttgagaatcactattatctagtgtataaggctgacttgttcccattatttcctaatccataatgctgctccttttttaccccataatccttcccttaaaccacatgtgcatcatttctttcatctggaatggatgtcttgtgtttcaaaaatgttttaccttatcactcttattttcacttctgaactaaaggtacattgcttgtataaccccctttttgctgttttgataaggtactaaattgaataatgtacctttaggccagagagcagtatagggcaagttacttagtttgtgagagagcctaggcaaccgattgctgaacagctattatctccttgtgatttcatttcctttgctcattattaggcacactataagtattgtgatattttctttggaaaattttggtcctaatcagaaagccatctgctaacaattgtgctggaagtgaagcagcatgataaagttacctttagccatgatatagttgtgtcaatgacctttcagttacatattactattatataatttgtggggaacatttcatgtcttagtgctttttgtaatgtgggaatttggcagtttgaaaatgtatggaaagcactacagttattgactcttttttttggtcatccaagtttcattgggttcttcatgtttctttatttcccttagactatttgagaggtaggaaaccaagggagaaggaaatggactcttatggtggagcaaattgaagtatcacttctgcttttctttttttcttttaatccagatgtacagtaaacatagacaagagtatagactacagccaggttatagaacagataggtctcagtagtaggcagtatgttagctcagatatctgggtagtcaacatggttgagagtgtggtagctatcattcataggtgagttgagtgcaagagccagggtagctggtagcaggcaatatccagagatccaggtgaacattatagttctgacagtgggattggagttcatgttactatttttccacatcaggtatgctggaaggtaatagttttgttttgttttgttttgttttgttttgttttgtttttttggagatggagtttcgttcttgttgcccaggctgcagtgcaatggcgcaatctcggctcactgcaacctctgcctcccgggttcaagtgattctcctgcctcagcctcctgagtagctgggattacgggcatgcaccaccatgcccggctaattttgtatttttagtagagacggggtttttccatgttagtcaggctattctcgaactcccgacctcaggtgatctgcctgcctcggcctcccaaagtgctgggattacaggcatgagccaccgcgcccggctactggaaggtaatagttttttgtgtagtccgttgcctgaaatttaaaacattttttttcatttaaaaataaagacaggcttagaaaatcacacacacaatatatggtttaataaattattaccaagtaaatacctttgtaactaacacccaggtcaagaaataagaactatgctacccaccccaaaagctccttttgtggaccacatcctaatcccaacccagttgctccacagaaataaacattgtcttgactttctttggactttttatggttttatcacccaaattcgcgttcctaggtattactgttttattcttgttcatttagaaaactttgatatgttttttaaatatctcttaaatgtgtgggttttccctctatcccttacttttctttacaattaatatttcgaagaacctatgccatctgacttacagagcatctcaccttttggattcttctgactgcaaattcaaggtgcagtttaacatttttttctgccatttatattttctacatattggcagctggatccagtggcttgatcagacttagttttgatctctggcaagattataagtggtgtctgacagtcatatatggggaagataatgggtactcgtctttctttttgtgatagtagtagctattggtgattaatgacaatattagttaactcagtttgaaaagtagtgatattcttggccaatatcatactgaatggggaaaagttgaaagcattcctcgtaagaacttgaacaagataaggatgcccaccacattcaccacttgtcttcaacatagtacttgaagtcctagtcagagcaattaagcaagagaaagaaataaagagcatccaaattggaaaggaggaagccaaactatctctcttagtcaatgatataatcttatacctagaaaaccctaaaggctcctccaaaagccttctaggcttgataaatgaattcagtaaagtctcaggttacaaaatcaatgtatacaaatcagtagcaccactatgcaccaacaacaatgaagctgagaatcaaatcaagaactcagtcccttttacaacagctacaaaaagtaaaacacctaggaatatatttaaccaaagaggtgaaagatctctacaaggataatgacaaaacactgatgaaagaaatcatagatgacaaaaacaatggttcatggattggaagagtcaatgttgtgaaaatgaccatactgtccaaagcaatctacagattcaatgcaatacctatcaaaataccaatgtcagttttcacagaattagaaaaaacaatcccaaaattcatatggaaccaaaaaggagcctgcatagccaaagcaatcctaaaccaaaagaacaaatctggaggcatcacactacctgacttcaaattatactataaggctacagtaatccaaacagtatggactggtacaaaagtaggcacataacaaattgaaaagaatagagaactgagaaataaagccaaatacaaccaaccgatcttctatgaagcagacaaaaatatacaatggagaaggactccctattcaatatatggtgctgggaaaattggatatctgcatgtagaagaatgaaactggatccttaagtctcaccatatacaaaaattaactcaagatagattaaagacttaaatttaagacctgaaactatacaattttagaagaaaacataggaaaaactcttctggacattgacctaggcaaataatttatgactcagaccccaaaagcaaatgtaacaaaaacaaaaataaataaatgggacctatttaaattacaagcttctgcataggaaaaaaataatcaacagagtgaacagacaacctacagaatgggagaaaatatttgtaaactatgcatctgataaaagactaatagccacaatctacaaggaactgaaacaaatcagcaagaaaaaatcaaataatcccatcaaaatgtgggcaaatgacatgaatagacatttctgtcttcaaaagaaggcatgcaaatggccaagaaacatggaatcatgctcaatatcactaatcatcaatgtaaatgcaaattaaaaccacaatgaagtgccaccttaccccagctagaatagccagtattaaaaagtcaaagaacaatacatgttggcatggatgtagtgaaaagggaacacttctacactgctggtgagaatataaattagtacaacctctatggaaaacagtagggagatttctcaaagaactcaaagtagacctaccattcaatccagcaatcccactactgggtatctgtctaaaggaaaataagttattgtatgaaaaagacatgtgcatgcatatgtttattgcagcacaattcaaagatatggaaccaacctaagtgcccatcaaccaaggagtagataaagaaaatgtggtatatatgcatcatggaatgctactcaaccacaaaaaaggaatggaataatgtcttttgcagcaacttggatgaaactggaggccattattttaagtgatgtaattcaggaatggaaaataaaatactgtatattcccacttgtaagtgggagttaagctatgggtacagaaaagcatacagagttgtataatggactttggacactcagaagtgaggagtcggtgagggataaaaaaaaaaaactacatactcagtacagtgtacattatttgggtgttggagtacactaaaatcccagactttgccactatacaattcatccatgtaaccaaaaaccacttgtacccctaaagctattgaaataaaaaaaaaactcaaagaaaagtagtgatattctaatgtaattttttttcatgtgttagttggtgttatggactgaattgtgtccctcaaaattcatatgttgaatctcaaaccccaaggtaactgtatatggagtaagaaagtaattaaggttaaatgaggtcataaaggtggaactctaatcaatattagtgtccttataaaaagagacaccagagagttcactcactccctgccatgtaaagacgcagcaggaaagcaggcatctgcaagccaggaagagacccctcaccagaaatcacaccttgccagaaccttgatctcacagccttgagaagagtgaaagaaataattttctgttgtttaagccactcagtctacaatattttgttttggtaggctgagttgactaatacagttggaatacttttaaaaagagatagtttcccccatccattatttggttatcaagtgatactgtttatattgaagagactataaatgtttgaggctttctctgtatgtacttaccagttttcaagaaaatgaactggttccccatcatcctcttaaagtgagtaattcttttctctttacaatatcattatgaactcttgaacttaaacatatttgatgggtttcaatccatttcaaatattgttgtcactgaagcacatattgtgtcatagttgactaatgggagtgtccacaagttggctcctgagtcctttaacaagactctagtctttaaaagctttcttattacctagtatgacacaatgtttctggttcattttatacattccttgcctcaaatttagaatcaggcattctacatatgtcacttgtttctattaattcataatggtatctcaataccacagtcttggtggaaaagatacttattgttacttctttgataattgttttttttcccactagccttttattctatcatctatctatctatctatctatctatctatctatctatctatctatctacctacctgtctataagacagtgttctccaacatttttggcaccagggacaggttttgtggaagacaatttttccacatactcaggggatgaggtggatgattccaggatgaaactgttccacctcagatcatcatgcattggattctcataaggagagtgcaacttagattcctcccatgtgcagttcacaatagggttcacattgcactcctatgagaatctaatgtcaatgatgatctgacaggagacagagttcaggtggtaatatttgctcgcccaccactcacctcctgctgtgtggcctggttcctaatggtacgatttggttccatagactggtacctgtccatggcccgggggttggggactcctaagagataggtctgactctgtgcctaggctacactgcactggggcagtcatggctgactgcagccttgatctcctgggctcaagcaatcctcctgcctcagcctcctgagtagctgggattacaggtgcaagccaccacacctggtggtcattgtttatacatcttttcagtggagagagctaagaaatataaaaataaattcacatacaccctcccaagactgaaccaggaagaaatggattccctgaacaaaccaataacaagctccaaagttgaatcagtaataaatagcctaccaacaaaaaaaagcccaggaccaggtggattcacagccgaattctaccagatgtacaaagaagggatgacactgttcctactgaaactattccaaaaatttgaggaggagggactccttcccaactcattctatgaggccagcattatcctgataccaaaacctggcagaaacacaacaacaacaacaaaaaaaaaaaaaagaaaaaaaaaaaaagaaaacttcaggccaatgtccctgaacatcagtgcaaaaatcctcaacaatatagttgcacacaaaatctagcagcacaacaaaaagctaatccactgcaatcaagtaggcttcatccctgggatgcaaggttggttcaacatacacaaatcaagaaatgtgattcatcatgtaaacacaactaaagacaagtccacatgatgatctcaatagataatgcagaaaaggctttttataaaactcaacattccggccgggcatggtggctcacgcctgtagtctcagcactttgggaggcagaggtgggtggatcacaaggtcaggagatcaagaccatcctggctaacatggtgaaaccctgtctctactgaaaatacaaaacattagctgggcatggcagcatgcacctgtagtcccagctgctggggaggctgaggcaggagaatggcgtgaacctgggaggtagagcttgcagtgagcctagatcacaccactgcattccagcctgggcgacagagcgagactccatctcaaaataaacaaataaccaaaaactcaacattccttcatgttgaaaactttcaataaactaggtattgaaggaacatgcctcaaaataataagagctctctgtgacaaacccacagccaacctcatactgaatgggcaaaatctggaagcattctccttgaaaaccagcacaaggcaaggatgctctctctcgccacttctattcaacatagtactggaagtcctggccagagcagtcaggcaagagaaagaaataaagggcatccaaacaggaagagaggaagtcaaactattcctgtttgtagacgatatgattctatatctagaaaaccccagagtcttggcccagaagctccttcagctgataaacaactttggcaaagtttccagatacaaaatcaatgcagaaaatcactaccattcccatacaccaacaacagccacaccaagagccgaatcaggaaggcagtctcattcacaattgccacaaaaaggatgaaatacctgctaatacagctaaccagggaggagaaatatctctacaatgataattacaaaacacttctcaaagcagtcagagaagacacaaacaaatggaaaaacattccatgctcatggataggaaaaatcaatatcattaaaacggccacactgcccaatgcaatttacagattcagtgctattcctatcagactaccagtgacattcttcgcagaactagaaaaaactagttttaaattcatgtaggaccaaaaaaaaaaaaaaaaaaaaaaaagacaagaaagagcctgcatagccaaggtaatcctaagcaaaaagaacaaagctggaggcatcacatcacccaacttcaaactacactacagggctacagtaaccaaaacagcatggtactggtataaaaaacaggcacatagaccaatggaacataatagcccataaataaggcttcactctgcaaccatctgattttagacaaatatgacaaaagcaagcaatggggaaaagactttatattcaataaatggtgctgggataaccagctagccataagcagaagattgaaattggaccccttccttacatcacatacaaaaatcaactcaaaatgtattaaacaattaaatgtaaaactcaaaactgtaaaaaccctagaagacgatctaggcaataccaatctggacatgggcatgggcaaagatttcatgacaaagacaccaaaagcaattgcaacaaaagcaaaaattggcaatgcgatctaattaaacataagagattctgcacagcaaagagcaaaagaaactatcaacagactaaaaagacaacctacagaatgggagaaaatagcttgcagactatgcatctgacaatggtctaatatccagcatctatgttctcagttataagtgggagctaaatgatgagaacacatggacacatagagtggaacaacacacaatggggtctttcagagagtggagggtgggaagagggagaggatcaggaaaaataactaatgggtactaggcttaatatctgcgtaattaaataatttgtacaacaaacccccatggcacagttcacctatgtaagtaacctgaacttgtacccctgaactaaaaagttaaaacaaatttaaaaaacaaatttacaagagaaaaaccaacaacctcattaataagtggccaaaggacataaacagacacttttcaaagaagacaaaacatgcggccaacacacatgaaaaaatgctcaatgtcactgatcattagagaaatgcaaataaaaaccacagtgagataccatcttacaccagtcagaatggctgttttttaaaagtcaaaaataacagatgctgttgaagatgtggaggcaaaggagcacttatacactgttggtgggtctgtaaagtagttcaaccattgtggaaagcagtatggcaattcctcaaagagctaaaaacagaactaccattgcacccagcaatcccattactgggtatatacccagaggaatataaagcattctgccataaagaaacatgcacacaaatgttcattgtcacactagtcacaatagcaaagacatggaatcaacctaaatgcccatcagtgacagattacataaagaaaatgtggtacatttacaccatggaatactatgcaggcataaaaaagaatgatctcatgtattttgtgggaacagagatggagctggaggttattatccttagcaaactaatgccagaacagaataccaaatgctgcatgttcttacttgtaagtgggagctaaatgatgagaactcatgaacacagaaggaaataatagacactgtggcctatgtgagggtggaggctgggaggagggagaagagcagataaaataaatattggatactaggcttactacctgggtgatgaaataatctgtacaacaaacccccgtgacaagactttaccaatataacaagcctgcacatttaccccagcacctaaaataaaagttaaaataataataatttaaaaagtactttgtaatcttaaaaaattaacacacataaaaccttatgagtttatactgatacttgcaattcaaatgcagtgccatatatatagacttctggttaactttttttttcctgttccatcctttgtctttcccaccaagaattgtgctttttaaggccagaagggatgacagaattagaataccctgaaagtattcatttatcttatttcacaatagaaatacagcagcctcagaataacaatacgaatactaccaccatagtcggatgaatattaaataaaagcaggaaaggaattagaacagagagaaaaggggaggaaggaataatagataccattctattgaaggtttggtggctattggtagttttcctcattctcatattttgcctttgtgataccttgtctcccaaagttttatgaaacattcatgtgtttttggttttgctttagttcctctatttttactgtctatgtacttttcatacaactttttgtttattttttaaattttattttttaattgacaataattgcacatattcatggggtgcatagtgatgtttcaaaacatattatgtgtagtgatcagatttggtaactagcatatctatcatctcatacctttattatttcttcatgtggtgaatatacaatatcttccttctagctatttgaaactatatattattgttcaaaactacaaagaagtttaaagaatagtacaatgaacccttgtatacttttcacccagattcaccaatttttaatattgtgtcactacatttataaatatataattctttctttctacttaatattttaatatgagaaattttaagcataaagttgaaagagttttacagtggccactcctgtagctgctgcctggattttactgttaaattttgctatagttttatcagtgtcagtttatccattccattatctatatattaatacatattgatgcattcagaaataaattgcagaaagacattcatgatcatgcatcagaaaaattaatattgttaatatgactgtacttccccaaattgatctaagcattcagtgcagtcttccttaaagtctcagctggtttctttgcagaaatatgagaagctgacctaaaattcatatcgtatggaaatgtaagagatccggaatagtcaaaacagtcttgaaaaagaacaaagttggaagactcttccaagatttcaaaattcactagtaagttacagtaatcaagactgtttggtgctgacataaggatagacataaatcaatggagtagagttgaaagctcagaaaaaaactctcacctttatagtcaattgtttttcaacaaggatgccaagacagttggaggaaagaaaatattcttcaacaaatggtgctgggaaaactgaatatcaggtgcaaaagaataaagttggacctatattacctaccttatgccaaatttaattcaaaaaggattttttatatgcaatgtacaaaataggcaaatctatagagacagaaactagattggtggttgcctaggactgggtgggggatgtggttggaagaaaatttgaagtgactcattggtatggggtttctttttgggatgataaaaatgttctaaaattgattgtggtaatggttgcataactctgtgaatatactgaaaaccattgacctgtacggaagtcatagcccaataagctgttagagaaaaacaattgcagaaaccaatacactttctcctaaatggttcaacatttatattaataactagggttcaatattggtttatgcattttagttttgatataaaaattccataagatgaaatgcagaaatcttaagtgaacattcactgagttttgacaatacatacatctgtgtaatccattccccatcatgttatagaacattaacatcaccgttggaagttccctcctgtcatccttctagtgagttttctcctatgtaccacctaaggcatactttgatctgattgttttccagcacggaattatccacctgatttagtattttacataaaatgcataatttaataggtacttttttatgtaagactttcactcagtatgctattaatgagattaatccatattgttgcatttctttagtgactgagtcatattccattgtatgaatataccaatgaagatttatttttttttaattttttttattttttgaagttttaaagctgggcatccgggggagacatcacatgtcagtaggttccgtgatgccccacaagccgcaaaaccagcaagtttttattagggactttcaaaaggggagggagtgtacgaataggtgtgggtcacagagatcacgtacttcacaaggtaatagaatatcacaaggcaaatggaggcagagcaagatcacaggaccacaggacccgggcgaaattaaaattgctaatgaagtttcgggcaccattgtcattgataacatcttatcaggagacagggtttgagagcaaccggtctgaccaaaatttattaggcgagaatttcctcttcctaataagcctgggagcgctatgggagactggggtttatttcatccctacagtttcgaccatagaagacggccacacccaagggggccattttagagacccaccctcaggggtgcattcaccaatgaagatttattatcataatgatacttaggctcagtttagtttctgtatattgtgaataaaggtgcagtgaatatttttaagcaggctttgtgtgaacctatgttttaatttcttttggattaatagctgggagtggaattgttgagtcatagggaaggtgtatgcttagtttcatttaaaattgcctcagttcaggagaatggcgtgaacccaggaggcggagcttgcagtgagccgagatcgtgccaccgcactccagcctgggcgacagagcaagactctgtctcaaaaaaaaaaattgcctcagttttctcaaaatggttatatcattttatattcccatcaatcaagtatgacagttccagttgttctataattactccaatatttgatgtcagtcttttaaattttaaccattctagtggttttattgtagtatctcaatgtgcttttaatttgcatttccctgatgactagtgatgtcgagcccttttcatgtgcttattggacatttgtgtattttcttttgtgaggagtctgttaaaatcttgtgcctatatgtcaattgggttgtttgtatttttattgttgagctgtagtaattccttttatatcttggataccagttttttgtcagatgtatgtattgtgaatatcttctttcagtctctggcttgcttattcatattaataattgtatattttgatgagttatttatccactttttgtggtttttcctgtctttgccctgtccaaaaaatcctgcttaatctcaagtcatgttttgttttttatatgtttgtttataaaggttttttcctctgtgttcctgtaaaagttttgtaggtttttatgttttatgtttctaatccatgaccttttatgttttaatcgatgatctttctcaaataatttttgcacttagtaatgaagtagggattcaggctcatttttttccaatagggatatccagtattccagtaccatttttggaatatgttttttccctattggattgctttggcacctttgttgaaaatcaagtacactatctctattctgtttcattgatttatttgctgattcttaagatgataccacaccgtcttaattactgtacctttataataagtctggaagtcaagtttgtggccaacccacatcccaagattatgcagaagatctaataaagaaaagcaagcttttaactaaattataatcaatgccttcatctttataatatgaataatgattcacttggagcattttcagcttgtttatctgaaccattaaagtcattttaaagtcagtttaaagtcattaccatttcctgggaaaattgctctaataatttgtataatttgaagcataatccttaggaatatttagacctagcattaggtaatgtttcctggaactcttggtcaaacttgggctttcaggaccactgcactagttttgcactgctcagctccagggaaccatttacactggcatagttgctagaaaggtaaataaaagcaagaaagaagttagaacagagtggaaagaagttagaacagagtggaaagatgaggaaagagataaaagaaatatttgtggtataacgtggtaggtcgtcatgtgtctggtatcttttagatagactagtaaggttagtttcaatcacttattttaattgtatcaaaaaagtaaagcagataaaagtagagctttctggctaaagtatatgtgtataagatcaccgcagatcatccccttcacacctcctcttttatcacccacagtccctaaagctgaaatccagcatatagtaaggttgttacattgcatattgcagtttggacatttataaattatggaggcaaaaaagtggtgtgcttttttgccaaagtggaaactatgtgtttataattctttgagcttttttgacactaaagcagttgtctcatgggtatagcatctccaatcaatttcgaccattgggaatcctgtgtataagatagatttatgtaagaacattatatatattgaggttgctaacatgtgtctagttaaaaatgtaatgaataaactacaattttatatatacacttacatagttttttatttctccatttgttccagtttctttccatgttctgttaactaatagatgctcaaaaagttaattatcagcatgattgcctcaatcagaaactatgactttttcctaacttaggaagagagagaatagttgcttggataatagttttctactgttgtggttagtcctgaggcctccatcttggcaggaataatttatgctaataagaaataggttgatgataaatatcaagtataacctcatgtcaacaagaggcgaagcagcaaattgccaggttgttgctatttttattaagatcaaagctcattggttgacgatatgcatataagacatatcctggactctttctgcctgtaaagaattctgcacctccatcttccagacctgtttattaaatctctttctcacccatgcttccactgatttctgtaagatggagctaattaaaggacagttttttttttgtcatgacaagagcataaagtgacagtagattttgagtagtatataaatggaagctgctttggaaataattgctatatttgagtgacgagtattgagaaaacactactagctttaatatttgaggaagtcatatgttttctaaatattaatcactagcctgttgcatagaactggagcttttgaatttgggaaggtctgtggtggcagtggtacattttttcccaccattggtatctgattttatgtaatcagtgtttgataataaaaaacattattaagactgcatttttttttctgttggttacaaatgaaacagccagaactgtagcattccttgtttttgtgatcctactaaactatggttttcctgatttctgctcatgttggaaaataccatgggaactttcatgcagaacacttgccttactgaaaatggtagcagagcttcttctttgctgcctgtgaagtaaagatcatattagctctttctattgtgagttccagatgctttgatgatcagccagtaattgtgttagaaatgcacaggaaatggttgatccacttggtgtaaaggcaaaaaccaatttcttcttactgcctgtcagcaggcaacagggaggcctatggcatgttagtgcatttttacactggcatagagccctggagttagacttactgagtcttaaatgcacttcgaacacaggttttgactgcttcataggagacattccagacatatttatgctcagcacaactctgaagtttttattcttattatcatggtactgtggtctttttgtttgcttcttttatctgtgatgttagtacttttccaaggccaagttaaaacaaataactacagttaagttcaacttgtgttaatctgtttacatttatggaacagctttgctgcaatctggagaaagataatgaaacacaggatacgtctgtacatgcctggtagaatggaaagctgcagtactgtcaataggccatcaataaagatattcttaccataaaattaaggttcatcttatttcccagttttctttttacagtaaggctatatctgttgattaactcatttatctggaagtaaatcattctaaatgatactggacattttcataacatccagaaataaattctagcttaaaatctgatgattttattatgttactcatgttttttacttcaccattctcgaccactaatttttagttggaagtcttggataatttcttccagtgaaattagttagtaatggaaggaatgtggcatttgaaagcaaaagatggagttcaagtgttagcctacggtgctattctaatctaaatattcatttaagccttctaaacctcagtttctatatctgaaaacataggtaaatattcctgcatacatcagagcattattactgagaggaccagataagtatatgtcatattatttataaattgcaaagaaatatacaaatgttcatcatcatttttgttgtttgcaatgcttttaactcaagcttcttaacacatcaatcccatgtatataattccttatgtgccaggttagatataataatataacttgagaatgtatatttcattttatttttgaaaatatacgtatcttaagattttcttcccaaggtttcatattataaatgaataacaatcatgactgcagaagaaatttaattataagcactgtccatctctccccattcccaaagtaaaataactgctttcagtttgaataggtaaattaaatgtttctctgctccttctattatagcttttaagaaacagtattaaatgattccttgagttgatttcactttaagattattttaatccattactcatttgagtttgcatcattgaattttctttatcaaggacgtaagcaggttaaatgtgtattggggaaatgtcttaaatgtcagtactatggtctggctgccttgtgagtacctcatcattggaggtgttaataaggtgtgactggatggctagaaatattttaggtggatatcatacatcatgtagagctgaagactggaaaactgctaattctatgctgtgatccttacttatgtttattttccaatttagatgattaacagatacaaatagttatttccttcaaacattgcttgtttcacttcaaaactttgggaatgcatgctacggaaaaatctacttcagtagcatgtgaaaaaatacatcttatttgccttaccatcagttttctaagcattttttttctcttttgaatactcataatattttatgtttgtcttataccatttatctcattctatctaataaatactaacttgtttatttctcttattgtccttattgggttttaaagttcttctggggagatatttaacaatctccgtataccccacatgagctatacagagccaacactatataaaataaagttatcaaatttcatttattgtcattagtgcctaaaacttggggaaaagttgctattgaataaaatagcgtacacttggtttctttcttatctgccagtcacagaatctactcttagcaaatgtcattctgatttagagtaattttctaatatagaaatctcatttacccaaataccattaaaattatctaataaggtaacgatttttaaaaggtcccatttcactatttccaaatggtatccaaaagtacttgtaaataaaaaatttaccctaagtgagctgtaggcatagcttccccatccaaaacataaagttatagaggctaatctcacgaacttttctgtggatttttaaggttaaactactggtaaagaagcaattggtaatttgttcagactggatgccagaatagctccgttgtctgttagctgatgtctttgaatctttgggctcactttttatcaatgtgagtttatgagaagccttaaactctggcatacttcaaagtctggtaactttttttaggcctctcacctcctttctgcaacctttcttaactctcacattagggggaaaaaacatatgggatctcaaaaaaactaagtaagcatattttattgtttatcttaaaaaatgcatttttttaaatcaaggaaaatcattaactacatcagtatcgatgaattacatgttgtagtcatcatattttaatgagtcttctctaatatttttagttctgagtttgtagaaagtggcagatgctgttctggttaaaaggctttccaactgattaacgtgttcatccctaatttaattttttaagaaagacacttatgacagcgagaagaaaacgtttcatcttcataggaaatctggcaaaatatcttggcttttgctcaaaatttgaaagcaaatgggaatcagtttcaaatattggaaaagtcaagaaaacgattctagctctggctctgtcattggctctctatttcttcatgtataaaatgatggaaatagattaatttctaatacctctttcaactccactaacattcttttattgatagcatttgttagggagaaataacaagatttgtttatggattgtgataggatatcaataagggggtataacaaagatacctaaaattttcatccttggactagtaaagaatggtcagtccacaaaaacaaaataggggttttgtgttaagggtagccaggtcgaagataacttctgttttgaaatgttaaaggaatatcttctacaagtttatgagactcatgggagtggccattgcatggtaatatggcatagtattatattgtttacatacaatttaaaaagtacaggtagtactgaaaaacatctgttcctgtcctcatcccttttgactcctagatcagtttttccagggcaaaagttgcaaataatttttgctttatcaacattttttattaacttcatgctatgatagatgatgtactctttgtgctacttcccttatccctcttccaccatctcctcccaatgtgttactgtttttaattaaatcaataagcaatgtttacattattttgaatatgtacatattataaatatgttgcttattgtattgtcaggtaatactctatggttctatttctttttatcttttccctatagtttctaattacatttcttttattcctgtaatacatttcttatactatttgggtttttcttaatgctccatgatatccactttcctcactttttccctgagagactacactgggaaccaaattgtcagtggtctttttttattttctgattttgtttatggtacataaaaatagaattcactttaacatattggtttcatatccagcaactttgctaaaattcattaattctaatttctttgtagattcttttgaattttctctgtatgcaatcatatcacctgtgaataacatttttgtttcttttttttaaacaaactttttcttttctttcaataatggctaggccctaggttaaatccaactttatcacattttatttaatatttttgcatctgtattcattggtaagattggcctgtaatttttctttcagactcagttctgtttaggtttgatataatggttatgctaggtttatctctcctcttctgttttctggaagagtttggttaggtttaatgctttttgttctagcttaattacattatggttagagatcatgttctgtacaaattccatccttcgagatttgtttagacaagccttaaggtccagtatatggttagtttttataaatatcccggatgtgcctgatataaatgtgtgtctttcatttcatgaggcattgtattatatatgtccattagaacacgtttcttagtcatgttcaaatctttctacatttttacagtttattttctttacatgttcaatcagccattagaggtctgtttaaaatctccgactctgattgtggatttgtttatttcaatttgtttatttcaatttattttaatatcttccttgggaaccaaaccttttatcattctgaagtggccttgtttcagcttttgcaacacttgtgcctcaaaatctactttgactgaaattaatacagctatactagcttcttttggttattatttgtgtatgacttttaaaatttttaattccaacctttctgtgtaactgtatgtttttgatatctctgatgaatggctcaaatgttgaaatttgcccctgtttttgcagtctgaaggtatttgtctctagaatgtttctcaatgtacttacctaactttttagtaaccagattttcaaaaaatttaaagacgatataatgaacaccattgtatattcatctagattcaacacttgttagtattttgccatatttgtttgtctcttgctttccagggtatctatgtgtgtgcatgtgtttaatgattatgtaagtatatgtgtgtttatacacattttgctaagccatttaaaagtaagttgcagaaatcagacactttatatgcataaatacctgagcatgcatcatgcctcacctaaggaaacataaacatgacataattatcaaacataagaaaatcaacagcaatcttaaagtgttatttaatattcaagtcataaacaaatttccctaatggtcctaaaaagtctttcatagctgttcatgtactgcatttatttattctcttacaaatttgaatatctagaatgcgttggaggaaaattttccgtggatctttcatgtctctgtacatcctgagaagagaggcattgtcattgttctgaactctcttttcaaggatctgttataatgaataactcggaaaattgagatagtatctcactttggaggaaaggccaggtttgtctaccttctagtacaataaagatattaaaaatatctctgggcaaagataaagcaagcttactgcccactataaaatatatggattccctaaacacccagtttttcttctataacctattgcactgcatgtgaaggcatcaccttgtctgctttacatcaccttgtgggaattggggctcgcggaaacccagggtattactgtaaataataaattagttgttgtctctgattaagaagtcttgtagcgtttgctggtgtctataaaactatggcaaggctaacttgttaactttcaagcatagaaaagtcttagtcccttcacggttcttgacagaatggtcttcccactttttacttcattgcactgattttttttaacagcttcattgagatataatttacataccatacattttacccatttaaagttctcagtaattttagaatatttacagtagggcaagcatcaccaaaatcaattttagattttttatcaacccaaaaagaaacctcatgtctcttagctgtcacgttccatggcagcccagccccccagccctaggaaaccatcaatctacttgtcactataggtttgtctattctgaacatttcatagaagtaaaatcatgcaacgtgtggtattttttgtctggcttctttcacttagcataatgttttcaaggttcatccatgctgtagcataaatcggtacttcattcctctttattgccaaataatattatattgtatgcatatactacattttgtttttcagttcattttttcatggacatttaggttgttttatacttttttgactcttataaataatgatgctatgaacattcatgtacagatttttgcatagacatgtttctgttttatacctaagagtggaattgctggatcacgtttactttgtttaggaactgcccgacttttataaagtggttactccattttgcattcccactagcaatgtaggagagtttcagtttctccacatcctcaataatacctgttattgtctgtcttgattatagctatctagtgtgcgtgaagtggtatttcattgtggttttgattttcttttcatttccctgattattaacgatgttgagcatatatttatgtacaataagcccataaaaagatatatatatattttgaaaaatgtctattcaaatcttttgcccattataaattgtattatttgctttctagtacattataagaattctttatatattcttgatatgattctcctgtaaggtatatgattggcaaatacattttcccattctgtaggttgtcttttcactttcttggtagtgtcctttgaagctcaaacttttacaattttgataaaattgtttttaactttttttgttacttgtactgttgctataatatctaagaaggctttgactaaacaaaggtaaaaaaaaaattactttttttttttttttgagacagagtcttgctctgtcacccatgctggagttcactggctcaatcttggctcactgcaacctccgcctcccgggttcaagtgattctcctgcctcagcctcctgagtagctggaattacaggtgcgcgtgccaccatgccctaatttttgtatttttagtagagatggggtttcaccatgttggccaggctggtcttgaactcctgacctcaggtgacctgccttcctcagcctcccaaagtgctgggattacaggcatgagccaccctccccggcccaagaatatttagctctgtgttttcttctaagagttttatagttttagttcttgtgtttaatctttgatctgttttaagttaatttctatgtatagtgtgtagaagaggtccaagtttattcatttgcatataggtatccagttgttccagcagtgtttgttgtaatactattccttccctcagtgaatgtccttggcacctttgtcaaaaatctattcaccatagatgtatgggtttatttttgtaatctcaattctgtcccattgatctacacgtctgtccttttgccagtaccacactggtttgattattgtaggtttgtagcaaattttgaaattggaaagtgtaaatccttcagctttgttctttaaatattattttggcctttggggttccttgcaattccctatgaatttcatgtcagttttatgatcagcttttccatttctgcaaagagggcggttggaatttttataaggattgccttgaaggtgcagaaaaatgtagggagcattatcatcttagcaatattaagtcttctgatccatgaacatgggataattttttatttagttaggttttctctaaattctgtcaacaatgatttgtagtttttcagagtaaaaatttttcatttcttaagtttattcctaagaattttatcattttcatgcagttgtaaatggattttttcacttaactttatgctagtctataggaatacaattgatttttatatagtgatcttgtaccatgtgaccttgctaaattcatttatttgctctaataggattttctgtttacaagactgtgtcttatgcaaagagatagggctttacttccttctttttgatatggatggtttgtgatgtgattatttcacattgcatgcctgtatcaaaacatctcatataccccataaatacataaacctactatgtacccacaaaaaattaaaaatgaaaaaatttgcatagggattgttaatttccttgtgtaattgccctacatagaacctgtaggattatgtggaaaagaaatgacagagtggacattcttgtcttgttcctggtcttatagggaaatgatttagtcttttaccattaagtatagcgttagctgtgggttttttgtagatgcccttatcaagttgaggaatttccctgttattctgatcttaatagtaatgtcctctcttttatttctgattttaatttgagtcttctcttttcttggtggtttgacaatttttttgagcttttctgagaaccagcttttgatcttgttgattttccctattcattttttattgttcatttcattaatttcagctcaaatctttattatttccttctttctacttgttttggggttacttcgctctctttttctgatgttttacattgaaatgttagtttatgatttggcatcttttttaatataggcagttactgctgcaaatttatctctaatcactgctttaaatgagtcccatatgttttggtattgtgtggttttattttcactcacctcaaaatatttctaataaaccttgtcatttgttctttgacctataggttaattaaaagtgaaatatttcttttctttatacttgttgatatcctgtttatttctgttattgatttctaattttattccattgtggttggaaaacatgctttgtgtaattgcaatacttttaagtttattgatgtttgttttatggcctagcatatgatctatcctggagaatgttctatgcattcttgagaaaaaggtatattctactgtaattgggcagagtgttgaatagatgtgtcttaaatgcagttggtttatagtgttgttcaagtcctctatttccttgttgatcttctgtctctcactgttccactgattattaaaagtggagtattgaagtccccaactatttttgaattgtctatttcttactttgattcagccagtttttgtttcatgtatcttggtgttctgttgttagatgtatctgtgtttataattgacatggcatcctgtagaattgacccttttatcattataaaattcctctctctatctctagactttttttgttttagaatatattttatctgttattagcacatctactctagcttccttaaggttgctgttagcatgactgtatttttcaatccttgtagtttcaacctttttgtatgttttaatctaatgtgttctgtagctgccattggatcttgatttttttatgaagtctgccaatctctgatttttgtttggcttgtttaatccatgcacattcaatgttattattgatatagttggatttttgtccgtaatttcactttttgttttctatgtatctcatggttttttgttgttgttcttatgttcctcctttactgccttctttttttttattaagtgaatattttctagtttaatattgcagtttctttaatgattttatttaatgtatttttatttgtttttcttaatggttgcttaccacgtaaattataacctattagagtttacttaagatttatagagttctctattcttactgtcttctcttactctaggcaaaattgctgatactgttccagagctgggagcgggaacactgttccccttcttttggagtaacacacctgctttattagcagggcactaagcaggaagaatagcctttgatcttcctggcttgcctctttcagcatcatcttctgttctatgagcaagttagagtgagggcaaccagatcaaatactcctgggctgctgtgcctggctggagtagagcttttgccttatgagttagggctgtgtggaggacaagagtctaagaactctcagctactctcacttggaacagagcttctataacaggacacacacggtaggggaagatcagaaatgctgatgacttgttccttcctgtgagatactgtagtgcttaactgggagctgggaggagaaggagccctggtttatggatgcacctaccttgggtgaagcctttgtgaagctgagcaagggaggtggagaaggaaggagcaggtcataatgccatagatacctgttgtacatatcaagatttaacacatattgttgaacgtttgttcattggctgtatgttcgtaggacaatatccagatacttgagtttttaaaacataaatttccccacttatcattgttttgctagggagatggtccacagaggtcctcacactgccattcacaaagtcatctctcccatggcatggcattgactttttccctttccttttcctctttctttcttcctttctttctttctctttctttcttctttccttctttctttctttctctcgctctcccttccttccttccctccctccttcctttcctccctccctccctccctccctcctttctttctttctttctttctttctttctttctttctttctttctttctttctttctttctttcttctttctttctctttctttctttctttctttctttctttctttctttctttctttctttctttcttcctcctcctcctccttcttcttcttttcttttcttttcctttcctttcttctttttttttgacagggtcttgctctgttgcacatactggagtgcagtggaacaatcatggctcactgcagccttaatctcataggctcaagtgatcctccctcctcagtctcctgagtagctaagactacaggtgcatgtcaccatggctggttgatgtttaattttttttgtagagatagggatctcatcttgtgtcccaggctggatgtgaactcccaggctcaagtggtcctcccaccttggcctcccaaagtgctgggattacaggaatgagtcaccacacccagctggcattgactttttgaagagtccgtgctagttgttttttataatgtaccttattccaaatttgtcccatgttgtgtcgatttacacttaattacacttaatgtaattactgatatatttgttttatttgtcttgcattttaaggtatcactttctctgtctgcctctctttcgtcttcttttggatgtattaagtattgtgcccctcaattactttgggattaatactctatttatcttttttaaaggtttaccctagaagtgacaatttctaggttgtatatgtatcaaagtccaaagtaatcaatatccttaccagttttctatacaattacaaagaccttaagaatgctttaacttctttcaccctatctcacttacatcatattaccaatgtgtatttctttcaattctatattttaaatgccacagtatgaaagagatgcatgttgcctacccaccagcccaagctgaggctaccaaggcagccccactctttccagtggcagagtctcagcatggctgctaccacccctcacctgaacactccacctggatactgaatattaccctacccccacctaacagagctggtgcttgcactcaccattggggtcctgagcacaagccgcagagccgagcttctgctctgagagagaacacatagcctgaggtcctggggattatctaacccaatccaccaccgtgggccccagtcctcctgggggcctgaggttgggcctaaactcccaaccactaccacttcagctggtacctgcctgcaagcaccacatatgggcctggacatgggcctacccagcccattgcagctactatcaacgtcagtgcacactgctcaagacccagacaattgtccgtccactgctactgccatcacccacaccatgccagctgcccagggactgaagaacctgctcacccacctggtccactgctggcattatcagcatccaagcaagacacctggaggcctaagaataggcccactgacaacagccaacaccagtgccagtgtaaaatgctctagggcacaaagatatgcatgctcagcccactggtgccaccaccgcagccttaagactagcacacctgttgttccagtccccagcacaacttcaccacagccttcactaataaccataccctaacacaccaaggaaaccataaacaccactaatgctgtttacagccaaagaaatcacacagagactatagcactatgaacagaatcaaagtcaaagtaccatacacagccaatatcttagatacatcttcagaaaaatatccttccctatgaaagtaaattcaaaaataggaagaaatgattgttacaccagatgcacagttaccaacacaaggacacaagaaatatgaaaaagcaaggaaatatgacacttgcaaaggaacacaataattctacaacaatagatcttaatcaaaaagacacttttgaaattccagagaaagaattcaaaatattgattttaaagaagctgggtgagatataagataattccgaaaaacaatacaaagaaatcaaaacacagttaaggataagaatgaacaatattactaaagagataagtatttttaaaaagaaccaaatagattaggtggaataaagaacctcaaaacttgaagtcagttctttttaaataaaccagtcaggtaggaataaagaaataagaattttaaaaagaatgagcgaagctttgtgtcatttgggacaacataaattgatcaaatcttaaaaattattgttagccccaaggatgaagagacaaagaaaggattagaaaacctatttaaagaataggtgaaaacttcccaagtctagtgagagatttacataatcagatacaggaggctcagtgatccctaggtagatataatgcaaagaaatcttctccatgacacattatagtcagaaagtctaaagtcaaatataaagagcaaatcctgaaaacagtaagagaaaagtgtctagtcacttctaaatgaaaccctatcaaattaacagtggattgctcagcagaaccttacaggccagaagagaaagggaataaatatattcgaagtgctgaaagaaaaaaattgccagccaagaatactacatccctcaaaattatccttcatcaatgaagaagaaataaaaaatctttcacagataagcaaatgctgagggaattctttatgactagactgaccctacaagaaatgctcaagtgagtcctaaacctggaagcaaaaggacaatatttaagatcatgaaagaacatgaaagtataaaactcacagataaaccagtcaatcaaagaaggaaaagaaaggactgaagcggtaacactatagcaatctaccaaacctcaaaaacaattaaaaagagaaaaagaaataaacaaagaatatataaaacaaccagaaaaccattaacaaaattacagaaacagagcttcacatattaataataaccttgaatgtaaatggattatattttccacttaaaatatattaaatggctgaatgaatttttaaaaaaacatgatgcaactatatgccatgtataagaaactcaccctaacagtaaagacacatatagactgaaagtaaagggatggcaaaagatattccatacaaatgggaaatagtagtaagcaggaatagctatacctatatcagataaaagagagtttaagtcaagaacagttaaaaaaaaaaggcagagaaggtcattatgtaatgataaatggaacaatccagcaagaagatacgacaactccaaatatatatgcaccccatactgtagcttccagattcataaagcaaatattccaaagagagaaatagatgacaatacaatcaaagtgggggtttcaacactccactctcagcatttagacacatcatctagacagaaaatcaacaaagaaacattgggtataaatagggcttcagacccaataaacctaacagacatttacaaaacatcctacccaacaactgcaggttatacatcctgcagttatacatggaccattctccaggatagatcatgtgttaggtcacaatataagtctcaacaaattttaaaaattgaaataatatcagttttcttttcagaccactttggaataaaactagaaatcaatacaaagaggaagattggaaactctgaaaatacatggaaattaaataacatgctcctgagtggccactgggtcaatgaagaaattatgatggaaatttaaaaatttatttgacaaatgggatctaattaaactaaagagcttctgcacagcaaaagaaactaccatcagagtgaacaggcaacctacaaaatgggagaaaattttcgcaacctactcatctgacaaagggctaatatacagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccattcgacccagccatcatcccattactaggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagctcatgtcctttgtggggacatggatgaaattggaaatcatcattctcagtaaactatctcaaggacaaaaaaccaagcaccacatgttctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtacacatatgtaactaacctgcacattgtgcacatgtaccctaaaacttaaagtataataataatgaaataaataaataaaaaataaaataaataaataaataaaaatttattgaaatgaaaatgtaaacacaacatacatattcagcaaaaatagtgctatgagagaagtttatagcaataaatgcctacattaaaaacgtagaaaaataaaaatttaacaatctagcaatgcacctcaaggaactagaaaagcaagaacaaaccaaatcgaaagttagcagaagaaaaaaaatagcaaagatcagagcagaactaaacagagactacaaaagcaaacataagggcccaacaaaatgtaaaactgcttctttgaaaagatacacaaaatttgtaaactgctagctagtctaaccaagaaaagacccaaataaaatcagaaatgaaaaaaagacactacaattgatatcacaaaaatacacaagatcatcagagattattatggacaactatacactgacacactggaaatcctagaagaaatggataaattcctggaaacatactacttaccaagattgaatcaggaagaaatagaaaacctgaacagaccaataatgagtagtgagattgaatcagtaataaaaattctccctacgaagaaaagcccaggaccagatggatacacagccaaattctaacaatcgtacaagacagaaataataccaatcctcctgaaactattccagaaaatccaagggtaggaaattctccctaattcattcctcgaggacagcatcaccctgatatgaaaatcagacaaggattcaaccaaaaaagaaaactgctggcaaatatccctggtgaagattgattgaaaaacaatttaaaaaatactagcaaatccaattcaacagtacgtcaaaaatataatacacatgggtccattgggattgaaggcaaggaaggcacaacctttgcaaatcaataaatgtgatacattacatcaacagattgaaggacaaaacaatatgaccatctcaatagatgcagaaaaggcatttgataaaatttaacatcccttcgtgattgaaactctcaacaaactaggcatagaaggaatataccgtagcataataaaggccatatacttcaaatccactgcaaacatcatattaaatgaagaaaagctgaaatcctttcctctaaaaactggaacaagacaaggatgttgactttcaccactcctattcaacatagtactggaggtcctattaagagcaatcaagcaagtgaaaaataaaaaaggcatccaaatgggaaaagaagcagtcaaattgcccctctttaccgatatatctatctagagaagcttaaagaatgaattcagtgaagttgcaggatacaaaatcaatgtacaagaatcagtagcctttctacacaccgataatgatctaaccaggaaagaaagaaagaaagcaattccatttacatttggtaaaataagtaaaatacataggaataaatttaaccaaggaggattgattctacaaggaaacctacaaaacactgttgaaagaaatgcaggtgatagaaacaaatggaaaaatattttatactcatggatcagaagaattaatattgttaaagtcatcgtattgcccaaaggaatctatacattcaacataatcgctatcaaaatgccaatgcaattttttcacagaattagaaaacaaatcctaaaatgtatatgaaaccaaaaaagagcctgaatagccaatgcaaccctgacctaaaaacaaagctggaggcatcacattacctgacttcaaaatatattacaaggctgtagtaacccaaactgcattatattgttatgaaaatatagaccaatggaacagaatagagaacccagaaataaagccacatcttcatagccaattgatcttcaacaaagctgacaagagcttacactggggaaaggtaatcctcttcattaaatggtgctggaaaaattggatagccacatgtagaagaatgaaactggacccgtatttctcaccatatacaaaaattaactcaggatggattaaagacttaaatcttcttttgcacaggaaaagaaactatcaacagagtaaacagacaacctacagaatgggagaaaatattcgtgaactgtgcatccaacaaaggtctaatatccagaatctacaaggaacttaagcaattcaacaagctaaaattttatgtaaatataagacctgaaaatataaaactactagaagaaattccaggggaaaactctcctggacattggtctaggcaaagaatttgactaagacctcaaaagcacaggcaacaaaaacaaaaatagccaaatggggctatattaaataaaaagcttctgaacagcaaacgaagcaatcaacagagggaataaacaacttgttgaatgggagacaatttttgcaaagtatttatctgacaggggactaatattgagaatacaaaaggaactcaaacaacaggaaaaaacaaacaaaacaaaataaaactccaattaatcccgtttaaagtaagcaaaagacctgaatagacatttctcataaaaaagacatacaaatggtatatgtaaaatgctcaacatcgctaatcatcagagaaatgcagatgaaaaccacaatgagatatcatcttatcccagtcaaaatggctattaataaaaagacaaaaaacaacagatgttggcaaggataaaaaaaataagggaactcttatatgctgttgtgaacataatctagtacagccaccagaaaactgtatggatatttaaaagaaagagagaaagagaaagagagagagagaaagagaaagaaagaaagaaagaaactaaacatagcatcaccatacaacccagcaattccactactaggtatctatccaaaggtaaagaaatcaatatatcaaagaaatacctacacttgcctgtttattgcagcagtattcataatcacaaagatatgcaattaacctaagtgtgtatcaacaggtgaatggataaagaaaatgtggtacatatacagaatggaatactacttagccataaaaactagtgaaatcatgtcatttgcagcaacatggatggaactcgatgtcattctcttaagtgaaataagccagccacagattgacaaatattgcatgttctcacttgtatgtgggagctaaaaaattgaccatatggaggtagacagtggaaagacagagaacagagactgggaagggtaagtgtcaaggagggggaggatgaagagaactgggttcttagcatattaaagatgtcattccgtggtcttctggctttgattattgcttctgagaactaatctgtaaattaattttcactctcttgaaggcggtctgtcttgtcttttttgatgcttttaaggcctttcctttacttttatgttatgcagttatgttctgctgcacctagtttcaggttttatttttatgccattgaatctgtttggtttcttgaatcacaaatatctgtagatttttcttgagaaatcttagccgttgtctctttagtattgtctttattccctctctcacctcttctagaatcccaatttcctttatgttattcttcctcactctttcttccatgtctcttaatgattatttcacagtttccatgttttatctctatgccacattatatataatttctttttagctttactaagtcttttaactttatactgtctctcttcagctctatctagtctgttgtgaagcccatccattgagttttaaatttcaattactatagcttttacttctagaatttatattttatttcgattgagctatgtcattttcatacaattgctggctccctttattatttttaagttagaaaaattcttctataattgtaaagatagttactatatattttttatctgataattccaatgtgtgaaatatttagtgagtactttctgttgtcatatgtttcttttggcttttgcttatggttttttttcttgtatgcttaatggtttttaattaggaaatctcatcttcctttaaaaaaatgatacattagaattatttgaagtttactatgaaggcatgttttttctacgtagagtcagtatgtatttttgcccagcctctagaaggtcaatgcagtcagagtccactcaggtaatgctaatttggattgcaaatctggccagtttgtggtgagttttttaagggttttttttcctgtacttctctgctaagcaccaagagatcttttcttccacctccctgggtgtgggattgtgaggtacatttatgcgtggtacacccttatagtaaaagaaattataaaacaaaacccaaaaattatccaagtttggcatatgtcctccgggaaaaagtagtttcattgatcagttcattttttggttttccctagattttgatttgataaatcctactgtgcttccctttgatgcttttaggaagaagtttttacttttttccaagcattttttttttaagtaagcatttcagtctggatacctaactggccacattattggaatatttcttatttctctctgccattattttgtagtatgtgtctccttggaacacctgaatcaaaattacttagagatgtttattaaaatttcagattctgctattcaacttcagcttactggaagaatctttacgatgggttgctggtatgtaaatttttgtgaggttctttaggtgaccctaattcatacagaatttgtttttatttgtacttttaagtctaatatctgctgttttaattgtagcagcatgagatctaaatttattattttttatatttattctagcaccatatgttgaaaaattcattgttttcacatctatttgacgtcaacttttatcatatagtagttgtgtgtgtgtgtgtgtgtgtgcacgtgcttgcatgtgtaaatctgtttctggccttcctatttttgttaactgaataccatactattttaattattgtagtgttgtgatgtgttttactgtgtgataatacaaaactttccttactcatttattactttctcccacaataaaaatttaaaatattactgtagtttcatcattttcttgcttctttcatcttcagtgatttcgaaaaattagtttttttcatatgaacttagccttttagactgaggtacttaatgttcattttacttctttgccccaatcaattttgtattttaatcatgcttagcatggcaatttttcctctaggtagctttctgtctatccttccaagttgaagtccaggtattcactttctccacagagcctttgtcaatactttcaggctcaagggaactgtttttcttaactttgatagcaattattgactataccactcatttttacctggcaaatcctacagaatcacagagagtgaaatctggaagctacctaaggagatcatattgtctatgtatgccattttacaaatgagaaaacagccaaagagtatggaaatgatttgtccatggtcaaatgtttcaacttctgaagtaaaattatgatataccgctgtatcattattccattgtattttgatattcttttcatatgtcctgaaaatacccagttacttaaaaaataaaatacctagttacttaaaaaaacaaaaaacctagactggaagttccttaaaggtagcacctgcatgtacttttgtacaactcatagaactattattgtgcttgtgtttattagacacctaatcaatattaatagatgttggtaaaaaaacaaattgttccattaaccagatgtcaaactggggctatctccttgtgggcgccactgttataactgtatagaaagtggcatctagtggttggtgtgcgtattacaattgcctgttttgttttaacctatgagtaccagagtcattctcataacctaggtggaataaatagactataaattaaaattttaaattgaatttaaacacatttatctataattcacaactgttttaatctgtgctctctctaaagtaaagctacatgttaataaaaaattgcaaaaaattatacaaaattacttgtaaaatgacatgcgagagtatttaaggttttgcttgtttataaattatattaggagttaggggctatcgttggatactgagaagtcaaaatgcaattataaagaaaggtcacatagaaacttgttcatatcaatgaaatcctgtcaggttattgctttgcattatttttaggagcttaatttgtatttaaaagaagaagatctctcaataaaggctgaagatggaaagctacactgtcttctactcgcaacaacaaaaacccatgcacatatattcacatataaagttcagacatgcatttcagtgtcaaatgttaattattcttacattaacagccatttggggttatcactactctttacctctccattaatgcatgagtgttgacaatatgcacaatttaattcagggactacgactgttgacagttactgtcttgtgaacttgtgaatcagtatcttcttgtgaaacggtatcttctaaattttataaaatccatagtctggaacttaaaatttatgtttgcagaaaaatattatatatttttaattaacctctgtttcctgcacattgtaatataattttttgtagatgggttcatccttcccattagagagcaatgatgtactttgtacttctacttgcacctaacataacatagtggctgtcacataacaggtgatcaataagtatttcttgaattagttacacatgttggagggagctgtgtgttactcatcttagaagtctagtgcctaacaatttttctgtcctctagtaatattcaattcatatttgatgaatgagtaagtctgaataagcctatttaatctgtagtgtagttagcgtaaaatactaaaatcagtatataacccccaaacatctatgaataataaataatagcggcatagcagactttctgtttgacgtgtcaggagcacagctttcactggagcagcctcttgtagtgtgagtgagagattactgcaacatcaagccattgtagtttgctcttataatcaggaaaagaggtttcagtatgaaggtgacttttagttgcagctgagtgagttaggagttctgaccagaaggataaggtcagtactttcaaaagggttgaggagggtactttggtagtgactagagtaaaggaaatcatggaatgttgagcagcaggctaaggtattttatatcaaaggccctcaagattgatgggcattatttggtatttatgtcacatgaaggtttcagtaactcagtctggtatctatctgatgaaaagaatgccacctccttgtaagtaaacactgagctatccatgtatattaaactaacttgtttttctaagcagttcattttctaagagtaaaggatagtactgaatggcagaagtcacatactgtattcttttcctctataggttttctattttggaggaggatatttttctggcttgaggacctcaattcctaatatgattgaatgcctgtttagaacatctagactgtgggagcagcatttatggtaaagctgttagagactgagctattattagtgatgaaggagtaggagcaaagaaaagaaagaaaggtggtaaaagatagtgttatatattttatgctccatgattgctcatgaatggagagaaacaagtgacttgaagtggtaggcattgttgtctagttgccaaggtcattgctaatacagagtgagaggtaattttttacaagcaatgttagaagaaaaaaaggagagttcctgagagtttggacatgtggcaaatcatattacagggaagttgtatgaatttcttttccatttttaacatattttagattgtgcatactgtcaacactcatgcattaatgaagaggtaaagggtagtgataaccccaaatggctgttaatgtaagaataattaactttgaaatgtatgtctgtactttatatgtgaatatatgtgcatgggtttttgttgttgtaagtagaagatggtgtagctttccatctttagcctttattgagagatatctcatttttaatgtcttgtaaaatgatatttttcactttaaaattataaaaattatgtttgctcattttgaaaagttaagacagaagtgtatataataaaaggtgcaagcttcctgagaggtaactgttatttgcaatttcgtatatcttttcagatatttttctggtatctatctttcaagtttggattgttgatttcagttgagctgtaagtcagagtctgatttttgggttcatatttaatgattttttccctctttctcttccttataggcttgctatgggtgttctccaggatcaaagtgtgactgcagtggcataaaaggggaaaaggtgaggtcttagattggcatttgaaaatttagtaaagccagtaaactaatggttttaataaatatttttttaaaaacagagcttctatctcagtacttaagtaagtgaaatgaatcctattgcattgcttattttagagagcttataaggattagattatatcttaaggtcagcaaagattttctgtaaaaggccatatagcaaacattttaggatttatgggacacatcagtttctgtcacatattcttatttatataaatagaactttaaaagtgactaaaaaatattcttagctcttggatcatagaacatgagcctcttgggatctggatcaggacctctttcccgtaacatatttctggcgaccacagaagggactatagtgcagaaaccctagcttaatggctacctttgggtaagtgttggggtcctttaatatctgcatttggcctgagagctataatctgccaaactctgattggtcttgttgaaggcactgacttacttaataggcaaagacaggggaaaaacacttaagaaggaaactaaacatttatcaagctactaatctctgccagataccaggcaatatcatgtatttttatctagtctatgcagtttaataatagatgaaagtctttttttttgttttttcgtttttgagacacggtcttgctctgtcacccaggctggagtgcagtgtcacaatcaaggctcactgcaacctccgcctcctgggttcaagcagttctcgtgcctcagcctgccaagtagctgggattgtaggcatgcaccaccatgcctggcttatttttgtatttttagtagagatggggtttcgccttgttggctaggctggtctcgaactcctggcctcaagtgatctgcccaccttggcaggggattccaggagtgagccaccatgcccagctgaatgtttatttctatcttactttttccacagcagcatctcctattgtacagatattatgattacaaagtaagtattggtgaagattatatagcataagcctaatcactatcagtgaatgacattaatattatcaaatataaaagggatagtaaattatagcctaaagagagttatactaggagatgggatcatactcttgtctccactctttggggctcagtatttttgaatgaatgagtgaatgctgctaattatatatgaagcagtttaggacagtatgtctagggcataatctacttagaggtatagaaggtacgttagcatattagacattcttaaaagttctggagcaaagaaacctatttgtttgttttgtaatgctacatttccaagccccatttgaccatgttatagactttccccttaacagagcagctattaatattaattggatagtcttctgcagaacacttatttgagtaacattagtttgatgggagtagtttcgcagtaagggtgctttctgtagtggagaaaataccaagagggattaacttcatataatagtagagtgatgtttatcagattaacttttgagataagaatggaatactctggacaaaatataacagctacttgatagtacaagagaataaccaaaggaaaaagaggagaggcatctgcacttgaaagaaaggaaatacactgggcatatttgcatttatatggcttttcccctgagtacagcccttagtctgcatggcaaaggaaggctaaaacccagacaaaaacccatggtcttactggcttgagtcagcagagttgaggatgccagaatggctgaaaagtgaagagggatatactggaatgtagggaaacacattggaaagagctcaaaaaattgcttatagattccatccaaattcttgcttgaatcctgaagtttataactatagaggaaggttcatacaacccagcaaaaaggaacagctggaagtctgcaataactgagcatagatttaaccgttgtccgttgaaaggagaatggagttttaagttcaagttcagctgagttaactatactatttcttaaaatagaagtttaatcaatactcttcagaggaagttaagagaatccagaatctctccatattacctacaatatccagtatgcaattaaaaattaccaagtaaaagtgatctacagtcaataaaaagaccaatcaatgaaaaccaaccctgaactaacacagatgttggaatttgtagactatgatttaaagcagaaaatagaaaaggaaaatctcctcatgatgcgtgaccaaataaggaatcacaacagagtaatggaaactgtattttatttaatttttttttattgttatactttaagttctagggtacatgtgcacaacgtgcaggtttgttacatatgtatacatgtgccatgttggtgtgctgcacccattagctcgtcatttacattaggtatatctcctaatgctatccttccccccacccccaccccacaacaggccctggtgtgtgatgtcccccttcctgtgtccaagtgttctcattgttcaattcccacctatgaatgagaacatgcagtgtttggtttcttgtccttgtgatagtttgctgagaatgatggtttccagcttcatccatgtccctacaaaggacatgaactcatccttttttatggctgcatagtattccatggtgcgtatgtgccacattttcttaatccagcctatcattgttggacatttgggttggttccaagtctttgctattgtgaatagtgccgcaataaatatacatgtgcatgtgtctttatagcagcatgatttataatcctttgggtatatacccagtaatgggatggctgggtcaaatggtatttctagttctatatccttgaggaatcgccacacagtcttccgcaatggttgaactagtttacagtcccaacaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatatgtttgagttcattgtagattctggatattagccctttgtcagataataggttgcaaaaattttctcccattttgtaggttgcctgttcactctgatagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttagatctagcatttaagtctttcatctgccttgaataaatttttgtataaggtgtaaggaagggatccagtttcagctttctacatatggctaggcagttttcctagcaccatttattaaatagggaatcctttccccattgcttgtttttctcaggtttgtgaaagatcagaaagttgtagatgtgtggtattatttctgagggctctgctgtgttccatttgtctatatctctgttttggtaccagtaccatgctgttttggtgactgtagccttgtagtatagtttgaagtcaggtagtatgatgcctccagctttgttcttttggcttaggactgacttggcgatgcaggctcttttttggttccatatgaactttaaagtagttttttccaattctgtgaagaaagtcattggtagcttgatggggatggcattgaatctataaattaccttgggcagtatggccattttcacgatattgattcttcctatccatgagcatggaatgttcttgcatttgtttgtatcctcttttatttcgttgagcagtggtttgtaattctcctcgaagaggtccttcacatcccttgtaagttggattcctaggtgtttcattctctttgaagcaattgtgaatgggagttcactcatgatttggctctctgtttgtctgttactggtgtataagaaggcttgtgatttttgcacattgattttgcatcctgagactttgctgaagttgcttatcagcttaaggagattttaggctgagacgatggggttttctagatatacaatcatgtcatctgcaaacagggacaatttgacttccttttttcctaattgaatactctttatttctttctcctgcctgattgccctggccagaacttccaacactatgttgaataggagtggtgagagagggcatctctgtcttgtgccagttttcaaagggagtgcttccagtttttgcccattcagtatgatgttggctgtgggtttgtcatagatagctcttattattttgagatatgtcccatcaatacctaatttattaagagcttttagcctgaagggctgttgaattttgtcaaaggccttttctgcatctattgagataatcatgtggtttttgtctttggttctgtttatatgctggattacatttattgattggcgtatgttgaaccagccttgcatcccagggatgaagcccacttgatcgtggtggataaggtttttgatgtgctcttggattcagtttgccagtattttattgagaatttttgcatcgatgttcatcagggatattggtctaaaattctcttttttgttgtgtctctgccaggctttggtatcaggatgctgctggcctcataaaatgagttagggaggattcccttttttttttattgattggaatagtttcagaaggaatggtagcagctcctccttgtacctctggtagaattcggctgtgaatccatctggtcctggactttttttggtttgtaagctattaattattgcctcaatttcagagcctgttattggtctattcagagattcaacttcttcctggtttagtcttgggagagtgtatgtgttgaggagtttatccatttcttctagattttctagtttatttgcgtagaggtgtttacaatattttctgatggtagtttgtatttctgtgggatcggtggtgatatctcctttatcattttttattgcatctatttgattcttctctcttttcttctttattagtcttgctagcagtctatcagttttattgatcttttcaaaaaaccagctcctggattcattgattatttgaaggatttttgtgtctctatctctttcagttctgccctgatcttagttatttcttgccttctgctagcttttgaatgtgtttgctcttgcttctctagttcttttaattgtgatgttagggtgtcaattttagatctttcctgctttctcttgtgggcatttagtgctgtaagtttccctctatacactgctttaaatatgtcccagagattctggtatgttgtgtctttgttctcgttggtttcaaagaacatctttatttctgccttcatttccttatgtacccagtaggcattcaggagccggtcgttcagtttcatgtagttgagcagttttcagtgagtttcttaatcctgagttctagtttgattgcactgtggtctgagagacagtttgttataatttctgttcttttacatttgctgaggagtgctttacttccaatgatgtggtcaattttggagtaagtgcggtgtggtgctgagaagaatgtatattcttttgatttggggtggagagttctgtagatgtctattaggtctgcttggtgcagagctgagttcaattcctggatatccttgttaactttctgtcttgttgatttgtttaatgttgacagtggggtgttaaagtctcccattattattgtgtgggagtctaagtctctttctaggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtgtgttttatcagagactaggattgcaacccctgcctttttttgttttccatttgcttggaagatcttcctccatcccattattttgagcctatgtgtgtctctgcacatgagatgggtctcctgaatacagcaccctggtgggtcttcactctttatccaatttgccagtctgggtcttttaattggaacattcagcccatttacattcaatgttaatattgttatgtgtgaatttgatcctgtcattatgatgttagctggttattttgctcgttagttgatgcagtttcttcctagcatcaatggtctttacaatttggcatgattttgcagtggctggtactggttgttcctttccatgtttagtgcttccttcaggagctcttgtaaggcaggcctggtggtgacaaaatctctcagcatttgcttgtctgtaaaggattttatttcttcttcacttatgaagtttagtttggctggatatgaaattctgggttgaaaattcttttctttaagaatgttgaatattggcccccactctcttctggcttgtagagtttctgccaagagatccactgttagtctgatgggcttccctttgtgggtaacccgacctttctctctggctgcccttagctttttttccttcatttcaactttggtgaatctgacaattatgtgtcttggagttgctcttctcgaggagtatctttgtggcgttctctgtatttcctgaatttgaatgttggcctgccttgctaggttggggaagttctcctggataatatcctgcagagtgttttccaacttggttccattctccccatcactttcaggtacaccaatcagatgtagatttggtcttttcacatagtcccatatttcttggaggctttgttcgtttctttttattcttttttctctaaacttctcttctcacttcatttcattcatttgatcttcaatcactgataccctttcttccagttgatcgaattggctactgaaacttgtgcattcatcacgtagttctcgtgccatggttttcagccccatcaggtcctttaaggacttctctgcattggttattctagttagccattcgtctaatcttttttcaaggtttttaacttgtttgcattgggttcgaacttcctcctttagctcaaagaagtttgatcatctgtagccttcttctctcaactcttcaaagtcattctccttccagctttgttctgttgctggtgaggagctgcgttcctttggaggaggagaggcactctgacttttagaattttcagtttttctgctctgttttttccccatctttgtggttttatctacctttggtctttgatgatggtgacatacagatggggtttcggtgtggatgtcctttctgtttgttagttttccttctaacagtcaggaccctcagctgcaggtctgttggagtttgccggaggtccactccagaccctgtttgcatgggtatcagcagcagaggctgcacaagagtgaatattggtgaacagcaaatgttactgcctgatcgttcctctggaagtttcatctcagaggggtacccggccgtgtgaggtgtcagtctgcccctactgggggttgcgtcccagttaggctactcaggggtcagggacccacttgaggaggcagtctgtccgttctcagatctcaagctccatgctgggagaaccgctaatctcttccaagctgtcagatagggacatgtaagtctgcagaggtttctgctgccttttgttcagctatgccctgcccccagaggtggagtctacagaggcaggcaggcctctttgaggtgcggtgggctccacccagtttgagcttccaggctgctttgtttacctactcaggcctcagcaatggcagacgcccctcccccagccttgctgccaccttgcagttcgatctcagactgctgtgctagcaatgagcgaggctccgtgggtttaggaccctccgagccaggcacgggatataatctcctggtgtaccatgtgctaagaccatcagaaaagtgcagtattagggtgggagtgacccgattttccaggtgccgtttgtcccctcttcccttggctaggaaagggaattccctgaccccttgcacttcccgggtgaggcgatgcctcaccctgctttggctcacgctcggtgcgctgcacccattgtcctgcacccactgtctgacaatccccagtgaggtgaacctggcacctcagttggaaatgcagaaattacctgtcttctgcatcgctcacgctgggagctgtagactggggctgttcctattcagccatcttggaaccacccattttggaaactgtattttaaaaaggaaaatttatatttgaaaagcagaatataagaaaaaacaattgaccttatgggcttaacaatagaatggagatgtcagaagaaatagtcagtaatcttaaagataaatcagaagaaacaactgaatctgaagagcactgaagagaaaatgaaaaaaagaaaaaacagaataggaccccagtgacctctgtgacagtgtcaaatggtctaatacaaatataaatggagtcctctaaggacaggagagaaagaacagggaagcaaaaagaagaataaattatggggcactaagaatggcaagaattctccacacttggtgaaaagtataaatttacagatataagaagtccagcaaacctcaagcaaagtaaaaacgaagaaaactatacctaggcccatcataatgaaactactgaaaaaatagagattgaaagaaaatcttgaaaaaagctagagaaaaatttacaccgtgtatagtggaacaattatacgaatgatgacagacttctcatcaaaaagattggataatgtacagcaatgtgaaaacatcgttagagagctaaaaaaaaatttgcaagcacaattattatatacagttaaaatatacttcaaaaataaaggcagatttaagacattttctcataataaaaatagggaattattcatgaagaggcttgcattaaaataaatataaagaaatttcttcaggctaaggggaaatctcactagatggatgtgtgaatttataggaaggaatggaaagtaatagaaatggtgtaaatgcgggtaaatataagaggattatatctcttttcctctatttatttaacagaaagcactgtttcaagtgtaacaacagagattcaaaatacatgaagccaaaactgagagaattaaagggagaaatagacaaatccacaatcatggttgtgattctaacactcctatttcagttgttccactcttaacaacttaggctttattgacataaaaagagcccaacatcaaacaactacagaatataatttttttcaagagccaaggaattttcaccagtgtagactatgtgataggtcacaaaatgagaccctctaaataccaaaagattaaaaatatcagtatattctcttattacaatggaatgagtaagaaataaataataatatttgtagaaaattcctactatttggaatttagaaagcactgttctaaataactgctggaccaaggaataaatcaaggaaaattagaaaatgattttagttacatattgttgaaaactgaaaattttggaatggggttaaagcagggcataggtgggaaatagatttaaatgtctatgttagaaaagaagaaagatttaacattggtgacctatgtttctcactttagaagctagaaaaggacaagcaaattaaatttaagagaatgaaggaaataataaagacaaaagtaacaatatattaactacaaaaaaaatagaaaacacagtcaaaatttggtaattgatagcacaaaagatgataagaaaatagaaaacacaaattacccatatcaggaatgttcctacagccattaaaagatcaataagggactatcataaatcactttgtaacaataaatttgacagcttaggtgaaatggacaaattccttaagaaacatacattaccaaaaacaaaaacaaataaatgcgtgagtgaaagaaagaagcaaaatataaattagccctatatatactaaggaagttgaattatcaacccttccaacttagaattcctgttccagaagagtttactgatgaattctatgaaacatttttgcaagtgacagtgtcaatcttgcataaatttattcagaaaatagagggatattgaatgccctccaattaattttgtgaagcaagcaaagccctgataccaaaaccaagcaacgacaaaattacagaaacagaaaacgacagactagtatccctcatgagcatagatacagaaattattaaaattttagcaaatcaaatccaacaacatataaagtggatgattggttgtgaccaagtgggatctatgccaggaatccatgtttggtttaacatttgaaaatcaaaaattgtgactcactatattaaagaccaaaacaaaatttagagcataaatatataaacccccaataattatcttaatcgataacaaagaatgcatttaatgacattcaatatccatttctaataaaaattactcttagtaaactaggagtagaagagatttcctcaaccttaaagggcatatgccaaatccctaaagctaaaattgtactcaatggagaaagactgagttcctttctcctaacttcaggaacatctgctctcaccatttctattcaacattgccagtacagtaagacaagaaaaagaaaagaaaaagtatccgtattgaaaaggaagaaataattttttttgtttttttgatgatgacatgatttttcaatgtagaaaatgttatgacatatgctaaaatactcttaaaacttataagtgagtttagaaagatcacagaataaacaaaaccaacaaactaagatcagtaaataaaaatcggttgtatgagcaatggggaaataattccctgttcaataaatggtgctgtgataactgactagccatatgtagaagaatgaaatcagacccctgcctttcaccatatacaaaaattaactcaagatggattaaagacttacgtgtaagacctcaaactataaaaatcctagaagaaaacataggaaataccattctagacattggccttgggaaataatttatgactaagttcccaaaagcaatttcaacaaaaacaaaaattgacaagtgtgacctaattaaactaaagagcttctgtatagcaaaagaaactatcaacagagtaaaccagcagcctacagaatgtgcaaaaatatttgcaaactatgcatccaacaaagatctaatatccagaatctataaggaacttaaacaattcagcaagaaaataaataaataaataaataaccccattcaaaaatgggcaaaggacatgaacacatacgcctcaaaagaagacatacatatgggcaacaaatatgtgaaaaaattctcaatgtcactaatcatcagagaaatgcaaattaaagtcataatgagataccattgtctccgttaaaatggctattattaaaaagttagaatggctattattaaaaagttaaaaacagatgttggtgaggttgcagagaaaagagaattcttacacattgttggtgtaaatttaaattagttcacccactgtagaaatcagtttggagattctttaatcagttcagccactgtagaaagcagtttggagattttttaaagaacttaaaacagaattcccattcaacccagcaatctcagtactaggtgtatacgcaaagtaaaagcaatcattctactgaagagacacgtgcactcatatgttcatcacagcactattcacaatagcaaagatggaatcaacctagatgcccatcagtggtggactaaagaaaatgtgctacatatacaccatgaaatactatgcagccataaaaaagaatgaaatcatgtcctttgcagcagcatggatgcaactggaagccattatccttagctaattaacacaggaacagaaaaccaaataccacatgttctcactaataagtgggagctaaatattgagtacacatggaaataaatatggcagcaatagacactggggactactagtgggggaagatgttggggagactgttgaaaaactgcctatcagtacgacactcactacctgggtgatgggatcctttgtactccaaacctcagtgacatgcaatttacccatgtaacaaacctgcacctgtacccccgaacctaaaagtaggtaaaaaaaaaatgttatacaaatggaatcataaagtatgtaactttttaagactgacttttgtcactctgcataattcctttgagaagcatccaagttgctgcatgtatcaatagttatttcctttttattgcttagtattccatggtatggatccaccaaagtttgtttaaccattcacccattaaaagacatctgcttttgtttttcttttccaatttgggaatattatgaataaagttgttatgaacatttgaaaaaaaatcagtcatatgtccataatctaacaatgaaaagtagtaaattggaattataatagtgccatttaaaataacaacaaaaatttgagatacttaggaataaatcagacaaaaatgtgcaagtctcataccctgaaaactacaaaaaatattgcggtgagaaataaaagaagacctgaataaatggagatatatatcatattcatgaattggaagactcaatattgttaagttgacaattggccccaatttatctatagattcagtgcaactccaatcaaaattcttgtggttttctggggctacaaatttaacaagctgatcctaagagttagatggaaatacaaatacagcttttataaaaaacaatgttggaggatttacagtacacaattccaagacttagtataaaaccacagtaaacaagatagtgtgctattagccaaatgatagacatatagatgaatgggacataatagagactcacaggtaaatagtgaatctgttttttgacaaaaatgcaaaggtagtggagaaagtcttttcaataaatagtcctggaagggttgcatatgcgtatgcacaaaaatggctcacactttatataaaagttaactcaaaatgcatcatagacctagatgtaaaatctaaaccttaaagtctttaaggaggaaacaaaggggaaaatccttgtgactttgggttaggcagatatttcctagatctgatatcaaaaacacgatccaccaaagaaaatactgttaagttgtatttcctcaaaagtaataacttgttctcctctaaaagtattgttaaaagaataaaaagataatccacagtgcaggaaaaataatatttgcaaattacatatctgatagaagacttgtatccagaatatataaagaactctaaaaatttaataataaaacatacagctccacataaaatttaattataaacaaattggaagaatattttgacacttaaataaaagcagatatatagatggcaaatagatacacgaaaagatcctcaacattattaattagggaaatgcaagagaaaaccacaatgagatgccaccataaacctgttagaatatctaataaaaacttttagccaaagcaagtatagatgagaatgtggaagcaactggaacaattatagattattggtataagtggaaaatgatctacacagtttggcaatttcataaaatgttaaacacctattaaatgaccctgttgattcctaggcatttacccatgagacatcaaagcgtatgcctataaaaacttgtacttgaaaattcatagtagctttatttgtaatagccagaaactggaaacaactcaacttcccatcaacaggtaaatgaatcaacacattgcagtatacctctacaatggaatactactcaacaataaaaagtaatgaactattgatattcaccataacaagtttgaatctctaagtaattatgctgactgaaaagttagacaaaaagagtacattctttataattccatttatataaaattctagaaaatgcaaattaatctacagtgacagaaagcagatctctaatagcctggggtgggtaggagtagggagatggatataggcataaggaagatatgggcacaaagaagcttttgtaatggattggctatgctcattattttgattgtggtgatgatttctgtattagtccatctttgcactgctataaagaaatactcaagactgggtaatttataaacaatggaagtttaattgactcacagctccgcatggctgtgcgacctcaggaaacttacagtcatggcagaaggcttaggggaagcgggcaccttcttcacaaggcagcgggaaagagaagagtgaggagcaaagagggaagagccccttataaaaccatcagatcttgtgagaacccactcactatcaggagaacagtgtgggggaaactggccccatgatccagtcatctcacaccaggttcctccctcaacacttggggattatgtggtatacaactcgagatgagatttgggtgaggacccagagccaaatccgtttcactggtgtatatatgtgtcaaaacttttggccaggcatggtggctcacaactgtaatcccagcactttgagaggctgaggcaggtggatcgcttgagcccaggagtttgatatcaacctgggcaacatggtgaaaccctgtctctacaaaaaatataaaaattggctgggcatggtggcacacacttgtagttccagctactcagggaggctgagctggcaggatcacctgagcccaggaggtataggctgcagtgagctgtgtttgtgccacagcactccagcctgtgcaacaaggtgagatcctgtctcaaataaccaccccccaaaacaaacaaaaaaccccaaacttttaaaatagtatactctacgcatgtatgatttattctatgttaattatacttcagtaaaactgcttttaaaacatatgtttttaacatagaaataaaacatctagatttccctaaaagaaatgtgtccaagtgcatattaataaacaaagaaaacttgctagacccctgatgagatcaagttaaccagttgacaatgtaaaatctgtgacacaatcaaacattaactaaacaaagtgtgcctctgtcagtggcatcagcatttactgggcgctggttagaaatgctaaatctcaagctttgcagctgacctactcaatctaactctggtgtcagggccaggtaatgtgtgttttaataaggtctccaagtggttctaatgcaagctaaagttttatatctgacttagagtatctccattttgacagtcgccaaaggtctattttcttgttctaccaattgtaatacatcaaatatttctagttctacataactacaaaaacaaaataggtattatgcaaaaaagagaaccgaattgcctataattgcattacctaattaaattatcattttcatttattcattaagggtcttgccttctccacatgtttatataaatatgttcatataatgtctgcatttttacaatattataatctgaagtaattttaatctcaattattattacagcagtttgtcctattttgtatttttcctatcctcagaattctaatattttcctgtttaatttttcttccttgagaaactattcttaaaatgcttttttattttaaagtggcatgattatacaactgtcttattgtcattataaagtgcgcttcctgaagatggtaacacttttatggatgcctttaactcacaaactagtctacttctcagtacattagatttttattcttcttaataaatgatatataaaccactaaaagttatcctttgtataatttcccctagccctaaatcttacatgtttttaacttttgacaaaagtgtatgccatatattttatttaatccattaaggaagtttattcattgaatgagaatttactgagtatttgttctgttgggcactaagaatacaaagttgaagaagatataattgattaatgaagtagtaattcgaggggagttaaagttattacaaatttctggctggggtagttgggttgtgctatttcctggaatggagaagacagtagaacatgaattcagtgttgtttatatcaagtttgttcttaggaaaattacaaaatttttccttgtcctgattcttcatatataaaatggaaataataatgtctacctcatattatcattgagagtattaaataagataaaacatggaaagagtttagagtaattatttggtatatagaaaacactaaatacatgttagctattattattgtcattgagttttaggtgcctgtatgcattcaagtgaagatgtttcagacagttgcctatgagagcctagttttttagtaaaaagagttgatattttagattcccgggtaaagagagagaagatcaaaaaaggaatccagtgtaataccagtatttaaaggataggcagagagagagaaatattattgcacaaaggaaaatacgaatgatatttttatgcaaatatgggcaggcagcataaaccggttttttttaagtttgacctttagaaatagccattttctgtttgtgagtgttagcaaattacaggaaaatctacagtagttgtaaggattaaacgagtgcctaacaacaggcagcaaagagtaggcaacaacaaacgtcaaccttccctaccatatgtattaggaattaggtggaggatcccatccccaccacatcctcgctcaaggcttctataatttctacttagtaaccttagtacctttcaaaggctgtggtattgatctttgaattccttttgctactgtctggtagttgcccttctctcttctttactataatattgctcactctgctagataggaccatgatattatttgactgtagtgcaaggagatttcaggatatatcatttataggtatatggttttattaatatcaacaaaattaagctttttagcacctccacttaaaatttttagcttattcctctcttatctgtaggcgagatagcagttttgcttctgagaaaatatggctttcttcaagtattatcctccagttttggcagagatatgctgtaaataccagctgagatcccaaaatgtacctgttttcccctcatgaaaatctactgtaactagattttttttcctttgtgctttctttctgactgaaacttgtgatcagatttctactactagctctgccagtaataatttgagggaatctagctctaaaaattttaaaacttttaatttcttcctcttgttttatttcctcaaaaacaattgtgttgaggttgatgaatactaaattatcataatttaaacactaattaaaacaacaaggggatatatgtctagaaaataagaagtgtagtaatatgtcagtaataattattgtcaaaactacaggaatgttgccatctatcattaattgactaaaattagcttcattaactttgaaatgaaaagtggaaactgaccagtagtcttttcaaagtacttatatttattataggatgtttgttgaattattcagcataaaatcatctaagctttttagactaaacttagtacttacaaaacacacacacacacacactttcagagtagaaataaaagtgtgctgtaccttaacctctagagatatgtgtcttcaatggccccttagtcagccacctagtagatatggatgctttctctttctcacgtgctgtccaggctgtcactgtgggtaggatctgttaagagggttcccagaatgaggtctgaccagaggcagccttcgagccttagaaaagtggaggaactacttgtaaccctgtagttgggagcacgtgccatgaagctgtccttcggggttcttttatatatatatatattttgtactttaagttctagggtacatgtgcacaactgcaggtttgttacatatgtatacatgtgccatgttggtgtgctgcacccattaactcatcatttacattaggtatatctcctaatgctatccctcccccctccccccaccccacaacaggccccggtgtgtgatgttccccttcctgtgtccaagtgttctcattgttcaattcccacctatgagtgagaacatgcggtgtttggttttttaaagttggaaaccatcattctgagccttcggggttcttaaacttcatagtgatgaattatctttgtgtaactggatcccctagttttggagtttacacccttactaggattggctatatgcagattaactaaccctaatatgttaatccaaatagcattagtacacatgctggctctgcttccccacctttctgactgtacagatattcacatcaggcaaccctactgtaaaggtgctgataagatatgatgggtcctcactggtagataggcagtcttcctgtcctggtgatgataaaggctgcggttagaactgagacctgagtcacaattcaagtaattattctgagtaaaggaattaatggtggtattttctttatacttttgttttctacattgaatatgtattcatttttagtattaattttacaattagaaaaagtaataaaagttttgatgttttgaaggtttttttctggttaatttcaagtctgggagcttctctgatggtttccttttacccttccctgctccatacttatttaatgtaacccttacagatctggtttcctggatttattgctatcttccctattaaactcttgatgtcagtatgtttaaatctcatttcatctctgatatgctttttacttttacaagaaagaaagagattaccacatatgatataacttccagacggtttgtgttttctccccccacatcttaacaggttttcccatgttagtagatactgtgaatttacataattaaattaagttagttttgtctagatagtcatgtgatctttttgaatctcaaccatgcctgtgcttgaaaattcacaaatgaccttacctttcattctcatttaattgcagggagagagagggtttccaggtttggaaggacacccaggattgcctggatttccaggtccagaagggcctccggggcctcggggacaaaaggtatgtatcatgttgccaaccagtaatgccagatgaattaagtcatcttaaatgtgggactaggtgtcacatcaactaaaaagttactgaattatagcaagaaactaatatgtaaatgaaacaatggaatgacggggagtctgtactttattgtattttgttaaaaaactaaatattactgccatattcagatgcttttggaagatgctgttgattgtttgtagttattggctgccttcacaaaaattaagttctgtcaagagcttagctgagctggagagagctgaattaccagttgttagagtagctgattaagagaagaagccaaaatgaaagtaacagtcaaacctttactcacttactgcaatattataagcagaaagttaaactggagaaagtgctgactcccccactgttctatttgtccccatggtgcagcatcagcaaaggtcagatggatcagcacagatgttggaaatcatttgactgctgagggagctcagaacgaaaagctcctgcagttgtatggacccaggggcagggtgggagaaggagaagagctaggatggaaacgtactgaatcagagtgcagaaaaagtatttttatggtttctttctcctctcataagaaggtctccaccaaaagaggcctttaaatgcagaaatgcagttgagcacagccagccatggtagcctgaatctttgactgatacttcagagattgcagtgcattagctgtgcaccaagtttgctgtgtggagggtagctgtcccttatgaggcctaccaagaggactttggttggacccgaacagtcataggtgtttagacaagagccatattctcaattccataccttgatttttcaggacctgagtgagaaacataagctgccccatcatggacctgaatgggttggactttaaagggctctgtcaaaaaacaggataatatctgaggccacagtagattatggtcatgatcaatcatgttctaagcaggatgaacaggcctgcttggagaactgaatgtaagcatgagccccagctattgccaagccagtaatagatgtcccatagcccacttgatctacgttagagagccaggaggcttttttcttaagtcttatgatggattgttctactttgccagttttcattgatctaggtgcaatatgaggtgctggcaattccagagacccctcacagttggccagcaggcagctaagggctatatggttagctaacactatgtgggccaaggagttgaggctagtctgttttgtttccaaagctgaagtaatgtcattaatgacctcagcaagggtcaaagacaggttgcggacaaccttttctaattgagcgatgctcacagtgagaaaagttgtctggagtattcccatgagtagacagtaggtaatgccagctggcaattctcctgaataaccggagtctatctagttttggagttctcattttgttttatgtaatgttatatgcttaatgggagggactgttttgaatatttgagtatctcttatcaatgtcctattatgtatgttacattggtaggaatgttgaaagcctgatttttataaaagaaataataccccaagaagagtgcacacagttctgggaatgtaagagtcattggttaccatggagatcaaccagccagaagtccctcctggtgagcagagtacttgagtggaattgaaaaatttgtgtaaggtggaggcagaaatagagaaataaattgccaccaccatcgaggccaaaatggctccaatggcagatcatatgtcccttttcccagataattcaattgcttccatatgggacaggagtgagctgacatcccaggaggtattttcttcctgtggtatcagagtcaattgttgcaatctgtcagatccagtgtaataaagttagggtacatgaagtactaaaatggtccatgtttagagaaacgtccattcgtaatattcagcagcacagcaatcagatgtttatctgcagggttcagcgataggtgacatatccattagtttgtcaaaatcagaatcttgtgaactacccgggacaggcaatcaatgaatttagtaaggtggaagtcacaaggttagtctgtaggagaaagggaagagaggttagatccctaccttccagccccatggatcagccccatggatcagctcatggatctggaggtagtctcaacctatcagttgtggggactctgtcttttgactgccatgtgggcagtctgtcctataccatgagcaagaatagcatctcaatgtgcatattaagatatagaattggaagagataatagtgaacttaagactcagagaattttctgggtttttttttttaatgactcttttggcttagtgcctttttccatctgtattaggtagactgatgaattgatatatgaaagggctacttctcctcatttgcctggaaaggaaaactggcttaaaaccctttttcttaattttattattttatatgatggtggtacatcatgttgttacaatattaaggaaatcaaatggatactcaccaggtagtcttccagtaaagggagaaaattaatttaaatgcatgaatattttttaacacttaactataatcagagcttagatttggggagaatgttggtcatgatctctgggaaaataggattacatcaggtagttttgttagattcaagagcagaagggacctgtgctaaatttcccaagtagaactttagtacttagaaaacagcaggaccctgaatgtgtgcatacaattttggtggatgaactactcagctgaatttcctgtgtctaatggcacatcaagagcaagagcaacagaatgattcttgtgcacccaggagtagcacagaagtatcagagatatctgaaagagtcaagtggatggaattgagcagtaacttggcagcaatctatgcatactattggcatggaacaactcaatgaataccagcttggactacactgtcacactcctcaacatattggagctagttaagttctccaaaacttagacacgatcttgtgaaaatgaggtggcaactccaatggactgagattaaacttcagccatgttatagaaataggtgttttggaagagaaattaagttaagctacaggaaaagttacatttcttgtatctgagtttacttgggattagggactgagtttcttgcaccccatgcttgctgagagatggtagttttaataaagatttgtattaaattaaaataagttacctaaattagaattcctttgaaataatttagtattaactaggactattctacaataacatgatcatttataaaggtgtgcttgtatgcaggttaagtttagaaagcagtccaatctttttttgtgatttcatttcagttatctaaaaagagagaaggtaaactgctttctaaactttcaggattctgaatttgaagcattgtgtacttctgcatccagtatgactccatgtttccccaaatggctgaatttataccttttatgtgattgggtattctggtacatgtgtatgttaacatatatactaagtcaaaaaacttgtaggagtattctttaatatgcacactcgcaattttccaaaggttttttattctaaaaaatcaaatttagttaattttgataggcagtacgttcatgtcactcaagttaagagggtatacaatgaaagatctccttctcacctgtgtccattagtccctgagttacccacacacactttaaccacctttgtttgtaaaatagtagcacattaaacacactgtttgacctttgtttttaatttaatatacattgtagacatcctattatcaatatatacagaacctcctcattttgtataactgcattgtatttcattgtatatatgaaccataacttagcattgtatgtataaaccataaattattaagccagtcccctattgatgattatttaggtaggtttcaattttttgctattaaaagttcctttttcttggagcagaattaggttttttaattctatttttttaaagaaaatagttaacgaaaactcagtgaggtaagactaaattctcagcaatgcggttgtgactagaaatgggtacatatgttaacatacacacatgggtaggttcttttgcatggaactgacagctaggaaggaaagtttatggttctttttaaatcgttcttacgctctgccaatacaaagtgcattataaaacaaagcagaggtttgaaaacagcaaattcaagaacagcacatatttaggctcagagatgatgctcattataccagcatggcaagcagattaacataatatgggaactgcccagattttcagctcctattttgtttacgaataaattatttggggaatgactatatcaatattttatctttgttttcttgtatgattcataattaactgtacaggtatagagtttgattcatatgtcagcgatttccttctcaggaaataaaggcctttcttattttgggtcatacaatttacctcagtgctttcagtctcaataataaatgcttcttccttgggtgtataagtttttcactaactttcacagatgtttacagtagtttaaatctcctattttataattgaaaatgagttatttgaggacttttttgacggacaaaaacctaaaaatattgcatttttcagggtgatgatggaattccagggccaccaggaccaaaaggaatcagagtaagtagtattttctctatatcaaatactttgttggtggaaacagatagagaacaaatgaagtattatgagacaattggaaaagacccatattaaaagccaagaagataaatacagtcttcaaaaagttaaatttaagagttggtatatgtctataactagcacttctttagtattttgatagctattacatatatttttatatatatgtctatttaatataaaaggattttaaagtagcttatggttgagaattatgaaagtcctaaattctaaagtttgtcatttaattaaaaatctatatcatatagttggtttaaaccagaacttcctaaccagtgtgattatctcagcctaggtccagaaggctggttacctcaggctgtgtatcctcctagtgtaccatgtataaacattatcatttttttgtgtatctagaagagaataagtttagtttaaaccactgtattaaagaataactatttttggaatactgcatttcttcaaatctaacgtgcatgacttttcaagtcttgaggctctgaaaaataaggatgcatctcaaaattgaaatgtacatttagtataattttttctcaaaagcttttaagttgacatatgtcttacagtgtattttacaactgagaggaaactgtagtttaaaaaatagtactggcttttaaaaaatcacatttagctttctgaccctcagtttcttcatttgttaacttaagagagctaaagagaacaatctccaaggtcccttttagctctgaaatactgtgttcatagattgatgaagctctctaatttgaaaataaaatatatagttggtgacatagcatgtttacgtgtgtgacaaagataaccatttgatcatcagaaatttagtagatgcataattttacaaacattaaaaacattctgtttgctatatacttcttaacatcatgtagcttgccttatgtgcatcttgtgactgatacggatagggtactggagaagcagggaagaaacttaaaacccttagtttatttcagcagacataattctttatttttctgttaaaaattgatatcaatatactattaaagctctttataataataaaaataatttttaatatccctatagttaacattaactatattctatattctaagcactattgagactaaaaagaattggctattttctcagtttccattgcaggtgtttgagattgcttggatactccatgtccctcaactagaactccaagagtgcttgggaataggtggcctgatagtttctgcatcctcaggtgtcagctcacaggcaattcttgacacgcagaattttgaagacattattgtggaaactgataaatgtatacaaatgtacagagcatatagtataatgaacccccatgaacccatcacccagcttcaaaaatgaacaacattttgatagttttgtttaacatataccttaccactttattttttgaagtattttaaagtaaatccctcacatcattcattctaccaatgaaaacttcagcatgtccctctaacaaccacgtaacaactaaaccatcatcatacctttaaacattaggaatagtttttcagtactctgacgttcagtccacattgagttttcctcagttgtctgaaagatgtccttttacaatggtttattcaatttacaacccaagcaagttccacgtattgctttgggttgctgtttattaagcttgttttactatgccatcagaaaaactgggtcattgtactgcattccacattctgaatttggctgatttgtttcctcatgatgtcatttaaattgttcctctgtcccccatatttcttgcaaatttcacgttgccttggaagaggcactaaagaactttctgggggtacagaactgtacgcttaagattagtatattttgctgtgcataaatcatactgcaataacattaaagaaaataggaaaaagtatactttataggtagtgttgtgaacttaactattgaataacattatgcagcatgaatatcaggctattcttcttttttttttttttttttgatgttaggtttgatcagtagtctcagataacattagcctgattctgccatcaaaaatttccctgtcaactttgactaatgatttggcacccatggatggtcattattttgctcagacttgcaagatgctgatttttaaaattctattaatcattcatttattagctggaattctaataggacaatgagttgctacaccagaaacttcaagtggtcatcaaggaaaattcttcaactttttttttttttcattatatgcacatggaatttgtgtgtttcaatcaattttagtcatttttttgaaggccaatttgtcccatcttttgcctgtgaaagccttttaaagttgactcctgtcctgtgctcttttcagaaaactccattgatctttcataacttctccctttttgacacaacaagctctttcatgctcatccttggcatttcccctttagatctgaaatgggacatatctctgattccaggttctttttagtgaaaaatgtgatttagataccacagcctgaatgttagggttttttttttttctttctttcttttttggagacggagtctcgctctgtcgcccaggctggagagcagtggcgcgatcttggctcactgcaagctccgcctcccgggttcacgccattctcctgcctcagcctcccgagtagctggggctacaggcgtccaccacaacgcccggctaattttttgtgatttttattagagacggggtttcactgtgttaaccatgatggtctggatctcctgacctcgtgatccacccgcctcggcctcccaaagtgagcggtttttattgctactcgatttgtcactgtttcaatgtcttctcagtggaaatatgtatttttaagagaaaaattaacatgagttcatattattgcttccaattgcaatttaaaattaagaaaggttttgtatacttattatctcttcccctcatctctctctctattgaggtgaaaatgttcattcctaatatcataaatgtaatttcttatttgctttttcctacaatatgcctatttcctacaatatgctttaaaataacaatgtataacttaacaaaataaaaatttaaattttaatagtgatgataggataataggattcttgaaaaccattaattatttctttgttgagttttccccctttgaattgaccagttttgctaaagaattagagttaagataccatgtttgatgaaaggcacttgaagtaattcttttctctgtatggttttgtcaacaacttgaaacagacgtacactggatccaatttatttttcatttttaatgatttcctttttaccttttttaaaattttaaattatttaaaacatctacgtggttttataagacaaggtgtagtcagagatgcttctctttcattcttgccatttccctagtgttttaatcttcctctgagaggtaatcattagtttttacatagtaatcatagttttacattatgtgaatgtgccataatttatttagtcatgttcctattggtggtcatttgagttgtgtattagtctgttctcacactgcttataaagacatacccaagactaggtaatttataaaggaaagaggtttaatggagtcacagttccacatggctccggaggcctcacaatcatggcagaagatgaaggaagagcaaagggacatcatacatggcagcagacaagagaaaatgagagccaagcgaaaggggaaacaccttataaaaccatcagatttcgtgagacttactatcacaagaacagtatgggggaaaccacccccatgattcaattatctcccaccgggtccctcccacaacacgtgggaattatgggagctacaattcaagataagatttgggtgaggacacagcaaaaccatatcaagttgtttctaattttaactataactggttacatggttgtttctaaactttagctataataatgctgcaattgttaactttgtttctcatattttgtttcataatttctagggtatcttcaggacagattcttagaagtgaaatgctaggtcaaagggcaaatgcatgggtaattttgctagatattttcaaatttctctccatagagtttgaatcttcattagcagtatatgagaatactttttcaccatagtctcacctacagagaatattgtcaaacttgtatttttgccaatcatgacagagaaatttaagaattttgggggtgatcactattaatgtcttcagtggaaatatatttgccactcccccatcccctgctgaattaatttttcatcacaaacctgggagatccttatccattagaagagacatttcatccacgaatttgcctgctcctaataagtgcaatgaagacaatgctccctcaaattgaagtttcttttatagttttcaataaaagagacttttaaacacatgtaagagatttttctctaatgtttcaaagaacaatgagtagtaataaatagtgagacacaatttttccaaatctattctaaaataattttcataatatccttaggtaggatattattttatttttatgggttgtcatttagtttaaggattttatttcttcttatagggtcctcctggacttcctggatttccagggacaccaggtcttcctgtaagtagcatttcactttttactttgaaatctcttgaaaagtaatctaagacatattatacatgtgttatgtcgcttttcaaagggaatgccaggccacgatggggccccaggacctcaaggtattcccggatgcaatggaaccaaggtgagatccatccatttaatcttgggtagtatacttgacaataattaacttaaaaacctaaagaaatcaatatgaagaatgtagaagaagggatatagtgtcttcaggtcttggctattacataaagtatgctctgactataattttctatatattgaactatcaataatttcattaaacatgtataattagctgggatattgcattgggttaaagattacttaccaaacccttttttgactttagcataaagtaggatgagaattaaaacgaaattaggatatatatgtttcaaatattatatcaattgttgaaagtaatacttctgaatgtcattcatttgctttgccattattaaaaaactaggtacaatttatgttttcaaatatttcatgtttttaagattttttaacacgccgaataacttccttaagaaaaatcttaaaaaattatatgtaatacagcacatccgtttttactataaactgtcagtatgaaacctgaaacttcttcatcagcaaagatgatacatttaacaattttaaataaccctaactttagatatagcaaacatttttttttctgatccaatgtttcttctctttagtcaactgttggattgaatataaagtaatagataataagaaaaaatgaggaaaatttgctctgcttgtaagcttacaatattatagccaattcttattccctcccctttctccttttcctttaggttaatgcaatatattgttattctctgtattttcttttggtattttctgtttttcacataatattctgtaaaactattcataaaataccttaggtccttctttctttctttctttgtttttgtttgttttttgttttttgttttttgagacagagtcttgctctgttgcccatgctggagtgcaatgtcacgatctcggctcactgcaacctctgcctcccgggttcaagtgattctcctgcctcagcctcctgagcagctgggattacaggcacgcaccacaatgcccagctaattgttttgtatttttagtagagatggggtttcaccatgttggtcaggctggtctcgaattcctgacctcttgatccgcctgcctcagcctctcaaagtgctgggattacaggtgcgagccaccgcgcccggccagatctttctaactaatggcatatgtcagattttatatagggcatatttttaaaataacttgaacaactattttgcattacagtggccatattttgtgataattactgtactctatacttgaggcagtacagttcttttcatctccagtatttcttcaggtcaatgtaacccttgtcaataataataatttttaaaaaaaattttggattcatgaggactaatcgtgttcttcattttagctagggcaaccttaaagtgataagaccaatgtggagttggtttgcctgatacatttcatgttaaattggactaaatttttgtgcctcttctggttatttgtttatttttatttacttatttatttttgccagtgtgctttaagaaacaaacagaccactaaccaaagtttcaaatttgaagggccaatgtatctataatcagtacagtgtgctatatgattaaagggagcattgattaacttgtgtttcaggcttccaattatgtgagtaacaaattttaaacaaattaaattgatttattatgcatatttttaaagtctgaatgcttttcttatatttcttactatgtaagtaaaagaatgaactttaaagttggagccacaatgtataggtttttttctttttctgtcttttaaacttgatgtctaggccacttcctttctctcgggacctactttttccatgtgtaacaaggtggagagaagggtattggactcacaaagacacacaacagtagtaattttattctttcaaaccttctgatgaagttgtttctaggattaccgtggcatacaggtatttgaaaggaggttgctttggtgttcttctacagcaatttcagcttttgttttctaaaccaagtgtccatattagtactttacagtagtgagtgagaaaagctgggtgcctagaaaacataatgacctgcaattgctagaactattgctattattgtcctcttggtgatattaatggccttctttcttaccatcttttcccctttacaaaaataatttgaaatagtttacaataaaagaaaaatgcaacagagcagttaaaataagaatctatataacacatgggcaggaaatggggcagatcattaactattaaatgtgatgatagaatttatggcgtgatcgtctcaaaatgtctttgttggaagaaaagaactgaggtagataattttttttctttacttctaattgggatagatgaattgggataaaagttgaattgatatggatagttgatattgaagtaattggaaagtgaaggctaatgaactttttggcaatctggcatgtttcaaaatggcttttatagaaatcttttcaagaagtcatatcttgatggtatagttattctttgtttcttgttcctccatgctctttatttttaactccttctagggagaacgtggatttccaggcagtcccggttttcctggtttacagggtcctccagtaagttataaaatttgggattatgatgaacacaggaattaacaaaagaagcagaaatgtagtgagagagcccaatgcattcatgtggaacaaagtaatacattttaaagtaataaactagaggaaaatgtttcaaaaagaagttggtaatatagctttctcctgggcaaaagcaaggattttgtatgtatataaatgtcacctctaagtatcctaaggtatatcctattcagaaatgacgctacagcagtctactcattttatactctatttagaaagcattctgtaattggcgtgtttctctctcatacatataaaataatcccttttctttttaataatagggaccccctgggatcccaggtatgaaggtaagcatctcattctggggaacaaatgttttgaataaaatattaggaaagctggcaacttcaataggataatgactcaaacttctgtcttaaaatcgatgtttctagaagttgtgcaggtgtaaacttacaagctctccttaagtagtctcctgtgttcccatggctttaagtaccttgtatgtgctgatacacttgaaaatgtgtatatcagacttgagtttctttgctgacactttaagtcttcatcttcttacactttgatacagttaaccacttactctctgtagaattacttttttccctggcctctgtgacactatcctttcctgatttttcttctacacctctggttaatttgcagtcttctatgtaaggtcattattttatgtccatcaagcatcaggtcacagtctgtactccttccctgcaatgcccagaaatattactaatgcccatattattgattactatctagttactaaataccaaatgagacttttcttctgagttagctatgtgtattcatcagcctctctgacatctccacatgttccaagttaatccacccacaaaataaacccgctcctccctgtggctcctcatatctcaaatttgcatctttatatgttatgtacacttttacacgatctcaaaacctgggagttaatatttatatcttccattccttcacccaccacctcattcaattccatcactaaacactaagtgtgcctgtaaaaggcaccttaaattcatccacttttcttcattcccactgttaccacgttaatcataatgtctcatctggattactgcaataacctcttacgtagtctctagtctctttttttcaccactactccgcccttacctcccatcctgttttattctttacaaagcaaccaagaatgacattttaaaagtgttcattgataatttaatatgcttataaaccttcaagggctttctactgtgtatctaaggtaaagtccatagtttgtttgtaagaactgcatgctctggtccttgcctacattgacagccttatcttaaaccactaaacttatcccttagctcactgaccacatcagtctgcatttagttattgggatgtgccaaacgttttgcttttagggtcttttgtatatatggtttactttgcctaatattcttcctcctatctttgcctggatgactccttattatccttcaggtcttaacctgaatgttaccttcacagattgcccttctttgactacccaagctaattttctccactagtttttttttttcaattattgtaccatgttatttttcttcatagcccttaatattcacagcccttgatattgtcatcttatatttttacatattagggtctgtattttcccattatattgttagctttatgagaacagaggccttgtttatcttctccattactgattacccagaacctaccacaattgttggcaaatacttaatatttactacatattttttaatgagtaactgaaggtactacactcttaataaatctactgttcttcagtgtactctggccacttcctcattttcctttaaaaggtaaacttatcatttttattactgagatggcctaatcttttagtacatctctgttacaaattgaatcttcagatcatttttctggttttgctggttttcatgtataataactgtgtcttagaacttccattgatggcttcttttagggtgaaccaggtagtataattatgtcatcactgccaggaccaaagggtaatccaggatatccaggtcctcctggaatacaagtaagtatccagtgattttctttttttgctatattgattaaaccagaagattacaacaatccctcaacctttagtactctctgtttttgtcataaaaattatcatcagatgtttactagacattacatgtactttctacctgaaaataaaagcaatctggaccagggagaattttaacaacatcggcttcattcttttgcctttctatccagtgttttggggattggcagcagaaatagggttctatattcttattcttgtactgtggagagcagtagggtcttttgtacatttacaaaagacctaattaaaaataaaaattatggaagtcccattgaatatattaagatatatcatttgtaacactatcagttatgcataatatatgaacatattttgaaggctgaaggaatacagtttatgcatggtgaacatcaaatgtaatcttaagaaaaaaattttagcctacagaaaacatgcatagagagagcagtaacttttgagtatagattaggaggtcaatttcttagggtttatatttcatgataatcgaatcctttgccaaaaatgaaaaatcaaaacttcctggtagtttatcactaagatacaagattggggacttttttcattagctaccttgtcattccttacttgatatcacccatccatagtttttaaaattcactcaatcttgccctttatattttataaattgttatgaagtaatatttgaaaatacaacagaatacatgcaaaatatatgtatgttatgaagcataactataaagtgaacaacatttaagagctagaaaattacaaataattttgaatcaacctgtgtcccccttggtaatcaaatccttctgcattcccccaagacatagctaccatctgtgccttaaaaatagctttattatatatgcatatatttctaagcaatagaatatttagctttgctttataaaataatgtaatatttatgtagttttctgcaacttactttttctacttgatatgctaagattcatccatattattggatatggctttagttcactctgtttcactttcatataactttccatttgtggacatactaccatttggtgttttttgttttatgtggtgtttgttgttgttgttgttgttttgagatagcatcttgcactcttgcccagaccggagtgcagtggcatgatcatggctcactgcagtcttaacctcctgggcttaagcaatcctcccacctcagcttcctgagtagctgggaccataggtgcacatcaccacacctggctactttttgaaaattttcgtggagacaagttctcaccatgttgccaaggctggtctcaaacatctgagctcaagtgatcctcctgcttaggcctccaaaagtatgaggattacaggtgtaagcctctgtgcccagcctacaattttttcattacaaaaaaaaatccatgatttatatctaagtatagaattgctagattgtaggccaaattttcagtttttaacatgccaaattattccataacacttgtatcattctcttataatttatcccagttcctctcatttccctctgtctttaatcttatctattttaaaattagagaagctatcttgaaagtagtagcctttcccttctcattggtagcataaaagccctaactaaatgcatacctttatcactttgttttgtaaattttccttattatttgtcttatgtttatttaccactttaaaccacaagttttcttataattacttaatccttttatccctttgcattttaaaatttcacttataatattgctgaatgataaaattgtagagcagaattccaatgacgactgaagtttaaatgaagtctaaatttcatccatttagttctttgtaagatacaattagggggccgggcacagtggctcacgcctgtaatcctggcactttgggaggccaagtcatgagatcaagaccagcctggccaacatggtgaaaccccgtctctactaaaaatacgataattagccggacctggtggcaggtgcctgtaatctcagctactcaggaggctgaggcaggagaattgcttgaacccaggaggcggaggtcgcagtgagttgagatcatgccattgcactccagcctgggcgacacaagtgagactttgtgtaaaaaaagaaaaaatacaataaggggcttgtttttcttttttttcatcattttctttactcactttataacagggcctacctggtcccactggtataccagggccaattggtcccccaggaccaccaggtttgatggtaagctctcttctttaatttaatttccccccctttcctttctgacttctttcaggaatattaatattatttataatacttgaaaacataatgcattctcaacattcataatttataattttcttatgtaaaggtgactttacaatgatatggtgaataatatgcattctaagtaatggctccattttatagatggaaaaatgaggtatataaaaggaaagatttacaatgaaatattttgttggttgctcttgatgtatcagtgttgaagtcaattctggccatttcagaaagtcttttaaggcagttttctaatcacttgatgaaacatgtttcttcaaactgcaattgtttgtttaagaagagcaaaagcagggcttcataaaaaatattggctctcatttcctaggcgcctgggacaaaacagtagaattggtgaggggagtgatcactatgcaattggtcacaggtttttgtaccccaaaaacttctacagatcctgaatgtgcaaccggttctcttactttactagctctgtagtcactcttattttctatcctagtaaattctaagtatttttacttctgcaatacttagatttcattcaagtcatgttttggacttacagctttgctgttgccctcttaaaagggcaagaaaattgtatttcagtagaagtaatttctcatgtgccactctatctctcatctaccatatatttaagtgacagttttcattatacctttataggttgtacatttttgtttgtgacaattggtcctgcacttttgagtgaaggaaataatgtttgataactgctagaagaatctaccagaaaagattgtgatttctgctttcctgtaactttttgggggaagatgagaaaacccttttgtttgttttagttgtagacttcatgcaaagcatgaaactatggactttcgcactttttcctaattctgctgttggaacattggtgccccttgagtatattgttacaccttgaatttcctcaaccattgtggccacttaaccgattcactttacgtttctggatattccttgaattaacgctaattcaacaggtgaagccaaatcttagaaatgccaccaagaggccaggtgctgtggctcatgcctgtaatcccggcactttgggaggctaaggtgggtggatcacctgaggttgggagtttgagatcagcctgaccaatatggagaaaccccatctctactaaaaatacaaaaaattagccaggcatgatggcacatgcctgtaatcccagctactcgggaggctgagacaggaaaatcgcttgaacccaggaggcggaggttgtggtgagccgagatcgttccattgcactccagcctgggcaacaagagggaaactccttctcaaaaaaaaaaaaaaaaaaaagaaagaaagaaagaaagaaatgccaccaagatacaatatataaataaataggcccattgaggttaagaggcaacatacttgagcagaaaggtgcctatttaattttttaaaccttgaaacattctcagatacacaaagtcatattgtataaaaatcaaactggattttaaaaaataaacacatgctttttagaacttgagagttaattagagttaattgctttatggtacctaagtttacctataattctgatgtgaaaaatttgatgggtctgttgagattaacttttgaattgatttttgacaatggggctacctctctacctctgcccatcccagcttttttctcttgcccatttctattttgtcatcagaggtactcacattcatctagctcattttaatcaattaaaatgtgtgtctctgactaaaatgaaaacaaacaagaaaatactattttgatgggctttttcacaccttactctttctgaaactaaataacttttaaaattaacttattaatataacattttattttctcttttgtcttctcttcttagggccctcctggtccaccaggacttccaggacctaaggtaattttctttttctttatatcttttatttggtgtggattccttttcttactgtcagtgagatttttaaatggaaacttctctctccaggggaatatgggcttaaatttccagggacccaaaggtgaaaaagtgagtaaagaaagagagctggttattcagccctcagctttctctttttgtagtcatttgaactgtctttttctttctcttgcttcttgaagttatcttatcttacatgttatattactgtctgtggagattatgaagtatcaccactgtcttattttatcttgcaaacagggtgagcaaggtcttcagggcccacctgggccacctgggcagatcagtgaacagaaaagaccaattgatgtagagtttcagaaaggagatcaggtgagtaagtagggaggaagtcaatgaaaatcttgctatggatatgttaattagtttgatggtggtaatcacatcacaatgtatatgtatatcaaaacatcacattgtttacaccttagatatatacagtttttaatttgtcagttatacctcaataaagctgaaaaaaataaaatgataaaaagttaaaaataatatttctatgtaagtggaattccattaaaatgcattataagctgaaatgtggttatatataagggtatttttttttaaataacaaggatttgagattattaattttttttttttttttgagactaagtcttgctcttgtcacccaggctggagtgcaatggcatgatcttggctcactgcaacctccgcctcccaggttcaagcgattctcctgcctcagcttcccaagtagctgggattacaggtgcccaccaccacaccctgctaattattgtatttttagtagagacggggtttcaccatgttggccagactggtctcgaactcctgacctcgtgatctgcccgcctcggcctcccaaagtgttgggatttcaggcataagccaccatgcctggccaagatcattaaattttcaaaataactttatcaagatacagtctacatacatataatccacccatttaaagtgtacaattcaattttttttttagtgcattcacagggtagtgaaactatcagtgcaatctaactttagaaaattctgaggcttcctcaaaaaaatctccatacctatgttagttgtactccttatttctccccaaattgaccagccctaggtaatcactaatctacttcttggctctgtaaatttttctattctgaatatttcatataaatggaatcatacaatatgtggtcttctgtgtctggcttcttttacttagcatagtgttttcatgttaaatcactttgcagcacatatcagtgcttcattcctttttatggctgaataatatttcattgtgtaaatagtctacattttgtttatccatttattcatcagttgatgggcatttgggttatttccatttttggctatttgaagaatccattcatgtataaaattaggttatggtaagtcagaatgatgacagtgttccctacatttcactgatatgcaaggagaaagataatgttactctataaacctttgttgtgtttagaaataattatctgataccctgcttttgctagagtagatgagggaaattagatatatttttaaagcatactggcccacactttaacaaacagaatgtgtgcatttttgtttcacttaaatgtgaataagaaagttaagaataaaggaaaagttgtattgaaactctatcatcaatatgaatttggccatttaattatctcccaaaatatatgtatgccgtgtgaccccaaaatctctttgttttaggtattcttgctttttataaaatattttataagaataaaaaattgtcattattttcattttaagtgttgccttgttatttacctcaaatcttggcttgtatatagacaaaaaattaactgaaatgagcaaagatagctctagttaattttgcctagaagatttcaactttaagttagaaacaccctattatctttggttgtactacatgagtattcagttcagtttaatttttttagggggagatttatttttattttattttattatttaaaaaagtcaacctttattttagatacagggggtacatgtacaggtttgtcacataggtatattgtgtgatgctgaggtttggggtacagatcccatcagccaggtagtgaacatagtactcagaagttagttttacaagtattacctgcctccctctactcttagtagtccccagtgtctattgttgccatctttatgtccttgtgtccccaatgtttagttctcagttataagtgagaacatgtggtatttgattttttgttcatgcattaattcacttaggattatagcctccagctctaaccatgttgctccaacatagatgtagctgtggttcagtttattaaaaatgctcctagctagctctagtgcttagaatgaaaatgcatgttccagtattaacattgatttcctttcccctactactgcatagggacttcctggtgaccgagggcctcctggacctccagggatacgtggtcctccagtaagtacctaaagtgctttagcatcatttaatgtaaattggtattggtacacagtatcccatgaaccattgtgaaactatttttatgtgtacagggtcccccaggtggtgagaaaggtgagaagggtgagcaaggagagccaggcaaaagagtaagtgatgtaactgctaatattctttgcaaaaaaattctaaatgtgtgtgtgtgtgattttattctttcttcctacatcttccattgtttcaaaatatcactactgacattataatgttgatgtctaaaaagtctacttaatatagtccaagccaggaataaagcttgttatattctttaactttatgcttcctaactaacaaatgtatgttgttgccctatcatttctttgtatcctatagggtaaaccaggcaaagatggagaaaatggccaaccaggaattcctgtaagtagctaaggttctttccccctgcaaaactggagacatttatgtgttggtataacataaggtggcagagaagcagtatgacaaaaattgtggggtctggaaatagtttaaatgaattgaaattatccagtctttgtcttttgaatataattttcaatttttaaaaaattttgtgagtacatagtaggtgtatatatttatttatgaggtacatgagatgttttgatacatgtatgtaatgtgaaataaggacatcacagagaatggggtattcatcccctcaagcatttatcctttgcattacaaacaatccagttacaccaaatataaatttgaggttcctctattttttaaagtcagatttattgagatataatttacataaagtaaaaggaactatttttagtttacagttctgtgtttgacaaacacatacagttgtgtcaccaccaccataatcaagaacacttccatcaccttcaaaagttccctcatgctcttttttagttatcccctccctattcccctatcccaacccccttataacgactgatcttttgtcaatctctttaattttgcctattcccaaatgtcagatacattggatcatattgtatgtagcctttcgaatcaggatcctttcacataacataatacattgaattgtgtatcagttcatttttttattgctgagtagtatttgatagtttgaatataccatggtttgtttgtccatttacacattgaaggatattttggttatttctgtgttttggccattatgaataaaacttttatattcatataaaaatatttatatgaatataaatattcccatacagtttttttgtgtgtgtgtgaacatgttttttcagtaaaagttttgacaggtaattcttctacttactaccaaaaaggggcatgggaaataaaatatgtaagtccaagaacattatttcaagcagcttcagtatcaagagtatccgcagtaggcaagagtttttcaaagacagagagaatatttgatgaaatttgtaagttattctaagggaaaaggataattcttaacaagacaggttagaattactaaattcagataaattggtttcaggatattttactaaacaggcaatcctcaacttacaatctctagttcaaaaatattttatattataaaatatcaagaggtaaattcagggcctcagttcctggcttcttttggaacaattggtctttgtcttgattcaggcagctgtgatattcaacaattgcctcttagtgttttcaacaaattggggttgcggggtggggaggctgttctcttgttctctgtttgcactgggagaacccaagttgggtcaaataaaggcagccttgcaaatagccttcttttgaaccagcagacagatcaaataatgataattctctggatatggggctttgaaggagctccaaccctgttctttcctctccaattgctgctaggctgctggttttcaccttgattgtgaggagaggtggtgtgaatagagcaagttaaaatgccacaaagctctgagaggtggtgggaatagagcaagttaaaatgccataaatctctgagaggtggtaggaatagagcaagttaaaatgccacaaagctctgagttctcaccaagattcagctttttttttttttttttttctgagaaaacactccttgaattgctgcaagctttggttaagttctgaaagttaattctgactgaccatttttgccagtattctcattgcttctatggagaagacaatctttggagatttcctaacaccatcatttgtgctgatgtcaccctatcctctatgttttaaagggtttgcctggtgatcctggttaccctggtgaacccggaagggatggtgaaaaggtaagaattttaatactttgaagtgactggtttagtctagctaaaataatccttttcttctcccaggcttgagttataaatggaaaaagtctacataactagcttttatattcaaaatatgccttctttattcatcttttgctcatttttcttttataccacacttgctaaattttattccattgccataaatcacagtccatgttgcagaaatacattaagcattgtttaactttagcatttccactgtgaaaagtcattgcctttactttgagcatgtatcggcaaaacttctttttttccacaaagagaattcagcactattttagtgaggtcctcttactaaaaaggcttataactgtgaatgtagaacgtcgccactaaacatttccattctgtatgcaattattgtctgtaagtctgtggctaattctttgttgttttttcccccctactgggccaatgcagtctgactgaggtcatttatttagttacctatttttcaagtgactttgaaagattgtatgaagcatacaattaccagatttttagcagggcacaaaataaccagtcctccaatccctcttgtttttaattgcttcgtatcaaaaactgaaagctttttggtttttcaggcaaggaaggaaaggcgttacaaacttgaatgtacccagaaggcacatattttaatggtggtttatttttaaattaggtccaagttctagcatggcttaaaaggcacaattagaatagatggaggtaggaaatactccgataaaatgattttttgtcaaatagtatttgtatatagatggatggcttctatgaacaagtttagagtcagaatagaagtatgaaaaagaccatccttgtgtcttggccagtagtagagtaacacttgaatattgaatattgtggtttttttcatgctgttgtagctactaatcaaggataaaagttttatctgaacttgtctttcattagcttctaagagcaagctcatgaaagcaattcagatttactagctattattgatgatagttaagtccatcacatctaaaatgtctgtcactaatagaaatggcactacatttatgtccttgactagttttatgagaagaaacatggctaaatgtaaaaaaaaaaaaaaaaaaaaaagtaattttttcactgattctagtgctaccattttttttctattatcttctttatagagtatttgtagttggctagaaataggaatcttaaaaatcaaagaatattacaactagaaataccttaaaactctggtccaaaaatctttattctttctatataaaccagagaagttaattaacttggtgaagattacatagctagtaaatctgagacaccatcacaggttaggcttagctcagaattgtttcattacttcatgttgcatttctcatttgaggtattttatgattgatttctgggtctttttggaaagtttctcttatattcttgaggaaattgatgttttcatgtgaattttactaacctattttacaattgcattgaacagggccaaaaaggtgacactggcccacctggacctcctggacttgtaagttttttttttttagtcttcgtttatcaaatttattaatgcattatcatttttgtgccttaatcgcatactccctactttttcttgatagaacacaaaatttcaagtcattatcaatttctactggcttaaaagtctttacatctaaaatcttcagtaatgttgacctcaaggtctttgtattgttctgcctatgcattacttctgcatggtaaaggtctaaaattatggcattgggttgttttgcctcatgattgccagatcatttctcaagcaaccagcaggtggtgcaagtgttgcttacaaaggttcaatgaaaacaacaacaacaaaacaaaacttggggaagttggggtgggggtgggggattggtcctttcccctgcagagctcaggagaaagatagatttggtcttaataggttttctcaatttgtaattgtctgattcacacttctttctttcctgagtgtgtgctttctagggacttttaataacgcatgtaggaagctgctttatgaaagaataattgagggtggcggagctacagattttctgtcatgtttgtgttcactatgaaatttaagtcaaatatacttccagtcttattaggaataaaatatcattgctgaggtttaacatattggtttttctttggttgaaatttagtaagactcttgacttcaaactgcattgaagccgcaacagtgcgaatgttggaaaacttatgtgtccagacatgttagtaacattaacttaattcgtattatccataatgagtctcagttattaatacttaggactgtactaaatctaatgaggatatacttaaagaagatcttagatattttttattcactttcattttaaaatcagcttcagtcctctaggaaataatctctttataaaatgagaagataaaattttaataagtatcagaagaaatggaaattttgagagtacagtcctatttagcagcctagtttcccttttgaatcactattccaatcttaggtcccacaactttttgtcttcttttgtgtgaatatttcttatatccatccaatagagacaggatgaaatatcacactgctattaggtgttgatttgtacatcagactggcagtctcttaaatctgaagttcatttacctttataggtctataagaagaatttgttaatatttaatttatttaatattaagttttttaagaaaatacttaatgagttacaagaatacagagtaaaaagaaatgattagttagttgggtttaatcaataaagaacatgggttttatttttaaatttttttggtatatagtaggtatatatatttatgggggagttttcttttttaaaggaagaaataaatgtgggttaataaagagaaagattggggaaaggcattacacatgtttggaatgaaatatgcaaagacatagacaagaacgtgcaagttgaatgaaatggttagaatcagacagacttcactataataaaaatttattgtaagacgtagtaggagattaaataggtgagagaagtattggaagtgagaggtgacttacagttcaggattaaaagtagcagcacttatagtaaaaagtagtgagcaattttgagtccttaagcagaatagttaacacacacacacaaatggtttttgaggaagcatatcctaacaatagattggaattcaagggacaagatcagaggtgcttctattactctaagtgtgagttgataatatagctgtggcagcagaaatcaagggagcaaattggagagacgttttctgtaaagaattgtcaggcttaggagattggaatgaattgaatgtgaattataggagaagagacatcaaaaatacttttagttttatatgcttcgggctcaggaacatggtaatgttgttacttgtattggacattttctaatcagttggaggatgggagtgatacaaaatgtgactcataaactatgtgaaaatgatgacattgtaatcatatgtagctcccataatgttttcaggagaacaaggcttttcttctttgcatttctttattttttttttctttggtaataaaggtaattcctagacctgggactggtataactataggagaaaaaggaaacattgggttgcctgggttgcctggagaaaaaggagagcgaggatttcctggaatacagggtccacctggccttcctggacctccaggtaaatgagattgcatttatggccttgttcttatagcatccttactaatccatgtatactttttatcacattagttccatggtcagcatggaagtaggagacacaagtcctttttaattgacagatacttcccaactcttactataccttctctcaccatattactcacttgtactttaaaaaagcccaagtgaatagtgtcctttaatcctaagattcctatttctacattttattttttattgatacataattgtacatatttatgggatacatgtgatattttaatacatgagtccaatgtataatgattaaatcaaggtaactagaatatccattacctcaagtatttatcttttctttatgttgggaacattcaaaatcttctcttctagctgttttgaaatatacagtaagttgttgttaactgctgtgaatctactgtgctaccaaacactgaaacttattgcttctatctaactgtatgtttgtacccattaaccaacctttcttcatttcccccgacccttcccagcccctggtaaccatcattctactctccacctccatgagatcaactttttttttttaacctcctacgtaagaatgagaacatgcatttgtatttgcctttctgtgcctggtttatttcacttaacgtaatgtccttcaggctcatccatgttgctgcaaatgatagaactccgttcttttatggccaaataatattccattgtgtatttataccacatttcctttatctgttcatccactgatgaacattcaggttgatttcatatcttggctattgtgaatattgctacaataaacatggaagtgcagatatctctttgaattactaatttattttcttttgaatatatacccagacgtgagattgttggaacatatggtagttctatttttagttttttgaagaacctccatactttttttcataatggttgcattaatttacattcccaccaacagtgtgtgagagttccctcttctctgcatccttgcagcatctgttattttttgtctttttgatgatagccatattaactggggtatattttattattaataaattacaccaaacaattcttaatttagtaggcaaatcatcacacttttcatgctaatagggaaggatattctccccaagtaatgcctagttttgcaagatttcctgtataaaaatggcaagcagcgttatccacctaaaatttcagaaatacctaactagaaatccccatggtgattttgttatacaataaaatcttagagctcaatactgagttttatattattccctttgaaaacacacagtatagtggaacatttctaatttggccacaaattgagtactgcccttatctagaatgtttatttgaatgttctctgaaatagggtaataatagtgatttccgtaagatttctagatgcatgtggtacagtgcctggcacacatacatattcaataaattattattccttttccttcaaaaatacgtggctaatgaaatactaaaatgatgagatgagtgatattcagtgatctttcccaagagaaagaaaataaatataggttccattatgctctaaatgcaaacttcagattcctaaatgtgaacttcagattcctaacctcaagatagtgaattaaatacagactgtatctggaaaattgaaataaagaattatctcaggatgcagtaaaagagataaggagttgggaagtatgaatgaaaagttaagaggtatgaaagataaacctagaagctccaaaattatctcatgagggaggtcaaggaggagagaatgggacaagaggcagcatttgaaaaaaaataatggctgagaacttccatctattaaaaaacacatgcatcactatgaaaaagctcatgaagcactaagcaatagtaaaataatagtaatgcaaaggtccataactagacacattgtagggacatttcagaattcagggataaaaagaagctcttaaaaactatttgagaacaaaaggccaatcacctacaaagcagtgagtcagaggatgataatggagcacattttcaaagtgataaggacaaattactatgaattagggattctgtattacattaaactatcatcctaatgtgaagatgagatacataggaagtttaacaccttcagactgtctctgaaatagttactggaggttttactccaaaaagaaaaaagggaattctggataaaatgagaatagcggtaggatgcaagaaccaaagcttagaaaatatattagtaaagcatattaagtctaaatcagtactggttattttttaaaaaggtgttttaagtaacaacttggagctataattgtaaacattattaacgtgatgtgtagatgcagagagaataaggataagagtttttgtcttgttagggaaagataatataaatcttgttaactgtataaatttttagaaatgtatacatgtttaagtacataggttaaaatgttaatagtagccactagagaagaatagaaataaaatgtataacatacacaccaattgaagaaagaaaatgactaaaagtctcatatatagtataagttaagatgggggcaaaataaagacaaatctgggtaaatagaaaataaaatataaggtgacaagaagaaattaaaaataagtcagtaactccaacaaatttgaaaggactaaacactgattaaaagacagtgactaaaataaaattgaaattaaaaatacctatatatagtgcacagtagacatatctaaagcaaagtgacagatacaatctgaaaataatgcagtatatattgggcaaatgctatacataaaaaagctggtttagcaattctaatatagtatgaaatataattaaattcaaaacttgaaactataaaaattctagaagaaaatgcaggaaaaacttttctggacattgacctaggtaaagatttatgactaagacttcaaaagtaaatgtaaccaaaacaacaatagacaattgggacttaattaaactaaagagcttctgcacagcaaaagaaacaatcagtggagtaaatagcctacagaatgggtgaaaataattgtaaactgtgcatctggcaaaggactaatatccagaatctattaatataaggaacttagacaaatcaataagagaaaaaaataaccccattaaaaactgggcaaaagacatgaacagaacacttcttaaaataagacatatatgtggccaacaaacatgaaaaaatgcttaacatcactaatcagcaaataaatgcaaagtaaaaccacaatgagatactaacacattagaatggctattattaaaaagtcataaaataacagatttgggcaagaaataatttcagttattcagagaccatctgattatctaccagaaagctttaaaaaatccattgacaaattcccagaacttaaagagaatatgtgtgcaagatggccagatctgagtagcatacttaatttgccttcctcttcaccagcaaacgtacaagagaaaaaaatacacttcacaatagtaatagtattaaaattcacagtagaataaccccaacaatacatgtgtaagacttctttgcagaattttgtaaattattattaaataatataaaattactaaatagagaaataaatttaattattacttgatgtgaaaaaccaatataataaacagttgattctaccaaaaaataatctttaacttcaaattaatcccattcagaatcccaaccagtttttgaaaatgaaactgaaaaatttatttagaaaagtaaatttgtagatggttttaaaaatgaacaaagatgagcgtattttccttagcagttttgaaaacattataaagtcatagtaactaaaaagtgtgttaatggtgcatgaatcaccagtgtaacagaagaatgtccggaaacagagccatgtttatatggtaactttgaaatacctttttatcttgctaatgactttccggtatttttgagattataagaacagattgtcaaaggatggggttactagtaatttccaaaagtagtaaacctactttaaattattatttcctaccctcaaactgttacttacattctttgaaacttttcaacctttttttcagacttttgagtctcatagaaaaaaaataacataaccagaattatatgttaaaggaagatcttatcattatctaatgtctcaatgagaactaaagtaacatctctaagatgaaatcattttgatcacttttttgaatcttaggggctgcagttatgggtcctcctggccctcctggatttcctggagaaaggggtcagaaaggtgatgaaggaccacctggaatttccattcctggacctcctggacttgacggacagcctggggctcctgggcttccagggcctcctggccctgctggccctcacattcctcctagtaagctatatttttctcctattaagttctatttttgtttttgtttattttgtttataagtaactctagctaaaggttggcctcatttgttgcgtttctgatatctaagaaattctaccactgcttctgctttttgggttttggtagttcttggatgtttacatttgctcttcatatagtatttatcagcaatgttatattttccttttgcttataggtacttttatttcttcagagaataggtctttttctggcttgtcaggctttcttttgtttaatcttctggatatttcacaattagcttgctatcctttctttatcttactcaggtgatgagatatgtgaaccaggccctccaggccccccaggatctccaggtgataaaggactccaaggagaacaaggagtgaaaggtttgatctccaaacatattcattccttcattttcttcattctttcaaatcatcagcaaaatcccctgtatcctccatcacaccttagccactgactcccatggtcataccccaagaccatctcattaccaatagtgttatacttacatgaccttggtttcatgcatcccattttttggatcgctctcttctttctagcttactacctctagtaacctgactccagcaatactccaaccccactgagacctagcaactttgactaatgcttaactttttgatgtcctttcttccctcttaaccttgcttaagttccattatcaatcactgtaatcaattccattcataaatccatgattcctttgcccttctctcacttcattgcactcacttggaacaaaagcataatccaaattttcatgttttctgagcctacactttctcttctcttttcaagttttaacagttcctcccctattcttaccttgcttcctacttcactgaccaattaaagcaataacaagagaactttcactgattgctaccaccatatttacttacctacttgcacctgtgcccatatagtctcccttcttgcatattactgttactgctcctatctaaagccagttcttctatttatacaatagattccatttcctcttatttccccaaggattttttttccagcaatttttgcctctccgacatcaccaatttttccctctctattcagtcattccaaggagcatacaaatatgcttttttcacctatctaaaaaaatgtaatcctacattccctgccagctgtttctctatttttctattctcatttgcaacaaaacttcctaagaattttctcctcattacctctagatactctcctcttgttttctcttaaacatactccaatcaagatttcatcccctcttcccccaactccccactgcctaccactccacaaatgctggtcagtcaccagcagtctatatcctactaatccaaatgtcaggtctgtcctttttttgcttgctttttgccttctttaaacatttgcatcccttagctttcagtacatttcctgttttttttttttcattcctctgtggtgtacatatatgtgtgtgtgtgtgtgtatgtgtatccatgtaattaccatctaaaccaaaatatagaacattttcaggaccctggaagactcttgtgctccctactcagtatcccccaaaggtaatcactattttatcctctggcatatattaatttgcctaatcttgaactttgtgtacatggaattatactgtatgagctcttttgtgcctggtttctttagctaaatatatgtgagatatatctatgttcttgtttgttgcagtatttttccaccattctttgttttccactgcacattacctcaatattctaatgttgatggacatttggtctggagctattgtgaataaagctgtcataaatattcttgtacgtgtattttttttgtaggacataaacactaatttttattggggatatatctggaaattgaattgctgggttataggttaggtgtaggttttgtttcatagatattaccaaaccatgttccaaagtgattttcatttgcgtttgcctaatgacttgattatgaactatttccttacagtttttatattctcttttgtaaagtgcctgtctttatctttaatttgattattggatatatgtattaaaactatcttctgttttgttaacttttgtttaacaaaagttgctaattaaatgaaatcaaattaattaatttcctattttatcgttagtactttttatgcactgttttagaaatctttacttatctcagaggcctgatgatattcctctgtgttttcttctagacactttattgttttacctttcacgttttgatctttcttcaattaatttttgtgtatagtttggagtagggatcaaagttcatttttcccatatggatgtccagttgactcagtactatagaacaaaagatcatcaattaccccaatgaattgcattagcactttttgtagatcacatgaccatatgtgtgtaggtctgtttctgactgctctattctgttctgttgtttcattagtctctctttgcaccaatacgatactatcttaattactgtggctttattgtaagtgttggatattctaggttctttgcattattttgtgtgcatcttagaattatctatccaacttttaagtttaaaatgctccaaggttgagtccttgttcttcttttctatataaactcatttattcagtcttgtgactgttaataccacctaattgcccatgacttccaaatttatgcctcctatccagatataactcttttcctctagatttgtgtatccatttgcctagtcaacattttgaacttgacatcctgatcaaattgaagtcttgatttctgccacctcctccccatagttgctgcactcacatcttcagcttcttacttaaaaagcaggccactttagccttctagttgctcatgctgaaaaccttggagtcatccttgattcccctcttcttttgtatttcatatatgatccatgagaacatctcattggctctactttcagatatgtctataatctaaccggttctgatcattttcattgcagtcactttgaaatgagctaccaccatctctctcctagatcattgcaacagtagccacttaagtggttaccctgtttccatcattgcctttagaggctattaacatagcagctagagtcatcccttaaaaacttaagttataacatgttgcttttctttttaaaattttctactagattctcatttcactcacagtaaaaaccacagcctttatatttcttatatgcctatatgccattcgttataaactgtcaactttctgaccttgttcccctccctcattctgctctagcaatctggtctgcttgctgttccttgtatataccaaacatggctattctttctgcttgggatgttctacactcttatgcacatgtcatgtcctttaagttttatcatataacaacttctcaatcaagtctatcctgactaccctatttaaaattgcaaccccccacccttccctggcatactcaataccacttatgtagttctattttttcctataaaaataatatattttaaagcatattaaatatttaatgtatatttaatttttttagacagggtcttgctctgttgcccaatctggagtgcagtggtgcaatcacagctcactgcagcctcaatctcctaaggctcaagcaatcctcccactttagcctcctgggtagctggcaagtacaggcatgcaccaccatgcctggctaatgtttttattttttctgtagagatggggtttcgccatgttggccaggctggtcttgaactcctcatctcaagctatctgcctgcctcgggctcccaaagtgctgggattacaggcatgagctactgcagtctgcctatacttaatattctattaaaatatttcatatatacattttgataattcatttcctttattgattattatccctttcccctggtagagtgtgaggcatgtagacatgaatttttatccatgacttttcttttgctcaccaatgtaacacaagcatctggaacagttcttggcacacagtaagcactcagtaatttatttgtcataaattgattcaggatataggcttctccaatcacaccattaagtggaaatgctgtcccttagtgctaacatttttagaacctatctatagaaggtatatgtacccctttcagtaaaatttgtttgttattatgatttcactaggtgacaaaggtgacacttgcttcaactgcattggaactggtatttcagggcctccaggtcaacctggtttgccaggtctcccaggtcctccaggtaaattatgcctcagggtaaccttctaaatattttttggctagattttgttgagcttatacttttagaatgttaccagtttctcattttataactagtcactcatatctataaagaattaagtatgaaatgcctccatttgttatcaaattaattatgctcttgtttctaatacctgaagctaccaatatattctattaaagcattttgacaatataatttcaggaaatatatcttccccattttccatatggagaagaaaatcacttatacagagtcagacttctttcttccagaatactgggagaaaagttcataatgcctagcccctgagtgtagtttccagtggcagagattccagtcactggggatgtatcacatgttgttgttcaggaataggggttctattggagtttggcaatcaactgccagtattcctctctctctatatataacacatctatccccctttccagtcaaaactatatgtgatatctgtcagaccctcaactgtttcatttaactgccccttaggtatcccagtattctcttgaaattacactttatgtttgagtcagggctgagaatagacaccagatctcttacctttctgtctagtgagtctactaaggacaccaattcatttggaggttgggaatactttcaacaaatcttgtagacattattggacattaataatctagccttgtacctctagtctcatggttctcaaacttgagagtgcatcacctggagggcttattgaagcccagaatgctgagcctcactctcaaagtttctgattcagtagacctggatgaaggctcaagaattagcatttctaattagtagccaggtggtgatgatgccactcatccagggatccatttggagaaccactgctttagtaatgtttcctctagtctttgggctgcaaatgtttctcataaaccaaatttcagggaatgacaaaccaaagaaaggactggtaaggatctaggaaaactgcataagtcagaacaaagatattcaaaccttttcattatcttttttctccctttggcaatgggaacatcataggaacccaggaaacgttgtgcatagtatttggcagttgcaaggtctgagaaagtctgctttggagttgaaagtttcttaggatacaatattgtatgtaacatgaaatgttaaatttattttttaaaaaggatgattacctcattttgtgaacataaaaggaaaatacaaatgtgacttaaatgggattgaatggggttcttattttaaaaacttgactttctgacttgatgatttctgtatgagctttgtcaggagttcaagctcaaagcttacgttattgtgtgtgtgtgtgtttgtttgtgtgtgtgtgtgttaggatctcttggtttccctggacagaaaggggaaaaaggacaagctggtgcaactggtcccaaaggattaccagtaagttttgagtatattataaaacaaaaagaagtagaaggaaggcattttacacattgattttcaattattcatatatatacacacatatacaatttaatttttccattaagttgtactttgtttgattccttgactcttcctgactcacatgcctcacttgattcagccctttgtacattaaatgttattggatgggttgaaggggtaaactggagagaagaaaatgttagaaaaaaagaaactgattttctttttctctttcttctttttccactcttttttctttttttccttactcatttcagggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctgtgagttggtttgatatttttggttttgtgatgttaaattttcacttagaaatgttttctaagttaattcaaaggatgggactgatgctgagataaacacccaatcaatgcttaaaacaatgtgaccatacagtaatggcacattgttactgactacgtagggtttctgcactactcttttctttcacttgttttgtaaacttatttttcttaacccattaatattgaatactattttctatgaataggtgggcaggaggttaagatgtttatgagacagtataaggttccccatctcttaacccccacatatctttccttgggtttacttaaacctcatgactgggcatggtggctcacacctgtaatcccagcactttgcgaggctgaggtgggcggatcacctgaggtcaggagttcgagaccagcctggccaacatggtgaaaccctgtctctactaaaaacacaaaaattagccgggcatggtggtgggcgcctgtaatcccagctactcgggaggctgaggcaggagaatcacttgaacccgggaggcggaggttgcagtgagccgagattgcaccactgcactccaccctgggcaacaagagcaaaactccatcacaataaattaaataaataaataaataaataaacctcataaccagcagtttaacttgtttctatatatatagtaagcttagagaatagtacaagtagatagccatgttcaatgtgccacagaactgaaagatttaacataaatgaacaatcttattttgtacataacacacagcccaggatatttaggtaggaagtgatattttataatgttatctagactataacctttctgacttacactaaaatgtaagctgcataaagtcagagatttttgtgtatttttgttttctgttgtatcaccagcacttgacacatagtaggagcccaaaaatatttgttggaggaatgagtaagtggaatgatcacacataccatctcataataccactcacttatatagcttttaagaagaactatttatggctatatcctttccccagttgtattcagtaccaacctacagatagttgttgtatctatatgtttctgtattaaacttttccctttttagggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtaagtttactgtgttttgttttaaacttggtgcttaaaaacagaaatttattatgttttggctactcatggcttcctttcccgagaggtgtgtttccctggccgtttatatttgaactcttcagagcatcttagcaagggatcacaatggtttttataagggggtttctttttaaatcttttctaactgtttcattgttactgttaattttgctctttttaagtacatgatacataatgcaaagtttaataaatagttataacagaagcacacaggtagctaccacacacatcaaaaaatagaatgttaccagcatcctagaaacccctaaccttttctccctgtcatttcctaatcacaatccccttcctcctgtctgctgtcttgacttttacatagttttcttccattacccctctgttttatgacctctgtatgcatttttaaacagagtattttaattttgtttctttttgaacttcatgttaaaggaatcatagggtaagtgttttttatattaacttttcgtgtggctatagtgtattcatttttattgctatatagtatttcattgtatgtatgtttatgtgtgtgtgtgtgtgtgtgttacagttgattgatccattctatggttaatggttaattgggttatttacagttcaggtctattatgaataatgcttctgtttacagtcatatagatagatagctaggtagatagatagatccctatatctccttgtgttcatgtgctcacacttctctagggcaagagttggcacactacagaactacagtccatggaccacatccagcctaccacctgttataaataaaagttttatgtgaacacttccacaaccattcacttttgtctgtggttgtttttgcactacaactgaagagttgagtagttgctacagagactggatggtccacaaagcctaaagtatttactctggtcctttacacaaaaggcttaccaatacctgggctagggtatgtatttaagattagcattttcaaagcataggataagtgcatcttccacttgactggataattacaaactctatccagaccaattgtaccaatttttactaccacaagcagtgttgaatattttatgttgatttacatccttggaaacaatttgtattgtcggacttttacacttttgccaatctgttgagtgtgatattttgcatttctctgattaaagtttagcaccttttcatgtgtttattggtcatttgaatttgcttttgtgaaatgcctaatcaagtactttgaccaattttatattggattatttctttttttattgatttagaggagttctttatatattctgtgcattagttcttagttacctatgtattttgcgaaaagaaatctttacctactgtggcttgccatttttactctttgtttggtgtcttcaatgagcagaaaacaactttcacatcatcaaaattatcaatcttttctctcatggttagtgctttttgtgtcatgtttaggaaatcttttttttcttgagccaatttcaagttcatgtttccattaataagaagtagatatacttgaactttgcacatgtaaaacctaaatgtacctattagccaaaaaaatattttccttgtttactacagtttgatttttaatgctcttttggcctacattttaaaaatacttatataggtaacaccctgttttaggggtttccagagaaacagaaccaataaaaaggatggacagatgggtagattagatagatagatagatagatagatagatagatagatagatagatagatgagaggtgatttattatgggaattgacttacatgattatggaggctgagaaatcccacagtaggccacctgtaagttgaagaactagggaagccagtagcttggctcagtcctagtctgaatgcctgagaacctgagtggctgcttagtacaagtcccagagtctgaaagccagagaacctggagttgtgatgtccaagggtaggagaggatgggtgtaccagtttcaaaagagagagagcagagaattcacctttttttctgcctttttgttgtatccggtccctcagctgattggatggtacccacacacattgggtgagggtggatcatccttattcgtttcactgattcaaatgtcagtttctttcggaaacagcctcacagacatatctagaaataatgctttaccagcgatctcagtatctcttaatctagtcatgttgaaacctaaaattaaccattatacatcttgaatcatggaagtccttaaggctgtcatatcctttttctttttgaaattctatccttctgttttatatatttcttgaatatatagtggaagattgtttttcttgtgaatttttgttagtttacattttcaaaagattgctgataattttcttttttgtttttaattaaaaagagacctttagttgagtaaatacttctcatttaccattgatttactcttgctttcaggtcctaaaggggatccaggtcagactataacccagccggggaagcctggcttgcctggtaacccaggcagagatggtgatgtaggtcttccaggtatgtgaggaatttatttcaaagtaacttcaacaccgatggcttttttttttttttttttgacagagtttcgctctgtcacccatgctggagtacagtggcgtgatgttggcttgctgcagcaacctcctacttctgggttcaagcagttctccctgcctcagcctcccaagtagctgggattacaggcgcccaccaccacgcccagttaatttttgtatttttagtagagacggagtttctccacgttggccaggctggtctcgaactcctgacctcaggtgacccattgcctcagcctcccaaagtgctgggattacaagagtgagccactgcacctggccctgatggcttctttctttgaacgttttcctttcaataactgctgtttctccataggtgaccctggacttccagggcaaccaggcttgccagggatacctggtagcaaaggagaaccaggtatccctggaattgggcttcctggaccacctggtcccaaaggtatgttggaatgggtagcaggcagagtaggttagaagtttagcatgatgttattctctcataaaattcattcaacaaataaaatatattaattgcaccttttttctctgtgctataaagaatgtaaataaaaaatcacagtgtattttcactgtaagttcattatctttatctaaaacagtccagacaagaaaatatctacattttagatatgcaaaagtgatatataagcttaaaaatcacaggaattattgtgttttgtgttcaccatagtattttcagggtttagaacagttcctaacacatagtgtgcacttgatgtttattgagttaaaggattttttaaacagaaaacagacttattgcagatgtgtagccaagtaatgttttatgctaaataatattttcttgatttattgaaatttttagggcttatgcttcagttctgctttattcctcacagaatttattctcacaaatggcaagagcacacagtggtctgaggacagttcttaaatatatctttactcatttatacaaaatgctttcaaaagtatcaggtttgattttatgtgtgtatgtatctataatatctgcagttatttttagatcatttccaaaattatatggtaggccctttgtcatactacatccagatataagcagaagaaaagttcttgggcatttttgtgtgggattcattccttacaatttagttctatcttattatataatagccctcattttcttcagaaaagcatatgttccacatacattagctctatgtgaaaataaaaggaatgtaagatgattgagaggattgtaaggcttaatcctaagtagtagaatgtcattgtgcttttgacatcttactgttgtcactaagcatgagtagaatgtgggtttgggaatttgaatatctttcttaaagtgcctttcctttggtggttaaaaaatgacttatcattttacaggctttcctggaattccaggacctccaggagcacctgggacacctggaagaattggtctagaaggccctcctgggccacccggctttccaggaccaaaggtctgggacatttttctttattccttctcattttcttatctttcccaccttccttatttctagctctctattttgactcagatatcatcccaagccccaagtctttactataaatatacagataacttattatatttccattaaaaaaatatttaaccccaaatcatctttaatagtccaaggtcacatttggagcaaaaaaaaaaaaaaaaaaaacctaatttctgtacctacttttgaatgcccagttctttgattagagaatacaggcataccttggagatattgcaggtttagttccagaccaccacaataaagtgaatatcaaaataaagtgaatcacacaactttttttgtttcccactacatataaaggttatgtttacactatactgtagtctttaaagtgtgcgatagcattaggtctaaaaaaaaccatatgcataccttaattaaaaatactttattgctaaaaaattttagcaatcatctaagcttgcagcaagttataatctttatgctgggggagggttttgactcaatattgatggctgcccactgatcagggtgatggttgctgaaggttgggtggctgtggccatttttttaaataagacaacaatgaagtttgccacatcaattgactcttcctttcagaaaagatttctctgcagcatgtggtgctgtttgatggtattttacccacagtagaacctctttcaaaattggagtgagtcttctcagaccctgctgctgctttatcaactaagtttatataatattctaagtcctttagtgtcatttcaacactgttcccagcatcttcaccagggtagattccatctctagaaatcacttttgctcataagaagcaactgctcatctgttctacttttattataagattgcagcaattcattcacatcttcattctctacttataattgttgttctcttgctacttccaccatatttgcagttacttactccattgaagtcttgaaaccctcaaagtcatctgtgagagttagaattaacttcttccaaactcctgttaatattgatgttttgacctcttctaatgaatcctgaattttcttcatgacatctagaatgaaacccttttcagaaggtttccaatttgttttgccagatccataagaagaatcactatttatgacagctatacattacacaatgtgtttcttaaataataagacttgaaaattaaaagcactctttgatccatgggctgcagaatgggtattgtgttagcagccatgaaaagaacattcatctctttgtacatcaccatcagagctcttgggtgactaggtgcattgtaaatgagcagtaaaattttgaaaggaatcttttcttctgaggagtaggtctcaacagtgggcttaaaatagccagtacactatgctttaaatacatctgctgtcatccaggctttattgttccacttatagagcacaggcagagtagatataccataattcgtaaggccctagaatttttagaatggtacataagcattggtttcaacttaaagtcagcagctgcattagtccctaaaaatagagtcagcctgccttttgaagctttgaaaccagtaatttacttatcttctctagctatgaaagtcctatgagcattttattccaatagaaggctgtttcatcaacatggaaaatctgttgtttagtgtagtcactttcatcaatgatcttagctagaacttgctgcagcttctatatcaaaacttgctgcttcaccttgcacttttatgatgtggagacagcttcttcccttaaacctcacgaaccagcttctgctagcttccaacttttcttctgcagcttcttcacctctcagtcttcagataattgaagttagggccttgctctggattaggtttttgcttaagggaatgttatggctggtttgatcttctgtccagatcactcaaactttctccatatcagcaatagggctgttttactttcttctcattcgtgtgttcactggagtagcacttttaatttccttaaataacttttccttcacattcacaacttggctaactgtttagtgcaagagacctagccttcaacctaccttagcttttgacatgccttcctcactaagtttaattatttccagcttttgattttaagtgagagacatgtgactctttctttcacttgaacacttagaggccattgttgtgttattaattggcctaatttcaatattgttatgtctcaaggaatagaaagacctgtggagagggagagagatgcggggaaaatggctgatcagtggagcagtcagacatttacaacatttttttattaagttcaccatcttatacaggcacagtttatggtaccccaaaacaattatgtggtaacatcagtgatcacatatcaccataacagatataataataattaaaaagtttggaatattgtgacaattaccaaaatgtgacacagagacaaaaagtgagcacatgctataggaaaaattgcgctgatagacctgctcaatgtagggttgccacataccttcaatttgtaaaaagtgcagtgtctgcacagcacaacaaaatgatgcacaataaaataaggtatgcctgtacgatggtctgctccctctgtgcatctctatagagtcatcatcccatgtcatctctgttcatgcctgtgtgatgattggttgaaatggtgttgaatatcatttccagaccttgtatactgttgttctctgtcccaattccattacagatacataatgcaaatcactgcaattgacttagtaatactaataataaataatactgtgtttgagttacttttcattccttttattatttcttatctaatgttaagctttcctgagtcaaccttcagcaaagagctgctgtggcatgtaattatcgtgactatttttatatattttatctctgcgtcattgatttaaacctcctgtgttttgtaattattacttatttttcatgggaaaaacagttaacccgtgacaccagttctcatgagaaaaccacttctctattggttgattctctttattatgaacattttcaaatgaaaataaaagtaaaatgaataatacaatgagctttcacatatccatcacccagattcaaaattattatgattttataacatttgcttcatctagtcctttttactttgcttaaatattttacccaaatctcaacacagtatcatttcacttataaatgcatcagcactcatctctaaataaattgacattttatacaaaaaccacaatgttgttatcatacttagtaaaattaaaaataattgtttagtattatctaatactcagcctataatcatatttccctacaagggtagtctgttctttaatctcatgctctctcagttttttttttttatcctgaaaccagtccaaatcatctaatttgttttactaaaccctgtttccaatccttccatatgttttctccaacataccaattactttttatttaattatcttctcctctccccccatggaaggaaaagtattgtcttgtattttcggcattaaattctctgtggcaaacaataaggacagaaaagtcatgggagtttttgttgtgttttgtcatgtgtatgctcaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtatggaggctgtcactgcatctcaacttgcttttaacttttatagaaattgacacctttgggaaagtttatgggtgataagcccaattaactggaaaccctatgctgccattctgttactgctacacatttttttcaatccttcattgattatttttgtcttttatttcattgaatagataataaaatcatggcccggcacggtggctcactcctgtaatcccagcactttgggaggccaaggtgggcggatcacctgaggtctggaattcaagaccatcctggccaacatggcgaaaccccgtctctaccaaaaatagaaaaattagccgggcatggtggcacatgtttgtaatcccagctacttgggaggctgaggcaggagaatcacttgaacttgggaggtgaaggttgcagtaagccactccagcctgggtgacagagtgagactttgtctcaaaaaaaaaaaaaaaaacaatcatatatgttataaaagtaacactgagaagtcttccttccaacccatcttcatccactttgttcctctccatcctcctgcttaactattttttattctcctttcttccccccaccctccccccataccccaagacagagtcttgctctgtctcccaggctggagtgcaatggcgtgatcttggctcactgcaacctccacctcccaggttcaagcaactctcctgcctcagcctcctcagtagctaggattacagatgcatgccaccaggcccagctaatttttgtatttttagtagagacagggtttcaccatgttggccaggctggtctcgaactcctaacttcgtgatccgcccgcctcggcctctcaaagtgttgggatccttctggtgtttcttatataaataccagccaagaatttgttttattttctctgttcttaaaggagaaggtattttcttttgactttatttgcactttatttttttactgaaatttgtatcctgaagatcactccatatcagtagatggagatcttaactttttgaaaataggtgcctagtgttaaattgcgtggatataccatagttcatcccagttgctagttgctagattggatttttgccaatcatttattacaaataatgccatagtgaataatctttcatgcatattatttcagatgtgttcaggtataatagtaaaataaagtgatgaaaaaggattttctgaattaaagggtaaatgcatctctggatattgtcagattcctctcaatttgcaccatttacactccacccacaatgtatgagtgtgtttccccacagccttgataagtgagtatgctgacaaactcttggatttttgctaacctgatgaagtaagtaggtttctaagtatatttttaaacattttattgttaaaaaattttaagtactgtgaaaaataatagtacagttaacagctgtatatctaccacccagattctacaatgaaccttttatctccctgccaacgttttgttttttaaaattttaaatataacaaagtagacagaactttattgggactactatatacccatcactgatattttactgtcaacattttactatatgttgacaaatactatatactatttgtcacatatctatccatccctgtctccatccattcatctatttttgatgcatatcaaaataaattacaacaacaatatacttctctctaaatacttcagcatgcataccataactaaaattccatagctgtatattacttttcttctgatatgtaattcacattaaatgagatacataaatcttaagggtacatttactggattttgacaaatgcatacacttgtataacacaaaatctttatcaagatattgttttagaaattttccttatgcccctttccagtcagtccctatcccatcatccacagtggcaactatactgttgattttttcatcataagttatttcgcctgttaactccttataaatggaactccttataaatggaaacatacggtatgtactttctttctgaggcttctttcactcaacataatgttttggagatccatccatgttgttgtgtttatcaatagttcttttctttcagtgaaatcattgagtattttattatgtgactgtatcatggatacctgggttgtgtcaagtttttggctactatgagtgaagctgttaaagacattttttacaattcttttttatggatatgtgatttcattttgcttcagtaaacaactaagagcagatttgttggatcataagtggatgcttagttgtactagaaactactagacctttttccaaaatggtgataccattttaaatttacaccaaagtggttcagaaatttgcattgttccacattttctcaaagtttggaatgttggtaggtgtgtggtagcatcatattgtgattttaatttacgtttccctgatgactaatgatgttgagttcttttttatgtacttgtgagctacttacatattcaaatattttgtctattttgaaagatggtttgtttctcactttattattaagttggaagtgttatttctatgtcctgcatactggccctttcctagatatatgtttattagcattttagccctggctggctgacctgttcatttccttactgtattttgatggataaaagttttaattttattgaagtttcatttatcaattttttcttatatgattataattttctgtgtcttgtctaagaaacatttgcctgccccaaagttgccaaggtattctatgttttattttataagctttatagttttagtttctatgtttaaaactattacacatgtcaaataatttttgttcagcatcatttgtttaaaataatcccctctctattggattactttgggatctgtgtcagatcaaataataatatatgtgttgatctacttctgtgctgtcaatcctgttttatttatttattttgctgtcattaagccagtaccacactgtttatattactgtagctttatagtaagactcgaagtcaggtaatgtaacccaccaactttattcttaaaaaaaaaaaaaacacatttctttggctatattaggtcctttgcctttactctcagagtggtttaaattgtatgtctcttactgtgagtgagattggccatccttttatgtgttaagggccatatttttttttcttgttaactgccaatatcctttacccacttctctgttgtttcttctactcccttgattttgagttatctaataatgagaaggaatagaattagtaaagctgacttgcattttttttcctttgatttggaaggaacccgacttccctcgtcaatgttttggctcctagtgagtaatctgaacagggccatgcttctggaacatgttggattgatttctattaaagcagtaagacagcccaatccaattttaaccaggctagattgtattctgccagcaaaagccccagactagctcaatacaaactcttcttagataagctcttaaaaaaatacctttctgtttttgactaaacaattcaggccagctgtaaactgtaacactcaaagttacaagttgtgtttcccaccagttatctcccctagctgtagacctgtagcaacaaaaattgcagataaagatatttgaaatatgtggcaaacagtcttcctgtggaagttacccacttactgtattttgtttgtatatattcttgagacacagtggtagtgaagaaatgcattgaaggctatttaaacatgaatttaacaggtatttgcctaatctttggaaggaaattaggatatggcattcccatatcctcacaggagtaattctcaattattaaaagccgagtacagttctttaggtgctagaaaaataagtgtttgggatattctgccatgtaactccttcattcttcaaacatttattatgttctatgccagctagtacctgaatcagtagaagctcaaatgcatagtttctgatcttgaagatctcaaggattgctctctactgtgagaaaatctaggtagcatcaccatgaaagtgattatctcaatgggaacttctatgaaaatgtatcactaatattttggatcagtagactacactcaaaactcagcaagcagatcacaataaaagttcacctaccaaacacacacaacacaccaatgaatgggtattagaactcagttactaaactgtaggaaaggttgatgcaacactttcaaaacaatgtagtgaccaataataaattaataaggctaatactcatcatgatatatctatatgaggaagaaaatgtgcttaaggttgaacgttagaatcagattatacaaaagagaaaaaaagatgattttggaagcattcagtttacctcatatattacttttgttcagggccttatctaaggtacctggagaggttttatatagatggtgacagttgaatttagacttaagggaaaggtgttccgggcagcaagaataacatccaaaggtattattgtgacaaatattgtgtgcttggaaatgttgaaagaaatacaaaagtatataatttatgctaacaacaaatctatatcaaacaaatatgacaaacaactgcatgcccatacatttgacaacttagattaaatggactaatttcttgaaagacataaattgttgaagctcactaaagaagaaataggcaatccaggaatctatttttttaaaaattgagttgtagttagaaacccaccaacaaagaaaactacaaatccagatggcatcactggtaaattctaacaaacatttaaagaagcagtaacaccaattctacacaatctcttcccaaaaacagaagtagagggatcactttccaaccattacatgaggccagcattattttgatatcaaagccaagcaaagacatatgagaaaagaaagctgtagaccaatatctctcatgaacatagacataaaaatcctcaagaaaatattggcaagtcaaatctagcaatatatgaaaaggataatacactacaatcaagtgaggcttatccttagaatacgggctggtttgacattttaaaatcaatgtaatttgccatatcaacagagtaaagaagaaaaactgtattataatctcagtaaatcctgaaaattatttgataagtttcaatattcattcctggaaaaatagtctcagaaaattaggaataaaagggaacttccttagcatgataaagacatttacaaaatcttgatccattatgtttagtggtgaaagactgaatacttttccccaaagttatgtaacacaaagatgttatttgttaccatatttgatggtatgaaaaggttcaatattgtattggaagtcctagccaatgttataagacaagcaaaataaatgaagggcatacagattggaaaggaagaaataaaactccctatattcatagatgacatggttttatacttagaaaaccctaataaatctacaaaaatttactagaactaaaaggtgaatttcgtaggatcataggacaaagcaaatatctaaaaataaattatgtttttatatactatcaatgaacaactagaaataaaaattaaacaaaaacagtataatttacaatagcatcaaatgacatgaagtgcttaggtatgcataggtccaacaaaaatgtgcaggctttgtatgtggaaaattacaaaacactgttgacagaaatcagatacctaaataaatggaatggtatattgtgttcatggatattgttaagatatcagttttctccaaatcaatccatagattgaaaatattctcaaggagaacacacaatttttcttctaaaatttatatggaaaaacaaatggcctagaatagccaaaacaattttgagaaagaagtacaaagttggacaattcatagtacttgatgttaagacttaaaataaagctacaatagttaaaatagtgtggtatgtgtgaaatacagactaatagatcattgtaacataatagagagtctagaaatacacccacatatttaatttttgacaaagttgctaaggcaatctcaacagaaaggtaagtcttttcaacaaatgttgctaaaatataaagcaattggacatccatatgcaaaaaaaaatataaacaaaccaacataacaaacctctacctgcacttcctaccttgcacaaaatttaactcccaatggatcacagacctaaatgtaaaacctaacattatcaaacttctggaacagaagcaggcaaactttttctgcaaagagctagagagtaaatattttagtctttatgggctacatatatggtctctgtcacatattcttttttaaacaaccctctaaaaatgtaaaaaccattcttagcatgtaggcagcacaaaaagaggcctataggccatatttagccatgggaagtactttgtcatcccttgttttagatgaagaagcataagagaaaactctgtgatcagatgttaggcaaaaacttgttagaataccaaaaagacaattcataaaagaaaaattggatatattggactttattaaaattaactgtattttcatatcatatatctgacaaaggacttataagcagaatatataatgaactctcaaaactcaataagaaaacaaacaaccaacttttaaaatatagttggaaaaatgagcaaacaatttgagtagataccttaccaaagaagacacccaaatgtctaataagcacatgtaaagatgctcagtataatttatcatctgggaaatgcaagttaaaaccacaatgggataccacttcataaatattagaattggccttttttcaaaaaggataactgacaataagtgctgctaaggatgcagagtaactcgaactctcatacattgctagttaatacacagaatggtgcagccactttgaaaaacagtttgacaatttcttatatagttaaacattgtctttgcacatgacacagcaattctactcccaagaaaaatgtgaagcttcacatagaaacccgtagaacagtgttcatagcagcttaattcataatcaccaataattgtaaacaccccaaatgtgcctcaaattgcaaaaagattaacaaaatgtacatattcatctgatagactaataaccagcagtaaaaagtaactactgatacacataacaacatgggtgaatctcaaatgcattgtattaagtgaaagaagacatattcaaaaggctacatactatatgattgcatttgtatgacattctgggaaagaaaaatctgtaagacataaaataaatcagtggttgccaggtaattgggatgtggggacgagttgactacagcgcacaggggcttttttgggtttatgaaaatgttctatgtcttgattttagtggtggttatatgactacatacctttgtcaaaactcatcaaagtgtacactaaaaagacagaattttagtacatgtaaaaattgtttaaagtgggagtgacagagggacagacagaagatggagagatggacagttaagtttctaatgtcaaagagatgttttactaatgaagggagaagcttgaacatgtttataagccatggccctgagttagtaaaaaggaaaatgttgaagttatctatcttaaaatataggtaacttgaaaatatattttaaacttatgaatatataactgtccacaatgagttacaagtagaaggaatatgtggtttgtaatcttttgtactttcttgtgaagttgatttaagtattgaagtagtgatcagcatatgttaaattataaggctgtaactattaatagattccctatcctttgctcttgatacttatgtgtacttttcttgctgaatgaatgcccagtttttcaagattcttgcttaatatgatatggttcccaaggactagtgactcaggtgttgcttttaatatttaaactgtatttatttcttaaaggtgatgttggaccaaatggacaacctggaccaatgggacctcctgggctgccaggaataggtgttcagggaccaccaggaccaccagggattcctgggccaataggtcaacctggtaagattagagtaaatgtgcattttgtagcactcataatatatacatttgttagctcatcaataaagtgaaacctacaaaacagtcttccagaagcagacttaaaaggcaatctatctatgtgtatgattttataaaagtggataagtacaagccacagcataaaagctactttaatccctgatatttcccttctgagttcatctaaaattgatgtatttccaataatacaattgcagtgtattattgatatgtaattgttgagttagacatggttttggaagcagaggcctagaaacttctagtgctgatcatttcagatctgagtagcggtacagcattcatagacctttgtggaacctcctaacatttcttagcacatgacaactagaattagggttcagcaaaactttctgtaaaagtgtattttaggcattcccattttctttttttttcagtgagttattttccctttttgcccctaaaatagcagtcattttgcaattcatcagcactccaaatctttacttttaatattttatattggatactcaaaaaggtcttttgtcaacacgtaacctaatgggtttgcctctatagataggaaatcatatggttcctctaaatttgtgtgaaagcatattgagtttctggattctgagctgtctggtgatgtgaattctcgttatgttaatctaggtaagtacagtaaaggccaccttggggccatcattatgttattgcaaaataccataataatttatgaaattaaaacaaatatgaaatatttaattgttccttaattcacatgaatacatctgaaggcttaaacacagagttcagatgtgcatacatttatctgaagcaatggctatatgtttcctgaccttaaatggcagtagatattttgttattattctaaaaatttagaaactcaggttaacaatataaaaagcttgtaaatgttattttcattatgtactatttacaattgattatatggcacattatacctttttatggtccctgacatgtcactactgatttaaaactaagaaaacttagagtgttgctttgaaccaggttgttacaaaatagctgctttatcacttatggaaaaaacattctgtccaactaacaaagcagagggatcttcaggaaaaagcacttatttttaggtttgacctgctgttttttttttgttgttgttgttgtttttgttttgttttgttttgagacagagtttcactcttgttgcccaggctggagtgcaatgctgcagtctcagctcactgcaacctcctgggctcaaacgattctcctgcctcagcctccggagtagccaggattacatgcatgcaccaccacgcccggctaatttttgtatttttagtagagacagggtttcaccatgttgaccaggctggtctcgaactcctgacctcaggtgattcgcccgcctcggcctcccagagtgctgggattacaagagtgagccactgcgcccggcccctgctgttttacagaggtggataaaatgaacttatcactcctatggtgttttgtcatttgtttcagttccaaaaagtgcatgagtctttagaagcattttgaattcttaagtcacagctgagtgcgaataaaaaaaggaacaccattaatatgaatctaaacaaaatacaaatatgttaacacgtgtcacgctttttcagatttacctgataccttgtaatgttttattaatctaatgttctctctttctttctccctctgttatatgatatatctgacaaaggacttataaccagatataaatataatatatagataaatatatagatataaatataatatagatatagagatattgatttataaagtataaataggatgggcaggaagaaaagtaataatgctgaattaaacttcatctatttcttttgtaaatatatgtatagccatagaattcaagatattaatatgattcaacaaataaatgaaattaacaggaactagcatgaaaatttattgaattcactcttaatatagaaatgttctcaaatcacagtacttttcattttactatgagatggaccacatttcatatttatacaaggcacagatactcactttctaagtaaattttacttacatcaccaaaatagaatattatcttagttcatttaaaaaacatcctgatttatgtccataaatctcaataataaggtaatcggaaagattcttatatcttgataaacctacttatgttgcatggctgaaactctatcaatgtttttgtaataagcttatttaatatacttgtatttcattttgcgataggaaaaatgcaaaatattctatactgttatctctctactgtagaatgtttacattatgctttttaggctttcctttgaactccagttttctattatttaattaagcttttactatttacctttctcttttctaaaccaggctatacagtttaacacggttataagataaggtcccattgaatatcagtttcccattccatagcagggaaataaaagaaaaattgccaaaggactagaaacaaaatatttttcatctcatgacctgctaacccaggcagaaatggaggttgttgattcttgttattttctttggccattacctgtacaattactgtcttactgaatttttttagagatcagttaaatatactctatttcatgttcacagatcatatcataaccagaaccaaacgtgttatagtgtgtgtccagtcttaggacaaagcatatggctaaatcagctaaagaggaaaaaaaaattcatcaccactaatgtgaatcaaaacaaacaaaacaacaacagcaaaaccctaggaattgtttatgaattattcatgtcattttcatagatgaaggagaaaatagttttctaacacttcaggaggctacaaaacccttgggtagggggagggtgtgtgtatgtgtgtgtatggaaagttctcacgaataatacatgtttttgaaattttcctttttttataaactggttccattcggctgccaataaatttagaacatcagtatatccctatatcacatctgtagacatatccatacaattcttgttattgtggggaaatttagcggaactttgggatttatattgacttcttcatcctggatcttaccaggatgtgtattcctgacagtattcatggaaaaaatctatgctatgggaggaagtatagtataatgtctgttattactactactaataataacgatgaagaaagaaatccttgcctagtgcatgcaagttgtttctccataatcatatgctaataatgattgatttatctatacccaacctgttgtagtataaaattaaattaatttttaaatttgaactaaactttaggagcttaaattccaaaaagattatttaaatcattaagtcagagataaacaattgaaaagctgacctttaccaaaaggtaatacttttgtgaatgtaaatattttattatgtcattattggcaaatacatttcatttatagaataagctatatgaacatctaagcaaatgcctaaaataagttttttcactcatttctaatatatgatagcagtgaatcgaggtctaataacttctatttgtagagttttatgttctaatttttaaatgcttagtttttttttccctaacctaatgaaactttttgcaacttacttctgcttgggtggcccaacttgctgctgaactgtaattccctgcctcttgaacatcaggtgtaccaggtactgtagttcttcctcaaaagccatatcttaaagtaaagctttaaacatggaaaacaaacatttctccagatttaagtctttggtttatttcccttattttatagaactgctctcttggagcacgtttcaaaagataaattatttatattgaaaacccaactattaaaaatctttgtgagctataatataacaatagatagtgatccatataaagctataatcatgttcactgttaggcatcatatcatctttcacaaatatgatataaaaatctctctctcctttttatagtcttttactgtaaaatggcagcattggaactatcgctactttgccaactgagtgtaattctctaatcttcaaagtggattttgtcagtttagggccatgctgaaatatgacataaaacagatcttaaaaccctagcatcttactctctacaaaaataatcaccactgagtcttcaacaataaatttagatcttattgttgaaaggagacttggaatgatcatctggctcaacccctagtttccaattggttatggcataatccccatttagcagatgaggatcaacattaagtgactcacgtaagtcgcacagctggtaggctttggagtgggaagttacatagtatttttagtgtaattcttttcccataaacatactcttttttaaccaccttgcttttgggggaaaatcagccttacagaaacttactaaggttaaatattttttgctgtgtcattttttttctgtaaaatcttggttggagaaacaaaagatgacaaaaaatactaatagtaacatattattaatgtattattaaaacaatgtgcaaaacaaaggtaaaatacaatttaagaagtccacttaagtgacttattcagtaatcaataattttgggagctcatagagatgtgtactaataatttataatacattagaacaatgcaaatgtaagtgtgttcaatagaccagtgtcaaataatctatcagtctgcaataggattaatacaaatgttgagaataagcatttagaaacttttatagcaatttgatagtgtaattgtatctgttgaatataataaccaaaaaggtaggcttttattttgcatctttggctttttattcagttttagtaattttcattgtattttataaaaaatattagtctgtgattaactaggaattaagaaaagattggccttttgccagaaataatttgagaagcactgtcttagagcaatctgcttgaaaatcctaaagcttgattgttcagttattttgtgtgcatgatgtcaaaagtatctctaactcactcttaggtctgttatctacagggttctatcacttgtttactagaaatataaccagatacatcttttaaaactgcttcagtacttattaatattgatattgtattaactaggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaatttgtttaaagttttctctgatttggattaaggaaattaaaactaatacgactctggtagataattcccatgttacacttttctagattgacgtgatcccttaaggatgagcattaaatatctatgactgcaggaagctcactttgctattttcactgcacatttttctctgtgagagttccagttatatattactgtataacaaacaaccccaaaacttaatgattttaaccaaccttttaattttgctgaagattttgcagctctagaattaagggatgacttgactggttcatttatctctaacccacgttgccccagctggagtgtttgggactgaaaggtctacttctaagatggcacttctctgacatctgggtgttcattagctcacatgtcatctcatcgtccatggtacctcttcgcatggcttaggctcctcacattatggtagtataaggctggttgctccccttccatggcagctggcttccaacagagagaatcccacaagagaaaagtgagtgtttcaggaactacaggtagaagcggcaagatttcttttctttcgctctctctctccctttttttctttctttttccctttctttctctttctttctcttttctttctttcttttctttctttctctcttctctctttctttctttccttttcttctttctttctttcctctctttctttctctctctccttccttccttctttttttttttttgagacagggtctcactctgtcacccagactggagtgcagtgggacatgatcacagcccactgcagcctcaaacccctgggctcaagccatcttcctgcctcagcctcctcccaagtagctgggactacaagcacataccaccacacacagctattttttttttctttttttctttgtagtgatggagtctcactatgttgcccaggctgctctcaaattcctgtcctcgagcaatcctcccacctcaacctcccaaagtgctaggattataggcatgagccactgtgactggcctgtaagacttcttttgatctaggcttgggagtcacacaatgtcatttagtcaagtgtgaggtacagaatcaaccctagttccaggtgagggttttatagtagattgtacatactgggacatatggttcactggggggccatctttagagattagctaccagactgagtctccttattcatgggtatcagcagtagtgggcactatggtcaaaaagtctaaaacttaacagtgccttacgtccaaccctcaatagttttctggttgacatcttaaaacttactttttatgttccctaagtcaaagaaaggcaaacattacttattgatattcttcaaaggtaccaaaggtgaaatgggtatgatgggacctccaggcccaccaggacctttgggaattcctggcaggagtggtgtacctggtcttaaaggtaataatcaaggtttgctgccagacgtatgtgagagggaaaattaaatatagctttatgtcagtacagaatatttttgttgactgttttaaaatgagcaatggttacttgtgtttctatgtaacatggcatttaaataggtcttgttttcaatttggttacgtgcttagtttggataccatgatacatggtaaatgcttagctcaaaataacaaaatataaggattaagcattaatttttttgtttgtcttttgagacggagtctcgctctgttgcccaggctggagtgcaatggtgcgatctcagctcactccaaattccatctcctgggttcacactattctcctgcctcagcctcccaagtagctgggagtacaggcgcctgccaccacgcccggctaatatttttttgtatttttaatagagaaggattttcaccatgttagcaaggatggtctcgatctcctgacctcgtgatctgcccacctcagcctcccaaagtgctgggattacaggcttgagccaccgtgcccgtctggattaagcattaatttttttatagtcggcctctatcgttgtcaaggaattccagatggagggattgttatctgagtataaaaatgtgtatgcactcaagtaattcatagagtacatccaaggtgcataaatgttttgagtggccagtggcctactcaactatgaaacatatcaataatctttatatgcattaatctttgatggataaaattgatatattgtgttttcacacacattgattttaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtgagtgaatgaatttatttatgaatatttttcctgatatatctgaagtttaatttttaaatagcatgaaaagtgacttataatacagaattcaccaacaaaggcacttaaatgcatcaaattttggtaacaaatattaattttcacttcattcatactgtttcaccagtcaacttttgtttgagtattttctttatagtttacctatcacgagctttacctaaccactagtgaggttttaaaatagacttaggcagtcaactactagctttctaaaaagtaatacaggaaaaggatatatagccacaattacttgaaaaacaaatttcagtgtttaggaaatttgctagtcctttcatttttttctccttgataccagataaggacgaatggtacattgctgtactgcagtgttttgatatccatatcatacttggctttcaaatacagttcaccgttattctactttggcagaataaacaagtattggactatgaacagccaagttcagcccgaggggaagtcactgaaagtagatctagggaacaattgtgtccatatagttattttattagaaacaaatacagcgtaaaatattacgtggggttttcaataaaaaaaaaaccttttttatagaagtataacatgttcataacaaaacatcataaaatatggataagcataaatcattatataaagcacttggcacccaatctatatagaatagcctttcaagcaatatggaatgttaaaactagctatatctgtgtatctgcagcttatagtaaagtttgtggctctttgtacgttctatccatcaatattgtcagttcatgtgtatgtgtatgtgtatgtgagtgtacacagatgttaacagtttccctatgagcaggatttggtgggatttttcctcaaaaaagaattaaaaatattaatgcagtgttgtatatagtcaagaaagaggcagggtcacctaattttttatggaatgactttcttggcttaccccttgcaaggcttcttttctgtttcaattatgcttcctgtataataggggcagtaaactatacttgacctctactataggcttattaaatatagtcagaatctaagagataacctagagattatctgtccttattccttatttcttcatttccattgtaagaaaatgaggcccaaaataggaaagtgatttcactactgagtgctctgaatttcttgatggtaggtaactaaaaagtgaaggattttcgtgtgagtccagtgctaatagctcatactatatcagaatatcaccagttcctctaattcacttatagtttaacacttgagtagcttgctttgccaaagttatttcatggatgaataatatcatcctaacttgcctcttctactcattcttggaaggtatacctggagtttcagggccaaaaggttatcagggtttgcctggagacccagggcaacctggactgagtggacaacctggattaccaggaccaccaggtaagtgtgataggccatttgtagcaattgcttagctgacactgaattctggataaataattatgtgtttgtcatgtttgaagatgctgtggatttgatcatggtaataagcttgggtagctactgaaatatggagctcactttcggcaaaaatattgccctttggctctagttttagcagtccagattttataggatattttgccttgattattcagtttcttctttttgtggcagcagggtatacacagaatcagaaatgtgatccaaataaggtgttgtgttttgttacatacattgcaaaatatataaatgagacaattatctcatgaaggcctgaagaattcatcttgtcctgcttttttttctttctgcctttagacaagtcagtcattaaaccatgtaaaacagatggctattgattctatttttttaaatttctaggcatgaaaatttcacaaattctcttggtagtcagttacagcattaatcactcttagagtcgacatttttttaaatcctactaaaactctttcttgtttcttcttcagccactttcttttagtttgtttcctaaggaaataaagagcagcagtccccattcttacaaagtcccttaagttcagttatttgcgctagactccatactacatggccttgatatagttgggaagagaaactcccttcctatctctccctcacatcttctgcattctcttttccaagttagaagtcattgtaaaggaaaaaaataaaataaaaaaagtttaaggcaatactgtggtcctaggaaaaaacccagatgacatcacagagctcaagcacctatgtgctaggaaaaatgtacaaacagagcagccatgcctgttcaggtcactgcccagtatctgtccaccacctctaatctctccctggcctaatgtactaaactatatcataacaggttaccaccttttctctttctgatctcatataatcacgctctacatgagaagcccatctctgaatcttttaaaaaacagacttattatattggatttatctgtgaaaatacattaagggtagttgtacacatacagcaaatagcacttcaggtgattggaattgttttagggaaagaaacaaggtgttctggtaactttttaatttttttttaaagttatattaggagacctctattactatggttatattgtaatatgttcccaaggagatgttttatgttgggttctatctgtggaccttaatcatatattcagatttaatccatctaatcccatgtttgcattttaatgactatccattcccatgaaaccagacaaccccaatattgctacattgtcttaattttaccaatttgacctttctaggtcccaaaggtaaccctggtctccctggacagccaggtcttataggacctcctggacttaaaggaaccatcggtgatatgggttttccaggtgagtgatgaaaatcttccaaatatttagtcccattaatgaaaggtggttcaatatctctttttttgtcagaaaagaggctggtgttgatagaatcagactgaaacgatatctgaggtaatcagtgggtagtgttctcttgttacacaaatatttaaaatgggaattaagggacaaaattgtagaaaccttaaaagttataattcacaaacatcttttctccagctatacccccttttatttaaacttcctttaaaagtaggcttttatataattgtgtttgtgaggctcattattatctaactcagagtttgcggagctttttaaaaatctttttgctttgtcatatgcatcttagataatccacaagtaaagcatattttgtaaaatattatatatcacatattttcaacagggcctcagggtgtggaagggcctcctggaccttctggagttcctggacaacctggctccccaggattacctggacagaaaggcgacaaaggtgatcctggtatttcaagcattggtcttccaggtcttcctggtccaaaggtaatctttggcatatagttttaggcacatacttgagcagatatgaaattttttaatactatgctcattcctaagttttcattaaacaaactatagaatgacatagtatattctggataagagatttattccttttcttttctcttagatgataagaagatatgttttagggtttgtggccagtccaaaataaaaagggaaaactttctggtttctttgtttttcttctatcttaatttctggatatacttcaataatctcaatgcctagatttttctggtcttgttagtccatccctttttagtgatggagttgttggcctttgtcctaatgttattattaactaatttgaaaagacttataaacaaagtgacagttaatgctaatgtagtagtattcttaactgcgtgtctgagatagtcctctgaatacagttttacaattccctctacttctctcttcaatgtgaaaactttggtggtgtttctcaagtaatcaaatttagaatttgtttcagaatcattggactcaacaggaatttatttgacaattgtttagttccatgtcaaaaagtagtaactccttaatcatgtagtcagaccacagacctaaaaagtattagaaaaggaattttggtactcagttttcatggaaatagtgaaagttcccagtgatataagaatttattgaattgtatgtaaggataatttttcttttaatattatataaaaatactttattttgatcatctaattgatcaatgtcttataaagagataatcaagagaagtttctgtatgttcattccagtttaacaatgtaaagtttcttgaagtgaattttaattttctctgttatatttatattttaccagtgacattgaatatatgattttattaaaaaataatatagacatattaagggtaagagtgaaaatcttcttcatgccccatcctctttttaccattcctttcctcatagaggcccactgtcaatagttgatatataaatttgaattccttgttctatacatttatatatatgcatatagagtttggggttttttctacacattgtgtatatgtagaatcatggtatgcatgctactctgtaccttgctttatcacttacccctttttatttcttttttcaatatatcttagacaattttctttgtcgtcatacattatatctgtggacatatatgtagttatttatactgtatagtttcataaaagtgtaattgttggatcaaaggataagtgcatttaattttttggctttttaaaacacttataataatgtaacatatgaacttgattttaaaatacaaccagtatgaaaagatgtaaaataaaaagtctcctttttacatgtttgcaaaccccaaatccccagttcttcttctccagggtaaccacttttagtagtttctctcatattcttcaagaaaggttttctaaatgcatttatatgcatgcatatatggtatttcatcaattttaatactcattttttacatccaaaatatctaatattggaatgcatcttattatgatggaaagcatattacaattaaaattgtaaatatttttccccaattattgatacatgaaatgatgctggaccttccaaatgtagatgttttctcatattttaattaatatatacaaaattatactatacatctgctctgtacctagctgtcatcacatagtaaatcttgacaaactttctttatcagcctataaatgtatgccttattattttttataattatatagtatttttatgggggttcactataaataatttaacctattatgaatatgaaaattatttctaggttcatgattacaaacatattttgcactgaagattcttatccatattcttacatacatatcttaagaatctttggtaaatatcaccatagaataaattctgagcagttgctagaacccagcatatatgtgcctttttaatatctatatttactgccaaattttccaattaagtaactctacacctttatactttcatgattagtataagtgattttctcctcattctacagatattgggtgttatcaatttaaaaaattttaccaatctaatgggtgaaaagtagtgtatcattattgtttatatttgaattttcctgattacaagtggggtttcagatgtttttaactctttcgtaaattgtctatttatactctttgcctcactgttttacgagaggacttggttatgtatttcatactgatttgtaaaagtacattataaatgtgaagatgcatccactgtctgttatatttgttgcaaatattttctcccagtcagttgtttgtcttatagcatgtttactgtgcatttcgttatgtagatgtttgaaatttttacataggcaaattatgtactcatttatttattcattcacaaaatatctgttgagtatgtatgatttaccaggtactgttttaggtgctggagatacagcctgaacaaaacagacaaacttttactgccttcaaggagcttatatttagtcaaggagtcatacaataaacaaaataaataagtctgtattatgttagaatgtgataaatctcatgatgaaaagtaaagcaagacttgatgataggaatttctggaaattgttatattttgaaataggttactaagggaaagtctctctgataagatagagcagtgaccacactgcagtaagagagtaagtcatacaaaaaccctgaggtgtgagcatacctgacatgtttgagaaacataaatgagtccagtgtgttaaacagaatgagtgagttgaaacaaagtaggagatgagattagattggtaatgggggaaagattatatagtgccttataggtcatcatagtaggggcttttactcctgagtgaatcggggagcaaatggaaagagttaacatgattgtacattaattttaagaactatcacagcacctgttttggaaacagatcatagaggagcaaggatggaaagcagggaaaccagttatggtgatatttaaataatgcaggctaatgatgttgatggcttggatcaagatagtggcaggggaagtgataagaaatgggcagattttgaatatataatatatgtcaagccaggaagatttgtgtatggaatatgagagagaggaatcaagaatgactccagtttttatcctgagcaaatagagtggagttgctatatgctgaaatacaaaaactttgaaaaaagcaggtttagtgagaaagatcaggagcatagttttttattttatttatttatttatttgttttattatactttaagttccagggtacatgtgcacaacgtgcaggtttgttacatatgtatacatgtgccgtattggtttgttgcacccattaactcatcatttacattaggtatttctcctaatgctatccctcccccattcccccaccccatgacagggtgtgtgatgtcccccgccctgtgtccaagtgttctcattgttcaattcccacctatgagtgagaacatgcggtgttcggttttctctccttgcgatagtttcctcagaatgatggtttccagcttcatccatgtccctacaaaggacatgagctcatcttttttatggctgcatagtattccatggtgtatatgtgccacattttctcaatccagtgtatcatggatggacatttgggttggttccaagtctttgctactgtgaatagtgccacaataaatatacatgtgcatgtgtctttatagcagcatgatttataatcctttgggtatatacccagtaatgggatggctgggtctaatggtatttctagttctagatccttgaggaatcaccacactgtcttccacaatggttgaactagtttacactcccaccaacagtgtaaaagcattcctatttatccacatcctctccagcacctgttgtttcctgacttcttaatgatcaccattctaactggtgtgagatggtatctcattgtggttttgatttgcatttctctgatggccagtgatgatgagcattttttcatgtatgtgttggctgcataaatgtcttttgagaagtgtctgttcatatcctttgcccacattttgatggggttgtttgattttttcttgtaaatttgtttaagttctttgtagattctggatattagccctttgtcagatgagtagattgcaaaaattttctcccattctgtgggttgcctgttcactctgatggtagtttcttttgctgtgcagaagctctttagtttaattagatcccatttgtctattttggcttttgttgccattgcttttggtgttttagtcatgaagcccttgcccatgcctatgtcctgaatggtattgcctaagttttcttctagggtttttatggttttatgttcaacatttaagtcttaatccatcttgaattaatttttgtataaggtgtgaggaagggatccagtttcagctttctacttatgactagccagttctcccagcatcatttattaaataggaaatactttctccatttcttgttttggtcaggtttgtcaaagatcagatggttgtagatgtgtggtgttatctctgaggcctctgttctgttccattggtctacatctctgttttggtacgagtaccatgctgttttggttactgtagccttgtagtagagtttgaagtcaggtagcatgatgcctccagctttgttcttttggcttaggattatcttgacaatgtgggctcttttttggttccatgtgaactttaaaatagttttttccaattctgtgaagaaagtcattggtagcttgatggggatggcattgaatctataaattaccttgggcagaatggccattttcacgatattgattcttcctatccatgagcatggaatgttcttctatttgtttgtgtcctctttcatttcgttgagcagtggtttgtagttctccttgaagaagtccttcacatcccttataagttgtattcctaggtattttattctttttgaagcaattgtgaatgggagttcactcattatttggctctctgcttgtctgttattggtgtataagaatgcttatgatacatctctagaactcttcaccccaatcaacagaatatacattcctctcagcaccacattgcacttattccaaaattgaacacatagttggaagtaaagcactcctcagcaaatgtaaaagaacagaaatcataacaaactgtctctcacaccacagtgcaatcaaattagaatttaggattaagaaactcactcaaaaccgcatgactacatggaaactgaacaacctgctcctaaatgactactgggtacataatgaaattaaggcagaaataaagattttctttgaaatcaatgaaaagaaagacaacattccagaatctctgggacacatttaaagcagtgtgtagagggaaatttatagcactaaatgcccacaagagaaagcaagaaagatctaaaatcgacaccctaacatcaattaaaagaaccagagaagcaagagcaaacaaattcaaaagctagcagaaggcaggaaataactaagatcagagcagaactgaagaaaatagagacacaaaaaacccttcaaaacatcaatgaatccaggagctggctttttgaaaacatcaacaacattgatagaccgctagcaagactagtaaagaagaaaagagagaagaatcaaatcgacaaaataaaaaatgataaaaggaatatcatcaccgatcccacagaaatacaaactaccatcagagaatactataaacacctctatgcaaataaactagaaaatctaggaagaaatggataaattcctcgacacatagactccccccaagactaaaccaggaagaagttgaatctctgaataggccaataacaggctctgaaattgaggcaataattaatagcctaccacccaaaagaagtccaggaccagatggattcacagccgaattctaccagagatacaaagaggagctggtaccattccttctgaaactattccaatccatagaaaaagagggaatcctccctaactcattttatgaggccggcatcatcctgatatcaaagcctggcagagacacaacaaaaaaaagagaattttagaccaatatccctgatgaacatcgatgcaaaaatcctcaataaaatactggcaaactgaatccagcagcagatcaaaaagcttatccaccaagatcaagttggcttcatccctgggatgcaaggctggttcaacatatgcaaataaataaacgtaatccatcacataaacaaaaccaaagacaaaaaccacatgattatctcaatagatggagaaaacaccttcgacaaaattcaacagcccttcatgctaaaaactcaataaactaggtattgatggaacgtatctcaaaataataagagctatttatgacaaacccacagccagtatcatactgaatgggcaaaaactggaagcattccctttgaaaactggcacaagacaggaatgccctctctcactactcctgttcaacatagtgttggaagttctggccagggcaatcaggcaggcgaaagaaataaagggtattcagttaggaaaagaggaagtcaaattgtccctgtttgcagatgacatgattgtatatttagaaaaccccaccgtctcagccccaaatctccttaagctgataagtaacttcagcaaagtctcaggagcatagttttttgattgtcaatattttgttgctgaaataggaaattcatcaattgagggggagagagaggaagaggtaaggaaggcttgaggcctgtcacatagattttaggattttttggaaaaaaagtcttctacttatgaagacttctatatcctgagattataaaaatagatttatatatttcttacaggattttcatggtttttttctgtacatttgcattttaatgcacctgagtatttctgtatgttgtatgaggtgagaaactaactttattttttttcccaaataaatatccagttgactgagcctcatttgttacaaactcaattctttattcactgatataaaattgtatttaaattttttttccaaatttgttcatgaatttttttttctggaatgagtgaattttaacattttactaatggaatcaaaattaccataataaattgtctctacatttttaatgggtgatagcagaaaaatatgttttaattggtaaatgtccaaagtatattcaactctacaagcaagaggttagcttttagttcttctgtgtgacctacaagtatatttcagtaagcaaattttacactaaatttagaaacttaacaaagatgatattgtggaaataatgtaaagtagtctgttgtttctttcagatggcattattataccttaaaatagtgacatgttgaaaaaataaaagtttttttagctcagttctattaggtacaggtgatctttgcttttgcacaaatttcagttatcattacttaacaccgatccacaacaacattgtttaaattttagttgctatgatatattaactcttccatttataaatcatcatctaaataagagatgtgcattacaatcagtggacagtaatttcacttctttcaaattctgtcactaattagtaaccatgcatctgttcagttcctgcactgacagcaaagcatttagttgtgtcacctccttgtctcccagtgataaagcaatgtgacattttacaaaaatggataatcaaaagagaaaattagccaacaaagaagaaagtgcaacaaaaaaaaaaaaaaaggaaagtgatagcactggaagtaaggtttgaatctaaagtaaatggggttatagaattaatagccaaccatagaattgtagacactgccaccatttgagagactctagatatgcagctaaggaacttagtgaaggcaaacttatcaacattaatgaggaaaggagcactgatgaaaaggatgaagatgtcacagaggaagtgttgccatcacaaatttcacattaaaggaactcttggagatattttacaagtttgaaagtataaaggttaacatgctggaagctgatctcagtttagaaacagtgagacaatttctgtgccaaggcatagaaaagatgtgtgctctgtattgtaagttatacgagaagaagggagacactgttcaaattactcttggtaacttttttacaatgaaataaatcactttatttttcaatgtttctaatgtttaaattagcatttaccaaataaatattggatttactattttttatttctttatacatgtgtatctgacattaaaacatattttaatgttttgataacatttttaaaggtcatagaataattacattttcccccattgattattaagatcactttacatgattttggtttgcagtttcatttttccagttccacactaccacgtgaaacaaagagtacccatattataaaggaagagaagaagaacagttttaggaaatataatggtatgattgagggaaaacaagcataagacaaatttctgtaattactgagttgttaagaaataggaatagtggtaaaatatcagataggtagtttgttttatggatgtcactgtttatgaaacagcagctctgttagtcaaaaagcatgattaataaagtatactgaaaaccccagacaaggagtcagtaggcagaaatttgagtcctgggtttgtgtacatgaccttgataagtcacttaattcttcagtgtcttcagtaccttgtccataaaaagtgggagaaaaaaaatcctactttttgtagttattgtgaggtttcaatgagattaaaacatgcttcataaaaaagaaaaaaaaggaaaaggaatgaaacactttgtaaattataaagcattctatacatagtatttctttttatctaaaatgaaagggctggagtagagggtgtctaagatatctggaattctcaaatataatgactctatggaactatatgaatctgtaatgctcttttaatatagtgtaattgttctaaccttcataactcctttttaaaatctaatcatactacagattcatccctttcataatcccagatggcttttatgctgaaattgacaagtgtatcctaaaattcatatggaagtgcaaggaacccagaatagtcaaagaaatcttgagaagaacagatttggaggactcactcttctggatttcaaaacttactacaactatgataccagcactgggtagacatagagactgatggaatagatagagtccagaaatacccatacatttttggtcaactgattttcaacgtaggtaccaaaacaatttaaagggagttaaggatagtcttttcaacaaatgatgctggaacatggatgcagctggaggctactatctatcctaagcaaattaatgcagaagcagaaaaccaaatagcacatgttctcacttaaagtttggaggtaagtattgggtatacacagatgcaaagatgggacaataaattctgggtattcccaaaaggggtaaggagtgggggaagtgttgacaaacctatggagtactatgttcactacttgggcaatgggaacattagaagcccaaacatcaacatcacataatatacccatgtaacacacctgcatacataacccctggatctaaaataaaaaacaaaacaaaaatcaaatcatgctgggaaaagaggatacctgtctgcaaaagaatgaatctggacccctatctcatactgtatacaaatattaactccaactggattactgacctaaatataagaactaaaccataaacatattaggataaaagatgactaaattcttgtgaccttgcattaggtaatggtttcttagctatgacactaaaagcacaaacaactaaaggaaaaataaattgggctatattaaaattcattaggtaatggtttcttagctatgacactaaaagcacaaacaactaaagaaaaaataaatggggctttattaaaatttaatgtgttttctgttgcaaatgataccatcaagaaagtgaaaagacagctcacgagatgaaagaaaatatttgcaaatcatatatgagataaaggatttgtatacagaatatataaagaattcttataattcaacggaaagcaaataactcagtttttaaaagtgcacaaagtgaattggacctaacaaacatatacaaaatattctatccaagaaaaatgcagaatatacatttttgcaactgcacatggaacattctccagaatagacaatatattagagcacaaagtaagtcttcatacacttaaaaagattaaaaccacacagcatatattttttaatcatgatggagtgaaattagaaatcaatggcagaaagtaaactggaaaatctactaatgcatgtaaattaaacaagacgctcttaaccaatgaggcaaagaagaaatcacgagggtagttagaaaatgtaatgtctttttttttttttttttttttttgacagagtcttattctgttacccaggttggagtgcagtggcgtgattgtggctcactgcaacctctgccttccaggctcaagcaattctcatgcctcagcctcctgagtagctgggattacagatacgcaccaccatgcttagctaattttttgtagagatggggttttgccatgttggacagttggtcttgaactcctgacctcaagcaatccaccctccttggcctcccgaagtgctgggattacaggcatgagccaccatgtctggcagaaaatataatgagacaaatgaaaatgaaaccacaacataccaaaacgtacaggatgtagtgaaagcaatgctaaatgggaaattaatagctgtaaatacttacattagagaagaaacatctcaaatcaaaaacctaactttacatcttaaagaactagaaaaagaaaaactaaatccaaaactagcagaaagaaagaaataataaagattagagcagagataaataaaatacagaactaaaaaaatcatagatgaagtcaacaaaactaaaagttgtttcttcaaaaagataacaaaatagaaaaagttttagctagcttgactacaagaaaaagagagaagactcaactaaaatcagaaataaaagaggagacattactaccaatcttacagaactaaaaatatatgagactgctatgaacaggtgtttgctaacaaattagataacctggatgaaatgggcaaattcctagaaagacacaatctaccaagactgaatcatagaagtagattatatgaatagacctaaagtgagtaagaagattgactcagtaatcaaaaaccttccaataaagaaaagctcaggaccagatggctacactggtgaattctaccaatctttttttttttttttgagacagggtctcgctatgttgcccatgctggatggagtgcagtggtgcagttacggctcactgcagccttgtccttgtgggctcaagtgatcttcagcctcccaaatattttccaaacaattaaagaaggattaacagcatttgttttcaaggtcttccaaaaaaattgaagaggagggaacacttccaaactcattatattatacctggattaccctgataccaaatccagacaaagacactacaataaaagaaagctacagaccaaaatcccttatgaatattgatgcaaaaaatccttaacaaaatactagcatactgaattcaacagcatattaaaaggattatatgccatggtcaagtgagattttttcctgggatgcaaggatagttcagcatacaaaaatcattagtgtaatacaccatcacactaacagaatgaaggagaaatcccacatgatcacttaattaatgcaaaaaaaagcatttgacaaaattcaacactgtttcatgattaaaaaaacacaccacaagctaggaatagaagcgaactatctacttattataaaggtcatatatgaaaaaacccacagctaacaatggtaaaagtctgaatgcttttcctctaagaccaagaagaagttaaggattcttaattttactacttcctttcaacatagtactggaattcctagccagaccaattaggcaagaaaaagaaataaaagtcatcttaattggaatggaagaagtaaaattatctttgttcagagatgatataatgctatgtagaaaactctacaaagataccatatatgcggaaaataggtagaactaataaacaaattcagcaaagattcaggataaaaaatcaacacacagcagtcagttttgaatgttttgatgcatcaacaatgaacattccaaaaaggaaattaagaaaattaaatttacagttgcatcaaaaagaataaaatacttaagaataaacctaaccaagaaggtggaagacttgtgctctgaagactacaaaatattgctaaaaggaattaaagaagacagaaataaatggaagatttaatactgttaaaatgtccatactacccaaagcaatacacagattcaatgcaacgcctatcaaaactccaatggcatttttttttccagaaacgaaaaacttagtctaattcacaaggaaatctcaagggaccccaactagccaaaacaattctaaaaaagaaccaggttggaggactcataataattttttattagaaaacatattacaaagttatagtaatcaaagcggtgtggtgctgacataaagacagcaaatagaccaatgtaatagatagaccagagataaaatctctggtctgtagttgaatgatctttgacaagggtgctcaatggggaaaggcgttcaacaaatgcatgctgggtaaaatgaatgtccatatgcagaagaatggagttgaaccattttcttacatcatatataaaattaattcaaaaaagaatgaagacctaaatgtaagacctaaaactataaaactcttagaagaaaacatgggacaacatgcctcatgacattagatttttttcaatgatttcttggatatgacaccgaaatcacaggcaacaaaagaaaaaatagattaattggacaacatcaaaatgttaagcttttgtgcatccaagaacactactaatagagtgaaaaggcaactcatgggatggaagaaaatatttgtaaattgtatatctggtaaaagattaatttccagaattttaaaaagaactcctacaagtcaataacaaaagccatcaaacaacccaattcagaaataagcaaatgacttgaatagacctttcttcaaagatgatatacaaatggcaaattagtacatgaaaagatggtcaacatcactaatcattagggaaatgcagtcaattctacagtgagataacacttcatacccattaagaaggctattatataaaaaacagtaaataacaagtgttggtgaggatgtggagaagttggaactctcctgtattgctagtaggaatgtaaaattgtgcagccactatggaaaacattatggcagttcttcaaaagtaaacacagaattatcatatgatctagcaatttcacttctggagacacatctaacataattgaaaacaaaaatgggacctcaaagagatgtttttgtagccatgcttctagcaacattattcacaagtcacaaggtggaagcatcccaaatgtccattgatagaggaatgtgtaataaaatgtggtatgcacacacaatagatattttttgaccttaaaatggaataatattctgatacatactacaatatggattaactttgaagccgttatgctaagtgaaataagccagttataaaaagacaaatattacatgaccccagttacataaggtacctagaacagtcaatttcatagagacagaaggtagaatggtaattgctcagggttgggggaggggaaaataaggagatattggccaaagggtacaaacatttagttagttataagatgaataaactctagggatcaaatgtacagcatgggcactatagtttaaaatattgtgttgtatacttgaaatttgttgagagtagatcttaattgctttcaccacacactgaaaaaaaaattgtaactcggtgaagtgctagatgtgttaactaatttcattgtggatatgagtataaggtttccgtttgggttgataaaaaaaattctggagatatatggtggtgatggttgcaaaaagtgtgaatgttgtttatgccacaggactatacccttaaaaataattaaaatggtaagatttatgttttgtatattttgatactctaaaaagccacataaaatgaaaatattaattagcttgatttaatcatttcacaatgtatacatgtatcataacatcacatcatactctataaatgtatatagtttttatcagttaaaaataaaatatttttaagtgaaaaaatgaacaaaggaattgaatagctatttctctaagaaagatgtacaaatggccagtatgtacatgaaaaggtgtttaacctcattagtcattatgaaaatgcaaatcaaaaccacattgagataccacttcacacttacttgagtaggcataataaagagagaaaataacaaatgttggcaaggatgtgaagaaattagaacccttttgcattgccagtgggaatgtaaaatgatgcagctgctgtgaaaaaatatttgacagtgcctcaaaaagttaaataaagagttatcatatggctcagcaattccactcctaggtattttcccaagagaaatgaagctgtatttctgcacagaaacttgtacttgaatactcacagcagccaaaagtgaagaaaacccaaatcacaagaatggctaaacaaaatgtgctatcccagagaaaattgaggagagtgaggatcatcatggtggacgggagacaggactggattacagctccaactcggacagacagagcagcatacagaggtacgcattgtgaatttagttccagatcaactgcaacaacaaaccagtaatcacaagaggatgcacagaccctctgaaggaagtggacttctcttgcaggacccaggagacaccccaaatactgtgagtgccccaaatatagaagtggaaagtggagatccttctctcccaaatacacaccgccactggagaaactggaggtctgtttgtgggagaagtttctgaccttacctggagctgagtccatttagagagccaagtgaaatacaggggtagaggaagcagcaggaaaggccctgggggcttgctgggtcaccaagcaggccattcctgcctggcaccacagggatccatcgggagggcagccagaggagtggaggaaagcaccacagggagaaggaagcctccagctgaactttgtaacaatttgaaccaggcgagaagcctcctggccagaactcgggggagggcatgaatccagtgtgcagactccacagatgggggaagaaccaagcccttttcttttgcagcttggtggcaggtagcctgcggcaagttctcaagccctgctcacccaccacctggaaacagacttggggctgttaataggggcacagtgggagtaagatcggccctttgatttgtgtgggagttgggtgaggcctgtgactgctggttttcccccacttctctgacaatctgcatgactcagcagaggcacccataatcctcctaggtacacaaccccattgatctgggaacctcacctccatcccccacagcagccacaataagacctgcccaaggagggtctgagctcagaggtccctagccctgcccccacctgatgagcctttcctatccaccctagtagctgaaaacaaagggcatataatcttgagatttctagggccccacctaccactggttcctctccatactaccacagctgatgctttctggaaagtgccacctcctggcaggaagccaaccagccccaaaatagagcattaaaccaccaaagataagaaccctcacagagtacatttcaccccctgccacctccactggaagaggtgctcgtacccatggctgagagaccatagacagttcacatcacaggactttgtgcagacaattctcagtagcagctgagagctgggtagactttctgggtggctaaaccaagaagagagacaataatcactgcagtgcccctcacaggaagccacatccataggaaaagggggagagtactacatcaagggaacatcccatgggacaaagggatcagaaaaacagacttcagccctagacctaccctgtgacaaagcctacccaaatgagaaggaaccagaaaaccaactctggtaatatgaaaaaacaaggctctttaacactccccctctccaaaaaaaaaaaaaaaaaaaaagtcacactagttcaccagcaatggatccaaaccaagaagaaatccctgatttacctgaaaaagaattcaggaggttacttattaagctaatcaaggaggcaccagagaaaggtgaagcccaatgtaaggaaatccaaaatatgatacaacaattggatggagaaatattaaaggaaatagatagcataaataaaaacaatcaaaacttcaggaaacaatgaacacacttatagaaatgcaaaatgctctggaaagtctcagcaatagaattgaacaagtagaagaaagaaattcagagctcaaagaataagaaaatataaacaaagcctccaagaagtctaagattatgttaaacaaccaaacctaagaataatcggtgtttctgaggaagaagagaaatctaaaagtttggaaaacatatttggggaataattaaggaaaacttccccagccttgctagagacctagacatccaaatacaagaagcacaaagaacacctgggaaattcatcacaaatcgatcattgcctagggacatcgtcatcaggttatctaaagataagatgaaggaaagaatcttaagagctgtgaggcaaaagcaccaggtaacctataaaggaaaacctgtcagatcaacagcagaattctcagcagaaaccctacaagcttgaagggattggggccctatcttcagcctcctcaaacaaaacaattatcagccaagaattttgtatccagtgaaactaagcatcatatattaaggaaagatacagttgttttcgcacaaacaaatgctgagagaattcgccactaccaagccaccacaacaagaactgaggaaaggagctctaaaacttgaaacaaatcctggaaacacataaaaacagaacctctttaaagcataaatcacataggacctacaaaacaaaactacaagttaaaaggcaaaaataaaaaccccaaaataccaaggtacgcaggcaacaaatagcatgatgaatgcaatggtacctcacatctgaatgctaacattgagtgtaaatggcctaaatgctccacttaaaagatatagaactacagaatggataagaactcaccaaccaatgatctgctgccttcaggagactcacctaacacataaggactcacataaacttaaaggagtggaaaaaagcctttcatgcaaatagacaccaaaagcgagcaagagtagctattgttctatcagacaaaataaactttaaagcaacaacagttaaaagagacaaagagggacattctataatgctaaagggccttgtccaacaggaaaatatcacaatcctaaatatatatgcacctaacactggagttcccaaatttataaaacaattactaatagacctaagaaatgagatagacagcaacacaataatactgaggaacttcaatcctctactgacagcactagacaggtcatcaaaacagaaagtcaacaaagaaacaatagatttaaactataccttggaacaaatggacttaacagatatatacagaacattccatccaacaaccacagaatacacattctattcaaaagcccacgaactttctccaagatagaccatatgataggccataaaagaagcctcaataaatttaagaacattgaaatcatgtcaagcactctcagaccacagtggaataaaactggaaatcaaatccaaaaggaatctgcaaatacatggaatttaaacaacttcctctcgggccgggcatggtggctcacgcctgtaatcccagcactttgagaggccagtttgggcagatcacctgaggtcaggagtttgagactagcctggccaacatggtgaaaccttatgtctactaaaattacaaaaaatagctggggatggtggcaggcacctgtaatcccagctactcaggaggccaaggcaggagaatcacttgaacccgggaggcggaggttgcagtgagccgagattatgccactgcactccagcctgggtgacagaacaagactccgtctccaaacaacaacaacaacaacaaaaaaaaaaaaaaaaaagaaagcaaagaaaagaaacatgctcctaaatgagcattgggtcaaaaatgaaatcaagatgaaaattaaaaaattgtttgaactgaacgataataatgatataacctatcaaagcctttgggatacagcaaaggtggtgcaaagaggaaagttcttagccctaaatgcctacatcaaaaagacgaaaagagcacaaactgacattccaaggtcacacctcaaggaactagagaatcaagaacaaatcaaacccaaacccagcagaagaaaggaagtcaccaagatcagggcagaactaaatgaaattgaaacaaaaaagaattgcaaaagataaatgaaacaaatagctgcttcttcaaaaacataaataaaattggtagaccattaccaagattaagaaaagaagagagaaaatccaaagaacatcattaagaaatgacacaggagatattacaactgacaccactgaaataaaaaagattattcaaggctactatgaacacctttatgtacataaactagaaaacctagaagagatggctaaattcctggaaaaataaaaccctcccatctttttttttttttacaattagtattaaaatgggaagcatatctagctcccagatcttggttacttttttttaaaattattattattatactttaagctttagggtacatgtgcacaatgtgcaggtttgttacatatgtatacatgtgccatgttggtgtgctgcacccattaactcgtcatttagcattaggtatatctcctaatgctctccttcccccctcccccgaccccacaacagtccctgatgtgtgatgttccccttcctgtgtccatgtgttctcactgttcaactcccacccatgaatgagaacatgcggtgtttggttttttgtccttgcgatagtttgctgagaatggtagtctccagcttcatccatgtccctacaaaggacatgaactcatcatttttaatggctgcatagtattccatggtgtatatgtgccacattttcttaatccagtctatcattgttggacatttgagttggttccaagtctttgctattgtgaatagtgccacaataaatatacatgtgcatgtgtctttatagcagcatgatttataatcctttggtatatacccagtaatgggatggctgggtctaatggtatttctagttctagaaccctgaggaattgccacactgacttccacaatggttgaactagtttacagtcccacctacagtgtaaaagtgttcgtatttctccacatcctctccagcacctgttgtttcctgattttttaatgatcgccattctaactggtgtgagatggtatctcattgtggttttgatttgcatttctctgatggccagtgaggataagcattttttcatgtgttttttggctgcataaatgtcttcttttgagaagtgtctgttcatatactttgcccactttttgatggggttgtttgtttttttcttgtaaatttgtttgagttcattgtagattctggatattagccctttgtcagatgagtagattgcaaaaattttctcccattctgtaggttgcctgttcactctgatagtagtttcttttgctgtgcagaagctctgtagtttaattagatcccatttgtcaattttggcttttgttgtcattgcttttggtgttttagacatgaagtccttgcccatgcctgtgtcctgaacagtattgcctaggttttcttctagggtttttatggttttacgtctaacatttaagtctttaatccatcttgaattaatttttgtataacgtgtaaggaaggtatccagtttcagctttctacatatggctagccagttttcccagcaccatttattaaatagggaatcctttccccattgcttgtttttgtcaggtttgtcaaagatcagatagttgtagatatgcggcattatttctgagggctctgttctgttccattgatctatatctctgttttggtaccagtaccatgctgttttggtgactgtagccttgtagtatagtttgaagtcaggtagcgtgatgcctccatctttgttcttttggcttaggactgacttggtgatgcaggctcttttttggttccatatgaactttaaagtagttttttcccattctgtgaagaaagtcattggtagcttgatggggatggcattgaatctataaattaccttgggcagtatggccattttcacaatattgattcttcctacccatgagcatggaatgttcttccatttgtttgtatgctcttttatttcattgagcagtggtttgtagttctccttgaagaggtccttcacatcccttgtaagttggattcctaggtattttattctctttgaagcaattgtgaatgggtcttcactcatgatttggctctctgtttgtctgttattggtgtataagaatgcttgtgatttttgcacatcgattttgtatcctgagactttgctgaagttgcttatcagcttaaggagatttggggctgagacgatggggttttctagatatacaatcctgtcatctgcaaatagggacaatttgacttcctcttgtcctaattgaataccctttattttcttctcctgcctgattgccctggacagaacttccaacactaagttgaataggagtggtgagagagggcatccctgtcttgtgccagttttcaaagggaatgcttccagtttttgcccattaagtatgatattggctgtgagtttgtcatagatagctcttattattttgagatacatcccatcaatacctaatttattgagagtttttagcatgaaggttgttgaattttgtcaaaggccttttctgcatctattgagataatcatgtggtttttgtctttggttctgtttatatgctggattacgtttattgatttgcgaatgttgaaccagccttgcatcccagggatgaagcccacttgatcatggtggataagctttttgatgtgttgctggatttggtttgccagtattttattgaggatttttgcatcaatgttcatcaaggatattggtctaaaattctctttttttgttgtgtctctaccaggctttggtatcaggatgatgctggcctcataaaatgagttagggaggattccctctttttctattgattggaataatttcagaaggaatggtgccagctcctccttgtacctctgaaaaccctcccatcttaaatcaggaagaattagataccctgaacagaccaacaacaagcagcaagcttgaaatggtaattaaaaaattaccaacaaaaaaaagtctaggaccagatgaattcacaacagaattctgccagacattcaaagaagaattggcaccagtacttttgacactattccacaagacagagaaagaaggagccctccctaattcattttaggaggccagcatcagcctaataccgagaccaaaaaagaaaactgcagactgatatccttgattaacatcgatgctaagatccttgacaaaataccagttaactgaatccaacagcgtatcaaaaagataatccaccatgatcaggtgggtttcataccaaggatgcagtgatggtttaacataggtaagtcaacaaatgtgatacaccacataaacagaattaaaaacaaaagtcacacgatcatttctatagatgcagaaaaaaaacattcaacaaaatccagcatcactttacaattaaaactctcagcgaagtcagcatacaagggacatacctcaatgtaataaaagctatctatgacaaacccacagccaacatagtactgaatggggaaaagttgaaagctttccctctgagaactggaacaagacaaggatgcccactctcaccactcctcttcaacatagtactggaagtcctagctagaacaatcagacaagagaaagaaaaaaagaacatccaaatcggtaaagaggaagtcaaactgtcactgtttgctgacaatatgatcgtttacctcaaaaaccctaaatactcctccagaaagctgctagaactgataaaagaattcaacaaagtttctggatacaagattaatgtacacaaatcagtagctcttctttacaccaacagtgaccaagcagagaatcaaatcaagaactcaaccccttttacaatagctgcaaaaaataaaataaaataaaataaaatacttgggaatagacctaaccaaggagacgaaagacctctctacaaggaagactacaaaacactgctgaaagaaatcatagacgacacaaacaaatggaaacacatcccatgctcatggatgggtagaatcaatattgtgaaaatgaccatactgccaaaagcagtctacaaatttgacacaatccccatcaacataccaccgtcattcttcacagaattagaaaagacaattctaaacttcatttggaaccaaaaaagtgcctgcatagccaaagcaagactaaacaaaaagaacaaatctggaggcatcacactacctgagttcaaactatactgttaaggccatagtcaccaaaacagcatggtactggtataaaaataggcacatagaccgatggaacagaatagataacccagaaatgaacccaaatgcttacagccaacggatcttagataaagcaaacaaaaacataaaatggggaaatgacacccttttcaacaaatggtgctcagttaattggctagtcacatgtaggagaatgaaactggattctcatctctcaccttatacaaaaatcaactcaagacggattaaggacttaaatctaagacctgaaactataaaaaatctagaagatatcattggaaaaatccttccagacattggcttaggcagagattttatgaccaagagcccaaacacaaatgcaataaaaacaagataaataattgggacttaattaaactaacgagcttttgcacagcaaaaggagcagtcagcagagtaaacagacaatccacagactgggagaaaatcttcacaatctgtacatctgacgaaggacgaatatccagactctacaacgaactcaaacaaatcagtaagaaaaaaaaacaaaaaacaaagaaacaatcccatctaaaagtaggctaaggacatgaatagacaattctcaaaagaagatatacaaatggccaaaaaacatatgaaaaaaaatgctcaacatcactaatgatcagggaactgcaaatcaaaaccgcaatgcaataccactttactcctgcaataatggccataatcaaaagatcaaaaaataggagatcttggtgtggatgcggtgatcagggaacacttctacactgctggtgggaatgtaaactagtacagctactctcgaaaagagtgtggagattccttaaagaactaaaagtagaactaccatttgatccagcaatcccactactgggtatctactcagaggaaaataagtcattatacaaaaaaaagataattgcacacgcatgtttatagcaacacaatttgcagttgcaaaattatggaaccaacccaaatgcccatcaatcaaagaactgataagctgtggtatatatacatatatacaatggaattctactcggccattaaaaggaataaattaatggcatttgcagcgacccggatgacattggagactattattctaagtgaagtaactcaggaatggaaaaccgaacattgtatgctctccctgatatgtgggagctaagctatgaggacgcaaaggcataagaatgatacaagggactttggggacttgtggggaagggtgggagtggggcaagggataaaagactgcaaatacggcacagtgtatactgcttgggtgatgggtgcaccaaaatctcacaaatcaccactaaagaacttactcatgtaaccaactaccacctgtaccccaataacttatggaaaaattaaaaaaaacaagcaaacaaaaaccaaagtgtgctatcccatacactggaatatcatttgacaattttaaaaaatgatgtactgatacatggtgtaaaatggatgaaccttgaaaacattatgctaagtgaaataagcaaggcacaaaatagccacatatcatatgatttcatttatatgaaatgtccagaataggcaaatctgtacaaagagaaggcagattaggttttgctacggcttggagggagtgagaatgagaaatgactgctaatgtgtacagtttcttttagggggaaatggaaaattttctaaaattagattgtgatgatggttgtacaatcctatgaagatactgaaaacattgaattgtacactttaagtggatgaattgtacggtatataaattatatctcaataaagttattttaaaacaatgcacattatagaaaatctacaaagtttctgctaataacatgtaatgtttttagttgtctttaaattactatctttattttaggatgtttttagttctagaatcctgagatttgatgaacaaatgggtgtgattttccccacaattaactttgggcacattttaagtaattgtatgtgctgtgattactagaactacacatgctgtgctagtatggaatagcatgatttatgaatcatattttttctttaatatttctttagtattttgagccacctgtaggctcattgagctgatgtttggagcaatttgctattatgcctatcttgcatggtaaagggtagtatagagctcattatcttttaagtttagttcatattctttttctctaagttcatcattaccttagacatactactattgaatttcatgtggcagctttggcctgctcaggcagccttgagccattatttatcagtttgttactgttagcttaacatttcactactgggaagagctaaataacatgcaaatttgaaggtcttattgtataattccttttctagataattaaaatgttaatggttgctcaatggatataaagcttcagttatgcaagatgagtaagttttacagatctgttatacaatatggtgcctacagttgacagtacagtattgttcaccttaaaatatgttaagaggatagatttcatgttaagtgctcttaccacaaccccccgacacaagaacatgaagaaatttttggaggtgatggatatgtgtagtactttgattgtgcttatggtatcatgggtatatgcatatatccaaactcataagtatgtatgcattatgtgcagttttatatataaattaataaagctttaaaaaagtatctctgcatgcacttttaaatttccctctgttaatattctgggtctaaaatagaacctatttatggttttgttcatggtctttaatctccaaatacagataaggttgtaaaaacattaacaattatgtgggaaccacaacttccaactgatggtctactcttgtaatattcttcttgcataaagcaagatatgatgtttactctttctcctcaaatattttccttttgttgtctttgtttcccccagtggcaatgcttctctagttttacagtggaatgcaagaacaaaagtgattagcttttttaccaatagatgtcttctgttctgtaaaatggggcaagcctgtaagtttattctgaattttgggttatagtatggaatggaggagaagatgctattactaggacatagtagagattggctatgatccaaataccattacattacaatttgaatcttaacaacaaagaagatatcaaattgactcctttttctacgtgatacaacacagtgaccttgaaagcagttctaatttcaggcttgtctttcagtgttactatagtcattagatagtttcacaatggtaaatgtgacttattaggtatgagatatttcattttcagaattatatcaaagcttgacattagaacagatgtagatatttgcagctgtgtgtccgagtcattcaaatcgcttctacctagaagtgcaaatagatttgaattttcctttctcagagtgatttgtgtccagtttgtagattttctgagcactgtcttctttatctcttcttgctttccttttttgaaattcattgttttcaatgagtttgtgtgtgaataataaaaggctagataaagcttaagctagcaaatttcagtgtttttttcagaagccctaataaaatatttactttatttttaaaaggtacttggtttgaaggagtagggccataagagtgattacagaaacggtattgagggcaagtgctggctgaacttagagactgggcttacagtagtccccccttaccaagggggatacattccaagaccccccgttggatgcctgaacctgtggataatacctaaccttttatatactgtgtggttttttttttccatctggtaacagagacagctactaagtgactcatagacaggtagtgtttatagcatggatatgctggggaaaggagtagttcaggtttcgagagggatggaatgggacaacatgacattttatcatgctacacaaaatggcgtgcaattaaaaacataaattatttatttctggaattttcaatattttcagaacacaggtgactgaaaccatggatagcaaaaccatggataaggaagaatttctgtacttttagaatttaatgtcctttagtatcataaataatccagagtttgccttctgcctttcagatttaccactagcagaatagtggaatttttttcttgttttttattttggtatatacatttaattttttcatgaataacaaaaagaatcatgatagtttattcaaaggtttcccatgtaaacacctaagatgggaccaattcaatccaaaatttaattgtatacctattatgtgcctcaaaatgaactagatatttgatttacaaggttcagaaaaaatgtatatattcccagcccaagattcttaatttttttaaataataggatgtaaggaaaaagagactttagtttaaagagctattaccataatgcagaaacatgagtcaaaaatagatcttactcacctgcaagtgtatgtactaagtgaggaaggaagtattcagtaggtgatgttgaacactagcaccttattgtaaaggtcctgatcttcatgcgcagagcagcaagccctgcagtagagatttagtgttaaggtatatgttgccattgttattgggaaaaacttgttttaattgtgaaagtgggtatgaattcttctaaggctctattggaaaaaaccttaatgcaaatattcattgagcaaaaacggttatacatatgtgaattatctcttacccaaaataaactttcaatgtaattaaggagttaagactgcatatatgaagccattgtagacatgacagagtaagaacctaccctaacctcttggggtaaactctctttgcccaggaatgcttcatggaagaagtaggatttttcttttcttgttaagaggcagggctccctctgtcatccaggctggcctgtagtggcatgatcacggctcaatatagccttgacctcataggctgaagccatcctcccacctcagcctcctgagtagctgggactacaggcatgcaccactacgcccagctgatcttttttattttttgtagagacagagtctccctttgttgcccaggctggtcttaaactcctgggctcaagcaatcctccagccttggcttcccaaagtgctacagccacaacactcagccagaagtgggattttagatgcccactgaagaattgatagacttccttatgttacagtgaaaatcacctttttcagtagaacgtactatagcttttggttgacatgtgtactggaagcaatgaattgcattatggcacagtaggaatgataaacacaggttctgaagtcagactgtttgaatccaaattcggatttcatcacttactagctccatcactataacatgggaataataacagtatctttctaatagggttgttaaggattaatgagaataatacatctacatactgtgagaatagtatgggctatgtagtctgattggctacatagctgattgtagtctggttcaaatcccagttctgccacttacaaaaaccttaggcacttggcttctcaagattcagttttctcatttataaatggagataatgaagcctaactcacagaactgttgtgatgattaaatgaagcaatttacatcaagtacttactggagtgcctgacatataataaaagctctataaataatgttatgttcttatacaatctaagtcgtgtagagacttcagtattatctttttattcgtgttttcagggtgagcctggtctgcctggatacccagggaaccctggtatcaaaggttctgtgggagatcctggtttgcccggattaccaggaacccctggagcaaaaggacaaccaggccttcctggattcccaggtaaaatttcttctcttaaatgcttccttctttccttccttatctactccaaccagtatcacagagcagcttcttatttggcagacttatattttatttcccaatcagatactgactagcaacataatctcaaactatctctttaccttttctttgcccaaatttatttctgtataaaatgagaatgaatattactgactcagcaggacaatatcctgtggacagagagactgtttggtggagcatttttcaatctttgactgctagccacaaatcacttaagaagccttgctatttttgtaggtaataatatatacttccaagcctctgcctgcagctgattatcttagaaaggtatgcccaggcacaccgctggtagcggttggtagaacaatcatacagttccttcaaatggcaaggattgagccattcaagtaagagattagcactatagtcaattatgtagcctgaactagattattatagtacctacttgtttagggttgaatttattttttgcttgttttgaattacacagtggcatggatgaatgaacctttcctttttattgaagtgaagcatacatgtagtaaagtacacttaagactatagatgagtttttacctaagtacatatatgtctttgaattgaccatatgtatcaagatataaaatagtttcttcatcccacgaagtttacccatgcccctacgccccccaaccccgaggtgaccactactatgacttccattaccatcagttaattttgcatgttattgaaattcatataaatgaaatcatacagtgatccttgtatctggcttttttcagtcatcattatgtgtaaaagattcatttattttgttacacgtgtcagtagtttgttctttatcattgctatgcaatattacattgaagaatgtaccacagtcaattacacattcccctgttgatggacttttgggttgtttccagtttgggactattatttttaaaaatgctattaacattcttttacatatcttttgataaacatatacattgatttctcttagacaaaaacttagtagtagaaatactgaatcacagggtaggtgtacattgaactttagtagatgctgccaaacagttttccaacatggtttgtaaattagtttcaacagccatgtatgaaatatccagttctccaattgcccatgtcctcaccatcactgggcagtgtcggtcttaattttatctgttttgatgagtatgtagaagcatctaattgaggtttgaatttacatattcctaatgaataatagtattaatcatctttttattatactattggccatttggatagcatctttttgaagtttcttcttaagtacttttgttcattttttattgaattgtctgtcctttttcaaatagattcagagtagttctttatatactcaagatatgagtcctttgtcagatacatatattgcaaatctattctctgtgcctcagatttgcctttcctaatgctgttgtgtaatgaacaaaagttgttaattttaataaaatccagtgtatcaatctttcctttcatgaatagtgatttttttatccaattcaataaatatttgtctatttgaggttatggaaataatcttctaatttttataacatgtttcatgtttaaactttcatatttggcttatgagctatctcaaataaaaatatttttacagtgtgaggtaggggtcaaggttcattttttttccagcacagttatccaattgctccctacactattttttttttaaagaacctaaacgcatccaataaattacagtcacacctttgtaagaaagccaaatgactgtacatgtggtgggctatttccagactctgtgtactgttccaatggtttattttctattgctgctttaacacaacactgaattactgtaaatttatattaagccttgaaaaatggtgggtaagtactagaaatttgtttcagttttttaaagcttgtcttggctattctaatttttttgcaggggaaatcagtttatcaatttccatttaaagtatctgtagggatttttaagtttgcaataactctctaggtaaggtagaggagaattgatattttgacagtattcaaccttccaatgaaatgaacatgttatctctccatttatgtaggtattgagtttgatttaacaatatgctgcactttttgttttgtaaatcttgaacatattttattaaatttatctctggaaatttgatgctttctggtgacatttaaatcatattgcttttcccagttcatcttccagttgtttcttggaagtatatggaaataattgacctaggaatattgaaataatatatgagaaaattgccaatttcactttttaaaattctgagtttgtataattttttgttttataaaatatcaccttagatatttttatttcttctttttcatttctttataccttttatttctttttcatgcttaattgcaccagttaggacctgtagtgcagtgtttaatagaagtggttatagtcaacatcattatcttttttctaaactcagagggacaatgattgctatttttccattaaatgtaatgttagtgccagggttttggcacatatattttactaaattaaggaaatccctttctagtcatactataatgggaatttttataaagaatggatgcgagttttatcaaattctttttctgaatctacagagatgataattgttttttctcctttactcttgatataatgaattacactgattgatattttatgtaaaaataaccctgtattcttgggataaactccaagatggtcatactgtacacattatctttaagtattgttggactggatttgctgttttttaaaaaattatacatggccatgagagagattggcctacgattttcttttctcatagtgtccttgtcaatgttttagtatagggatttgctggccttatgagctgggaagtattccctccttctctattttttctttaaatgtttcatagaattcaccagttaaggaatctggatctgtagttttctttgtagaaacctttttaaattacagattaaaagtctttaacagttatattactattcagatgatttatttttatgtcagtttaaatacattgtgtttttcaaggaaattgaccatttcatctaaattgtcaaattcattggcagaaagttgttgataatatccttgttttgtccctttaatttctgcagaatgtgtactgaagtctgcattttaataatgttttgatataagtaattttatttctttattttgatcaagcctctgaggcattcattaagctttattaattgttaaaaattaactttcgtaagtgattttctctaccatttgttttctattccattgatttctgcttatatctgtattatttcctaccttctaccttctatggatttaatcttgctgttctttttctagcttctttacctggaagcttaaatcatagatttttcagctttgtcttttctaatagatgtatttaaaaacttaaatttccatctaaggagtgctcaaaccatatcccagaaattttgttcttttgcgtttttcctttgatcattcggtttaagatattttctaattttcctgttgatttctgtttttctccatagattatttagaattgtgttgctcaacttacaaatatttgggggcttcccagatatctttatgttattgatttttaatttgattctattgtggccagaatacatattttgtatgatttaactattaatacttattgagacttatcatatggccaaatttagggtttatctgggtgaattttccttgtacccttgaaaataatttgtattctgcaatttgtgtattgcattataaatgtccattaggtcaggtttgttggtagagttgttaaaatcttgtgtattcttaccaacttcttgcctaattgttttatcaattactgagaggtaggtgttaaaatttccattatgattgtagagttttctatttctccttttctctctgtcaattttttgctgtatgtcttttgagatatttttattaggtatatataaattcaggaaacgtatgtcttcttgaagagttgacctttttatcattatgtaaagaccctctttattttcataatactcttttctttggatttttctttgtctgatatcagtatagatacatcagattctttatacttagtacagtataactttttctatataatttttatttttacctgtctgtacatttaaaatatgttttttaggaataaaatgcattcatatcttgcttcttttcgagtccaacaatctttcccgtttatttggagtgtttagttgatttatatttaatgtatattgttatgtttggattttagtcttccacattgctatttgttttatgctcctcctttgtccctggtttcctgttctgtttgggttcatcagatatgctgtggtattccattctatctcctctattggcttttaagctctccctctttctactatttttaaatgattgctccaaagatttcagtgtgcactcataatttaccacattctgcattaaattaatattatgtgacttcacatataatgtaagattcttacaacagtgtaattttatttacatataatgttcttttgtgtgattgtgtttatatatttcagatgattattatataggtaataaattttacaattaattgctattactattgctttaaacagcttcttctaaataatttagcatgagaaacaaaaccaattttcatatttaccaacatatttacatttctactcttctaccctcctgtgcagcagacttctagttggtatcattccctaaagcctgacgttcttccaccgtcatttattgtaaaatgattttgctggtgacaaattctctcaccgttaatttatctgcaaatgtctttgttttagttccattttaaataaatttttcactggatatagaaatccctttttgatatttgttgctttcagcactttaaatatttcttccactgtcttttcgtctccatttttcctgataataacacatcaattatttttaatattttgctcctttatattatgtctggtttttctctggatgtatttgagattttctctctgtaattggttttcaatagtttctttttgttgtggttagttatggttgtatttattttgccctctattcattaatattcctggatctgtagggttgttattttttaataactttggaaaatctcagctatcttttcctcatatatagtcgtgtgtcacataacaacattttggtcaacaacaaaccacgtatatggtggtggtctcatatgattatcatggaactgaaaatttcctatcaccacgtgatgtcatagctgtagtaacattgtatcacatttataatgtatttttactgtaccttttctaggtttagttatacaaatacttaccattgtgctataattgcctacaggatgcagtacagttacatgctatgtaggtttgtagcttgggagcaataggctctgctatacggcctaaatgtataataggccataccatctaagtttgtgtaaatacactttatatgttcacacgatgacaaaatcgcccaacaactcatttcttaaaacatacccagttgttaagtgacacataactgtatttcttctgtcgtattttctcctcttcttttggagtgcatattagatcacttgatactgtatcacaggtcactgagggtctaggtatgttttcaatttttattctctctgagtttaatttggatggtttttattcactgccttcaaatttactgattttttgatgtgttcaatattctgttaatcgccacaaaaattttaatttccatttggttcttttaagagttatcatatttttccagaaattccctattttttactcattatatacatgtttgcctatagattctttaacatatttattatagctattttaaagatcttttcagcttattccaaattttcagataaccatgtgtctatttctattggtagttttgtttttcttgaataagcaccacatattcaagtttcttccaatctgctaatttttattgtatactaaatgatatggatagtatggtataaagattctggattctattaaatttcttgaagaatgctgaatattgttctacctggcagttcaattcctggtatcaacttgatcctgcagtgatggagttttagattttgttatagcagggctatttccaatgccctttgtcttacgtgtatcccttggacttggcatacgggctttattgttaatgtgtgggttttctggggtaattttatttaaaaaatttcatttagtatttcttttttttaagtttattattattatactttaagttttagggtacatgtgcacaatgtgcaggtttgttacatatgtatacatgtgccatgttggtgtgctgcacccattaactggtcagttagcgttaggtatatctcctaacgctatccctcccccctccccccaccccacaacagtccccagtgtgtgatgttccccttcctgtgtccatgtgttctcattgttcaattcccaccgatagactagattaagaaaatgtggcacatattcaccatggaatactatgcagccataaaaaatgatgagttcatgtcctttgtagggacatggatgaaactggaaaccatcattctcagcaaactatcgcaaggacaaaaaatcaacaccgcatgttctcatttagtgtttcttatagtgaagtctgttggcaacaaattgtcttagctgtcattcattagaaaacatttccattgtgctttcacttgttattgagttacatagtagacagaattctaccatctccaccccaagatttctggcccctggttatttagtaaaaaaccaatctccttaaagctggtaagcaacttcagcaaagtctcaggatacaaaatcagtgtgcaaaaatcacaagcattcctatacaccaataatagacaaacagagagccaaattatgagtgaactcccattcacaattgctacaaagagaataaaatacctaggaatacaacttacaagggatgtcaaggacttcttcaaagggaactacaaaccattcctcaaggaaataaggacacaaacaaatggaaaacattccatgctcatggatagaaagaatcaatatcatgaaaatggccatactgcccaaagtaatttatagattcaatggtattcccatcaagctaccactgactttcttcgcagaattagaaaaaaactgctttaaatttcatatggaaccaataaagagcccgcattgccaagacaatcctaagcaaaaagaacaaagctggttgcatcacgctacctaacttcaaactatactacaaggcttttatcacctagtgatatcatagccatagtaacattgctaaggagagaatccagctcagctgtgcccagaatattacctacagaaatggtgagataataaatgggtattgttttaagtcattaactttgtggtaatttgttacatagcaagagaaaactaatgcactatccttttgttcattatttaagtttttacttccctcctaaatatgcttgttagtatttattttagggtctttgaatagttgctttttgtattctgtcaagttttaaattataatcagtgagaaaaaaaggctgtagtgggcttattctatcttggcttgcctcagaagtgtttaggggtaaatttaagaaaatatttgcatggtatattcactgaaaactataaaacctgctatgttagacttttaaataccaaaataaatgaagagatagatcatacttatggaatggaagatcaaaattgtttggaagccattatccttagtaaactaattcaggaacagaaaaccaaacactgcatgttctcactgacatgtgggagctgaacaatgagaatacatggacacaggaaggggaacaacacacactgtggcctgtggagcagggtgtttgggtcagggggatggagagcatcaggaaaaatagctaaggcatgctgggcttaattcttaggtgatggtttgataggtacagcaaaccaccatgacacacgtttacctgtgtaacaaacctgcacatcctgcatacgtaccccagaacttaaaataaaaaaaaaaaagatgccagttgcctctaaagtcattcatagattcaaagtgattccagtttaacccaacaacctttatttggtaacagttgacaaatggattctaaaatgtgtatggaaatgaaagggacatagaatatccaaaacaatattgaaaacgaggccgggcgcagtggctcacccctgtaatcccagcactttgtgaggctgaggcgggcagatcacgaggtcaggagtttgagactggcctggccaatatggtgaaaccctgtctctactaaaattacagaaattagccgggcatggtggcatgcacctgtattcctagctactcgggaggctgaggcaagagaattgcttgaacccgggaggtggaggttgcagtgagccgtgatcgcgccaccgcaatccagcctgggcaacagagtgagactccattacaaaaagaaaaaaaatgtgtggtacttgataaggattgagaaatagatcaatgaaacagaatttggaggataaaaaagactaatatacaataaattgacttttgataaaggtatcaaataaattttttagagaaagcaaattcttttcaacaaatggccctgaaacatctagatattcgtatggggaaaaaacaaaacttaattcatacattacatcatacagaaaaaaaaatgtttttaattagatcttagtctgaacataaaagctaaaaccataatgcttttagaggaaaacatagatagatatttccgtgacttggcataggcagattttcttaggatacaaaaagcagtaactgtaaaagaaaaaaattgatagattagatttaaatttttaaactacttttatcagaaaacaccgctaggaaaatgaataggaaagccacagacaaggagaaaatatttgcaaaacataactgacaaattactgatatctaggatatgtaaaaaacttcaataactcaataataacaagatgtattatccaattttgaaaaatggagaaaactttgaatagatacttcacgaaagaagatatacaagtggccgataatcacatgaaaaggtgatcgatgtcgttagccatcagagaaatgcaaattaaaaccacaatgaggtagctccatatacccaccagaatgtctgttattacagcaactgatatcatcacaaaggttgtgcaaggatctggaacaattggaatttccacacattgttctgagtgtgaaatggtttggcagtttttaaataaaacacaacatatacctactttttgacccagcaattccacttcttgttatatacctaagataaattaaggcagtggtctacaaaaagacctgtgcagaaatactcatagcagctttatttataatagataaaagctggaaataaaacaggtttttataaataggaaagtggatatttgtaataactaaaacctgtcaataaaccaaaagtccagcaagaggaatggattttttaagttatggtatattcatataatggagtcctacaaatcctaccagtataatatggtggtagttatttttatgtttatgaatatataataatgccaacttcaggataaatggttaaaaacataaaattattattaaaaatagccaacaaacaccagcatcttttgggtttctttttgttcttcactgtttctatgctagcactataaattgtaagtttgaattgtagctcttaaagcaatgcagtttttctttcatttttaaattgagctctttactctaggaaccccaggccctcctggaccaaaaggtattagtggccctcctgggaaccccggccttccaggagaacctggtcctgtaggtaagcatgaaaaataacagtttgctgttttataaaactaatgtttatcatattaagtttgggaaagtcaaatcatgttcagctgtgaacattttcaacacaaggaaatatagtgttcattcacttaacactgcatgtgaggtacagaatgaataacttttaataaaaagtgcttaaaattggctgggcacagtggctcacgcctgtaatcccaacattttgggaggccgaggtgggaggatcacttgaggtcaggagctcgagactagcttggtcaacatggtgatacgccatttctattaaaaatacaaaatattagctgagcatggggatgggctcctgtaatcccagctacttcggaggttaaggcacgagaagtgcttgaacccaaggggtggaggttgcagtgagccaagatcgtgccactgcactccagcctgggtgacaaagcaagaccctcgaaaaaaaaaaaaggacttaaaatgatcatatgtgaccttattttctaggcccactttttccagggagagttaattcaagtgtcctagaatagaagctttgatttttttagaatggcaggctgtagtaagtaagtttgtttattgatttctaaagtaaataacttctcttggccccatatgaggcctataattctccccaccacccttcgcaccttactctcttagatattctgaaactatattaaaatgaagaactgaaaggttttagatgctgaatgactattccttattttcattatcctccttcatatttttataacattttgtgatccaaaggagtgtctcaaaagcaccttgtttcttttggataaagaagggagcatatggaagtaaaagggagttggaaattggaaaactgggtgtaacctgctgtactcaattttttaggtggtggaggtcatcctgggcaaccagggcctccaggcgaaaaaggcaaacccggtcaagatggtattcctggaccagctggacagaagggtgaaccaggtgctgtagtttttcatttttcctatttttctaattttctctgtgttgaatttaacttgcctttttattacccacagtgaaattgtatcttctttcttactaagctaccacacactttccccttttcctagttaccgtcttcctcttcatcctgagactattagctcatgtatcttgatcaagttgcctcttacaaaaaaccccatatcttttcttgtctaattttttatatcaaaaagaagttacctagcctttgcaaatttctctgtggtttactatgcaatctatatttcatttatatttttttcttataagcatatagatatatttaacattcatcggaaatagaatatatgtttagatcattttctcatgttagaattgcagttctgtgttggaaataaatcttctgcatgtttcatataatatacattgctgcacctaatgaaaacctcaatgatctaaaaataatttggccttgtttcagtttgtattatccacttgagtttttgttttgttttgttttgtactctgacaggtcaaccaggctttggaaacccaggaccccctggacttccaggactttctggtaaaccttaataaaacatgctaaatcaatctataataaaatgagattatttccaaatacatctatttttccatctccaccttttactatcataaaatgcatgtaagaacccagaaaactcaaacctagtgttaacgttaaaacatttattatttagcaacttagtttaaggagttgtgttaaataaaaatgtatccttacggaaatttacatgtagagatctcttcactaaattcataaataagtgctgaggaaataagaaagaaggcaaaattgcaggaagataagaaaagtctgtagaaataagaaaagtctgtagaaatatacgccaataataaaaatgtttctggaaatttcagtcttaatatatgttttgcatatttgggtagatgtgtgtgtgcacacacacatctaccctccctcttttgtgcttactcttactgtgagcaccaaatagtagaaggactgaatgtacatacagacatgtatgtttatgttctgaaatgacgactggccattttatggagacttttctcaaaccatacacatatctcctgtaaagtcaaatagatatccttcccatgataccaacatggaaattattactttaatgtgccactgttacattgctcttaaaagtgtcagaggtagagaaaaaatgttgagaacaattttgctagacggtgattataaatattgggtagaatggtcttcggggacacatgacaaccattgaagagccatatctttcattagtctcaaaattagactcaaaatatttgttttagaaatttcctccagccatcttgaaactatttttgaagatactttatactttttttcctcacagctattggtgatgtatcattgctctgtcttaacacaaaggataccttttaggatgaaagctattattatttctacatttctatatatactctaataaatacttctgctaacaaatgcatatatttaataggaaggatggttttctgggtagatttgggatttggtaggagatagaaatgactcttgtgaattccattaattgccctaatgtatgtgaatagctaaccttataagcaagcttgtaactcggtattatttatcttctaattatactttactttcataggccaaaagggtgatggaggattacctgggattccaggaaatcctggccttccaggtccaaagggcgaaccaggctttcacggtttccctggtgtgcagggtcccccaggccctcctggttctccgggtccagctctggaaggacctaaaggcaaccctgggccccaaggtcctcctgggagaccaggtatgtccgtgagtggtaggagaatggtctatttattagtccatgtatttcgttttgctggcaggttattcagtctttaagactttagaatttttccggtgcattggaggatgttaaaaaaaagactttaaaatttgtgatataacttcttacaagtaaatagcttggttcatagctaactccatctatttccatggttctaataatttgctttagtaatgcattttatcatttatatagaggaagtaaaacaatttggaggaataaaggaaatggtagttttattagtcttgttactaaaaggtaaaactatactgttaacctgtcagcaaaatgccatctgcatttttaaatgtgagcttctcagcatgtcatcacagaaatcattttagtgatcacccaatagatgcttgtggtccataccagaagtattgctttggttctgtcatatgatcagcaaatctcaccaggcacaattaaaaaaattatcttctataggaactgggcaatcaaatttatctccaacatcacagcatgatcaaattgactagtgatctcttcataccaacctcatgtctatacctcatttgtcttgtgttcactgctctagtagtctcagttttgcatccaatgttcaccttttcattttgtatctgtgctgtgtcatttcattttactaattttggaaatgctcgttttcatccttgattaatgtcactgagcctagtcactggtgataggttatgaacagattttgagacttgatattcaaattttatatttctggtcactgaaaacttggaagtaaatgtccttttattctttgaaagtctctgacattatataagtgcatttcaaaatgaaaaatgttatttatattacagtaaaatctaaagtgattggaattcattttaataagatgttctaaacacatgaattaaatgggatcacatactgtgttcagaggatcattttcaaaaccaaattttatctgatctgacataatctgatggaaagtattgtttaaggttttatgtttgtatactactgaagaaaaccagtgaaaatctcctcagccatgttaactctcttgcatgtaatgtaaagaactgaagcaagtatcttgcttggttttgcatgcagtaattcaaataaaccaaactattatcttttttatattttaatcatcactgtggttattcgttcttactagtaatgaatgagtaatgagctcactgttgaaccttactttgaaatttgtcggtatgaagccattagtcacaaagatgtcctaaaaattacatttttaaagaaataataacaaaagtagttagaagaatgcacacctgatgagtgtttgtgacttctcaaattatttcataaactataaattaaaactgagttgtaaaccccattgctcttagaattgattgttcttagtctgagctcatagtaatgattatgatagcaatgacttttggcctttaaaaatacgccacagtgtgctgttttcattttagttttgtcactaagtggtgataatttggtttatatacagatgcatggatatgaactttcagagtattcttttattgaaatgaattttaacttgaaagtatttagtgtaatgctttttagtttcttgatatttctaacagttttgatatttttcctttttgttaatgatgacattgggccttggtgaactttgatccctatccaggtcctacaggttagctccttaactccaaagtagtaactgcatgaagtttgaaacttatatacctgtaccaaatgttttcaagtgtttgaatgtattttaagagcatatgtgccaattcaattcttacatagtggcttatctctttaagtttttaggaacttgtagaacccagtgtttctgtctattggaaagacccaaaattacctaactaggaaaactaatttaacatttaaaaattcatatatttgtgtcattttcagttgaaaatctgtagtaccgaaaacagccttacatattctacctttctttggagtctgtttcttatgtttaatttatatctgttaatgcaaacgaattgaactatccttcaaaaggacattctttttttaaacaataatatgtattatcagatcttgaaaatatgtaattcttaacttgccatatcttttgcaggttttcaaactatcccaccttcacattttgggttgtcacaaagttctcaattctactgctgttaaaaatggactaatagggccgggcaccatggctcatgactgtaatcccagcactttgggaggccaaggcgggtggatcacctgagatcaggagttcaagactcgcctgaccaatatagtgaaaccccatctctactaaaaatataaaaattatccaggcgtgttggtgtgcgcctgtagtcccagctactagggaggctgagaaaggagaattgcttgaacctgggaggtggaggttgcagtgagctgagattgcaccactgcaccgcagccagggcgagactaataggcacagagaaaaaaaaaatcaatgcaaccagcacagattacgaggttcttaatcttattttcattatacatgtgtaaacagtacacaccaaagaacaattaccaagagctacctaatggaaaattgctgattcttagtgaaagatgtttgtttacctaattagcagtaaaaaaagccacaaatatttgaatgtatttattgttattcaaaataaatagtccttttcaaattgttaagaaagaatcaaaagaggtaatagtataccccatgatatctggctgttgagaatggcaggacattttttcatcttataaaattaaaaaaaataatttttcaagattatttttagggagccatttgtttctacctgaattgattctctagtttcttactccactgcaaactcattatttcatagaaccatagaatgtcagatctagaagggacctaagttttacctatgtcgaggagaaattatccacaagacagattttattcaggactattgcagtagagtagaaactattgcagtaggagagagactgagctcaacttcaaatacaacaaagaaaagtgattatttacagccaaggagcagagtgagagggccagtaatggaaaattactaagaggagacatcaagggtagagaggggtgggttcttgttaaactggcccaacaggatttttgccagaaacaggccaaggatttagacatcaaaggtgggagatcaggaacttgatcagatatcggggtgaagggactctctctaaaccgatttagcaggattattgatgtaaatggatttggaaggccaaaaagtaggcccaaggatgaggcctaattgagaggagggctcagaggagcctgtctaaagtttgatcaaggaatctttgtcacatatgaaaaaatggaggcccaaagaggttaagaaacttgctcagggtaatactgttagttagtggcataactgggactctgacttaaggctccccagtgatcaattaggtgtctattctacagggagcagactgttcgctgcatccactttcttgttttctgttacctcaaaagctccgtcaacacctccatcaaccagattgcttcttgtgttcttcttaaatgatgtcatcaaaaagattaagacagtgcatactatttaactatcactaagataaagcaaagactagggggttactttgaagtaatgttgagtcccaccttatctgacctacatagaattttgccactttgattactgctaaactctactgttagctaggagatttctatcttctgagttactataatatattcaaagaagaaaaagaaaagtagccacattcctttaaaagaaatttaacaatttattatttacaaaatgtgctctaaattgcatagttgttggaacttggtctctgtgatgttttcttctttgcaagactacaaccttaagtggaaactgaatttaaaatataccagtcaattcatcagtatacctttagtaattactacttatggacaatattttaggtttttgttttgttttctttttcagtttaactttgttacacagttgaaaaataatggattgtggacctcatacaaaaaaaaattgacttggcatatagctcattaaaatgttgctttttaaaatagagtcttagaagttttgctatgatatgatccacagttttccttgctaattactcaggctgaaatgtcatatttcaatgaaatattttgctgagagttcttgttattggtccctctatatcaaacacatatataaaatgtctttactcaaaccttgagttgtcttagttgggaattctaatttatttaactaattttgtggccagactctgctctaagtattgtcttgagttaatttgctgtctgtgatttagaaacaatttaaataaacagaagccaatatttagctttctgaatttcaaagtatcaaatgctttgaaagttttattaggagataatgataatgttttctatttatatgacatgccacaatttacatcatataatgtacttttattgtaagcatcttaagggcagagtttgagtcttgctcatctttgtgtttcctgtagcaccttgcacatggcagacattaggccagtattttacaacttgaatttgatctttaaaacattcctgtgagggaggttagggcagataccagtattcccattttacaggtaaaaaaccatactcagaaagattgaattgcccaaagtcatatagttattaagtagcagagtcaaaaatagatcctaggtcttccaactcctaggattcattgctctagcacaatttattctctctgctaacatttggtgcttataaatcatagcaaaacttgtaagaaaagaaaattgtgtttttagtcaattaacactaaccaaggggtgctctatttgtaggcttttaatctttttatttaatgatccttcttttaatagtgaatagcctgtcttaatatgtgcattgaataataatagagtaaatatgatattttctgtggttcggggtgggatattgcatgccaaaacattttcaagtaccctttcactgataggcttcatatcttggaaaagttgaatctttatttttgtgttcaatgttgtacaaatatatattggctttttctccttaagtaacttattgcaagtactataataataatataataataataataataataataggccaggcatggtggctcacgcctgtaatcccagcactttgggaggccgaggtgggtggatcacctgaggtcaggaattcaagaccagcctggccaacatggtaacaccccgtttctactaaaaatatgaaaattagccaggcgtggtggtgggtgcctgtaatcacagctgctcgggaggctgagccaggagaatccctagaacccagaaggtggaggttgcagtgagctgagatcacaccattgcactccagcctgggcgacagagtgagactctgtccaaataataataataataataattcaataaatagtaataggaaagcctcctggtgaattatgaaaaaaatcagaatgtggcttcatgaaatgcttttcaaatacaagcaaaagtacagttggtaatggccatcgtatattcatgttttgatttttctattctgtcacccatgatctttatatttattgccaatgaggcctttaaagtcaactgtatcttcttgaagcagtctgagcatatcaagaaattggcacctggtgtttttattaaaagataacacaagccaagataaacttcagcattaatccaaaaatacccctttactaaaggaatttgaaggctgttggtgaaatggtactatctagccaactttaatgttttgagaagctaatttttggaaagccacagtagcagtgttaacatgatgtcttcagtagagttttctattttctggattaacgaagaccaacagcttatcctttagaataagctctatttgaaaaagtttggctctctatacttctgtatggttctgtttgcatactgattatgctgtaagtataagaaatgctggcaaagaacattattgttttaacttgtactataatgtgaaccacttctaactcataatcttattttgtactgtgtgatgtctgatactgctaacatcgatctttgggctttggtgaactctgatcttcccaggttttcaaggttagactcttcactggtcaattcttttttttttttttttttaatgctttgtgtgtgtgataagagaaatgcaattttttgctataattcagaagtcattggagagtgctgttatcctcaagctggggttttaacattttgatgaaggtaatgtgacttgattataattaagtttcaaatgacgttagggtctttgtgtttgcaattgtttataataagtaatcaatacataaagacatgttgaattttaaacggaaatacacttatttttaccttcaagactgcattaaaatatttaggcaagcatatgacctatttgtaatctctgaatgttgattttattttctcaaaattttgttttctcagattgccctgatctgtgtatttatggctattttcagtgatggcagagatatactattgaatactgttaaaaataaaacttatatgttctttatgtaattaataactcataatttgaaggactctaaacatcaggtctgaattaacatgcaagtttcccatttttttttaatttcgaaaagtgcagtgccttaggttatttcagatgatacagtgttctgataacttttaaaatggagtagagggtcataaaaggtttctttttttcccatcttactttgttattgttatcaggttgattcacagtttatttatttttcataattagctgatttgctacttaatttctagtgcaaatcatacattgtggattaaattgacaagtttgcttagaacactgaagttctgtttttttattcaaatgtacaatgtactaaaccttttcgttatgattgagaagggaatttctgtgttgactggttgccagcctagggtgactatatgagttaaattgtttaaatgtaaaacaattgttgtactattgtaaatctccttcctctttctcatatgccagatagagtcatgttatattatgaaattacatagaaatacctgaaagattaaaaagatgctcatattttaagatttgtttttatcttcaattttactaataaagaaaataataataattttaaaaagtccttccatagcttctactatataccaggcactgtgctaagtaatttttacattgtatctcatttaatccttggaacaacctgctaaagtaggtgctattcttaattccattttatagaagaagaaattgaagccaaggagattaataatcttactgaagtcaaacagctaataactaatggagctgtatttgtaacccagcattctagctccaaagtcctgtgttcttaatcacagtgtcattctgccttgttagtattttgccattgattctgaatcttaagagtattggaaagggaactaaagtctgaattttattttaggttaaaaagacaaccctttgtccataagaatgaactctattctaaattcataacaagtgcctattatagttcctcaaaaaataatccctacatatcttcattttttgttgaaatcaataaaatttgaaatgaccagaggagagaaggtgtaaatgctaactattggctgttcattatttagggttttgtaattattttcttaaggcaggattacttagtctcagcctcagccactgaacactctgcaagcaagtaacacctatttgccacctggtgacaaaagacttggccaatgataagatctccctggttgcttaatggacctcatacctttattcagaaaaagaaattaaaaacacagcaaaagtaaaaatgctaagcaaaatccagttttaaattattttgtttattcacaagatacatacagaattctttatttttcttgaaaaatatttaaaatgtaaagaatatgaaaacattttaaaaatgaattttaaagtactttattgattcaataaatttctaacatttaaaaaaattcctatgtatcaagcatatcactaaaatgaaattagtttgcttaaattgctatctgtattgcatagtaataaaagctgaataaatgtaactacttacaaataaagcaatttgatcttaatcacaatgagacatggcttgaatttctgattgccctacagcagtgatgcttaaagtgtggtcctggaactagcagctttagcttccacaaagcacttgttagaatgcaaattattgggcctctcctaagtctcttttttctaaattatttattcttaagactggtcaagtgcagtaacgagaagggaggaaagagttgaacaaggagttcaatctataactgaacaatcaattgagataactcactaccttcagaccagtctcctcagtcttacggaatccaaaactcttggggtgggcccaggaatctgttttaacaagccctctagttgattctgatgcatgctccaatttgagaaaataccctacagtttctgtttaatttaactttaagtcaaactctttgttaagaattacagagccacacattgttaagccatgagtctttttctttagatgttattttattgaatttaatatataataaaatgtaaactaaaagagtctgcaaatcagtgttcataacaaaaagaatccagttcaatttatattagaaagggaatcagcataggtctagatattttaatgttgtgtgggttttattctgcaaactaataggaagatgactgatattttaaaagcctgacttttatgctactcttaacactatactgaaatgtcgtcatttgctgtggattattaaggtctaccaggtccagaaggtcctccaggtctccctggaaatggaggtattaaaggagagaagggaaatccaggccaacctgggctacctggcttgcctggtttgaaaggagatcaaggaccaccaggactccaggtaggaaatggaagtagatatctgatgagagaagaatgtgggtgtttgtattcaaaatgtgaattctaagctgcatcattttaattaacactcactagacaaggttctatgtgtggctcactggcgaattaaaaagacagtagaaggcaagtttcctatagtctcctaaagggactttgttgtattatagtcagagttcctgaaaagatacttcacctggagtctttggtatgcatatttggatttgagtagccttcatttcagtgaaagcaaatttatgcaaaggagacatgcatattagagcattgcatatagatgaatccacccatagagaagtaattatggtgaatagaggcatcttttaggctttgaaattagataaagttagggtcaaatgtcagctcccctgcacacttctgctttgtatctatgaggaaaacagacactgggtttctgtcttcacctataaaaagagaataataacatatccactcatgtgctttctatgttggtttgagtgacccagagcagagagtcacattcctctttatgggttctcaaaactgcctccattcggtcaagatgattgctggtggatttggcagtcaacacaatctggactgtcttttaattctgaagactgctttatggcagaaaaaaagtatttaaagtagtgatccttaaagcttttcaaaatctaatctttttccccatgccatcactattcttccagttacctagacttaaaaatttacttctgtttactcattctctactcactccctataaatatgcatatttccagaaacaattaagagtaagtttcacctgctatacccctttaccactaaatattttaatgcagatttcttaagattaaaaatattctcatgttttattataagatgacaataaaaagctatgggattgtttatattttataaaattcttaccaaatgtcttggctgcagcctgtaatcctagcaacttgagaggctggggcaggagggttgcttgaggccaggaatttgagacgagcctggacaacatagcaagaccctgtctctaaattttttttaattatataaccacagtacacttattaacttcagaaaatttaacatagatatacattaatttctatctttcatattccagttgggtccaatgacctaataatgttcttagcatttcttcttccagtacaggatccaggccaagtcatgttttgcatttaattgtcatatctctttagccttctttaatctgaaacagttcctaagtttattttctttttttcatgacctcgacatttttaagaaattgtaccaccacccccatttttaaatagaatattccttttttgcctgatgtttattcataattagattcaggttatgcatccccagctggaatactacatgagtggttctgtgtccttctcaggctaaccgataaggaggtccatgatgtctatctgcttctcatttgtggttttagttttaatcatccagtcaagttgttgctcagtttctccactgcatcattaggtttttccttgcaactaataaaactgtaggaaggcacattaagatagtgcaaatataccaatactcatcaaaaatttcccttagatttaacatctattaatgattttgcctcaaccagtctctagtgggatagtggcaaaatgatgttgtttcaactctagcactacctccacatatactagtcagtcctactgtaagcaagagccctcccttctctctggtttacctatgcatttcttatcatttttgactcattttttctcatgttttccactaatttacaatttctaaactatcattacttatttcgatgctctcattgttccagatttggaagccccttcaagctggatttgatgtttttctgatatgtacttccctccaactatttttttagcactttttaatattatttcataataagatgctccaggcttgttcctctttcattcttactaacataagcttcgttgtcctgcacttgaagtagagcaatagcctcctatatgatcttgctattctatattcttcctgtagttgggtggctgaggggggatgattgtttgagcctaggagtttgaggccagcctgggcatcatagtgagatcctatctctatagaaaagaaagaaaaaacaaagaataaaataatagttacctttcattaagtacacaccacacaccagtcttctaagcacttaatattgtcagcaaaagacaatgagatctagaggagaaaaaggaagagctttattttctgtaaaaagtaatctgcggattgggaaggcacagctttctgtacaagcgaaagtgtgatctctgaagaacaaagggagggtttggcttaagtagggaaagttctcacccatgttctcaaccaggtccatttatgcaaatgaaggattcagacttatcagttctgattgattgaaatacttgagccctgatcaggtgatttccaaaaccaaagccagaagtctgccagatgtttctttcaaatggccaatgggcagggggtgtgttcaagccacagtttatcttcgcagtggtttgacttgattgtacaaagggagatcctgtgacacttttacaacatctttccaagaacacaaggtatgtgacatttcccttacccaaccacggccagttggttgtgttttaactttgcgcacctcagttagccatgggaagttcattttgtctgtcagccaggggtatattttaacaatatgaactgtctcatttaattctcaccacaaccctatgaagtaaatactgttattttctccaaatttgaggtgagaaaactatgaatcaaggaggttaaataatcaactcaattcacacaagataatataaggcaaaattgagattacagtcttggaagtttgactctagaaatagtgctatatgccactatgtaattcttatgccctcaatcaccttcctcccctcgctgcaatttttttgtaacattaatgattttatttattcagggtaatcctggccggccgggtctcaatggaatgaaaggagatcctggtctccctggtgttccaggattcccaggtatttgaagggatttttgtggtttccctttatattaaactcctctgggacaagatagccattttctgatttgactgggtaaaggttgtagccctgttgctttgccataaaactgtatgtaccttctgtgcaggcatgaaaggacccagtggagtacctggatcagctggccctgagggggaaccgggacttattggtcctccaggtaagacttattcctgaagatagttatacctgatacttagatgctttaaagaatttgaaagttttcattctgtctttcagccagaccatcggaggctaagtccccaacaactgaggcaaaataaacaaggctctgcctttatttactaatctcttaaattctctattttagtaacataatattgatagcagaccttttaaagttaagataaatgcaggatcaacaaaaatgcttccttgacattagcttctatactaacttccccaaattcaattgaacagatcacaagagcaagtcacatatgaattttttataatattttcgatattaaaatagttctttttcctaagaggcttatagaggtttcttataaattgagaaataaggaatctgctaaattcccctactagatcaaagggtccctggacaagcacagcaagcaaaaactgcaaatgatgttggagtcagaatggatgtgtaagggaataaaattgtcttcccctgacaccagtgttcacagatttgaacacagatggatgagactttgtagtaactgagtaagattcaaggtttgaaaatagagatgatatgcttaatttttacactgaccctaagaaacttatttttcaattgaaaattatttttcaattttaagttttcctaaacagatttctgttagatatggcagcaattcaaaaactggtttctctcacaccaatttttgtcctgaacttaggtcactttggcttccatttcttgtaacctttctctttcccttcaaatttgtgtgttttgtctcataggtcctcctggattacctggtccttcaggacagagtatcataattaaaggagatgctggtcctccaggaatccctggccagcctgggctaaagggtctaccaggaccccaaggacctcaaggcttaccaggtaccaatgcagatcatctttattatcattattatacttttaatttctgggatacatgtgcagaatgtacaggtttgttacataggtatacacttgccatggtggtttgctgcacctatcaacccatcatctacgttagatatttctcctaatgctatccctcctctagcccccctaccccttgacaggccctggtgtgtgatgggcccctccctgtgtccatgtgttctcattgttcaactcccacttatgagtgaaaacatgtggtgtttggttttctgttcctgtattagtttgctgagaatgatggttttgtccatgcaaaggacatgaactcatcaattttcatggctgcatagtattccatggtgtatatgtgccacattttctttatccagcctatcattaataggcatttggattggttccaagtctttgctattgtgaacagtgctgcaataaacatacgtgggcatgtgtctttatagtagaataatttataatcctttgggtatataccaaaatgggatggttgggtcaaatggtatttctagttctagatccttgaggaatcgccacactgtcttccacaatggttgaactaatttacactcccacaaacagtggaaaagcattcctatttctccacatcctctccagcatctgttgtttcctgactttttaatgatcaccattctaactggtgtgagataatatctcactgtggctttgatttgcatttctctagtgaccacagatgatgagcttttttcatatgtttgttggcctcataaatgtctttttttgagaagtgtctgttcatatcctttgcccactttttgatgggattgtggttgtttttttcttgtaaatttgtttaagttccttgtagattctggatattagccctttgtcagatggatagattgccaaaattttctcccattctgtaggttgcctgttcaaactgatgatagtttcttttgctgtgcagaagctccttagtttaattagatcccatttgtcaattttggcttttgttgccattgcttttggtgttttagtcatgaagtatttgtccatgcctatgtcctgaatggtattgcctaggttttcttctaggatttttatggttttaggtcttacatttaagtctttaacttatcttgagttaatttttgtataaggtgtaaggaaggggtccagtttcagttttccatgtatggctagccagttttcccaacaccatttgaatatgaaatcctttccccattgcttgtttttgtcaggtttgccaaatatcagatggttgtagatgggtggcattatttctgaggcctctgttctgttccattggtctatatatctgtttcggtaccagtaccatgctgttttggttactgtagccttgtagtatagtttgaagtcaggtagcgtgatgcctccagctttattctttttgcttatgattgtcttgtttatatgggctctttttttaattccatatgaaatttaaagtagtttttttctaattctgtaaagaaagtcaatagtagcttgatggggatagcattgaatctataaattactttgggaagtatggccattttcatgatattgattcttcctaaccatgagcatggaatatttttccatttgtttgtgccctctcttacttccttgagcagtggtttatagttttgcctgaagaggtcctccacatcccttgtaaattgtattcctaggtattttattctctttgtagcaattgtgaatgggagttcactcatgatttggctctctgtttgtctattattggtgtataggaatgcttgtgatttttgcacattgattttgtatcctgagactttgctgaagtcacttatcagcttgagattttgggctgagacaatgaggttttctaaatatagaatcatgtaatctgcaaacagagacaacttggcttactcttttcctaattgaatacccattatttcttcattttgcctgattgccctggccagaacttccaatactatgttgaataggagtgaactcaggattaagaaactcactcaaaaccgcacaactacatggaaactgtaccacatgctcctgaatgactactgggtaaataacgaaattaaggcagaagtaaataagttctttgaaaccaatgagaacaaagacacaatgtaccagaatctctgggacacagctaaagcggtgtttagagggaaacttatagcactaaatgcccacaggagaaagcaggaaagatctaaaatcaatacccttatatcaaaattaaaagaactagagaagcaagaacaaacaaattaaaaaactagcagaaggcaagaaataactaagatcatagcagaagtgaaggagatagagacacaaaaacccttcaaaaaatcaatgaatccaggagctggttttttgaaaagatcaacaaaattgatagcaagactaataaagaaaaaaagagagactcaaatagacacaataaaaaatgataaaggggatatcaccaccgatcccacagaaatacaaactaccatcagagaatactataaacacctctacccaaataaactagaaaatctagaagaaatggataaattcctggacacgtaccccctctcaagactaaaccaggaagaagtcgaatccttgaataggccaataaaaagttctgaaattgaggcagtaattaatagcctaccacccaaaaaaagtccaggaccagacggcttcacagccaaattctgccagaggtacaaagtagagctgataccattccttctgaaactattccaaatgatagaaaaagagggactcctccctaactaatttcatgaggtcagcgtcatcctgataccaaaacctggcagagacacaacaaaaaaagaaaatttcagtccaacgtccctgatgaacatcaatgcgaaaatcctcaaggaaatactggcaaaccaaatccagcagcacatcaaaaagcttatccaccacgattaagtcggcttcattgctgggatgcaaagctggttcaacatacacaaattaatagacgtaacccatcacatgaacataaccaataacaaaaaacacatgattatctcaatagatgcagaaaaggccttcaacaaaattcaacagcccttcatgctaaaaactctcaataaagtaggtattgatggaacatatctcaaaataataagagctatttatgacaaacccacagccaatatcatactgaatgggcaaaagctggaagcattccctttgaaaacggcacaagacaaggatgccctctctcaccactcctatgcagatcattcttttaaggcttattcattggagaacatttccctagttctccttttacatgtcagaggttgtctctgacaataggagtctaagcaactagtagaataccagaccaccacaagttccattttcttttttcttgaaagtgttaatttcccatggttgaatttctcttagactatgtcaggttactgttagcccctctggctgttccaatttgaacaactaattaatgttagaaaaatttataatgaaatgaaaatgcatttaagatctggtgctttctgtacatcatccagcagaaagattgaaggctgatttggtgggctatcagtttcccactgtgaagccccttgtcttttaaactaactggtgtctagctggccatttgactctacgtttatagccaactttcattaatcattataaaagaaaactagaactaacttcagtcttttgctcttattaagtgatcaagtgacagtcttatcaaaaacaaagtatacctggcagtaacttatggtggaatagaaaacgaaagttgggacttacattcttgtctgattctgaagacaaagagagcacaactccattaaaagcatcccagaagcaaatggattgtttaaaactaaagctaaatccttgttggcttctttggtcctggacttgagttatctcttcttttttctggatttaagacaaaaccaaattgtgaattcagtgtctcgagaaccttatgtctcctagatctgtccagatgtgaaaatattctactcatatttgaatgcctcattcttttcctgtaggtccaactggccctccaggagatcctggacgcaatggactccctggctttgatggtgcaggagggcgcaaaggagacccaggtctgccaggacagccaggtaagacaagtaaaacatgctgttggtggagggaaagtctttgagtctgagagacctctggacatagggcctccacttagagctgtgagatcttctcttgatgttagcatagctgactggtgaatgtggacctgaggaaaataggaaagcacataataaggagatttgtcactatcagagaagcatacaagattgcttttatttgtgtttagagcagtggaaaactcagttaaattttccaagcactcactgtacttacttgttcagcaaattttcaatatgttgatttaaatcccttgaccatattgaaactattgtgaatatttccacatttgaaaatatcgcagtaggctgtaatttctttcataaagagcagcaaatataaatgaacagtttaagtgattgccatagacctttaagagtcatggtgaagtttcatattgagatgataaattgatattaggagcattaataggtgctcctgataatattgagtctggtatctgttagattttcaatttgtactcaacctacttccaaaaagaatttgagtcaacttgaaataaaaaatactttaacgttaaggtttctaaaatagaaatagaggatcatacattatatatgttaacaactctagattatataaatatgactaataaataaacataaagagtttgtatttcaaatatcagtggcaacacagcagagtggtaatacctatagccttcctagagtcaatgccctgacatttcattaatgctatatttctagggaaataacaagttagtgtcatcttcatcacaagtgtttctgtgaagtttccctaaaatgaaaatttatacacagactgtccaaaggcctgtatatacagaaaattattaaatgaactcaaaccaagaggctaaatcaggaagggaagccagtggtggattgaaaatgggcattttgaaaatacttctttagaatgccctgcctgttctctacacaaaaaggtatgcctgagaataattcccccagacggattcaaaggaaaatgtttttcagcaatgaagctggcagattgatggcaaccacacccttcctttctcattgatgaacaaaacagcaggctgaaaattgaccatggggttcagattcttttagtacaacaagagactaaataacatacagactctccaaataagcatattttatttgtctcctagcccatgatatctgacaatgcctttatagacactctataaatatcaaataaattaactagtcaaatgaggtcataatgttttgtcaatatccataagagtggatcagagcttacttaatcttgtatactgattatttcgtggaaataggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttgggtgagataatcaatatctaatttcctactgtgccttttgtttttgtttcagaaatcctgttgggttctagagtagccttggccaaagtgcctctctctattcttttggggcttccgaattgaaaaccatgtcaaaggcaactgaatatattcactatgatttttaaataaataatatttaaccttaaactaaaagcattaattagctcttgtgaggtacaattcttggcctaaagcagatcatttcaaaaaggccacatttacttttagttagattagttattaagggaacagtttccctgggctctttgcagtatagcagctgcttgagtgtgcagtgtttataattcctgggagatacttacctcatctttgaaactggtcttcatcaagttcataagttctgaagagaatcttggttcatagatcaaagaaagtaaggtcattgcttaattatgctagtttgtagttcctaaaataagtgccttagctttataaagtattgctggagtcatttaaagctatataaagtatgacatttctgtacaaaatccagttcatttaaggtgttcccatgtatcttctctatactggggtggacagctaggttgatgggatgaggggactaaatcactctcaaggactcttccatccccatgaattcttttcctggaattctgactttggatgttgaagtcccattgtcttacctggggctgcattttgttgttgttgttgttgttgtgttgtttttttttttgatacggagcctcgctctgtcgcccaggctggagtgcaatggcgtggtctcagctcactgctacctctgcctcccaggttcaagcaattcttctgcctcagcctccgaagtagctgggaattacaggcgcccgccagcatgcctggctaatttttgtatttttagtagagacggggtttcaccatgttggccaggctggtctcgaaatgttgacctcgtgatctgcccacctctgcctcccaaagtgttgggattacaggcgtgagccaccgcacctggcagggctgcctattttaagactgactatcccctttgcctccataaagacatttaagaagatagtctgggctcccagtttctgggatctctatgatgagaagcttcctgagatctcattgtctgggccattcattctgtggaaatgtttctgcagcagcagagaccccggaggtcagctttactccctatttttccaaggcatatggccacaccagttctggcccaccagggtaaggatattcacttacatgtaagtcagtggtcataggccattttatgaaaccaaataatgtaagggtttgcccaatagctttcttttccatcttctttttttcttccgtttatatttcctttttctccttttcaactttcctctgctacttttctttctccttttcacttggttacatctttttaaattttataattgaccaatcttcattaaattagtaattaaattatctttccataatttaatcgaataataaatatctaaataattaatttaatttaatatcttcaggtaattttctctagtctttctcctataaatttcttttttgttcattctctctacactgtcagacttataatcaaactttaaacttcaaatccctaacctaccaggtcaacagaggaaccattataagttttgagcactacgaattcaaaaatgtaatgcagttagaagatggaatctgctatcagcatgtaattataacttttcagaatccatgtattttctctaataagaacaatcagatttggaatctataaactggccctgactctggtacagtttaggcctcagacacaggaaggccatgacggagcccaagatcctaggaatggtcctggattgcagaggctctgctggggctcacacaaggatcacattggaagtatcttgatgactaagcaaagatacaggcagctgtcactttgatgttaaagaaacaattacctcctgatcgaataaatgcagtctgtgttgaattagtggaaggattataggatgtaagaaagaagacagagaagatggattaaatactaaagcttttctgtctgggagaaaagaaaaacatactgagaaccattagtctattaaagtcttataactatggggtatagagggcattgggagtatatgggatcactctctcttcgaaaatttggagactataacccagaattctgcatcattgtgggcagccacaggtgcaaccagatactccagatacttccatcattatgggccttccttttatttacctttcttttccttacgagactggatattttcagctctgtcccaaattaggcagtagaataggtttttttaaattactttataatgtacaaagcactttcatgtccattgtctaatttaatttacacaactatgattaagaaaaatgtatataaatattctgctttttcattttatacacaaagagactggctaataggttaaataacttacagttagaaagtgatggaggtaacacctgccaattctaaatccatttctttttaaattttcccatgttgttcactcttacatgactgtgagtcagtcaggtttttcttaacgagtttttgaaagggataaattagactaaatcaatgattttcaacctagggaattttttaagactcctagtcttatgccaaatccattgtataaaaattccaaataattctgataatacaggtttaagatctattggtcttttatcagtcatcttcagtctgagataagcatacccctttgaatatatgaagaatttccatgatgcacagaggcattattttttaaaaatcaaatttcaactcctcgacttttatatgtattttctcctaaagtcaatctgactttagcagatgtgctttgggcaatctcctttcccatgtctcctttgtctcctttcactgtcatgcattccccactttgtaagagtcatactcttgcacattgccttgaagtatgaaaacctctgacagacaaattcaaagggataattcaaaataacagctttgctaaagatacaattaccgttagatccagcaatcccattactggatatttacccaaaggaaaatagtatatcaaagagatagttacactgacatgtttattgtagcactattcacaatagcaaagatatggaatcaacctaagtatccaacaaaggatgaatggataaagaagatgtggtatatatacacaatggaatattattcagccatataaaaaatgaaatcatgtcatttgcagcaacatggttggaactggaagtcattatcttaagtgaaataagccaggcacaaaaaaaacaagtatcacatgttctcacgtatatatgggagctaaaaatttgaacacatggaggcagagagtggaaagacaggtagcagagacttggaagggtaagtgtggggaatggggaggatgaagagaagtgggttaagggatacaaacatacagtaagatagaaggaattaattccatatttgatagcagaagagaatgactatacttaaaaaatatattgtacatgagtgatggacaccctaaataccctgacttgatcactatggattatatacataaaaaaaatgttcatgtgccccataattttgcacaaataaaaaattaatggttttgttaaagtctccattaactcaagctctgtaattcacttttaatccaaccttctaagaaatacgtttctaataaaagtttttttgtaataattatataaaaatttataatacatatatttttatcagttgtgaattaataataacaatgacaggtcaaaataaaacatttaacacgtaaagtcttatagtcacaaagttttaaaaaggtatattcaatattaatttttgagaaatatgatagcatgatcaataaaaaactttcaaaaataaaaatatgttacattaggaaaaaactgtgtgagaaaagtggaatggaaatataatttttaaatgtagaaggaacaatgtataatttccaactgctaaagacaagtttatatattttctataatggttaatgttagatctcagatcattatattggatgcatttaaaagagtgatataaaagtttgttcttagatatcaatattcacaaaacaccataaatgaaaactggcaaggtagaaatgtggtttgcaaattcccagtccctgctattacaaagtggaataccgaagggtgggtgtggagctgagagacaatagctaaaatcttaatactggcacagtatcaatttaaacttacgatgaaatttagatatcaaaactttagatatgttaactttcaaaagtgtaagagagtgcatttttcatcattcttttgtgagtaaatgagaaaagaaaggcttgatcacaagtaaagataacctctcttgtccctactagctctgaatttcaaagattagtttctttctttttttggtttgtttgttttcccctcacatctttccttcctgtcttatttttttcctttttacgtattcttcaaacctgactgtggtggctgtgcacactggccagcattactattgtccctaggcctaagaagattgcagattcacacaagatacatactgaggaagtcttagaagaagagagggcagcctggagcacgaaatattgataagatatcgtaaggactcagtatgtgtccttcacttgtacacaatgaattactaaatatcctccataagacaccattgtttataagatgcatcactagtttaaaaacagcattagggaatatataatgagctaccacaataaatattaacatactttattaaacacatcctaattttataaatgttaaaatatgagtaaatcttagacttaagaaatatagtatatttattacctatgaaaggctggcaagtttccttgaaaggctgtttgctattgttttagaagaaaccaaagtatcattatcacgcagtcctttactgttttctctccaaatctttctagggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcggtaaggcattgatttagctgtgacttttaccaatccccagttagttagctagtcagatttgagtccaaagctaacaatctgatgatattcctcctaggttaggtagaacagaggtacctcttaatattcaattaagtatttagtttgactcatatttattgggggtctgcttttgaccaggcccccatgatagacatagtgtaatagccagataatgcacagtgtagtaattatttattacataaatttgtctaatatatatcagatttgggctaagttctataatagatataataaaaatgttatgaaaacatagggaaagagatgtttagtttcaactggagaaatgtgggatggccatatggaaaaaatatgtcttgaactggtcagtccttgaatgactagaaggacttgaggcacaggcagttataaaggggaaatatacactaggcagataaatgacaatgggtaataaaacaatgtgtctaggatgtagtatgtaaaggttatgttgggagaaaagattgtaaagttagcttgggcccagatggtagaaggccttctgtaccaaattgtagtttaaagtttatttgatatgtaacaaggagccctgaaatattttagagctacacttcaggttagattatagtgccatcaatgtgtaacatggattacaaaagggatagtctcgaggtagagagaccagttggattgaagggtattgctatagccctgatgtgagtaaattggaactcacagtggggtacatgtatcacattattaggctagataggatttgacagttgattagctatgggaagaaggtggtagctgagatttggagcatgagtaactaagaggagggtgataccattaatagaaatctcttagagttttgccattttgaaacctagtttaactcaatctcttaggaatgttggttattgccgtttttattctgatcatgacccaggatttcaataaccataaaggatgaattgctggaaattctcgttcctttgatagtaaatataaagattaaagctggttcagccttagtagcaaattcatggtgccctttttaatacattttcctgaatcctttgggaatttgggtgtatgtgtgtgtgtgtgtgtgtgtgtgtgtgtacaattttgtcagtcccaactcttgggagtaaaagcttgtctaaatgtattaactattttgttaggtaaactgcaaaactggcctcagtaatatgtcaagaggtccactcatgttttttattaaagatatggaagtctcagctatattcattctgttgctatcttacttgattttatagatttcagccacatctccaagtgcctgggtacctgcccagcattctggatatggtgtacttctccagatatagtcaaatgtttataaatgtcctttggaccaagaataatgagtagagattgagaaagcgtccgtttcttatattttccagtctttctgacattgttcttaccacagtttcagcattactaaatgtctcccctccaattgagtactttgacaacaagtagtatgtgcaatacaccaaaccaaactcttacggcaattgaggcattgactatagcaagtatgaatagacatttagggcataatggaatattaaaaggccattgcactggttctgcagttttttgaaaaaagtttacagtttattatgtatactgggagacaatacttagcaaatgcaatcctcaaagtgcattttttcaccttttgtgatcattgaaagagacattaatcggcttccatactaagaaggcttccaatgaagcaggatggctacttctcacatgctcactctgtagattatgttccttctccttttcctttaccagatgtgcagtatgtgaagctccagctgtggtgatcgcagttcacagtcagacgatccagattccccattgtcctcagggatgggattctctgtggattggttattccttcatgatggtattttacactcttccttgcatttgtcatcatagctgactgtccattccatctacatttcttcccaatatgaggaatccctgtcatttgcataataagaagcttaaacttcaaacagcttctatccaagcactgtgttccccctcacacattttttgtaacatattttcataatctgcctattacttttttttgactacccttggtgtggatactattgtcttacctctgggcctgttccttcactagatttgaatttggccaagctcagcacacatctttggatattcactaagctattatggcacatgggtattgcggcacatttttccttgtcttttatagcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcaggtaaagtgcttatagctttaattcaggtccaaagcttccttcagagatgctagggaagaaagagacaatttatggatggtttatcctcaacaaatgttaggaatttattggattgtgtactttattcttgcttgttcttctcatatacatgactcaggtcagaaaaacagacttgattattaatattaggtgagtttggtttgtgatagcttagtagtaatccttcaataatgaaacagagataaagaaaggttatgtgaccttcctaataagtcagcagctgttcaactagattgagaccaccccaggaattgaagttacagtctgtcttttccctctcagtccagtggtctcctttcccaggatattttaaagattctcatttaagggtttgaatgagcaagacatacgtaatgtatgtacctcaggatacttcattctgttgatttttttcagtttaaatttatttttatgtgttgcttttgggttatcactacttggtatttttcttatggtccttgttatctatcataacatcatcagttgcccagatttccctcatcctgtgaatattagaaaaatgtatgagagaaagagaaaaagatagaaaatgagagggaaacacaaatatacaaagataatagtggtggggagaatcgttacaaaatatctatgaccactaatggctcttaaaccatactagtcactgcattagatcatattgctgaaaagtaaaccattaagtcaccaagagagctacttaacacacaaaaaatgtttagttataaatttgaaccagtaacagaattgaaataccagaaaatgtggatctgattgtcttatttcttatttcccagtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattatttttcacggtgctactaatcctgctgtatcccgggtttttaatataaaggtgttaagcttattttgctttgtaagtaaagaatgtgtatattgtgaacagccttttagctcaaaatgttgagtcatttacatatgacatagcatgaatcactctttacagaaaatgtaggaaaccctagaatacagacagcaatattttatattcatgtttatcaaagtgagaggacttatattcctacatcaagttactactgagagtaaatttattttgagttttatcccgtaagttctgttttgattttttttaaaaaacaaacccttttagtcactttaatcagaattttaaatgttcatgttacataccaaattataatatctaatggagcaatttgtcttttgctatattctccaagattatctcttaagaccatatgccccctgttttaatgtttcttacatcttgtttttactcatttctgactggacaaagttcttccaaacaattctgagaaacaaaaacacacacgcagaattaacaattcttttccctgtgcttcttatgtaagaatcctcctgtggcctctgcttgtacagaactgggaaacaacacttggttagtctcttttaagttacaaaaagccaattgatgtttcttattctttttaaattttaaatattttgttataaatactcacaggataccttatttccctagctatcatctcctgacttaatgttttttaaacccaccaatataaatttaattaaagatatatgttgtaaggatggtctgttgtgtatctcttcagcctgtgtggaaaaaacccctgctcattt

SEQ ID NO: 1192 - DNA, 257795 bp, mus musculus; identical to SEQ ID NO: 1191

SEQ ID NO: 1193 - DNA, 257795 bp, mus musculus; identical to SEQ ID NO: 1191

SEQ ID NO: 1194 - DNA, 257612 bp, mus musculus
agcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggtaagtccttcctcccctcccccgcgcccatcaccgctctttcacgctgaaattaccttttttttggggggggggtccctttatcttccttttggcgttgactagggaattcaaatttgctttctcatgtttaggaagaaacgttatttgcaacaccggtaactcaagccttctgaagtccaacggagaggtttaagtgcttaaaaatagggctgcttgcttccctgcagctagctcctccgggggcaagagcaaagtcagaagtgggggacgctaattaaaggctcactaggctgtggtgggtatttaaaacttttcctcccctccctccaccgtcgggtgtttccctgcctggcgactaaccttttcactacttgtacccagcccactctttgaattttgtctgtagtttaatattttggctcttcgaaaatccagcttccatcaaagtgtttttagcgcctcagtgaagttcgtcccctttgctctttccttaagcaacaggaacctacccccacctcaggtcattcaagccactgacctccttttcccttttgacatccttgttacaaatgaaatgctaaggcaacataccaagaagagtgaggtaaagtctcaggcttcaggtcttttgcgtctttttgttgttgttgttttttctaaattatgggtttttttgtttgtttacttttttttaaacctaccaaggcatctgaacaaattgagaatttgcccatcacctattcaaaggaaaatactcctttttcaaaggagaatcagtgttccagtttaaaggaaagtgggggaggaggtacatgtgaaatagcagcaaaaagctccattcagttttaggaatgtagaattcaaacctcagtatatctcttagaagggtatctgggtagtcccacccactgtcctattggggatgagggccagatgttaaaaaaatgaatggctttgtgagagaaaatgttctccagcctgaagcccatcatctttaatttcatataacctctgaagaataagtgtgtgacaaattatttaaatttatttgagtgatcattatggatagttttaaaaactgtttaatatgagatcatggcttaggccttcacatggttgagtgaccgtcaattctttgtaagcagctgctatgttacagctcatctgggtccacttttaagttagctgtctagcttccctatagcacttagcatgcctcaaatcacatgtcctctttctatccttctgaaggtgtgtacccggtgtatgaaaactaactttcatattactctgagcacaacataattataatagcaaatttgctgaaaaaccatgcatatcaaatatttttactatgcatgccataattttcttccatcaaagtagacaaatgatttaaaaatgcttttttgatgcagagcatcttaatgggggtaaggtttagccagtcaatagggctacagacttggataaaactgcaattgtgctgttgaaaatagttcattttaaaaacatcttcttggtgccctctgtttctggcatttggcccagggacaaagattttgtagatgtttgattaaatatatatatgttttttgatgttacttttaacaaatttgcaccagatgacaactatacaggtatgtatagcaacactacacatcaattaatattaaatcaatttatgttaacaatgaggtttctttttattgacaaaacttgagagcaagcttgttttcttggattcttaaactaatgagtattcatgaagtcattacagctctttcccttttcctcctatataatttttaaagaacattttatatccccttttcctatcattaggatattgtgcctctattaaaaccaagggtttgtttttcctggttcatacataaatattttaataggctcaaaaatatgaatgatatcggctctgcatacttgtgctggagatatcggtgaccatttctagagtaaaactggttggtggtagggctagtctttgactggagtagtttagtattggggtttttatatcaaaaaagtgttgctatttaaagtgctttactcttttataggtaaatgatttctttatctctgaaatcatgccaaattggtacatcacaaatatgtggaagatcttttttttaggtagagcattcattaggtggaataaagtaacctctatgccaaaaggttagtaataagagaagacagttttaagttggaaatataatttttagtgatggaaataacatttttatgtgaaggtaattatacctgtactgattcactgtcagtgggatatgcacttagatttgtggatgtgggtagtatgtaaaattatgttagttttattttacatagttagtaagttgttttctgtgcagtagattggatatttttgtctactttaaacgtactatcttccttgtgaccagcggcacgaatttatcaagggtaggagtgttgtttgtagccatgaaacacttcatcctctatgaagtatattgctccataggaaaaacttgtcatcattgtcatcattattaatgtagataacataatgagtgtttactatgtgccaggcactgtgctaatatgataatacatattatcatatttaatcttcagaacagacttatgagacatataccgttattatcctcactttacagatgagaaaactacaaattacagacgttgaatacattcccagaaatccagtcatgtaggcagtaacttgtgaagctggaaaatttgaatccaggcagtttgactctagaatctttgcccttaatgactgtcctatactgcctactttgtatgtggtctatagagatttactggtgtgtaaagtatttggatctctgccactttttttggacacaggaggtgaaatggaaatgataatgggggttacatgtcttcctgctgatgttaggagaagcagcatggtgtaatggaaatagctttgggcctagaataaaaagatcagagtttgacctctgtatctgtatctagagtgagattatttaaaagcaatctaaaagcaaatgctgttgaaggttttatgattttatgtaatcacaatatgtaaacatttcaacttatataactactataatttgtgacagatgatttgttttgaaggaagatttgccttatgattatttaattactcagttactgcattaattttaagtccaccaaacttttcaggagcatgtctattgtgaaacaaccgggtatgtgtgtatggtaacacactttacttaacatgcttaatttagttttgttctttttttgtactaatttgcctacctatcatatccaattttattcacaaactatatagatatatatctttagtcttatgcatatatctatatatgtatctgtcccatggcagtgtaagagtttgtattttttcatgtgtttttatttaccttttgatgtctatacatgtaagacatgagactctttacatccctgaaagcttggttaagatggtgtctgctaggtttattcactataaagtcactattttttcttttgtaattacaaagtgagactatgcagggcaatattgtgagacaatgtaaatatcctgtttctcatcatatatttgcccactaattttagcatatgttgatgattctggcttgaataaattattgttgtgacatttgccagacattgatttcaattttcaacatttttacatttattaattgattgaattatactgtaataaaaaactttctctttacgcttaatgtatatatttattcagctgtttatagcagtatggacttaatgaatatttgttttattctataggttataatgaattatgctcttactactttttgtttttgctgaaacccagatttggccaacaggagccccttcaaattggctcctgtgtcctttcaacatgtctccatcattttttaagcaccctcttactttctggcaccacagatgttccagactcttttttttttctttttttttttgagatggagtcttgctctgtcacccaggctagagtgcagtggcgcgatgatctcggctcactgcaagctctgcctcccgggttcacaccattctcctgcctcagcctcccaagtagctgggactacaggtgccagccaccatgccgggctaattttttgcatttttagtagagacggggtttcaccatgttagccaggatggtctcgaactcctgacctcgtgatccacccgccttggcctcccaaagtgctgggattacaggcgtgagccaccgcacctggcctccagactcattttttaatttccttgccccaactctggaatcagaatcttttctccaaggagctctgattctttttattggagaatggtatgtagaagccaagatctgggtgcttggcatgcttattgctactgaggtgtcattgcctctaggccctctcagcaggcagaactaggaaatatatgtatatatgcacacatacctgtttctatatcgatttcttgaagtccctctttatatatgtcaaaatcatggattcataatgatacatctgattccagtccaagaccctagaataaatatacatgatctcattctcttctggtatttctcttcacacgttttgtggactttgtagaggtcttatacagagtcttcaagaggttggcctctgaagtcagacatggaatctgactggtagatgtgtaactttcagcaaaatagtaatctttgagacttaatttcctcattggcaaaaggaaggccgtagcacctatctcacatatttttttttttaggatgaaatgagaaaagttatgtaaaacatatagtatttgacaccatagtaaatgttaaatcaattttagatttcattattgtcattatatttattgacttaccatttcttactacatcaactctcaaatctcctgtctgattttcaaggcctatcatgatcttttcccttatccaaccttatttttcattacagtttataatatactccctccagtctagcctaggtaagctttcctacaatcccgtgagcactgcatacacattttggccctccatcttgattagaattttgtggattcaagtctttgctcaattccagcaaatgtttacatttattcagcagatatttattcagcaacttctaagtactcaaaaattctatttatgctgttctatttctattcatggaggtgtactgcctacaaaatcattttgtgctagacactatggctaaaaccaaataaagacaaggttcttcccttcatggtgtttacatactggtgagaatagctaaatagtcctgtgaaactttcccttattatagtatcaaatactgattgtacctttctttgaacatttgtaatatttagcctctcccagtttcgtatctgcatgtatttggtcttataggcattttgttttatgacattttatctgttctttttatttgattaaagtcccttttgaagcaataactatatatttgttcattcaaccaattcatatgttgattttatatggtaacaaaagtaacagctgctcaatgttggaaacttgaaaaacataaagaaaataaaaatatgtccacagttctaccagcaggccagaactgtgctggctgagcacagaataatggtgtgtgttttgattattgttgtttttactattttctttcctatatatataatatgtttttaaaaataaatttggcatagaacaatgacttgtaagagtacaatttttgaattgtaaatgatatgttaaggtttggatgtgaatcacgaaactctaagcacaattcatgtttcaattgctatggtaaagttttcatttcatgaagatactgaatttttaaaatactaaaaaacctgattaaataaacactagctaataactaaaaaaaaagttggttaaaataaaaaagtaagttgggcttattctacatatagttttatttcttactgtttgatcacttatcaagcagtttcccatgttaacattcttagttttaaaacgttattttaaaatgattacatacaacttgtatttatacacactccaatttatttacctgttcacttttgtagagtatattttaaaatgtcaagatttgttagccatcgtaagaagtgctgccatgaacatttcttattccatatttttattattttattgctacagccgccttcatggggaattagtgggttaaacgctataagtatttttcaagtctttgatacatacagtagaccctgatatttaaaaaggctatatcaacagagaaattatggtaacttttttagtggttactatgttatatcctgttaggtagctaatgttatttccacttttatatacaaggaatcagaagcccacattggttaaataacttgccaaaggtcgtgcagttgatacatgattgggccaagatttaaaccaaggctctagaacctgctcatgagattctcctcaatccctatttcatacatggtagataatagagaaaagtaaagtcatgatgaaaagttgaataattctcattgccctttctgtaaacccttctgtgactggtcacttaagatgattctgaagaaagactctccattggctcatcttttaataagtctttaccataactgcctaggccgttcatccttaagggcttaaattttaattttgtgcacaatatatcctcctacttttctcccctgggcagaaggtggagcttgccctccacaaatacctctcctactgatctcttcccagctataacagtggtataacatactcaaattcattgacattctccctcccccagaagagttttgtgcatatgcatctgaaatgagagccccttctgaccactttccccacccctctcaccagcccctgcactgtagctgtctttcaggcttacacttaaatggctgtgtctttacctagtattgtccctagctttcatctctcccttagtgatactcagaaacttcccttcattaattcttaatcttttttttccactttggggagataatatcacagcctcaattccctctttttagaaaattaaactggttagtacatacggaatgtgaggtcccccatccattttgtaccactcccaatttgtaacatactcactttaccttctcctcacatttcctcagtagccaaatgacatcattgcctgtttgccagccctatagcttgcgcaattgaaatttatttctctgcaaagtcacaaactgttatgcattgtggtttttccaggtggcatttgaatagctgaactttaagctcctgagtgatagggatctgctcttgccaaattactttccagaatggttttaccaattatactcctatcagtagtgtataagagtgcctgtgagacagacttaatttttctttcctatctactacagtgactatggaattgatgctcaattgattgccagttggttggctgatttggtcttagtctctaatgattttcttttacaaatgtaatcattccatcatctcatccccttgtgatgatagcagctacggaacagaagtaatttttgaaaatgtattctttctaattaacattataaatgaaccacccagacacttagctaaatctttattataaagatttgtttttaaatagcagtaattcttgaggattttagagaaacaccttcagtgtgatatgtgacacataggcttctttcattttaacaaaccagattctcattttatgcaacttgaacttatttacctccatagtctgtccaggtccacccacactttgtgcctttagcagcttctgctggcctttaaccaaaagggcagtctatgatggtacttgctaccctgttgaaatgggaaccttaaatcccttgcttttcattaattaaagacagtcaaaggcaaatgttataaaagaaacaggcttttgctaaatttaatttttaacttttttattttaatgaatctgttataaatgtcagatgcttactaacttgtagagaatgtaagtaccatttacaagcaagttctattctggttaatggaattgtgtttttgacagtaataaaataagacttcaagaaattctgttaaggaatttgtatcatgctataattcaatcaaataatatttttcctgtatataggagaactggctggtttgctttcaaaatttcttacagtgtatatgacattaattgagtactgaaagagatatggaactttgagaggggcagtggtattaggagtgggacatgactgatgaattatttagtatattctgtgtttacaagccctccaaaagcttgctaaaggaggactggtccttctctgtccatattctcacaatttaattgatgtagtaaaatgtttctgtatgtggaagatagtcatggtggtgtctgtttatattagataggttgtttttcttgcaagtgctaaaaaacactatctgtcttaaacaataaaaacaatttttagctcacataacaagaagtttggaggttgattatctccaaagttaattaattcagccaaataatgacactagtaagggccagagtttgttccatttttctgtactgccatactctgcctatcaacttgccctctaatattagtgcccctcatactctcaagatggctgctgcagttccaggaatcacatgcagacactgcaatgcccactagaaagagagtatgaactattcatgtgtatctctttttactagcaatggaaactttctaaggagtcccacagcaccaccctgaaaacacctcttatttatcattggttgaaatcgtgttatatgtatatgcctacaccagtacattggcaagtggtatacggacataaacgtagagttagtccagtcactcacacaaccacctctccctgccctgcgtctggccaaaacacattgctacctagaaaagttggagggtggaaaatatgtaaataaactcatgatgttttggggggaaggaagaaacagtttctatttcacaacctcatgagtttgtcctcaggatcagttgatacaaaagatttgtaagaaactggtgtatttgttaaatgtgatatattacttatctagggaaacgaatgttttgtatagttctacaaatgaaagttgttgactgttcataggcattttagagctggagggacattagtgatcttttaggtcagtagttctcaaactgtggtctgtggacccctacggttcctgaaatcctattagagaacatgaggaatattttaacagtaatattatcttagtctgtttgggctgccataacaaaatacctcaggctgggtggcatataaacaacaaattatatctcattgttctgaaagctgagaagcctaagatcaaggcagatcaaacctaagattcagtgtctggtgagggccctctttctggttcacagatgttatggtctctctgtgacctcacatggtgaaaggggaaaggcgtttttttctctggagcgtcttttacaagggcactaatctcattcatgagggcttctccccgtgacataatcatctcccaaaggccccacctcctaatgccatcaccttgaagattataattttaaaacatatgaatttttttggaggggacataaacatgtatcatagcaaatacgaagaatgtttacttttctcactatgttgacatttgcactgatggtgagtaaaattactggtgcagtgtaccacattttcttagtagttgtattcgtcatactctcaggggggagaaagccagttttacctcagagggtcctcaatgtagcattaatttatattaattgaattttgacccttgagtgtatgtctttttaatattacatatgacaaaattggaagtatacacaaagcacttatgtacgctgaagtaagatagttgtttctaggaaaagcacttgtgcaattgtttgagttacgagctgaaccagttgatttttgcatggaacgcttttttgtttgttttagatacagggtcttgctgtgttgccccagctggtcttgaactcctggcctcaagaggtcctcctgcttcagccccccaaagagctgggattacaggcatgagccaccaagcccagccaaaattcatttttacttgaaaaacaactgagacaaactgtggttatttatacttgggtatttggcgggcattttcttgaaaatgagtagaattagcctaccacttcagggaaaactactggcagtatttgtggccaatgaaaaatttgagcttttcaagtaagaatgagaattttggaaaacttgaacctgacaccaagagtgtgacagcttcccaaatcttagacttttctaatgaagctggtaattatattaatgtgtattttttatattgtacaataaattgtgttaacatttggaagctctgcataggtcagtgaactaatgttttccaaatgactaatacacagtgttacaaaatcatgcatagggaaaagatcccttcaaagggcaagatagatcgagtttaatgtaattgaataaaaaaagctagtttttttatttttattttttatttttattttattattattatactttaagttttagggtacatgtgcacaatgtgcaggttagttacatacatgtgccatgctggtgtgctgcacccattaactcatcatttagcattaggtatatctcctaatgctatccctccccactccccccacccctcaacagtccccagagtgtgatgttccccttcctgtgtccatgtgttctcattgttcaattcccacctatgagtgagaacatgcggtgtttgattttttgtctttgcgatagtttactgagaatgatgatttccaatttcatccatgtccctacaaaggacaggaactcatccttttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatagtcctttgggtatatacccagtaatgggatggctgagtcaaatggtatttctagttctagaaccctgaggaatcgccacactgtcttctacaatggttgaactagtttacagtcccaccaacagtgtaaaagtgttcgtatttctccacatcctctccagcacctgctgttttctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgccgtgcagaaactctttagtttaattagatcccatttgtcaattttggcttttgttgccattgcttttggtgttttagacatgaagtccttgccaatgcctaggttttcttctagggtttttatggttttaggtctaacatttaagtctttaatccatcttgaattaatttttgtataaggtgtaaggaagggatccagtttcagctttctacatatagccagccagttttcccagcaccatttattaaatagggaatgctttccccattgcttgtttttctcaggtttgtgaaagatcagatagttgtagatttgtggcgttatttctgagggctctgttgtgttccattgatctatatctctgttttggtaccagtaccatgctgttttggtgactgtagccttgtagtatagtttgaagtcaggtagcatgatgcctccagctttgttcttttggcttaggattgacttggcgatgctggctcttttttggttccatatgaactttaaagtagttttttccaattctgtgaagaaagtcattggtagcttgatggggatggcattgaatctataaattgccttgggcagtatggccattttcacgatattgattcttcctacccatgagcatgacatgttcttccatttgtttgtatcctcttttatttcattgagcagtggtttgtagttctccttgaagaggtccttcacatcccttgtaagttggattcccaggtattttattctctttgaagcaattgtgaatgggagttccctcatgatttggctctctgtttgtctgttattggtgcataagaatgcttatgatttttgtacattgattttgtatcctgagactttgctgaagttgcttatcagcttaaggagattttgggctgagatgatggggttttctagatatacaatcatgtcatctgcaaacatggacagtttgacttcgtcttttcgtaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcctgaagggttgttgaattttgtcaaaggccttttctgcatctattgaggtaattatgtggtttttgtcattggttctgtttgtatgctggattacatttattgatttgcgtatattgaaccagccctgcatcccagggatgaaacccacttgatcatggtggataagcttaaaaaaagctagttgataaagtttcagattctacattacaactaaccttatcttaaaaggctattagaatgcacacttttccagctatataactattggaaaccagattttcttcatatattttaagtaaagcaatgtattccaacagaagaaatgcagaagcagataggaggattcagcttttgtcaaagcaaagaaatctacaaaaaaagtaaaataatctctcttcccactatttttttttgttttggaaaatataagtaattttcataaaaattcataatatatgttaacatttaatgggtttattgccacttgaaaatgaataaataattttaaatattactcagttttaatttttatatggtatatgttgatagatgtaatccagatgatggggtcttcaatactttttaagagagtaaaaaggtcttgaaaacaagaagtttgaaaactactgctataccgaggccaactccatcttttacatgaaagtgattaatgaaagatgataactagttatttagttgcagaggcagagatggaagctgtattttctgaatcttattctcgtcctctctccagtatactacattggtttagggattggtaaattgataatatgatgtggtaattttgttcatcgtggtagatacagttaaaataccaaacagaaaatgtagatactagattgtactcgtcttgcctaccattttcaatccaattgccaagtcagaaacattcttgctacacaaaccacagcagaagagacacacacaaaaaatagctaaagttgcagttacttttaggtactaaattggaaaattcatgaaaccagagttcttatcttacatatctttgtattcaccacagtgcatggactggtttcttctatatagttatctctcaggaaatagttgttgaatgaatgttgaatttggggaaggagtagatttatccggataacactaagaggcaaaacttagaatcaatgggttaagttacaggaaccctggatagcaataattttcttttttcttttcttttctgttttttgtttgttggtttgttttgtttttgttttgttttttgttttgaaggaatcttgctcttgtcgcccaggctggagtgcaatggcatgatctcagctcactgcaacctccccctcccaagttcaagtgattctcctgcctcagcctcctgagtagctgggattacaggcgcccgccaccacacccagctaattttttatttttagtagaggcagtgtttcaccacgttggccaggctggtctcaaactcctgacctcaggtgatccaccctcctcggcctcccaaagtgctgggattacagtcgtgagccaccatgcccagccagcaataattttctaacagttaattatttgctacttagtaatggaaatgtctcattagtaataggaatgttcctttactaaaaatgctcaaatagaaggtggatgctgctctgtctgccaacatacccatgaggtccctttggactctaagattctgttttttctggtaattagaaggaaaatactttcttactgagctcaagtctacttctatgattttatcgagacaaggtctcctgctgcctaggctggtctcaaactcctggactcaagggatcctccaacctcagcctcccaaagtgctgagattacaggtgtgagccaccacgcctggcctacttctatgattttaaagcaaattttaggtataattgacatacaataaaatgcatatatttgaagtgtacaatttgagttgtgacatatgtatacacctgcgaaaccatcacaacattcaagataatgaacatgtaaattgctccaaaagatttttattcctctttgtaatccctcccttcctacccccatcctccatccccaaataaccactgatctgctttctgtacagtagaaagtttcattttctagatttttatataaatgcaattatatgatatgtatacattctttgctctgacttatttcacttagcataattattttgagattcatccatgtcatggtgtgtgtccatagtttattattttattgcacagtagaattccattgtattgatacaccacactgttgatggacatttgggttgttttttgtttgtggctattaaagttgctatgggcattttcttgcactttaaaagtactaaattgagctataatttccataaagtgatacacagtgatcttaggtgaacagctcaattattacttaactcaattataacttaacaaagtgtataccaatcatatatactttggtaactaccaaccaagtgaagatgtagaacgtttccattaccttggaaaggtccctcatgcccgtcccatttcaatgtcttttgtgtcttgtctgaataagccacaaggttgtgaagatacatgttttcttccataatctgtatagcttcagattttgtatttatgtccatttttcttatatagatacccagttgttccagtattgtgtatttaaaagaaaaattcctttttttttcattgaattaccttgaggactttattgaaaatcaatggaatgtgtatatgcaggtgtaggttgaaactcactagtctgttctattcacctgtttgtgcatccttatgccagtatcacactgtattgattactgtggcattactttggtagcataagtcctttacatttcttcttattcaggattgtgttagcttttgtgttggctatttattccatataaattttacattaatcttgccaaattttgcttaaaaaccttttgaggttttgataggaattgtaacaattgtgtagatcaatttaggaacaactgaaatcttaaaattattatttttttcaatccatgaacaccatatacctctccattaatttaggtattctttaattagcttcatcatagaggtcatgcacatcatttgttaaatttcttcctatatgaataattctattctaaatggtatcatttttaaaattttatttttagttacttgttgctaagatgtagagatgtgattcatttatatattgatctgtttatccaaagataaaatgctaattaattttcttatggtatgatttacatactgtaaaattcacccactttatgcacagttctattatttttgacagatgtatacagtaatataaatatagtctctaatcaagatatagaacagcatttctaaatttattcattagttctagtagtcgtgtccatttctttggattttgtatgtatacaatcatatcatctgaaaataaagagggtcatagtttttcctttccattacctatgtctttttgtcctggctatcttattgcactggctaggacctccagtacaaatataatggaagtagtaaagaatgactttttttttgctgtcttttaaggaagatactcaatattttgctattatatcagctgtaggttttccataaactttacagatcgaggtggtcctttttcatttctatttgctgaaaatcttttttaaagtaatgaatgttaaatttcatcaaaaaataatttgtatctctttaaacaatcatattgtcaggagctcagccgagctgctaggtgtcagacaccaagccaaaatcaaaataatagtcaagcctttaatcacttagtgtgattatataaacaagaagctaaaccggagaaagtgctgaggactgtcctcacttcccagttacatttttccccatggtagattggaccagcacaggcttcgggggtctgtgttttctcactgacaagggagccccaaacaaaaggctctggcagtgttagggacccaggggtttgggggaggaagaaggaaaaggctaggtgtggaaaaatacctagtactgagtcagagtggaaagaagtgtcttcaacgtttgctcccacttcctctgctgtgaatatttgtaaacaagtctttgggtagacaaatgctttcattttccttggataaatatcaaggaatggaattgctgggttgtagcattagtctatttttagctttacaagaaactgccaaattgttttcctaagtggttgtaccattgtactttccactgaagtatgaaagttgtagttgttcctcgtcagaactgtgcataaaatgggtgaattttacagtatgttaatcataccgtaagaaaaataattagcattttatctttggataaacagatcaatatataaatgaatcacatctctacatcttagcaagtaattaaaaataaaatttttacctgcatttgatattgtcactctttttaattttagtcattttgatatcttagtattggtatgttcttgtcattttcttatagtcaccttttgtttatattgagtaaaattcgctatctttggtgtactgctctatgagttttgataaaagcatacaacctttaactactgccgtaatcaagactcagaatacttccataacctcaaaatgtttcctcatattgctatgtaattaacctctctacttacccacagtttctggcaatcactcatctattttctgttcctataattttaccttttttataaatgtcttatagattgactcatccagtatgtaaaattttgagtctagctttttcctcttagcataatacatttgagatccatccatgttatatgcatcagtagtccatttcttttttatttgttttcttataattgagtaggaagagctttttgtgcattctgcatataatatattcatttcatacatacatgccatgcggatatgctctgccatttggtggcttgcgtttttgttttcttacctataattttcagagaataaaagttgaattttgatatagtccattttatcacctttttatggttatagctttctgtcccctttataagaaatctttgacttccccaaggtcaccaagattttctttcatatttgcttctaaatgattttatagtttttgcttttgatccatttacttatttttgtgtggtgtttggtaagagttctggttcagtttttatcccatgtgtttagttccagcaccatttgttgaacagactatcccttccccattaaattaccttgatacttttgttttgtaggtctgttttgtattctagtctgtttcaccaatctctatgtctatccttatgccaataccacaatgtcttcactactgtacttttatgataaggtctgaaatcaggtaatgtaagttctccaaatttgttcttttcatattttggggtctcctcttcgcccccgcctccttctttgaatttctatataaattttacagttaccttggcaatttgtacaagtaaaactcctggagttttgaatgggattgtatttaatctataggtcatttttgggaaaaatgatgtcttaacagtattcagtgttctgataagtgaacatggtgtatctttccgtttattaagatcatctttggccgggtgcggtggctcacgcctgtaatccgagcactttgagaggccgaggcgggtggatcacgaggtcaggagatagagaccatcctggctaacacggtgaaaccccacctctactaaaaatacaaaaaattagttgggcgtggtggcgggcgcctgtagtcccagctactggggaggctgaggcaggagaatggcgtgaacccgggaggcggagcttgcagtgagcccagatcgcgccactgcactccagcctgggtgacagcgagactccgtctcaaaaaaaaaaaaaaatcatctttaatttctctcagcaatgttttcagtgtgcaggtcttatatgtactttattgaactcatcccctaagtattcatgtatttgaattgtactataaatggtatcgtgttttattttctttcaattgtttgttgttggtatatagaaatacaactgatttttttttctattgacctgtacactgtggtcttgctaaattgattatttttagtagctctttcatggattatttataattaactacatacatgattatgtcttctgtgaattaagatagatttgcttctttctttctagtcttcacactcctttttttccccttattgtactaattagggcctgtaggataacgtttaatgtaagtattaagaccccagttctttgctgccttttcccaatgtttgaaaacatatgcttcacacattttgtacagtttcctagttgtttgtagcaagagggcaagtctagtagcaatcattccaacaaaatctgctttcagttttttgatatttataaataacaatgatgtgaacatttttgaacgtatttgcacttcagattatttcctttgaacagagttctaaaactatatattgtaatctatatacatatatctgtatctatctctctgcctgcatatttaaacctacagtataagagctacctcaagagcagtgactatatttcaaatttatataccttgcatcatctagcagacagcctttcattggattaatggaaagtaaaatctttatgattaattttctcatacccagagtatctatttaactatagcatagagatatttctaatcttgcctgtgaagtctaaaaagactgtgatcattaccatagttttaatttactattactttattttgcttcattttaactgtcttatttctctttgataatgttgtaggaaacaagaaatatgtaggtcttaactttggccactgttaaaaattttttttaaaaaaatataatttggtttattttgagaaagggaagacatttttcctaactttcctacattttgtgttaactttgtaggatgttgtttgagcaatgaccctgtaggacgtggccttacacattttgagttcatttgagttaatttagtttcaggaaggcttctgaaataggaagcatttattcaagctttagtattccttctgaatagttttgctagctagctataaacaggccaatttgccctagctctaagtttatgttaattttcattactttgtttcaaaataaaagggccaattcccgttacattttgatttaaaaaattaagctatacatttttcttagatgtgggtatgttaaagcttttcaatgtctggcaaaattaatcaccctaggccgtggatttccttgcccccaactccctccaccccctaaagatacttgataatatgttggaaggagagaaataatagcttttttcttccagttcttatggtcaggtgagttcctagggtttttgtttgtttgtttgttttgagacagagtttcgctcttgttgcccaggctggagtgaaatggtgcggtcttggcacactgcaacctctgcctcccggattcaagcaattctcctgcctcagcctcctgagtagatgggattacagatgcctgccaccacgcctggcaaatttttttttttttttttttttttttttttttagtagagatgcgatttcaccatgttggccaggctggtctcgaactcctgacctcaagtaatccgcctgcctcggcctcccaaagtgctgggattataggagtgagccaccacgtttggctgagttcctagggtttaaatgttttaaaatatttttattcatagtatactcaagttataggaatttggttaatagtgaataaattcattcttagcaccagcctctctcaattctatttgcttgcttatcttttacagcctatttagacatatcatttttctccacagttgcagtaaagacttctttctgttatagcgcaagcttattagaccttatcacagccttcatgccttcatttgtgtatactatataatgggaaaaaaaagactaatgttgtaaattaacaagtgagatcaaactgaaaaaggtcacctttcttagaggctgaaaaagagattcattttctggggcctggatttgtttttctgactaattttactgccacttttgaatttgcagattgacaacctttatactaaaaatatttatctgtatcctagtagatttccaaatccatattctcagttttctctactccatgatatgcagatatggaaaaggaggcattttttttcccctcagatggttaatgttataatttgaaattggtaatatgctaataaacaaaggtaggttcaaaatcagatctttctgatttccatgaggcattgtaaatattatattacttaggatttgttttaaaatcaggttccaatttaagttggaaaaaactgaaaatgtttagaggtaacagtgattaaattatttcagattattatatttttcttagttttccctacatgtctacttcttcatctgttgttttactttatggtacttaaacattctataaagttttttgtttttttttgagttggagtttcgctcttgtcatccaggctggatggcatgatctcggctcactggaacctcacctcccgggttcaagccgttctcctgcctcagcctcccaagtagctgggattacaggcatgcgccactacccccggctaattttttgtatctttagtagagacaggttttcaccatgttggctaggctggtctcgaactcctgaactcaggtgatccgcctgccttggcctccaaaagtgctgggattacaggagtgggccaccacacccagcctctataaagatttgtagtgcgtttaaacattaatagaatgaaaaagtattataaaaggcaagaatatagacataggttctcattaaatcacaattaatggaaatgtatactcatagcaaaattaattatgctctttttgggtagaatattctggagcctaaagtttcatctccttttcataccactgtccttaaaaatgcaacattagcttaaacatgaatttgtttatattaacataaaacttctctataataaatgtttattcaaaattgaaggaggaaaaaagatttagagtaagatacatactaatattaaatactagtgctgagattatgagtcattttttcttatatgtattttctgttacctacagagaaatagtaatagtaaatgcctattactattacaataaaatgattttaaaatatttaatattagtttaacatatatttcaacagttttttgatttaaataatttaacaacatattttacagtcatagggttattttattttatttttgtttgtttcttttttcagacaggatctcactctatcacccaggctggagtgcagtggtatgatcatggctcactgcagccttaaccttcagggctgaatcaatccttccacttcagcctcctatgtagctgggattacaagtgcacgaccccatgccccgctaatttttgcagagacagggtctcactatgtttcccaggctggtctctactactgggcttaagtgatccactggccttggcctcccaaagtgctgggattacaggcctgagccattgcgtcccttcctatcctccctctcttgtaataaatgttttaggtagtttttaaagttttcttttacttggctttcttaaaggagaacttcagttgcttttttccagtaaaaaattccagagactgccagaagaagcctaatgccagtaataattctgtcattgaacataatggagaggagtcatcttaatttgtatgcactcttttttatatcaagtgtaacacatattcttcttgtccttccctccaagtgggttacaaacagcttttctctttcactttaccaacattaaaaagagtgattttaagaatgctggatccacctttttccacttatatttggaatgaaatgtgtaatttatgtatgaaacctttaattttaatttaaggtctcgtgaaagcaccaaaactctttagataaattgacacggagttgctttaagatacaaattccttcttagtaaaaaaaaggaagaattttaaaactttatgttttaattgtttctagttgaattcagaatattaaagctttgttatatatgtggtaactctctaataaatacttcaagaaagtatctcagtatttaattaattatgagtactataatttattctaaagccttaataaaatcaaatttctattagtttatgcttttctcaatgttcattgaaaatattgagtcatattacctattactgccccaatccccagcccagcttgtaactttcctgaggaggaaaattgagtaaacctcagtgattatttgacagttgactccatagctaagctggaagacagggtgttgtgggagggagataacgcttttagggttttactgaagaaaggatgtagattttctgattctgttttgaagatgatataggtggatgctgctgggagaaatgacagtggcatcccattaggcctgtcgtgcccatccccttttaggattctgcatatctcttagtttttcctttgtcaggtaacaaaggtgtaacatgggagatatattccacttctccacattgttagcttagtgtagtactctatccagcaaattattggaaagagcaggatttggaagttagactagattttattgcttgggtagagagagaatgctcaagagagcttatcctggacaccagaggatgagcaattggaaagatggactgctttatcatttttgtgttattttgcaatagatagggcagattcccctctttttattgcagtacaaaatccctttaatagctagctctaacgttactatggcactatagtgtaatggtttagtttagagtatgggcatggatgtcagactcgacttgtatcgagactcttccacctaccaattgggctaacattattagtctaaagtgtcttaatgcctggcgtagagtaagtgttcaataaataattttccacaggatctatagtgtcctcttccaatataatttagttcaatcttaagcctaatagtttgttttccttcctgatcccctttcttcatctctagcattttaccataggagggaaagatgtcttagaaacacttttttagtttatttctagaggtattggctagacttcatgtcagttatatgcatataccaatattttatatattaaaaacaaatataatccctagaatagcattgtctgattagagataaaatggtctcaaaagaggacaggaaaatagggaagtgggagtagtagtaaagagaaatgtaaaccaatgtgtaaacaagaaagcaggtttatctgcaactatagggaagaactgttcaaattaccttgcacatttttatttcttaggaggcttcttaagattttaaattaagttattaaactatttattgggttgaattaaatatttagataaatgcagtatatagatatgtctgtctgtatgcatatatgttaaatacacctaagtttcttatactttaactaattttgggattccttctcacccaaaagaaatttaaataaatactttggatatttctgtaaatacagcatgccatttagcaaatttaagggaacaagtgaataacttagctatgccaacaatgttttgcctccgcattccttggcgcaaacagggacctcagtgaagcgttcctcatgggagttgcctggggaaatcttactgaagaagtctaggtcccaattcaggctcctttcccttctactttctaaaatatcaactttattgaggtatagtttacatacaataaaatgtactagttttaagtgtacaatttaatgattgacaaatgtgcacacccacaacattttcaatattgagcagtttcatcaccccaaaaagttccgtttgtttttcttcccagtaaatctttccctatccctgtaccctgaaagccactgacctgctgtcactatgaatatttgtgtacaagtcattttgtacacataattttcatttctcttgggtgagtgcaaaggaatagaattgctgggctgcataaatatgtaatgtattgaaccttacaagaaacaaatatgtttgcaaaataataggaatattttacattctcaccagcagtttataagacttttttaattatagctatcctggtgggtatgaagtggtatcttgttgttttaatttgctttttctgatgttgagcatattttcatgtggttattggccattcaaatatcttcttttgtgatgcatattctcaaatctttgcccatttttttcaaaagttggattacttgccttcttataattgtaagagttctttatttgtcatgtttacataaatatacacacacgtatattatacacacacctagtatttttcccattctgtgggtcgtattttctttttcttaatggtatattttaattagcagaattcaaaaattttatgaagcgcagcttatcatttttttctttgatctttattgccctttgcattataaggaagaatcctttaactattaatacactaaagttttaaattttgcctgctttcttctagatatttggtgcttttaacttttgataaacttagtgttattttggtgtgcagtgtgagttaagggtcctggtttaatttttaaaaaaattatcaaggtgaaatttacataacataaaattagtcatttaaaagtgaacaatttagtgacatttcgtatattcatcatgttatgtgaccacttctacctagtactaaaaatttggtttctctcactccaccttgtccctggaaaccatcaatctgcattctgtctctgtggatttacctattctggatatttcatataaatgaaataatacattatgtgacattttgtgtttgacttatttcacttagtattttcaaagttcaacttcattgtacatcatccctttttatggctgaataattttgcattgtatggatataccacattttgcttattcgttcatccattgttggacatctgggctattaccactttttatctattgtgatgagtgctgctatgaacatgtatatatatatgtatttgtttgagtacttgtttttaatatttaagggtgtatccttaggtgtggtattatgggccatatggtaattctatatttacgttttaaggaaccaccagactattttccttggcggtttaaacattttacttcgccaccagcaaggtatcagcatttcaagttctccacaatcttatcaacacttgttatttttgttttgtttattttaagttttaattttttaattatggccatcctagtttgttatggagtggttcttcattgtggttttgatttgcattttccgaatgcctgatgatactaagcatttttcaagtgcttgttggcaatttgtatatcttctttggagaaatatctattcaagtcctttgaccatcagtatttttttttttagacttaaggtcttgctctgttgcccaggctggagtgcagtggtgtaatcatgcctcactgcagcctttaactcctgggctcaagtgatcttcccatctcagcctcctgagtagctgggcctgcaggcaggtggcaccacatggccaaggtggctttttttttttcttttagaaatggggtcttgctatgttgcccaggttggtctttcttgcctctgcctcccaagcagctgggattccagccctattttcaagttgggccgtttatctttttgttgttgaattgtaagagttatttatacattctgaatactagacaaatacataatttgcaagtattttctcctattctgtaggttgtttttttcacttttgtgataatgtgctttaatgcagaaacattttaaaatttcatgaaatccaatttgttttttttcctttcttgcttatgcttttggcgtcatatctaagaatccattgccaaatccaaagccatgaagagttatctctatgttttattatacaagttgtgtggttttagctcttatgtttaggttgttgattcattttgaaatagtttttgtaaatggcatagaggtccaactttattcttttaaatgtggatatacagttgtcccagctgttattttctcattgactagtctaggcacccttatcaaaaatcaatttaccattgatgtatgggcttatttctagactctccgttctatctcaatggctatgtttatctttatgccagtaccacactgttttgcttactgcagctatgtagtaaggtttgaaatcagaaagtgtgtgtcttccagctttcttttactttttccagattgttttggttcttagggccccttgcaattccatatgaatttgaagattgactttactattactctttctgcataaaaggctgttcaatagggatttcattgaatctgtagattgctttgggtagtattgccatcttaataatattaagtcttccaatccaggaacacaagatgccattcattcatttaggttttctttaatttctttcctcattgttttctagttttctgtgtacatgttttttacctccttggccaaatttattcctaggtgtgttttattcttttggatgttattgtaaatggaattattttcttaatttcctttgtagattgttcatttgggctctatagaaataaaactaattttgtgttttgattttgtaccctagaactttgctgaatttattagctttagtagtttatttgtggattctttaaggctttctgtatacaggttgagtatctcttatctgaaatgcctaggaccaaaagtgtttcagattttggagtttttcaggttttggaatgtttgcatatacataatgagatatcttggggatgggacccaggtttcaatatgaaattcgtttatgttttatatacatcttatacacatagcctcaaggtaattttatactatattttaaataattttatgcatgaaccaaagtttagactgcgtttttactgtgacccatcacatgaaatcaggtgtggaatttcccacttgtggcatcttgttggcggcactcataatgacttgaattttggagcattttggattttggattttcaggttaggaatgctcaacctgtatgaaaaaaatatatctgcaaagagagatagctttgtttcttcctttccaatttggttgtcttttatgtctttttctagcctaattacttagctaaaacttccagtactatgttgaatggaattggtgaaaccaagcatccttagtttgttcctgatcttataggaaaacagtttttcacctttgagcattcagttagatgtgggtttttcgtaagtgtttttttttttttttatcatgctgagactgctcctttacattcctggatttgagtgtatttattaggaaagggtgttggattttgtcagatttttttttttatcattgagatgatccaaatgttttttcctattggttctattaatgtggcatattgcatcagtgggttttcttgtattgaaccacattgcattcctgggataattctcatttggtcatggtttataattcttttagcatgctgttggatgtggtttgctagcatctgttgagggttttttttttgcctctatttttacagggactattaatctataattttattttctttagcatctttggctttcatatcagaataaaactatatttatagaatgagttaggtagtgctattctgctttttggaagagtgcgagagtaattggtgttgttttctttaaatttttggtagaattcactagtgaagctatctagctatggactttacttcgttgttaggtttttgattattgagtcaatgtctttacttgttatgaatcttttcagattttctattttttcttgagttagtttaggtaatttgtatgtttctagaaatttgcccatttcatctaggttgcctaatttactggtgtatgatttttcatagtattttctctctctctctcttttttttttttttttttgaaacgggatcttgctctgtcacctaggctagtctcaaactcctgagctcaaaggatcctccttcctcagtctcccgagtagctgggactacaggcacctgtcactgtgcctggctaattttttaatttttattttttgcagagatggggtcttgctttgttgcccaggctggtctcaaactcctgggctcaagtgatcctcctgcctcggtcttccaaagtgctgggattacagggatgagtcatcatgcctggctcatagtattttcttataattctttttatatctgtaaggttagtagtaatgtcttcattttcattttttatttcagttatttgtatcttctccctttattttttagtttagctaaagatttgtcaattttcttggtcttttcagagcactaacctttgttattttattttattttcaagttttctttttgctttaaagctataatagtaaacaacataatttgcacatatattcaggctcattttcaaattttattttcatttcaaagggcacatgtgcaggtttgttacatgggtaaattgtgtgtaactgaggtttgatgtatgaatgatcccattacccaggctacctcctctagtagtccccagtgtttattgcccctctctttgtgtctgtgtgtactcattgtttagctcccacttataagtgagaacacgtggtatccggttttctcttcctgcattatttcacttaggataatggcctccagctgcatccatattgctgcaaaagactcgatttcactcatttttatggctgtgtagtgttccatggtgtatatgtaccacatattctctatccaattcaccatcgatgggaatctaggttgattccatgtctttgctattgtgaatggtactgcagtgaacaaagacatatatgaaagtgcatgtttttggtataatgatttcttttttggggggtatatacccagtaatgggattgctgggccaagtggtagtcatgttttaagttctttgagaaatctccaaactgcttttcacagtggctgaactaacatacatttacaccaacggtgtacaagcattcccttttctctgcagtctcaccagcatctgttttttgttttgttttgctttttaataatagccattctgactggtctaagatggtatatcattgtggttttgatttgtatttctctaatgattagtgatgttgagcattttttcatatatttgttgcttgcatgtatgacatcttttgagaagtgtctgttcatgtcctttgcccatttttaaatggagttatttgtcttttgcttgttgaattaagttatttgtagattctggatactatacttttgttagatgcatagtctgttaatattttctcccattttgtaggttgtttgtttactgtgttgatagtttcttttgctgtgcagaagctctttagtttaatgaggtcccacttgtcaatttttgtttttgttgccattgcgtttggggatttagtcataaattatttcccaaggctaatgtccaggatggtggttcctaggttttcttctaggattcttatagtttgatgtgctacatttaagtctttaatccatcttgagttaattttcatatatggtgagaggtagggattgagtttcatttttcttcatatggctagtcagttatcacagcaccatttattgaatagagagtcattttcccattacttgttattgctgagtttgtcgaagatcagatggctgtaggtgaaaggctttatttctgggttctttaccctgttccattaatctatgtgtctgtttttgtaccagtaccatgctgttttggttgctgtatccttgtagtgtagtttgaagtcaggtaacgtgaggcctccagctttgttcttttggcttaggattgctttggctatttgggctcttttttggttccatatgaatgtataaatagtctttttctaattctgtgaaaaatgacattgatagtttgataggaatagttttgaatctgtagattgttttgggcagtatggccattttaacgatattgattcttctcatctgtaagcctggaatgtttttccatttgtttctatcatctatgatttacttctgcaatgttttgtagttcttcttgtagagatatttcacctccttggttaggtatattcctacatattttttggtgactattgataatgagattgctttcttgatttggctctcagcttgaaccttaccagtatatagaagtggcaatcatttttgtaccatgattttgtaacctgaaactttactgaactcgtttgtcagctctaggagccttttggtggagtcaatagggttttctaagtaaagaatcatagcatcagtgaagggagataatttgacttcttttacaatttggatgccttttatttgtttgtgctgcctgattgctctgcctaggacttcagtactatgtcgaaaaggagtggtgagaatgggcatttttatcttgctctggttcttaagtagaatactttcagcttttgcccttgcggtatgaacttggatgggggttaaagaaccaacttttggtttcattgattgtctcgattgtttttatattttctatattgcttatctccactctaatctttcataatttcctttcttttgctagctttgggtttagtttgctcttccttttctagtttcagaaggtataaatataggtcatttatttgagctctttctcatcttttaatgtaagcatcgactactataaattttcctcgttacaatttccttcactacatcccataatttttagtatgttgtatttttattttcattcttctcttaagtattttctaattagttttgtaatttcttctttgacctattggttgtttaagggctacattatttaatttgtacatatttgtgaaatttccagctttcttctttttattgatttgtagtttaattccattgtgattggagattacattttgtatgacttcagtttttgatattttttcagacttattttgtggccgtacatatgttgtgtcttagagaatgttacatatgcacttgggaggaatgtgtattttactgttgtgtattctatatatgtctagaaataggcttatgatgttgttcaagacttctgtttccttattggtcttctgtgtagatgttcaatccattattgaaaattgattttcgaagtatccaacaatcattatagaactgtctatttcttttttaaattctgtcaagatttgcttcctatatttagaggctcagttacttggtgtgtatatgtttataattgttatatgttgacgaatttacacttttcaataaataatattgttgtcttttgtaacaggggtgacttaaagcctaatttgttggatattattataatcagccaccccagctctcttttggtcattattttcctgggatatctttttttctttcttgaaatttcagcccatttgcatctttgaatctaaggtgaacctcttgttgaaagaatcccttcagaatgctaatttcatttcctttgggaatatacctagtagtgggattgccagatcttatggtaataacacttttagttttttgaggaaccgccatactgttttccaaaatggctgtactaatttgcagtaccaccaacagtatataagggctcccttttctccacatcctcgctaacattcatcttttagctttttgataacagccagtctaacaggtgtggggtgttattgtggttttgatttgcatttctctggtgattaaagatgttggacatttttttgtgtatctgttgaccatttgtatgtcttcttttgctaaatgtctattcaagtctttagaacatacattcctcacatgtttgtggtgatgctggtttaaaccaattgcagtgctagtcatataaaagtatagtacatacaattatttatagtatgtaatataataagtcactatgttactggtttatgtgtttaccatactacactcttaccattattttgttatcactacttcataagtagaaggagtgtattccttcttctcataacacaaaaaagttaactgtaaaatagcctcagtcaggtacttcagaaggtatttgagaggaaagtattgttatcataggaggtgacagctccatgcatgttattgcccccaaagaccttccagtgggacaagatgtggaggtagaagacagtgatattgatgattctgaccctgtgtacgcctagactaatacgtgtgcttgtgtcttagtttttaacaaaaagttttaaaagttaaacaataaatacagtattttaacaatagaaaaaaggttatagaataaggatataaagttttatatatatatatatatgtatatatatatatatatatatttttttttttttgagatgaagtcttgctctccagtagcccaggctggagtgcagtggtgcaatctcggttcactgcaacctctgcctcccaagttcaagcgattctcctgcctcagcctcccaagtagctgggatcacaggcacctgccatcacgcctgggtaatttttgtatttttagtagagatgggattttaccatgttggccaggctggtctcaaactcctgacctcaagtgatctgcctgcctctgcctcccaaagtgctgggattacaggtgtgagccactgtgcgctgccaataaaatatttttgtacagctgtacaatatatctgtgttttcagctaagtgttattacaaaagtatcagaaagctaaaacaattctaaaaagtttataaagacagtcaaagtaagctaaggttaatttattattgaaggaagaaattttttatgaatttaatgtagcctaagtgtacagggtttacagagtctatagtaatatgcagcaatatcctagttcttcatgttcacatactacccactcaactggttcaaccagaacaacttcaagccttgcaatgtccattcatggtaagtgccctatacaggtgtaccatttttaatcttttatatcatttttaaaatcttttatatcatattttatatttcatatcatattttactgtaccttttctatatttagatatttctagatacatacttaccattgtgttacagttgcctacaatatttagtacagtaacatgctgtacagatttatagcctagaagcaatagattatactatgtagcgtaggaatatagtagactataccatttaggtttgtgcaggtacactctatgatgtttgcacaatgatgaaattgcctaacaatgcatttctcagaacatatccccattattaagtgatgcatgactgtaattgtttcctttgctttgtagatttttagtttgatgcaataccatttgtttatttttccttttattgcttgtgcttttggggtcatatacaagaaattgctgcccagaacaatgtcatggagctttccccctatgttttattctagtaattttatagtttcagatcttacatttaatccatttggggttgatttttctataagggatgagataagagttcattttctttcttctttatgtggatatccagttttctcaacgtcatttattaaagagactgtcctttctccaatttgtgtttttggtgcctttgtcaaaaatcaactgactgtagatgtatgggtttatttctgggctctctatcttattccattggttgatatgtctgtttttattccagtaccatgttgttttgattactgtagctttgttatatatattgacatctggtagtgtgacacctcctgctttgctccttttggtcaagatcgttttgactatttggggtcttttgtggttttatattaattttattattgttttttgtatttctgtgaagaatagcattttaattttgatagggatggcattgaatctgtggatcgctttgagtctttgtatacatgtttatggtatatttagttttttaggcctttaagaacttattttagcaatgttttatacatttcagtgtacctgttttattatttcttgtagtagtagtagtattagtagtagtattcgtagctttttgtagatttttcaagatttttaatatgcacaattatggtgtctttgaaaagagacagtcttacttctccctttcttccctatatgcttgttatttgttttccgtgccttgttaaactagctaggacctccaatataatattcaaaagaagcagtgagagcaaagcagtgagatcagacatcctcaacttgcttctattattagtgggaaggcattcagtctgttaccattaaatgtgatattatctcagtggttctcaatgagtgggggatcttcacccaccagaggacagttggcaatgtctggagacattctttgttgtcacaactgggggctgttattggttttttaatgagtagaagctcaccagagcccctcttccaggcctagagccccttcatgttttactaactctggcaccaaaactcaattgatcgcaaaaactgatgggaacgtatatgaaactacttatagtcttgatccaaccttaggatattcataagttttactgctaaatattaatttgttcaattacaaaatgttatgtaacttgtacagtatataaacctctctaaattctgattttcaaacagtatatagacataaggatttcaggatttcatttaagggtctatagagatgctgccaaacatcctacaattcacaggacacccactcacccagactctgcaacaagaaatcatctagcccaaaacgtccatagtgttgctgtggagaaactatgtactacctgtaggttttaagggatatcctttaccagattgaagaagctatctcttagtctgctaagagttttcatcagaaatggctatgaaatttatgtcagatggtttttcttctaattgtatacgcctttatactcatgtattctatgaatataaaaaataccttgatttatttattttaaatttttaattaaaaaagtttttgattttaatttttatgggtacatagtaggtatatttatgggatatgtgagatgttttgatacagacacacaatgcgtaataatgacatcatgtaaaatggggtatccgtcccctcaagcatttattctttgtgttacaaacaatccagttatactctcttagttattttatatgtacaattaaattattattgactatagtcatcctgttgtggtatcaaatactaggcattttctaactgttcttttttttttttttttttttttttacctattaaccatccccacctcctccctaccacaacctcactacccttcccagcctctggtaaccatccttctactctctatctccatgagttcaattgttttgatttttaggtccccaaaataagtgagaacatgcagtttgtctttctgtgcctgacttatttcacttaacataatgacttctagttccatccaccttgttgcaaatgacaagatctcattccttttatggctgaatagtactccattgtgtatatataccacattttctttatctattcatctgttgatggacacatggttgcttccaaatcttggctcttgtgaatagcgctacaaccaacatgggagtgaagatatctctttgatctacttatttcctttattttgtatattgcattagttggggttctcttagagggacagaacgaataggacaggaagcatacagcatgggagaaagatgtaggctgggaggctaggcccatctctcattttcatgtttttctgcctgctttatattcgctggcagctaattagattgtgcccaccagattaagggtggatctgccttccccagcccactgactcaaatgttaatctcttttggtgacaccctcagagacacgcctaggagcaatgctttgtatccttcagtcgaatcaagttgacaactcagttttaaccatcacaagtccaccccttgtcaacttgaacccatacacatctcctgggatcatacataatcttcaaataaagacaataataaggtcataattacgcctaacataatacagctatccttcatacaaccagaaacacaacaatccccaacccaaatactattacataaagttaacatacttaaatgctgatatgaagtcaataaatcgtacatcacatgataaaggagaaaggaaataaaatgaagatattagtacaagtgtgtacatgcacaaacatgtttttaacaaaagaaagaggaaaggccgggcgcggtggctcatgcctgtaatcccagcactttgggaggccgaggtgggtggatcacctgaggtcgggagttcgagaccagcctggccaacgtggagaaaaaccctgtctctactaaaaatataaaaatgagccgggtgtggtggtgcatgcctgtaaccccagctatttggaaagctgaggcaggagaatggcttgaacctgggaggcagaggttgcagtgagctgagatcgcgccactgcactccagcctgggcaacagagagagactttgtctcaaaaaaaaaaaaaaaaaaaagaagaaggagaaatactcatgacaattagtccccatttctgtagctggtcacatggttgtagctaatattgatgattaccttgttctactacctattctgtattccctttgccttcagcaagcagcttagcaggtcgtggttttttttcctggtggagtgacccaaaccttccttcctgaagggtctgggccatttgtagtcctatctggattgcattgttgtagtttcccattgaccttaatcacagagatggtaataccctaatggatctcctgtattccatgcatactctttcttacctccgttatggagtagtacactgaattcatcttgatagtatgggtcagtcaccccagccaacactgtaactcccttcttagcttgttgacttaaaggtaggaggggcccaaagtgtccaggtggcaatcttgacttacggtttaatggaattgttgttgtgtctcctggtggcagctttcctccctctggaactaagacctctaggccagtagaacgtaatgttgtgggaacaggaagcaaaaattttgctagtggatcactaggggtgatggtgagtgctgccacttccacttccaccccttgattcctggacctgtgaatcctggctatggagaaagagtaccatatattggatgctgattcagatcacacacagccttctggagaactttgcctcagctctgcaatgtattgtcacctagttggcattgtatttgtgacttcaaaaggccattccaccgttctatcaatccagctgcttcaggatgatggggaacatggaaagaccagtgaattccatgaccatgagcccactgccacactgctttagccaaaaagttagtgccttggtcaggggcaatgctgtgtggaataccatgatggtggataaggcatttcgtgagtccaaggatcgtagtcttggcagaagcattgcgtgcaggataggaaaacccatatctggagtaagtgtctgtttccagtgaggacaaacctctgccttttccatatggaagaggtccaatataatcaacctgccaccaggtagctggctggtcaccccgaggaatggtgccatatcgagtgctcatttttggtctctgctgctggcaaattgggcactcagcagaggctgtagccaggtcagcattgatgagtgcaagcccatgttgctgagcccatgcataacctccacccctgccaccatggccagggcccattggtgatgacaggggtggctggggaaagagactgagtggtgtccacagaatgggtcattctatccatttgattattaaaatcctcctctgttgaggtcacctgttggtgagcaatcacatgggatacaaatatcctcacagtttttgaccactcagagaggtccatccacatacctctttcccaaatttctttgtcaccaatttcccagtcatgctttttccaagtccctgaccatccagccaaagcattggctacagcccgtgaatcagtatacaatcgcacatctggccatttctccttccatgcaaagtgcacatccagatgcactgctcaaagttctgcccacttggaagatttcccttcactggtgtccttcagggatgtcctagaaagggaccgtagtgttgcagctgtccactttcgggtggtgcctgcatatcgtgcagaacgatctgtgagccaggccctggtcttctcttcctctgtcaactgatcataggaaactccccatgacaccatcattgcatgctggggaagagaagacagggtggcaggagtgaagaccatggtcatttgacccacttcctcacgtaacttacttgtaccttcaggacctgctcgagcccaatcacgtatataccacttccatttgatgatggattgctgctgtgcatgaccactttatggctagatgggtcagaaaagcacccagtttatgacaggcagtttaagttgcacagtggcttgatgacccatagtcaaatgttcagtttccgccaaagcccagtaacaggccaagagctgtctctcaaaaggagagtagttttttgcagaggatggcagggtcttggtccaaaatcctagaggcctctgccgttactcacctatgggggcctgccaaagggtccaaacagcatccctatctgccactgatagctcaagcacaattggatctgctggatcatatggcccaagtggtagagcagcttgcagggcagcctggacctgttgcagagccttctcgtgttccggaccccactcaaaactggcagcctttcgggtcactcgataaatgggcctgagtaactcacccaaatgaggaatgtgttggctccaaaatccaaataggcccactaggcgttgtgcctctttcttgattgtaggaggggccaaatgcagcaacttatccttcaccttggaaggaatatcttgacaggtcccacactactggacccctagaaattttactgaggtagaagttcctggaattttagtcggatttatttcctatcctctggcatgcaaatgtctcaccaataagtccaatgtgtttgctgtttcttgctcactgatccaatcagcataatgtcatcaacataatggaccaatgcaatatcttgcagaagtgaaaagcaatcaaggtctctctgaataagattatgacacaaagccagagagttgatatacccctgaggtaggacagtaaagctatattgctggctttgccagctgaaggcaaattgcttcgggtgggcctcatgcacaggaatggagaaaaaggcatttgccaagtcaatggctgcatactaggtaccaggagatgtgttaatttgctcaagcaatgaaacacacctggtacagcagatgcaattggagtaaccacttggttaagcttaccataatccactgtcattctccaagatccgtctgtcttctgcacaggccaaatgggagacttgaaaggggatgtggtaggaatcaccacccctgcatatttcaagtccttgatcttggcactaatctctgcaatctctccacggatacgatattgttgttgacttactatttttctaggtagaggctgctctaatggcttccatttggccttttccaccatagtagccctcaccttaccagtcagggatccaacgtgggggttctgccagctgccaagtatgtctatgccaattatgcattccagaactggggaaatgaccacaggatgagtctggggaccctctggaaccacagtaagttggacctgagctaaaactccattaattacctgactttcataagcccctactttaactggaggaccacaatgacattttgggtcccctggaatcaacatcagctcagagccagtgtccagtagtccccgaaatatctgaccatttccctctccccaatgcatagttaccatggtaaaaggtcagaggtctccttggggaaggatgggaaaaagattcactgcataaattgttggtaatgtagtggggtgcttcctcaaggggacccagcctccccttcattcaaggggttctgagtctgtaaactggctcaagtctggaaattgatggaggggttgcgattctctgtttttataattcaaattaggcttttgtctattcaacctagaagttttctctgtataatttaagtaggaatgaagtaggcttcctatcagtttcgcttctaggaacactgtgattgattagccaatgccagaactctacatgagtcagactatgctgattgctgcttcgcttttgctgtccattacggtaggtacacccaccttgcctttggcggttgagtaccaccacttggccgctgccacctcaggatccaattattcccatcgaatttaaattttgtagttgagtgactgcagttcccaccattagatctgacatacagagatgagcaattacagggctctttgaagatgcatgttctgccctcacaaatctatttcacaaggcattggtcaagggtatatcttctggaccctcccagctgggatgagtaggtctaaaatgactaatccactccaccatcccaatctccctaagcctttagatcccttcctctacataaaaccaagggagatcaggcatttccatcttgctcacagtgggccatcttttaatccatatttcagctaaccaagcatataaactgttagaaccatttttaactccccgagctgaaacactgaatgcagagtccctaagcagtgggcccaaatcaacaaattcagcctgatccaactctgtgttccttccaccattatcccatacccttaatatccattctcatgcctgttctccagattgctgttcttatataaatcacagaactaaaacagttcttttctagtgtagtgcacctcctcatgggtcacactctcaaactcacctctagtggccgctgggactttaatctaattataggtctagaagcaaatggaggtgttgggggtagcttctgaagagaatcaacattatcttgcctggcaattgcctcaggggaggccatcactgttgcttcaggcagtgtttatctccttagacaaaggtggaaaggctgatggcagcatgggtcagggaggggatgttgccactactggggatggggaagctattccttctggcaaaaaaggttcatcagagtttacaaactcagtgtccccagctttatcagggtctccccacacatccccattccaagttgcagggtcccattattttccaatcaatgccctcactttaacagtagccacctggagaggctgtgcatgcatctttcattgcaggccagtcactcacataagagcttgtgtatgtttttccacaattttagctctttctctacaagggcgaagactctcactcaggacaatcttagcagatttgaggctcagtatctccttctgaagccaggaggcagaatccctgagttccttattttctttcatcactttgtcctctgaacttaggagcaaccaactggcttcattatgttccttggttctccacataaggtcaaatgtattatgcatagagtcactaaattctttgccactcatgagtggtgaatcaagagtgtcaaatgcatttattttgcataattctctaaatagttcatgccaaagactatcattgttctccatactatttgaagtagagtccttagcattttggggtctaatcatattaagcagccaactccagaaacctccaaaagaactccatccttaatattctgttcctctagaaccactcctcgtaccagaatctgtattagtcaggattctcttaaagggacagaactaataggatatgtgtgtgtgtgtgtgtgtatgtgtgtgtgtgtgtgtgtgtgtgtatgtaaaggggagtttattacgtattaacgtacatgatcacaaggtcccacaatatgctgtctgcaacctgaggagcgaggagaaccagtctgaatcccaaaactgaagaatttggagtctgattttcaagggcaggaagcatccaggataggagaaaggtgtagactgggaagctaggccaatctctccttttcaggtttttctgcctgctttatattcgctggcagctgattagattgtgcccaccagattaagggtggatctaccactgactcaaatgttaatctcttttggcaataccctcacagacacacccaggatcaatgctttgtatccttcaatccaatcaagttgacactcagtattaaccatcaaagatgtctacctaggagtggaattgctagattatatggttgctctatcttgttttttgaggatcctccaaactgttttccatagtggttgtactaatttacattcccactgacaatgtacaagtgttcccttttctccacatcctttccagaatttgttattgcctgtcttcttgataaaagccattaactggggtaaggtgatatattattgtaggtttcatttgcatttctctgatgaacaatgtttagcactttttcatatatctgtttgccatttgtatgtcttcttttgggaaatgtctatttagatcttttgcctattttttattcagattattagactttatcttgttcagctgtttgagctccttatatattctggttattaatctcttgtcagatgggtaatttgcagttatttctttcagtctttgggttttctattcactttgctgatagtttttttgttttttgctgtgcagaagctttttaatttcaatatgtcaattgcattttcaactctagaatttctgcttgattcttttaaattatttcaatctctatgttaaatttatctgatagaattatgaattccttctctgtgtttgaattttttgagattcctcatcacatctattttgaattctctgtctgaatggtcacatatctccatttttctgggattggtctctggtgctttatttagtttggtgatgttttcctggatagtcatggtgcttgtagatgttcatctgtgtctgggcattgaatagttaggtagttattgttcacagtttgggcttgtttgtacctgtacttcttgggaaggctttccaggtattcaaaagcacctggctgttgtgatttaagccgtatctgcattagggaacatcccaagcccaatagtgctgtggttcttgcagactcgcagaggtaccaccttggcggtgttgcataagatccagaagaattctctggattaccaggcagagattcttgttctcttcccttatttgctcacaaacaaagggaatctctctgtggtgagccacctggggctggagatgtgttgacacaagcacccctgtggccaccacccctgggattgtgctgggtcagacctgaagctaggacagcactgtgtctcatccaaggctcaatgcaacgacttcttggctaccacctatgtttgtgcaaggccctagggctctatagttagcaggtggcgaatccaggcttgtgtccttcccttcagggcagcgggttcccccaggccccaagcaagtccagagatactgtcagggagctagggactggaattaaaaatctttgcactctacctggtgtgttctattttactctagcagatttgaccctcaatccatgaggcatagtctttcccactcttctctgcccttatcacaggcagaggagcctcacctcatggtcaccaccaccacaggcccacggggactactgccaggctaccatctatgttcacttaaggcccaagagctcttcattcaacttgtggtgaatgctgccaggcctgggcctcatgtttcagggcagtgggctccccattgtcccagggcaggtcccaaaatgctgtgcaaaagccaaggcctggaattgaggaccccaagagccctcttgttgttgtaccccactgtggcagagttggtacctaaagtgcaagccgaagtcccctttacttttccctctccttttcttaagcagaaggagactttcccaatagccaccacagctgggaatatattgagtcttacctgaagctagtgtatctcagtcttacccaaggcccatggtgtactacctgggtagctgggtattgctactggttatttagggctactggttatttagtctgcaggtgatggatcctgccaggacttggcccttctcttcaaaacagccagttcctttctggcctggggtgtgtctggaaatgtcacctggggattaggacatgtaatggagtcctcatgactctgactggagccctatcctactgtgtctgagctagtaccccagacacaggcaaaactcctctttactcttccctctcgtctcctcaagtggaaggaagggatctgtggtggacgagtgatctttgcagcctggggttgagggagcggtgacacaagcattcccttagctgcaccaactggtgtctcagtaagtcgtgtgcctccccacccccaaatccactgtctccaagcccagctcagcactgggacttgcagactttgtggcctagattttctttcaagtttatttaatgtcccagagcaatttagcctgcagtggtgagccttgctggaactcaagttctagtcacagggatgggtgatttcctctgactagggctggtttgaatgctcccactgtaggcgggtgtcagctgtgttcagccttgttttgctttctgctgtgacagggcagcattgaattcaatgcaacatctcactatcactgcagcctccttctcctaagcacatgtattctctctcagtccacatggctgctgccaatgggtggggaaggggtggtgtcagtgattcaagactcttttctaccctctccagtgcctccttcagtgatatgaagttaaaatcaggtactgtgagtgctcacctaatttttaggttttttttatgaagatggttttttgtgtagataattgttaaatttggtgttcagggcggggatgatcaatgcggccttttattctactatcttgctccacccccaattgattaagtttcaatttatttatttattcaaatagatttttgcggaacaggtggtgtttggttatatgaataagttctttagtggtaatttctgagattttggtgcacccatcacccgagcagtgtacactgtactcaatgtgcagtcttttatcccttacacccctcccaccctttcccatgagtccccaaagtccattgtatcattcttatgcctttgcgtcctcatagcttagctcccacttatgagtgagagcatacaatgtttgattttccattcctgagttacttcacttagaataatggtctccaactccatccaggttgctgccaaagccattatttcattcctttttatgactgagtagtattccatgctatttatataccatattttctttatccacccattgattcattgattgatgggtatttgggctggtttccatatttttgcaattgtgaattgtgctgctgtaaacacaagtgtgcaaggttttgttttgttttttctgtttgtttttgcttgtttgtttgtttgttttttgtataatgacttcttttcctctgggtagataaccagtagtgggattgctggaaagaatggtagatctacttttagttctttaagaaatctccacagtgttttccatagtggttgtaccagtttacattccccccagtagtgtagaagtgttcccttttcagctgggtgtggtggctcacgcctgtaatcccagcactttgggaggctgaggcaggtgatcaccggaggtcaggagttggagaccagcctgaccaacatggagaaaccccatctctactaaaaatacaaaattagctgggcgtggtggtgcatgcctgtaatcccaactactcaggaggctgaggcaagagaatcacttgaacccgggagatggaggttgcggtgagccgagattgtgccgttccacttcaacctgggcaataaaagcgaaactctgtctcaaaaaaaaaaaaaaaaagaagaaaagaagaagtgttcccttttcagcacattcacaccaacatctattatttttttatttttttttaattatggccattcttggggagtgagatggtatcacatggtggttttgatttacatttccctgatcattagtgatgtttatcattttttcatatgtttgttggccatttgccaactgatatgttttcaaaggcaaaataattaaatgagattgtttattccacttaaacgaattcaaaaataatgacttacaaagtagtaatataattccaccgcccatgtgtccaaaatgttgatttatttatgccagaatgttgtttctctgaccaaatattgtcttttggagctggaggatctccaaaagggaaagctcttatagctaatcaagaagtttcagtggggaaacttataataccatgaactaagcatcagcctgattagctactgattttgtgactgaaataaaatggtacctttcgttcttaccctgccccaaggtgttttttagacaggggaaattaggtgtaataatttcctctgaaaggtgagttatgctacttttgattatttttctttttacttctttgtattttttcctcttacatttatttttgattaggtaacacattcatgtggttcagaatttgaaatttacaatagagtgtacaattaaaggtctcacattctttgtgcccacccccacagttcttcccagaggcaaccagtgtttttacttttataaatattttatgcatacacaagcacaggcacttgcaaacatgtgcacacattcttccccccagttgtttttacacatttttctgtactatgctttagagcatttcatatcagtgcataaggagctatggctacatggtattatttgtttgtatagagatgacataatttatttaacaagtcccctattgagggatgtttaatttgttgcctgtcttttgctattgcatttctgcagtaagtaatcttgtaatacatcatttcagatgtgtgctatctgtagggtgaatttctagaaatggagctgttgggttggatagtatggacccttgtcattttggtagatattgccagaatgtcctctatagaagttgtgcccaatttacactcctaccagcaatgtataactgtgttttcctaaccctcaccaacacattgtattatcaaacattatatctttatgaatatgatatgtaaaaaatactatgtttttaatatgcatttctgttctgaataaggttgagcaccttttcatatatttaagatcctgtgatatttataaaaataatttccttttttataatggctggaatgctgcaggattgataggcacaatgtcttttctccttaacttatacctgcaggtatattcttttacacagcagtatgagagtgattccaaagagcatatttaggttaaataaataatccaggaacactttgtgttttaaaatttcggtagcattttataattcactcattatacaactaacatattatagttgacaaacaaatgaaccaacatcccctagtaactttaaatgatttaaattactcaagaaatttaactcagtggttttgttacttcttaatatacaccatactttataattttttcatattccaagaaaaatagaattatcctttatttaggaagttaccagtgtgttagaatttgcacggagttatcttaaattatggtctgtttacatttgcaatatgtatttgaaattttcttccttaatacctaagccacattgcaggaaggtgagaagttcagtgtatatttaaatgtgttgactgattcataaatggccccggactcttttgcatcacacaacaaatttttgtcagatctttgtctatggcactgtagatcacctctattatagcagctatcaaagtctgtcatgtattgtcattatttatttatgtgtctgcttttgtcactagattatgaacttctagaggatacaatttgtattcccctctagcactggtctggagctttgcatatatttcagacttataaaatgtttgttgaactgaattgaatcacatttatatagaggttctgaggttgccttttaaaaaacgtttttccacgtattgtttgcttttttaaatgtaaagtcttattttaataccgcccaagtttgctttctgctaatattattgaatttgtattgagaataattattcaaaatactcctgtaataatatcagtgaagaggcagatttttattgtgcatatttcctagctgttcatagttttaaccatcagagtcctgctttaattttagcctcaggcaattctaaatatttagtgagcaaagtgggaatattagacactttagtgcgggatgttatttgtttcatctcactaagattcccaatttatataggccatttgaaatgtgcaattaaagttctggtcattgctaatattaaggaatttagaaggttctatagcagagtaaacagctttacaaatgatagtggtgttttttaatttaaatttttattgagatatttgtggattcatatgtagctctaagaaataatatagagagatcccttatacactttatgcatttctccccagtggtaacatcttgcagaacagttgcctactatcataaccaggatactaatagtaatataatctgccactctatattcagatttcaccagttttacttgtgttcatgtgtatgtgtgttctgtacaattttattacctatatatgttcatgtttccaccaccacagttaaaatactaaacagttccaacatcgcatatattcagaagtatgctatctgtagggtgaatttctacaaatggagctgttgggttggatgtttgtacctttgtcattttgatagatattgccagaatgtcctctatcgaagttctatcagatttacactcctaccagcaatgtataactgtgtttgttttcctaaccctcaccaacacattgcgttatcaaacattgcccttttataaccaccccctgacccctatcatcctaaatcattgcagccactaatctgttctccacttctaaattttgtcatttaaaaatgttatttatttagaataatgtagtataaccttttatgattagccttttttatcattatcaagtattatgtactttgcataattgtatgtgctatactttttaatgagtatttttatgtaaatatttaaaaatttatcttattttaggtttgggggtacatgtgaaggtttgttacacaggtaaacacgtgtcatgggggtttgttttacatattattacatcacccatgaattaagcttagtacccaatagttatcttttctgctcctcttcatccttccaccctctgttctcaagtagaccccagtgtctgttgattccttcttggtgttcgtaagttcttataatttagctcccacttataagtgagaacatacagtatttggttttctgttcctgcattagtttgctaaggatgatagcttccagctccatctgtgttctcacaaaagacatgatcttgttctttattatggctgcataatattacatggtatatatgtaccacattttctttatccagtctgtcacggatggggatttaggttgatttcatgtctttgctattgtgaacagtgctgcagtgaacattcatgtgtgcacatgtctttatggtagaatactcatgaaagtgtcttggagctatttggacaaggaattttaggatcttgggtactcaaattatgatatggaaggggaaacacaggctttcagtggttctttcccttttgccccacagactcttcctctctgaaactgacagcagctgaggaatggctagagtggggtctgctacattggagagcatctcttgtccatgtcaaagtgtgacgcttcatttattaattgtttgctatgatttaactactaaatgctattttaatttttttggcttgaaaataagtcttaagatgtcatcaagcttgatgccagcaaatatggcagagtagggaaccctcaaaatttatctttttttacaattgcactaaataaactggcaaatactctcagaatcaactttactggcattatggaaactaatcaaaagtttacagcaaccagacaaatgcttaataataaaaaaagttgaatctcagtaggagagatttgtggcattttagcttacccttgtcccaccccctgctctctagcttggcagtggctctgaagacaacagtctacatttcactgtactagtccactgagtacaggttcttagtacctgagggagtagaagtaaccttattcttaaataagtgtgtttgttggttttgatctgtgttgtggatctgagggaccagttcagaaggcttgcctttattttgcctaactcagaacttttccaaggttgaggcagctatgggggtggaggagagatttgtgaaaacatttacaggcaaatgtattagctgctacttcctaggggtagggataaaggttggtcaaacagtaaactagctaaaaagcttgggaaaaaagtctgggaaatgagatgctttggagaattagagctttgaaaagcttcaacatattcctggtaatttcgaaggccatgtgcccccaaggctatgtggatgctcagaaaagacctgagaacgccctaagctttcacctctggcttatcttcagggtctcaactagcaggaatttaaggctaatgcagaatagtaaacttcctggctgagtgttgaaggtgtgcacatctgcaaagactgggaatttattgttgttgttgttccaggcgttttaggaaatttctgtttcaaatcactagatgctcactacgataatgaaacagatttcagtggccacacaacaaagaatacagactttacaaaattagtttagaaaaagtcactaaacaaacaaacaactactataataagcatcaataacaaaccctggagagggaagagaatctgattttcagatttgctgcatcataatattcaaaatgtcctatcttcataaaaatatgaaccatgcaaattaaaaagaaagtattacacataggaaagaagaaattactataattccccaaagaatcccctggctgtagtatgggagagtcattaatctgctatttagctaattgaacaagtaaaatggacaaatcgaatattgagcactactagaggatccccatttactagtaaaacatgcttttatagagatggatagctgttccaaaaatgtctggccatttttattgcattataaccttaagttaaattttagttttcattttatcttgtgatatatgatatatggaagctaactcatttcctatgagcaaatgaattgatgagttttgctcaactgcagaaaatcattgagtcttttataggattttttggtctctgactttagataaaatggtatgtatgaactctttcccaaatagtacctggatctgctatgtttctctttctaccaagcagatagcctaattctcaatgcctggctgtctcacttgtgtcttgtgctggatatttttatttgctgaatattatgttaagtacagttgactatcattttcatctttataaggaaatcattgtatagctatattaaaaaatgagtagtttttatactgttttaactatagacccttagtggttataaagacttagcaaagggccaaagagtttttaaaatgatatatttataagcaagtatagagaggaattcaataagtgagtctggcattgtgcatctgttttagagatttcattcattagaaaatagagaacaccatggggaaagactctcaattttattaactaagtatggtccatgcatatgaagcgacttcagtagaataagttcaaaggaaaaatgaatgatgtcaaagagaaaagtaataattttacttcataagttgccaactcaggtagttgtcatttaggaaatatactgggacagcctaaaggtaagttaacttttttcttaattaagccttctttgaagaagttaagtttagtgagtaagatgcttcttttttataatggtttttatttacatatctcatgttggtgaatcatgtgttagtagaaatcataagggaatagatatgctgctatttaacttcagttctgttttttcaaaaaaataataaattaatggataatgtagcttctcacttatacaggggttacagggacctaattcttggatctacatagccatcaactgtagtaccatatttctcttgagggagctccccaaatgaatgggagagttaaccagcatttatatggcttaccttgtatctcaaatctaaaaagaaaaaaaaaaaaaaacggatgtagctaatggtatcttttaaatgttctttgacatttaatcaattttcactcttaatggttctgtatatcttattttgctcggaaagggtcaaagccatgcctgaaagaccttaaaataaaatgttaaattttgactatgctttggtaactttgtttattttgatattgcctgatgcacagaaaatgataaaaatttccataagaaaatagattgcaactatttaagtctacaatacttttccttgtttttataaattaaaatttaaatacaattttaagtctattttttgacctaaacaattgtaatactgagttctttgtgtatttcttaagaatttctttgcaggtccaaacagatctagcattattgagactgaataaaagatgcttctttcaggtggcccctaatttaattgtttgtaatgattattctagaaaaaagcaccactctgacacatggattttcttgtaggtcagcattttataaaaagtatcctaacgacaaatggatgataggaagagcaaaagaggaaaaaatatccgtaagaaaagatgtaatacaattagtacaaggggcaggaggtaacaggaatttggttcttctttctatatttttttactttgagttcctcaaatattttatatgcaagaaaatatttcaagttttaacacatatgtcataccattttcttagtttgtattccatcatgccataagcatttactttcagaaggacttttggttttataaattaaaggcctgattttttttttttcagtgcacttctaagttagataacgcagagggaggtttatgtggaaatgatcgtttttctaagtgaatgttcaaacactgagtcactcacaagttcttaaaatcctatatgttttaagatatattagaggcagattctatactgaagaaatagtgcaaattttgcgcagttaacataaaatttagcatttttcatcctcccattatcttcagccccatgattttgtgtctttggggatgaatacttagactttcacttgatgcattcaggctctgggttagaaaaagatgcttaaagactgagtcatgaatattggaaaagaatatagtgggaggaatcactctacatgatattatgacctactatatagctgtagttaattaaaacagttgcagtagtagagaaggaatagacacatagatcaatatgatagaagggagaattaagaaatagacctttacaatatgcccagctattttttgacaaaggagcaaaagcaatttaatagaggaagaataactttttttttcaacaaatgattctggaacaattgagcatccatagacaaaaatatgaaccttgacctaagcctcacaccttacaaaaaagttaactcagaatggatcatgggtttaaatataaaaagaaaacaataaaacgtttagaaaaaaataaaatcatcacctagagctagatgaagaattcttagacgtaataccaaaagcctagttcatgaaataatcaaaatttaaaaatgtttattctgtgaaagtccttgttaaacagagaatgaaaacactagctataaacggagaaaatatttgcaaaacacatatccagtagaagattattatttagaatatatatttttaaaactcccaaaactgatcagttcaataaaacccccccaaatcccattagaaaatggacaaaagatatgatcatacatttcatgtaagaggatatacatggaaggaacattattgggaaattggtgacaaagaaatttggagaagagatgtgtgaatagacctccctgaatgggcaaaaaacatgaagataattgtgtctcatcaaagggcaacctcagcagaggaggattttaatagccaagtggataggatgacccgttctatggatatcagtcagtctctttcccaaccactcctgtcagtgcccaatgggctcatgagcaaaatggccatgatggcagggatggaaattatgcatgggttcagcatcctggacttccactcaccaagaccaaactggctatagccattgctggatgtccaatctgccagtagcagagaccaacactggtagcaacaccagatgaggcaacattgcctggagtgatcagccaactctctggtgggaggttgattacatcggaccccttctaccatggaagaggcagcgttttgtctttaatggaacagacaatcgggatatggatttgccttccctgctttgcagtgcttctcccaaaactgtccatgaatggcttcattttgttttttcctctccagtttctcaggatgtagctttagattattgaattgagacatttcttctaatgtatgcatttaatgtaataaatttccctctaagaacattttagctacacaccactcatttttgacatgttatgttttcgttttcattttaatttactcaaaacagtttttttcaataattttactttgactcatatgttaatacttggaagtgtcttgtttcatttgcaaacatttgaggatcttctcaatatcattctcttttttgatttctagttcaactctattatgatcagataatgtactttgtatgattgctattttttaaatttataatttttttatgtcccagaatatgttctatcttggtgtgtgttctatatacatttgagaagaatgtgcattctggctggatggaatattctatatcaaattggttgatagtattattcatatccttactgatttcttcatattttttctgttaattactgagagagaactgatgaagtcacaaaatatagttgtgtgtttgcgtttttttccttttatttctgacaggttctgcctcatgttttgaagctctgttagttgtatacacattcaaatattatgtcatcttggataatcgatccctttattgttatgtatgtttcctctttctcttggattatatttcttattctatagtgtcaaaaattaatatcactattacaactttgttttttgatagtcgtttctttttgaaaaaagctttattgacttgtgattcaccaatttaaaatgtataaatcaatgtttattagcatattcacagagctgtacaatcatactcacagtctaaattttgagcattttaatcactccatagagaaatcccataccctttaccagtaactctcccgtaatcccccaaatcttggcaaccactaacctactctctgtttctatagatttgcctattctggacatttcgtagaaattgaattatacattacgtggtattttgtgattagtttctttcacttagcagaatgtttacaaggttcagccatgttgtaacatgaatcagtattagattcattttcatcactgaatcacattacattgtatggatataccacattttggttatcggtttataagttgatggacattcaagttgtttcctcatttggctattagaaataatgctgctatgaatatttgtgtaaaagtttttgtatagatatatgtttttttaatcttgggtatatacctagaagtagatttccacgtgatgtggtaactctatgtgtaaacatttggggacctaacatcctgttttctaaagtgactgcatcattttctattttcaccagagagcctggtggggttcctggagaaggctgttagagagtgtgagttcctctatgtttgtgggccccagaagtttcacattatcttattagcccacacctggcctttagcaattagttgaaatgtctaattgaatcttcctacctgcttgtattctgtattgcattctatattgtcattcaatattcaattttcttataagtaaggaaatgctctggacctatttctctctggaggttttgggctgattctttgctgtgatctctattatctctgataggtccaagaaaaattgttactctgaaacctgcttgacttttttcttattgcaagtttaggagtaacatctttctagctctctacatcttcaagctaaaaaatgtcatttaataatgagtttacctgttttttatatattatggataccagttctttattatatgtacatttcacaaaagttttcttccagtttgttgctggcttattctttttcttaatgattttttgatgagcaggtgttttacattttaatgaatctagtttatcattctttcttttattatttgtgctttctgctgcctaacaaatatttttctatgccaaggtcacaaagctgtttcctgttgttttttctagaaactttaaagtattttatatttaagaacatctttgatcttgaagtaattttttgaatggtgtgaattagaggttgacgtttctgttttaaaatatgggtatactgttgtttcatcaaaatttattggagagatttcctttcccagtgaacttttatgttaccattttcaaagatcatttgactttatttgtctgtgtctaattttggactctccattttgtttgtttgacctgttcattcattaataccacactgtcttggtattgtatagtgagtgttaaaataaggtagagtaaatattaaatataaatattaaaacttccttcctcttttcaatattattttggatagtttatgttctttccatttctgtataaattatataatcactttgtcaatttttacaacaatatctctgatgattttgatgggtgttgtagtgaatctatgggcaaattttgggaagattgttaactgaagaatatttcatctccagtatatgagtctagcatatatttccatttacttgataggtatatatttactttacattacatttaatatttctcagcaatgtttttatcattttcatagcataggttttgcacatctttcactaattttatctctaagtaatttatgactttggatgccattgtaaatggtattagtataaaatttttcattttataatgataactgatttactaacttcagttttataatcacttttatactgtgagtatacaaaatttacttgtttaaattttatggctttttaaagattacttagaagtttctacaattaataatcacattatcttcaaataagagatgattttgctcttcccttttcaattattttgcatttttccttatctaattgcggtggatgagctcaatggcaaatgctaaataaaagtgatgagataagatatttttgtctgtttcccaagcataaggaggaaaaacttcagtatttcactattaagtattatgcaatatgtatgtattttacatgcacatcatcagattgaagaagttccctctatttttagtttggtgacaatttttatcatgaatggatattgaattttgttcaatgatcatataattttacccctttaatttgttaatgagtaagttttatttgttgatttttattgttaagccaatcttgcattttggggattaaattctatttgagcaagatgtagtatccttttaatatgttgttgtattctatttagtaatattctattaaatatttttggatctgtgttcttgagagatatttgtgtataattacattttcttgtaattcatttatctggttttcatatcagtgtaatataggcctcctaaatgagtttgaatgtgcttcctcttccttcattttccaaaaatgcatttgtagtattggtatttttctcttaaatatttgattgaattaactaatgaagctgtcttggcctagatttttctttgtgcaacagtacaattttgtattgtgtttatttaattaacgttttatcatgggcacttttctatttcattaaatatttttcaaaaccaagatttttcagttacataatactcatttgaataaatatactgtaatatatgtaactagtcccctacataactgttactttttttctcaaacatacgtctgtgtgtatgtgtgtatttgtatacaaacatatgtatacgtttatatataatatgaagtatgcataatatagtatattgcatacatagtatacatacataataaatacatgtatgtataaaaatgtacatatgcatgcccacacacatagacccactaagagaggcagacagactgatggactctagaattagatatatcagtacattaacagagtttaactttggatgttgggagtttgggcactttttactttctttcacagttttcagtattcctattcttttcagaccaagagtgttactctataattagaaagtaaatacctgaactgttttcattcttgagaattaaaaaatggataatttcttaagctagcacaggcaggtagggaaattaccaaaatactgcgtggtaattaaaattatagcaatgttcatgtttgtgatccccaaccacccaagagcggaacattaaatgatgtcggaggaggtgcagtctttcaggctcccatgagaattgccaaatggggcacttatgctttttgggacgaggtccaggttttatttttttcttcttcaaaagtcttaaaataaatgaaaattgtcacagcaaaatgcattttccctttcatttagagcattgaaggctacgcaacgtcaggtgacactggaagaatttggcttgaatttttaaagttgcttgataggggaaagggagatgaaaattactttgaagaattatctagtcacatttggttaatgtgggcaatgatagaataaagtaaaaattttagacatgtaatccattgtgatggctccagtttttcaggacaattaagaaatagcctctattgctcaaagtctcaagaaatactggaaaaaaatgcatggatactttattgggtgcttgttaaattattaaataggtgacaacttaggggtgctggctaaactttttaacttcttgtttggccttgtacagtttataaattttagaagtaacactgagaggacagaaaatatctagaagactttttaaaggtgcatacatatatatacacacatgcatttcagaccaacgagtgagggatgagtatggcaggaggagtggggacagaggaccgaagaagaatgagaggatgttgggaggtggagagagagataagaaacaaaataattagagaaaaattaaaaggtgtatttattaggtatagggtgaaaaaatttgcctaattcctgaatttggatgatttcagagtgttcttatctggttctgtacccaaaataatttattcttagggattctgtgagggattaaatgacactagagacaaacgatgaggcaatgagaaaattatgaagaaattaaggagaagagcaatatcttcttatttgctataattcataatacatggatgtttgagaatcactattatctagtgtataaggctgacttgttcccattatttcctaatccataatgctgctccttttttaccccataatccttcccttaaaccacatgtgcatcatttctttcatctggaatggatgtcttgtgtttcaaaaatgttttaccttatcactcttattttcacttctgaactaaaggtacattgcttgtataaccccctttttgctgttttgataaggtactaaattgaataatgtacctttaggccagagagcagtatagggcaagttacttagtttgtgagagagcctaggcaaccgattgctgaacagctattatctccttgtgatttcatttcctttgctcattattaggcacactataagtattgtgatattttctttggaaaattttggtcctaatcagaaagccatctgctaacaattgtgctggaagtgaagcagcatgataaagttacctttagccatgatatagttgtgtcaatgacctttcagttacatattactattatataatttgtggggaacatttcatgtcttagtgctttttgtaatgtgggaatttggcagtttgaaaatgtatggaaagcactacagttattgactcttttttttggtcatccaagtttcattgggttcttcatgtttctttatttcccttagactatttgagaggtaggaaaccaagggagaaggaaatggactcttatggtggagcaaattgaagtatcacttctgcttttctttttttcttttaatccagatgtacagtaaacatagacaagagtatagactacagccaggttatagaacagataggtctcagtagtaggcagtatgttagctcagatatctgggtagtcaacatggttgagagtgtggtagctatcattcataggtgagttgagtgcaagagccagggtagctggtagcaggcaatatccagagatccaggtgaacattatagttctgacagtgggattggagttcatgttactatttttccacatcaggtatgctggaaggtaatagttttgttttgttttgttttgttttgttttgttttgtttttttggagatggagtttcgttcttgttgcccaggctgcagtgcaatggcgcaatctcggctcactgcaacctctgcctcccgggttcaagtgattctcctgcctcagcctcctgagtagctgggattacgggcatgcaccaccatgcccggctaattttgtatttttagtagagacggggtttttccatgttagtcaggctattctcgaactcccgacctcaggtgatctgcctgcctcggcctcccaaagtgctgggattacaggcatgagccaccgcgcccggctactggaaggtaatagttttttgtgtagtccgttgcctgaaatttaaaacattttttttcatttaaaaataaagacaggcttagaaaatcacacacacaatatatggtttaataaattattaccaagtaaatacctttgtaactaacacccaggtcaagaaataagaactatgctacccaccccaaaagctccttttgtggaccacatcctaatcccaacccagttgctccacagaaataaacattgtcttgactttctttggactttttatggttttatcacccaaattcgcgttcctaggtattactgttttattcttgttcatttagaaaactttgatatgttttttaaatatctcttaaatgtgtgggttttccctctatcccttacttttctttacaattaatatttcgaagaacctatgccatctgacttacagagcatctcaccttttggattcttctgactgcaaattcaaggtgcagtttaacatttttttctgccatttatattttctacatattggcagctggatccagtggcttgatcagacttagttttgatctctggcaagattataagtggtgtctgacagtcatatatggggaagataatgggtactcgtctttctttttgtgatagtagtagctattggtgattaatgacaatattagttaactcagtttgaaaagtagtgatattcttggccaatatcatactgaatggggaaaagttgaaagcattcctcgtaagaacttgaacaagataaggatgcccaccacattcaccacttgtcttcaacatagtacttgaagtcctagtcagagcaattaagcaagagaaagaaataaagagcatccaaattggaaaggaggaagccaaactatctctcttagtcaatgatataatcttatacctagaaaaccctaaaggctcctccaaaagccttctaggcttgataaatgaattcagtaaagtctcaggttacaaaatcaatgtatacaaatcagtagcaccactatgcaccaacaacaatgaagctgagaatcaaatcaagaactcagtcccttttacaacagctacaaaaagtaaaacacctaggaatatatttaaccaaagaggtgaaagatctctacaaggataatgacaaaacactgatgaaagaaatcatagatgacaaaaacaatggttcatggattggaagagtcaatgttgtgaaaatgaccatactgtccaaagcaatctacagattcaatgcaatacctatcaaaataccaatgtcagttttcacagaattagaaaaaacaatcccaaaattcatatggaaccaaaaaggagcctgcatagccaaagcaatcctaaaccaaaagaacaaatctggaggcatcacactacctgacttcaaattatactataaggctacagtaatccaaacagtatggactggtacaaaagtaggcacataacaaattgaaaagaatagagaactgagaaataaagccaaatacaaccaaccgatcttctatgaagcagacaaaaatatacaatggagaaggactccctattcaatatatggtgctgggaaaattggatatctgcatgtagaagaatgaaactggatccttaagtctcaccatatacaaaaattaactcaagatagattaaagacttaaatttaagacctgaaactatacaattttagaagaaaacataggaaaaactcttctggacattgacctaggcaaataatttatgactcagaccccaaaagcaaatgtaacaaaaacaaaaataaataaatgggacctatttaaattacaagcttctgcataggaaaaaaataatcaacagagtgaacagacaacctacagaatgggagaaaatatttgtaaactatgcatctgataaaagactaatagccacaatctacaaggaactgaaacaaatcagcaagaaaaaatcaaataatcccatcaaaatgtgggcaaatgacatgaatagacatttctgtcttcaaaagaaggcatgcaaatggccaagaaacatggaatcatgctcaatatcactaatcatcaatgtaaatgcaaattaaaaccacaatgaagtgccaccttaccccagctagaatagccagtattaaaaagtcaaagaacaatacatgttggcatggatgtagtgaaaagggaacacttctacactgctggtgagaatataaattagtacaacctctatggaaaacagtagggagatttctcaaagaactcaaagtagacctaccattcaatccagcaatcccactactgggtatctgtctaaaggaaaataagttattgtatgaaaaagacatgtgcatgcatatgtttattgcagcacaattcaaagatatggaaccaacctaagtgcccatcaaccaaggagtagataaagaaaatgtggtatatatgcatcatggaatgctactcaaccacaaaaaaggaatggaataatgtcttttgcagcaacttggatgaaactggaggccattattttaagtgatgtaattcaggaatggaaaataaaatactgtatattcccacttgtaagtgggagttaagctatgggtacagaaaagcatacagagttgtataatggactttggacactcagaagtgaggagtcggtgagggataaaaaaaaaaaactacatactcagtacagtgtacattatttgggtgttggagtacactaaaatcccagactttgccactatacaattcatccatgtaaccaaaaaccacttgtacccctaaagctattgaaataaaaaaaaaactcaaagaaaagtagtgatattctaatgtaattttttttcatgtgttagttggtgttatggactgaattgtgtccctcaaaattcatatgttgaatctcaaaccccaaggtaactgtatatggagtaagaaagtaattaaggttaaatgaggtcataaaggtggaactctaatcaatattagtgtccttataaaaagagacaccagagagttcactcactccctgccatgtaaagacgcagcaggaaagcaggcatctgcaagccaggaagagacccctcaccagaaatcacaccttgccagaaccttgatctcacagccttgagaagagtgaaagaaataattttctgttgtttaagccactcagtctacaatattttgttttggtaggctgagttgactaatacagttggaatacttttaaaaagagatagtttcccccatccattatttggttatcaagtgatactgtttatattgaagagactataaatgtttgaggctttctctgtatgtacttaccagttttcaagaaaatgaactggttccccatcatcctcttaaagtgagtaattcttttctctttacaatatcattatgaactcttgaacttaaacatatttgatgggtttcaatccatttcaaatattgttgtcactgaagcacatattgtgtcatagttgactaatgggagtgtccacaagttggctcctgagtcctttaacaagactctagtctttaaaagctttcttattacctagtatgacacaatgtttctggttcattttatacattccttgcctcaaatttagaatcaggcattctacatatgtcacttgtttctattaattcataatggtatctcaataccacagtcttggtggaaaagatacttattgttacttctttgataattgttttttttcccactagccttttattctatcatctatctatctatctatctatctatctatctatctatctatctatctacctacctgtctataagacagtgttctccaacatttttggcaccagggacaggttttgtggaagacaatttttccacatactcaggggatgaggtggatgattccaggatgaaactgttccacctcagatcatcatgcattggattctcataaggagagtgcaacttagattcctcccatgtgcagttcacaatagggttcacattgcactcctatgagaatctaatgtcaatgatgatctgacaggagacagagttcaggtggtaatatttgctcgcccaccactcacctcctgctgtgtggcctggttcctaatggtacgatttggttccatagactggtacctgtccatggcccgggggttggggactcctaagagataggtctgactctgtgcctaggctacactgcactggggcagtcatggctgactgcagccttgatctcctgggctcaagcaatcctcctgcctcagcctcctgagtagctgggattacaggtgcaagccaccacacctggtggtcattgtttatacatcttttcagtggagagagctaagaaatataaaaataaattcacatacaccctcccaagactgaaccaggaagaaatggattccctgaacaaaccaataacaagctccaaagttgaatcagtaataaatagcctaccaacaaaaaaaagcccaggaccaggtggattcacagccgaattctaccagatgtacaaagaagggatgacactgttcctactgaaactattccaaaaatttgaggaggagggactccttcccaactcattctatgaggccagcattatcctgataccaaaacctggcagaaacacaacaacaacaacaaaaaaaaaaaaaagaaaaaaaaaaaaagaaaacttcaggccaatgtccctgaacatcagtgcaaaaatcctcaacaatatagttgcacacaaaatctagcagcacaacaaaaagctaatccactgcaatcaagtaggcttcatccctgggatgcaaggttggttcaacatacacaaatcaagaaatgtgattcatcatgtaaacacaactaaagacaagtccacatgatgatctcaatagataatgcagaaaaggctttttataaaactcaacattccggccgggcatggtggctcacgcctgtagtctcagcactttgggaggcagaggtgggtggatcacaaggtcaggagatcaagaccatcctggctaacatggtgaaaccctgtctctactgaaaatacaaaacattagctgggcatggcagcatgcacctgtagtcccagctgctggggaggctgaggcaggagaatggcgtgaacctgggaggtagagcttgcagtgagcctagatcacaccactgcattccagcctgggcgacagagcgagactccatctcaaaataaacaaataaccaaaaactcaacattccttcatgttgaaaactttcaataaactaggtattgaaggaacatgcctcaaaataataagagctctctgtgacaaacccacagccaacctcatactgaatgggcaaaatctggaagcattctccttgaaaaccagcacaaggcaaggatgctctctctcgccacttctattcaacatagtactggaagtcctggccagagcagtcaggcaagagaaagaaataaagggcatccaaacaggaagagaggaagtcaaactattcctgtttgtagacgatatgattctatatctagaaaaccccagagtcttggcccagaagctccttcagctgataaacaactttggcaaagtttccagatacaaaatcaatgcagaaaatcactaccattcccatacaccaacaacagccacaccaagagccgaatcaggaaggcagtctcattcacaattgccacaaaaaggatgaaatacctgctaatacagctaaccagggaggagaaatatctctacaatgataattacaaaacacttctcaaagcagtcagagaagacacaaacaaatggaaaaacattccatgctcatggataggaaaaatcaatatcattaaaacggccacactgcccaatgcaatttacagattcagtgctattcctatcagactaccagtgacattcttcgcagaactagaaaaaactagttttaaattcatgtaggaccaaaaaaaaaaaaaaaaaaaaaaaagacaagaaagagcctgcatagccaaggtaatcctaagcaaaaagaacaaagctggaggcatcacatcacccaacttcaaactacactacagggctacagtaaccaaaacagcatggtactggtataaaaaacaggcacatagaccaatggaacataatagcccataaataaggcttcactctgcaaccatctgattttagacaaatatgacaaaagcaagcaatggggaaaagactttatattcaataaatggtgctgggataaccagctagccataagcagaagattgaaattggaccccttccttacatcacatacaaaaatcaactcaaaatgtattaaacaattaaatgtaaaactcaaaactgtaaaaaccctagaagacgatctaggcaataccaatctggacatgggcatgggcaaagatttcatgacaaagacaccaaaagcaattgcaacaaaagcaaaaattggcaatgcgatctaattaaacataagagattctgcacagcaaagagcaaaagaaactatcaacagactaaaaagacaacctacagaatgggagaaaatagcttgcagactatgcatctgacaatggtctaatatccagcatctatgttctcagttataagtgggagctaaatgatgagaacacatggacacatagagtggaacaacacacaatggggtctttcagagagtggagggtgggaagagggagaggatcaggaaaaataactaatgggtactaggcttaatatctgcgtaattaaataatttgtacaacaaacccccatggcacagttcacctatgtaagtaacctgaacttgtacccctgaactaaaaagttaaaacaaatttaaaaaacaaatttacaagagaaaaaccaacaacctcattaataagtggccaaaggacataaacagacacttttcaaagaagacaaaacatgcggccaacacacatgaaaaaatgctcaatgtcactgatcattagagaaatgcaaataaaaaccacagtgagataccatcttacaccagtcagaatggctgttttttaaaagtcaaaaataacagatgctgttgaagatgtggaggcaaaggagcacttatacactgttggtgggtctgtaaagtagttcaaccattgtggaaagcagtatggcaattcctcaaagagctaaaaacagaactaccattgcacccagcaatcccattactgggtatatacccagaggaatataaagcattctgccataaagaaacatgcacacaaatgttcattgtcacactagtcacaatagcaaagacatggaatcaacctaaatgcccatcagtgacagattacataaagaaaatgtggtacatttacaccatggaatactatgcaggcataaaaaagaatgatctcatgtattttgtgggaacagagatggagctggaggttattatccttagcaaactaatgccagaacagaataccaaatgctgcatgttcttacttgtaagtgggagctaaatgatgagaactcatgaacacagaaggaaataatagacactgtggcctatgtgagggtggaggctgggaggagggagaagagcagataaaataaatattggatactaggcttactacctgggtgatgaaataatctgtacaacaaacccccgtgacaagactttaccaatataacaagcctgcacatttaccccagcacctaaaataaaagttaaaataataataatttaaaaagtactttgtaatcttaaaaaattaacacacataaaaccttatgagtttatactgatacttgcaattcaaatgcagtgccatatatatagacttctggttaactttttttttcctgttccatcctttgtctttcccaccaagaattgtgctttttaaggccagaagggatgacagaattagaataccctgaaagtattcatttatcttatttcacaatagaaatacagcagcctcagaataacaatacgaatactaccaccatagtcggatgaatattaaataaaagcaggaaaggaattagaacagagagaaaaggggaggaaggaataatagataccattctattgaaggtttggtggctattggtagttttcctcattctcatattttgcctttgtgataccttgtctcccaaagttttatgaaacattcatgtgtttttggttttgctttagttcctctatttttactgtctatgtacttttcatacaactttttgtttattttttaaattttattttttaattgacaataattgcacatattcatggggtgcatagtgatgtttcaaaacatattatgtgtagtgatcagatttggtaactagcatatctatcatctcatacctttattatttcttcatgtggtgaatatacaatatcttccttctagctatttgaaactatatattattgttcaaaactacaaagaagtttaaagaatagtacaatgaacccttgtatacttttcacccagattcaccaatttttaatattgtgtcactacatttataaatatataattctttctttctacttaatattttaatatgagaaattttaagcataaagttgaaagagttttacagtggccactcctgtagctgctgcctggattttactgttaaattttgctatagttttatcagtgtcagtttatccattccattatctatatattaatacatattgatgcattcagaaataaattgcagaaagacattcatgatcatgcatcagaaaaattaatattgttaatatgactgtacttccccaaattgatctaagcattcagtgcagtcttccttaaagtctcagctggtttctttgcagaaatatgagaagctgacctaaaattcatatcgtatggaaatgtaagagatccggaatagtcaaaacagtcttgaaaaagaacaaagttggaagactcttccaagatttcaaaattcactagtaagttacagtaatcaagactgtttggtgctgacataaggatagacataaatcaatggagtagagttgaaagctcagaaaaaaactctcacctttatagtcaattgtttttcaacaaggatgccaagacagttggaggaaagaaaatattcttcaacaaatggtgctgggaaaactgaatatcaggtgcaaaagaataaagttggacctatattacctaccttatgccaaatttaattcaaaaaggattttttatatgcaatgtacaaaataggcaaatctatagagacagaaactagattggtggttgcctaggactgggtgggggatgtggttggaagaaaatttgaagtgactcattggtatggggtttctttttgggatgataaaaatgttctaaaattgattgtggtaatggttgcataactctgtgaatatactgaaaaccattgacctgtacggaagtcatagcccaataagctgttagagaaaaacaattgcagaaaccaatacactttctcctaaatggttcaacatttatattaataactagggttcaatattggtttatgcattttagttttgatataaaaattccataagatgaaatgcagaaatcttaagtgaacattcactgagttttgacaatacatacatctgtgtaatccattccccatcatgttatagaacattaacatcaccgttggaagttccctcctgtcatccttctagtgagttttctcctatgtaccacctaaggcatactttgatctgattgttttccagcacggaattatccacctgatttagtattttacataaaatgcataatttaataggtacttttttatgtaagactttcactcagtatgctattaatgagattaatccatattgttgcatttctttagtgactgagtcatattccattgtatgaatataccaatgaagatttatttttttttaattttttttattttttgaagttttaaagctgggcatccgggggagacatcacatgtcagtaggttccgtgatgccccacaagccgcaaaaccagcaagtttttattagggactttcaaaaggggagggagtgtacgaataggtgtgggtcacagagatcacgtacttcacaaggtaatagaatatcacaaggcaaatggaggcagagcaagatcacaggaccacaggacccgggcgaaattaaaattgctaatgaagtttcgggcaccattgtcattgataacatcttatcaggagacagggtttgagagcaaccggtctgaccaaaatttattaggcgagaatttcctcttcctaataagcctgggagcgctatgggagactggggtttatttcatccctacagtttcgaccatagaagacggccacacccaagggggccattttagagacccaccctcaggggtgcattcaccaatgaagatttattatcataatgatacttaggctcagtttagtttctgtatattgtgaataaaggtgcagtgaatatttttaagcaggctttgtgtgaacctatgttttaatttcttttggattaatagctgggagtggaattgttgagtcatagggaaggtgtatgcttagtttcatttaaaattgcctcagttcaggagaatggcgtgaacccaggaggcggagcttgcagtgagccgagatcgtgccaccgcactccagcctgggcgacagagcaagactctgtctcaaaaaaaaaaattgcctcagttttctcaaaatggttatatcattttatattcccatcaatcaagtatgacagttccagttgttctataattactccaatatttgatgtcagtcttttaaattttaaccattctagtggttttattgtagtatctcaatgtgcttttaatttgcatttccctgatgactagtgatgtcgagcccttttcatgtgcttattggacatttgtgtattttcttttgtgaggagtctgttaaaatcttgtgcctatatgtcaattgggttgtttgtatttttattgttgagctgtagtaattccttttatatcttggataccagttttttgtcagatgtatgtattgtgaatatcttctttcagtctctggcttgcttattcatattaataattgtatattttgatgagttatttatccactttttgtggtttttcctgtctttgccctgtccaaaaaatcctgcttaatctcaagtcatgttttgttttttatatgtttgtttataaaggttttttcctctgtgttcctgtaaaagttttgtaggtttttatgttttatgtttctaatccatgaccttttatgttttaatcgatgatctttctcaaataatttttgcacttagtaatgaagtagggattcaggctcatttttttccaatagggatatccagtattccagtaccatttttggaatatgttttttccctattggattgctttggcacctttgttgaaaatcaagtacactatctctattctgtttcattgatttatttgctgattcttaagatgataccacaccgtcttaattactgtacctttataataagtctggaagtcaagtttgtggccaacccacatcccaagattatgcagaagatctaataaagaaaagcaagcttttaactaaattataatcaatgccttcatctttataatatgaataatgattcacttggagcattttcagcttgtttatctgaaccattaaagtcattttaaagtcagtttaaagtcattaccatttcctgggaaaattgctctaataatttgtataatttgaagcataatccttaggaatatttagacctagcattaggtaatgtttcctggaactcttggtcaaacttgggctttcaggaccactgcactagttttgcactgctcagctccagggaaccatttacactggcatagttgctagaaaggtaaataaaagcaagaaagaagttagaacagagtggaaagaagttagaacagagtggaaagatgaggaaagagataaaagaaatatttgtggtataacgtggtaggtcgtcatgtgtctggtatcttttagatagactagtaaggttagtttcaatcacttattttaattgtatcaaaaaagtaaagcagataaaagtagagctttctggctaaagtatatgtgtataagatcaccgcagatcatccccttcacacctcctcttttatcacccacagtccctaaagctgaaatccagcatatagtaaggttgttacattgcatattgcagtttggacatttataaattatggaggcaaaaaagtggtgtgcttttttgccaaagtggaaactatgtgtttataattctttgagcttttttgacactaaagcagttgtctcatgggtatagcatctccaatcaatttcgaccattgggaatcctgtgtataagatagatttatgtaagaacattatatatattgaggttgctaacatgtgtctagttaaaaatgtaatgaataaactacaattttatatatacacttacatagttttttatttctccatttgttccagtttctttccatgttctgttaactaatagatgctcaaaaagttaattatcagcatgattgcctcaatcagaaactatgactttttcctaacttaggaagagagagaatagttgcttggataatagttttctactgttgtggttagtcctgaggcctccatcttggcaggaataatttatgctaataagaaataggttgatgataaatatcaagtataacctcatgtcaacaagaggcgaagcagcaaattgccaggttgttgctatttttattaagatcaaagctcattggttgacgatatgcatataagacatatcctggactctttctgcctgtaaagaattctgcacctccatcttccagacctgtttattaaatctctttctcacccatgcttccactgatttctgtaagatggagctaattaaaggacagttttttttttgtcatgacaagagcataaagtgacagtagattttgagtagtatataaatggaagctgctttggaaataattgctatatttgagtgacgagtattgagaaaacactactagctttaatatttgaggaagtcatatgttttctaaatattaatcactagcctgttgcatagaactggagcttttgaatttgggaaggtctgtggtggcagtggtacattttttcccaccattggtatctgattttatgtaatcagtgtttgataataaaaaacattattaagactgcatttttttttctgttggttacaaatgaaacagccagaactgtagcattccttgtttttgtgatcctactaaactatggttttcctgatttctgctcatgttggaaaataccatgggaactttcatgcagaacacttgccttactgaaaatggtagcagagcttcttctttgctgcctgtgaagtaaagatcatattagctctttctattgtgagttccagatgctttgatgatcagccagtaattgtgttagaaatgcacaggaaatggttgatccacttggtgtaaaggcaaaaaccaatttcttcttactgcctgtcagcaggcaacagggaggcctatggcatgttagtgcatttttacactggcatagagccctggagttagacttactgagtcttaaatgcacttcgaacacaggttttgactgcttcataggagacattccagacatatttatgctcagcacaactctgaagtttttattcttattatcatggtactgtggtctttttgtttgcttcttttatctgtgatgttagtacttttccaaggccaagttaaaacaaataactacagttaagttcaacttgtgttaatctgtttacatttatggaacagctttgctgcaatctggagaaagataatgaaacacaggatacgtctgtacatgcctggtagaatggaaagctgcagtactgtcaataggccatcaataaagatattcttaccataaaattaaggttcatcttatttcccagttttctttttacagtaaggctatatctgttgattaactcatttatctggaagtaaatcattctaaatgatactggacattttcataacatccagaaataaattctagcttaaaatctgatgattttattatgttactcatgttttttacttcaccattctcgaccactaatttttagttggaagtcttggataatttcttccagtgaaattagttagtaatggaaggaatgtggcatttgaaagcaaaagatggagttcaagtgttagcctacggtgctattctaatctaaatattcatttaagccttctaaacctcagtttctatatctgaaaacataggtaaatattcctgcatacatcagagcattattactgagaggaccagataagtatatgtcatattatttataaattgcaaagaaatatacaaatgttcatcatcatttttgttgtttgcaatgcttttaactcaagcttcttaacacatcaatcccatgtatataattccttatgtgccaggttagatataataatataacttgagaatgtatatttcattttatttttgaaaatatacgtatcttaagattttcttcccaaggtttcatattataaatgaataacaatcatgactgcagaagaaatttaattataagcactgtccatctctccccattcccaaagtaaaataactgctttcagtttgaataggtaaattaaatgtttctctgctccttctattatagcttttaagaaacagtattaaatgattccttgagttgatttcactttaagattattttaatccattactcatttgagtttgcatcattgaattttctttatcaaggacgtaagcaggttaaatgtgtattggggaaatgtcttaaatgtcagtactatggtctggctgccttgtgagtacctcatcattggaggtgttaataaggtgtgactggatggctagaaatattttaggtggatatcatacatcatgtagagctgaagactggaaaactgctaattctatgctgtgatccttacttatgtttattttccaatttagatgattaacagatacaaatagttatttccttcaaacattgcttgtttcacttcaaaactttgggaatgcatgctacggaaaaatctacttcagtagcatgtgaaaaaatacatcttatttgccttaccatcagttttctaagcattttttttctcttttgaatactcataatattttatgtttgtcttataccatttatctcattctatctaataaatactaacttgtttatttctcttattgtccttattgggttttaaagttcttctggggagatatttaacaatctccgtataccccacatgagctatacagagccaacactatataaaataaagttatcaaatttcatttattgtcattagtgcctaaaacttggggaaaagttgctattgaataaaatagcgtacacttggtttctttcttatctgccagtcacagaatctactcttagcaaatgtcattctgatttagagtaattttctaatatagaaatctcatttacccaaataccattaaaattatctaataaggtaacgatttttaaaaggtcccatttcactatttccaaatggtatccaaaagtacttgtaaataaaaaatttaccctaagtgagctgtaggcatagcttccccatccaaaacataaagttatagaggctaatctcacgaacttttctgtggatttttaaggttaaactactggtaaagaagcaattggtaatttgttcagactggatgccagaatagctccgttgtctgttagctgatgtctttgaatctttgggctcactttttatcaatgtgagtttatgagaagccttaaactctggcatacttcaaagtctggtaactttttttaggcctctcacctcctttctgcaacctttcttaactctcacattagggggaaaaaacatatgggatctcaaaaaaactaagtaagcatattttattgtttatcttaaaaaatgcatttttttaaatcaaggaaaatcattaactacatcagtatcgatgaattacatgttgtagtcatcatattttaatgagtcttctctaatatttttagttctgagtttgtagaaagtggcagatgctgttctggttaaaaggctttccaactgattaacgtgttcatccctaatttaattttttaagaaagacacttatgacagcgagaagaaaacgtttcatcttcataggaaatctggcaaaatatcttggcttttgctcaaaatttgaaagcaaatgggaatcagtttcaaatattggaaaagtcaagaaaacgattctagctctggctctgtcattggctctctatttcttcatgtataaaatgatggaaatagattaatttctaatacctctttcaactccactaacattcttttattgatagcatttgttagggagaaataacaagatttgtttatggattgtgataggatatcaataagggggtataacaaagatacctaaaattttcatccttggactagtaaagaatggtcagtccacaaaaacaaaataggggttttgtgttaagggtagccaggtcgaagataacttctgttttgaaatgttaaaggaatatcttctacaagtttatgagactcatgggagtggccattgcatggtaatatggcatagtattatattgtttacatacaatttaaaaagtacaggtagtactgaaaaacatctgttcctgtcctcatcccttttgactcctagatcagtttttccagggcaaaagttgcaaataatttttgctttatcaacattttttattaacttcatgctatgatagatgatgtactctttgtgctacttcccttatccctcttccaccatctcctcccaatgtgttactgtttttaattaaatcaataagcaatgtttacattattttgaatatgtacatattataaatatgttgcttattgtattgtcaggtaatactctatggttctatttctttttatcttttccctatagtttctaattacatttcttttattcctgtaatacatttcttatactatttgggtttttcttaatgctccatgatatccactttcctcactttttccctgagagactacactgggaaccaaattgtcagtggtctttttttattttctgattttgtttatggtacataaaaatagaattcactttaacatattggtttcatatccagcaactttgctaaaattcattaattctaatttctttgtagattcttttgaattttctctgtatgcaatcatatcacctgtgaataacatttttgtttcttttttttaaacaaactttttcttttctttcaataatggctaggccctaggttaaatccaactttatcacattttatttaatatttttgcatctgtattcattggtaagattggcctgtaatttttctttcagactcagttctgtttaggtttgatataatggttatgctaggtttatctctcctcttctgttttctggaagagtttggttaggtttaatgctttttgttctagcttaattacattatggttagagatcatgttctgtacaaattccatccttcgagatttgtttagacaagccttaaggtccagtatatggttagtttttataaatatcccggatgtgcctgatataaatgtgtgtctttcatttcatgaggcattgtattatatatgtccattagaacacgtttcttagtcatgttcaaatctttctacatttttacagtttattttctttacatgttcaatcagccattagaggtctgtttaaaatctccgactctgattgtggatttgtttatttcaatttgtttatttcaatttattttaatatcttccttgggaaccaaaccttttatcattctgaagtggccttgtttcagcttttgcaacacttgtgcctcaaaatctactttgactgaaattaatacagctatactagcttcttttggttattatttgtgtatgacttttaaaatttttaattccaacctttctgtgtaactgtatgtttttgatatctctgatgaatggctcaaatgttgaaatttgcccctgtttttgcagtctgaaggtatttgtctctagaatgtttctcaatgtacttacctaactttttagtaaccagattttcaaaaaatttaaagacgatataatgaacaccattgtatattcatctagattcaacacttgttagtattttgccatatttgtttgtctcttgctttccagggtatctatgtgtgtgcatgtgtttaatgattatgtaagtatatgtgtgtttatacacattttgctaagccatttaaaagtaagttgcagaaatcagacactttatatgcataaatacctgagcatgcatcatgcctcacctaaggaaacataaacatgacataattatcaaacataagaaaatcaacagcaatcttaaagtgttatttaatattcaagtcataaacaaatttccctaatggtcctaaaaagtctttcatagctgttcatgtactgcatttatttattctcttacaaatttgaatatctagaatgcgttggaggaaaattttccgtggatctttcatgtctctgtacatcctgagaagagaggcattgtcattgttctgaactctcttttcaaggatctgttataatgaataactcggaaaattgagatagtatctcactttggaggaaaggccaggtttgtctaccttctagtacaataaagatattaaaaatatctctgggcaaagataaagcaagcttactgcccactataaaatatatggattccctaaacacccagtttttcttctataacctattgcactgcatgtgaaggcatcaccttgtctgctttacatcaccttgtgggaattggggctcgcggaaacccagggtattactgtaaataataaattagttgttgtctctgattaagaagtcttgtagcgtttgctggtgtctataaaactatggcaaggctaacttgttaactttcaagcatagaaaagtcttagtcccttcacggttcttgacagaatggtcttcccactttttacttcattgcactgattttttttaacagcttcattgagatataatttacataccatacattttacccatttaaagttctcagtaattttagaatatttacagtagggcaagcatcaccaaaatcaattttagattttttatcaacccaaaaagaaacctcatgtctcttagctgtcacgttccatggcagcccagccccccagccctaggaaaccatcaatctacttgtcactataggtttgtctattctgaacatttcatagaagtaaaatcatgcaacgtgtggtattttttgtctggcttctttcacttagcataatgttttcaaggttcatccatgctgtagcataaatcggtacttcattcctctttattgccaaataatattatattgtatgcatatactacattttgtttttcagttcattttttcatggacatttaggttgttttatacttttttgactcttataaataatgatgctatgaacattcatgtacagatttttgcatagacatgtttctgttttatacctaagagtggaattgctggatcacgtttactttgtttaggaactgcccgacttttataaagtggttactccattttgcattcccactagcaatgtaggagagtttcagtttctccacatcctcaataatacctgttattgtctgtcttgattatagctatctagtgtgcgtgaagtggtatttcattgtggttttgattttcttttcatttccctgattattaacgatgttgagcatatatttatgtacaataagcccataaaaagatatatatatattttgaaaaatgtctattcaaatcttttgcccattataaattgtattatttgctttctagtacattataagaattctttatatattcttgatatgattctcctgtaaggtatatgattggcaaatacattttcccattctgtaggttgtcttttcactttcttggtagtgtcctttgaagctcaaacttttacaattttgataaaattgtttttaactttttttgttacttgtactgttgctataatatctaagaaggctttgactaaacaaaggtaaaaaaaaaattactttttttttttttttgagacagagtcttgctctgtcacccatgctggagttcactggctcaatcttggctcactgcaacctccgcctcccgggttcaagtgattctcctgcctcagcctcctgagtagctggaattacaggtgcgcgtgccaccatgccctaatttttgtatttttagtagagatggggtttcaccatgttggccaggctggtcttgaactcctgacctcaggtgacctgccttcctcagcctcccaaagtgctgggattacaggcatgagccaccctccccggcccaagaatatttagctctgtgttttcttctaagagttttatagttttagttcttgtgtttaatctttgatctgttttaagttaatttctatgtatagtgtgtagaagaggtccaagtttattcatttgcatataggtatccagttgttccagcagtgtttgttgtaatactattccttccctcagtgaatgtccttggcacctttgtcaaaaatctattcaccatagatgtatgggtttatttttgtaatctcaattctgtcccattgatctacacgtctgtccttttgccagtaccacactggtttgattattgtaggtttgtagcaaattttgaaattggaaagtgtaaatccttcagctttgttctttaaatattattttggcctttggggttccttgcaattccctatgaatttcatgtcagttttatgatcagcttttccatttctgcaaagagggcggttggaatttttataaggattgccttgaaggtgcagaaaaatgtagggagcattatcatcttagcaatattaagtcttctgatccatgaacatgggataattttttatttagttaggttttctctaaattctgtcaacaatgatttgtagtttttcagagtaaaaatttttcatttcttaagtttattcctaagaattttatcattttcatgcagttgtaaatggattttttcacttaactttatgctagtctataggaatacaattgatttttatatagtgatcttgtaccatgtgaccttgctaaattcatttatttgctctaataggattttctgtttacaagactgtgtcttatgcaaagagatagggctttacttccttctttttgatatggatggtttgtgatgtgattatttcacattgcatgcctgtatcaaaacatctcatataccccataaatacataaacctactatgtacccacaaaaaattaaaaatgaaaaaatttgcatagggattgttaatttccttgtgtaattgccctacatagaacctgtaggattatgtggaaaagaaatgacagagtggacattcttgtcttgttcctggtcttatagggaaatgatttagtcttttaccattaagtatagcgttagctgtgggttttttgtagatgcccttatcaagttgaggaatttccctgttattctgatcttaatagtaatgtcctctcttttatttctgattttaatttgagtcttctcttttcttggtggtttgacaatttttttgagcttttctgagaaccagcttttgatcttgttgattttccctattcattttttattgttcatttcattaatttcagctcaaatctttattatttccttctttctacttgttttggggttacttcgctctctttttctgatgttttacattgaaatgttagtttatgatttggcatcttttttaatataggcagttactgctgcaaatttatctctaatcactgctttaaatgagtcccatatgttttggtattgtgtggttttattttcactcacctcaaaatatttctaataaaccttgtcatttgttctttgacctataggttaattaaaagtgaaatatttcttttctttatacttgttgatatcctgtttatttctgttattgatttctaattttattccattgtggttggaaaacatgctttgtgtaattgcaatacttttaagtttattgatgtttgttttatggcctagcatatgatctatcctggagaatgttctatgcattcttgagaaaaaggtatattctactgtaattgggcagagtgttgaatagatgtgtcttaaatgcagttggtttatagtgttgttcaagtcctctatttccttgttgatcttctgtctctcactgttccactgattattaaaagtggagtattgaagtccccaactatttttgaattgtctatttcttactttgattcagccagtttttgtttcatgtatcttggtgttctgttgttagatgtatctgtgtttataattgacatggcatcctgtagaattgacccttttatcattataaaattcctctctctatctctagactttttttgttttagaatatattttatctgttattagcacatctactctagcttccttaaggttgctgttagcatgactgtatttttcaatccttgtagtttcaacctttttgtatgttttaatctaatgtgttctgtagctgccattggatcttgatttttttatgaagtctgccaatctctgatttttgtttggcttgtttaatccatgcacattcaatgttattattgatatagttggatttttgtccgtaatttcactttttgttttctatgtatctcatggttttttgttgttgttcttatgttcctcctttactgccttctttttttttattaagtgaatattttctagtttaatattgcagtttctttaatgattttatttaatgtatttttatttgtttttcttaatggttgcttaccacgtaaattataacctattagagtttacttaagatttatagagttctctattcttactgtcttctcttactctaggcaaaattgctgatactgttccagagctgggagcgggaacactgttccccttcttttggagtaacacacctgctttattagcagggcactaagcaggaagaatagcctttgatcttcctggcttgcctctttcagcatcatcttctgttctatgagcaagttagagtgagggcaaccagatcaaatactcctgggctgctgtgcctggctggagtagagcttttgccttatgagttagggctgtgtggaggacaagagtctaagaactctcagctactctcacttggaacagagcttctataacaggacacacacggtaggggaagatcagaaatgctgatgacttgttccttcctgtgagatactgtagtgcttaactgggagctgggaggagaaggagccctggtttatggatgcacctaccttgggtgaagcctttgtgaagctgagcaagggaggtggagaaggaaggagcaggtcataatgccatagatacctgttgtacatatcaagatttaacacatattgttgaacgtttgttcattggctgtatgttcgtaggacaatatccagatacttgagtttttaaaacataaatttccccacttatcattgttttgctagggagatggtccacagaggtcctcacactgccattcacaaagtcatctctcccatggcatggcattgactttttccctttccttttcctctttctttcttcctttctttctttctctttctttcttctttccttctttctttctttctctcgctctcccttccttccttccctccctccttcctttcctccctccctccctccctccctcctttctttctttctttctttctttctttctttctttctttctttctttctttctttctttctttcttctttctttctctttctttctttctttctttctttctttctttctttctttctttctttctttcttcctcctcctcctccttcttcttcttttcttttcttttcctttcctttcttctttttttttgacagggtcttgctctgttgcacatactggagtgcagtggaacaatcatggctcactgcagccttaatctcataggctcaagtgatcctccctcctcagtctcctgagtagctaagactacaggtgcatgtcaccatggctggttgatgtttaattttttttgtagagatagggatctcatcttgtgtcccaggctggatgtgaactcccaggctcaagtggtcctcccaccttggcctcccaaagtgctgggattacaggaatgagtcaccacacccagctggcattgactttttgaagagtccgtgctagttgttttttataatgtaccttattccaaatttgtcccatgttgtgtcgatttacacttaattacacttaatgtaattactgatatatttgttttatttgtcttgcattttaaggtatcactttctctgtctgcctctctttcgtcttcttttggatgtattaagtattgtgcccctcaattactttgggattaatactctatttatcttttttaaaggtttaccctagaagtgacaatttctaggttgtatatgtatcaaagtccaaagtaatcaatatccttaccagttttctatacaattacaaagaccttaagaatgctttaacttctttcaccctatctcacttacatcatattaccaatgtgtatttctttcaattctatattttaaatgccacagtatgaaagagatgcatgttgcctacccaccagcccaagctgaggctaccaaggcagccccactctttccagtggcagagtctcagcatggctgctaccacccctcacctgaacactccacctggatactgaatattaccctacccccacctaacagagctggtgcttgcactcaccattggggtcctgagcacaagccgcagagccgagcttctgctctgagagagaacacatagcctgaggtcctggggattatctaacccaatccaccaccgtgggccccagtcctcctgggggcctgaggttgggcctaaactcccaaccactaccacttcagctggtacctgcctgcaagcaccacatatgggcctggacatgggcctacccagcccattgcagctactatcaacgtcagtgcacactgctcaagacccagacaattgtccgtccactgctactgccatcacccacaccatgccagctgcccagggactgaagaacctgctcacccacctggtccactgctggcattatcagcatccaagcaagacacctggaggcctaagaataggcccactgacaacagccaacaccagtgccagtgtaaaatgctctagggcacaaagatatgcatgctcagcccactggtgccaccaccgcagccttaagactagcacacctgttgttccagtccccagcacaacttcaccacagccttcactaataaccataccctaacacaccaaggaaaccataaacaccactaatgctgtttacagccaaagaaatcacacagagactatagcactatgaacagaatcaaagtcaaagtaccatacacagccaatatcttagatacatcttcagaaaaatatccttccctatgaaagtaaattcaaaaataggaagaaatgattgttacaccagatgcacagttaccaacacaaggacacaagaaatatgaaaaagcaaggaaatatgacacttgcaaaggaacacaataattctacaacaatagatcttaatcaaaaagacacttttgaaattccagagaaagaattcaaaatattgattttaaagaagctgggtgagatataagataattccgaaaaacaatacaaagaaatcaaaacacagttaaggataagaatgaacaatattactaaagagataagtatttttaaaaagaaccaaatagattaggtggaataaagaacctcaaaacttgaagtcagttctttttaaataaaccagtcaggtaggaataaagaaataagaattttaaaaagaatgagcgaagctttgtgtcatttgggacaacataaattgatcaaatcttaaaaattattgttagccccaaggatgaagagacaaagaaaggattagaaaacctatttaaagaataggtgaaaacttcccaagtctagtgagagatttacataatcagatacaggaggctcagtgatccctaggtagatataatgcaaagaaatcttctccatgacacattatagtcagaaagtctaaagtcaaatataaagagcaaatcctgaaaacagtaagagaaaagtgtctagtcacttctaaatgaaaccctatcaaattaacagtggattgctcagcagaaccttacaggccagaagagaaagggaataaatatattcgaagtgctgaaagaaaaaaattgccagccaagaatactacatccctcaaaattatccttcatcaatgaagaagaaataaaaaatctttcacagataagcaaatgctgagggaattctttatgactagactgaccctacaagaaatgctcaagtgagtcctaaacctggaagcaaaaggacaatatttaagatcatgaaagaacatgaaagtataaaactcacagataaaccagtcaatcaaagaaggaaaagaaaggactgaagcggtaacactatagcaatctaccaaacctcaaaaacaattaaaaagagaaaaagaaataaacaaagaatatataaaacaaccagaaaaccattaacaaaattacagaaacagagcttcacatattaataataaccttgaatgtaaatggattatattttccacttaaaatatattaaatggctgaatgaatttttaaaaaaacatgatgcaactatatgccatgtataagaaactcaccctaacagtaaagacacatatagactgaaagtaaagggatggcaaaagatattccatacaaatgggaaatagtagtaagcaggaatagctatacctatatcagataaaagagagtttaagtcaagaacagttaaaaaaaaaaggcagagaaggtcattatgtaatgataaatggaacaatccagcaagaagatacgacaactccaaatatatatgcaccccatactgtagcttccagattcataaagcaaatattccaaagagagaaatagatgacaatacaatcaaagtgggggtttcaacactccactctcagcatttagacacatcatctagacagaaaatcaacaaagaaacattgggtataaatagggcttcagacccaataaacctaacagacatttacaaaacatcctacccaacaactgcaggttatacatcctgcagttatacatggaccattctccaggatagatcatgtgttaggtcacaatataagtctcaacaaattttaaaaattgaaataatatcagttttcttttcagaccactttggaataaaactagaaatcaatacaaagaggaagattggaaactctgaaaatacatggaaattaaataacatgctcctgagtggccactgggtcaatgaagaaattatgatggaaatttaaaaatttatttgacaaatgggatctaattaaactaaagagcttctgcacagcaaaagaaactaccatcagagtgaacaggcaacctacaaaatgggagaaaattttcgcaacctactcatctgacaaagggctaatatacagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccattcgacccagccatcatcccattactaggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagctcatgtcctttgtggggacatggatgaaattggaaatcatcattctcagtaaactatctcaaggacaaaaaaccaagcaccacatgttctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtacacatatgtaactaacctgcacattgtgcacatgtaccctaaaacttaaagtataataataatgaaataaataaataaaaaataaaataaataaataaataaaaatttattgaaatgaaaatgtaaacacaacatacatattcagcaaaaatagtgctatgagagaagtttatagcaataaatgcctacattaaaaacgtagaaaaataaaaatttaacaatctagcaatgcacctcaaggaactagaaaagcaagaacaaaccaaatcgaaagttagcagaagaaaaaaaatagcaaagatcagagcagaactaaacagagactacaaaagcaaacataagggcccaacaaaatgtaaaactgcttctttgaaaagatacacaaaatttgtaaactgctagctagtctaaccaagaaaagacccaaataaaatcagaaatgaaaaaaagacactacaattgatatcacaaaaatacacaagatcatcagagattattatggacaactatacactgacacactggaaatcctagaagaaatggataaattcctggaaacatactacttaccaagattgaatcaggaagaaatagaaaacctgaacagaccaataatgagtagtgagattgaatcagtaataaaaattctccctacgaagaaaagcccaggaccagatggatacacagccaaattctaacaatcgtacaagacagaaataataccaatcctcctgaaactattccagaaaatccaagggtaggaaattctccctaattcattcctcgaggacagcatcaccctgatatgaaaatcagacaaggattcaaccaaaaaagaaaactgctggcaaatatccctggtgaagattgattgaaaaacaatttaaaaaatactagcaaatccaattcaacagtacgtcaaaaatataatacacatgggtccattgggattgaaggcaaggaaggcacaacctttgcaaatcaataaatgtgatacattacatcaacagattgaaggacaaaacaatatgaccatctcaatagatgcagaaaaggcatttgataaaatttaacatcccttcgtgattgaaactctcaacaaactaggcatagaaggaatataccgtagcataataaaggccatatacttcaaatccactgcaaacatcatattaaatgaagaaaagctgaaatcctttcctctaaaaactggaacaagacaaggatgttgactttcaccactcctattcaacatagtactggaggtcctattaagagcaatcaagcaagtgaaaaataaaaaaggcatccaaatgggaaaagaagcagtcaaattgcccctctttaccgatatatctatctagagaagcttaaagaatgaattcagtgaagttgcaggatacaaaatcaatgtacaagaatcagtagcctttctacacaccgataatgatctaaccaggaaagaaagaaagaaagcaattccatttacatttggtaaaataagtaaaatacataggaataaatttaaccaaggaggattgattctacaaggaaacctacaaaacactgttgaaagaaatgcaggtgatagaaacaaatggaaaaatattttatactcatggatcagaagaattaatattgttaaagtcatcgtattgcccaaaggaatctatacattcaacataatcgctatcaaaatgccaatgcaattttttcacagaattagaaaacaaatcctaaaatgtatatgaaaccaaaaaagagcctgaatagccaatgcaaccctgacctaaaaacaaagctggaggcatcacattacctgacttcaaaatatattacaaggctgtagtaacccaaactgcattatattgttatgaaaatatagaccaatggaacagaatagagaacccagaaataaagccacatcttcatagccaattgatcttcaacaaagctgacaagagcttacactggggaaaggtaatcctcttcattaaatggtgctggaaaaattggatagccacatgtagaagaatgaaactggacccgtatttctcaccatatacaaaaattaactcaggatggattaaagacttaaatcttcttttgcacaggaaaagaaactatcaacagagtaaacagacaacctacagaatgggagaaaatattcgtgaactgtgcatccaacaaaggtctaatatccagaatctacaaggaacttaagcaattcaacaagctaaaattttatgtaaatataagacctgaaaatataaaactactagaagaaattccaggggaaaactctcctggacattggtctaggcaaagaatttgactaagacctcaaaagcacaggcaacaaaaacaaaaatagccaaatggggctatattaaataaaaagcttctgaacagcaaacgaagcaatcaacagagggaataaacaacttgttgaatgggagacaatttttgcaaagtatttatctgacaggggactaatattgagaatacaaaaggaactcaaacaacaggaaaaaacaaacaaaacaaaataaaactccaattaatcccgtttaaagtaagcaaaagacctgaatagacatttctcataaaaaagacatacaaatggtatatgtaaaatgctcaacatcgctaatcatcagagaaatgcagatgaaaaccacaatgagatatcatcttatcccagtcaaaatggctattaataaaaagacaaaaaacaacagatgttggcaaggataaaaaaaataagggaactcttatatgctgttgtgaacataatctagtacagccaccagaaaactgtatggatatttaaaagaaagagagaaagagaaagagagagagagaaagagaaagaaagaaagaaagaaactaaacatagcatcaccatacaacccagcaattccactactaggtatctatccaaaggtaaagaaatcaatatatcaaagaaatacctacacttgcctgtttattgcagcagtattcataatcacaaagatatgcaattaacctaagtgtgtatcaacaggtgaatggataaagaaaatgtggtacatatacagaatggaatactacttagccataaaaactagtgaaatcatgtcatttgcagcaacatggatggaactcgatgtcattctcttaagtgaaataagccagccacagattgacaaatattgcatgttctcacttgtatgtgggagctaaaaaattgaccatatggaggtagacagtggaaagacagagaacagagactgggaagggtaagtgtcaaggagggggaggatgaagagaactgggttcttagcatattaaagatgtcattccgtggtcttctggctttgattattgcttctgagaactaatctgtaaattaattttcactctcttgaaggcggtctgtcttgtcttttttgatgcttttaaggcctttcctttacttttatgttatgcagttatgttctgctgcacctagtttcaggttttatttttatgccattgaatctgtttggtttcttgaatcacaaatatctgtagatttttcttgagaaatcttagccgttgtctctttagtattgtctttattccctctctcacctcttctagaatcccaatttcctttatgttattcttcctcactctttcttccatgtctcttaatgattatttcacagtttccatgttttatctctatgccacattatatataatttctttttagctttactaagtcttttaactttatactgtctctcttcagctctatctagtctgttgtgaagcccatccattgagttttaaatttcaattactatagcttttacttctagaatttatattttatttcgattgagctatgtcattttcatacaattgctggctccctttattatttttaagttagaaaaattcttctataattgtaaagatagttactatatattttttatctgataattccaatgtgtgaaatatttagtgagtactttctgttgtcatatgtttcttttggcttttgcttatggttttttttcttgtatgcttaatggtttttaattaggaaatctcatcttcctttaaaaaaatgatacattagaattatttgaagtttactatgaaggcatgttttttctacgtagagtcagtatgtatttttgcccagcctctagaaggtcaatgcagtcagagtccactcaggtaatgctaatttggattgcaaatctggccagtttgtggtgagttttttaagggttttttttcctgtacttctctgctaagcaccaagagatcttttcttccacctccctgggtgtgggattgtgaggtacatttatgcgtggtacacccttatagtaaaagaaattataaaacaaaacccaaaaattatccaagtttggcatatgtcctccgggaaaaagtagtttcattgatcagttcattttttggttttccctagattttgatttgataaatcctactgtgcttccctttgatgcttttaggaagaagtttttacttttttccaagcattttttttttaagtaagcatttcagtctggatacctaactggccacattattggaatatttcttatttctctctgccattattttgtagtatgtgtctccttggaacacctgaatcaaaattacttagagatgtttattaaaatttcagattctgctattcaacttcagcttactggaagaatctttacgatgggttgctggtatgtaaatttttgtgaggttctttaggtgaccctaattcatacagaatttgtttttatttgtacttttaagtctaatatctgctgttttaattgtagcagcatgagatctaaatttattattttttatatttattctagcaccatatgttgaaaaattcattgttttcacatctatttgacgtcaacttttatcatatagtagttgtgtgtgtgtgtgtgtgtgtgcacgtgcttgcatgtgtaaatctgtttctggccttcctatttttgttaactgaataccatactattttaattattgtagtgttgtgatgtgttttactgtgtgataatacaaaactttccttactcatttattactttctcccacaataaaaatttaaaatattactgtagtttcatcattttcttgcttctttcatcttcagtgatttcgaaaaattagtttttttcatatgaacttagccttttagactgaggtacttaatgttcattttacttctttgccccaatcaattttgtattttaatcatgcttagcatggcaatttttcctctaggtagctttctgtctatccttccaagttgaagtccaggtattcactttctccacagagcctttgtcaatactttcaggctcaagggaactgtttttcttaactttgatagcaattattgactataccactcatttttacctggcaaatcctacagaatcacagagagtgaaatctggaagctacctaaggagatcatattgtctatgtatgccattttacaaatgagaaaacagccaaagagtatggaaatgatttgtccatggtcaaatgtttcaacttctgaagtaaaattatgatataccgctgtatcattattccattgtattttgatattcttttcatatgtcctgaaaatacccagttacttaaaaaataaaatacctagttacttaaaaaaacaaaaaacctagactggaagttccttaaaggtagcacctgcatgtacttttgtacaactcatagaactattattgtgcttgtgtttattagacacctaatcaatattaatagatgttggtaaaaaaacaaattgttccattaaccagatgtcaaactggggctatctccttgtgggcgccactgttataactgtatagaaagtggcatctagtggttggtgtgcgtattacaattgcctgttttgttttaacctatgagtaccagagtcattctcataacctaggtggaataaatagactataaattaaaattttaaattgaatttaaacacatttatctataattcacaactgttttaatctgtgctctctctaaagtaaagctacatgttaataaaaaattgcaaaaaattatacaaaattacttgtaaaatgacatgcgagagtatttaaggttttgcttgtttataaattatattaggagttaggggctatcgttggatactgagaagtcaaaatgcaattataaagaaaggtcacatagaaacttgttcatatcaatgaaatcctgtcaggttattgctttgcattatttttaggagcttaatttgtatttaaaagaagaagatctctcaataaaggctgaagatggaaagctacactgtcttctactcgcaacaacaaaaacccatgcacatatattcacatataaagttcagacatgcatttcagtgtcaaatgttaattattcttacattaacagccatttggggttatcactactctttacctctccattaatgcatgagtgttgacaatatgcacaatttaattcagggactacgactgttgacagttactgtcttgtgaacttgtgaatcagtatcttcttgtgaaacggtatcttctaaattttataaaatccatagtctggaacttaaaatttatgtttgcagaaaaatattatatatttttaattaacctctgtttcctgcacattgtaatataattttttgtagatgggttcatccttcccattagagagcaatgatgtactttgtacttctacttgcacctaacataacatagtggctgtcacataacaggtgatcaataagtatttcttgaattagttacacatgttggagggagctgtgtgttactcatcttagaagtctagtgcctaacaatttttctgtcctctagtaatattcaattcatatttgatgaatgagtaagtctgaataagcctatttaatctgtagtgtagttagcgtaaaatactaaaatcagtatataacccccaaacatctatgaataataaataatagcggcatagcagactttctgtttgacgtgtcaggagcacagctttcactggagcagcctcttgtagtgtgagtgagagattactgcaacatcaagccattgtagtttgctcttataatcaggaaaagaggtttcagtatgaaggtgacttttagttgcagctgagtgagttaggagttctgaccagaaggataaggtcagtactttcaaaagggttgaggagggtactttggtagtgactagagtaaaggaaatcatggaatgttgagcagcaggctaaggtattttatatcaaaggccctcaagattgatgggcattatttggtatttatgtcacatgaaggtttcagtaactcagtctggtatctatctgatgaaaagaatgccacctccttgtaagtaaacactgagctatccatgtatattaaactaacttgtttttctaagcagttcattttctaagagtaaaggatagtactgaatggcagaagtcacatactgtattcttttcctctataggttttctattttggaggaggatatttttctggcttgaggacctcaattcctaatatgattgaatgcctgtttagaacatctagactgtgggagcagcatttatggtaaagctgttagagactgagctattattagtgatgaaggagtaggagcaaagaaaagaaagaaaggtggtaaaagatagtgttatatattttatgctccatgattgctcatgaatggagagaaacaagtgacttgaagtggtaggcattgttgtctagttgccaaggtcattgctaatacagagtgagaggtaattttttacaagcaatgttagaagaaaaaaaggagagttcctgagagtttggacatgtggcaaatcatattacagggaagttgtatgaatttcttttccatttttaacatattttagattgtgcatactgtcaacactcatgcattaatgaagaggtaaagggtagtgataaccccaaatggctgttaatgtaagaataattaactttgaaatgtatgtctgtactttatatgtgaatatatgtgcatgggtttttgttgttgtaagtagaagatggtgtagctttccatctttagcctttattgagagatatctcatttttaatgtcttgtaaaatgatatttttcactttaaaattataaaaattatgtttgctcattttgaaaagttaagacagaagtgtatataataaaaggtgcaagcttcctgagaggtaactgttatttgcaatttcgtatatcttttcagatatttttctggtatctatctttcaagtttggattgttgatttcagttgagctgtaagtcagagtctgatttttgggttcatatttaatgattttttccctctttctcttccttataggcttgctatgggtgttctccaggatcaaagtgtgactgcagtggcataaaaggggaaaaggtgaggtcttagattggcatttgaaaatttagtaaagccagtaaactaatggttttaataaatatttttttaaaaacagagcttctatctcagtacttaagtaagtgaaatgaatcctattgcattgcttattttagagagcttataaggattagattatatcttaaggtcagcaaagattttctgtaaaaggccatatagcaaacattttaggatttatgggacacatcagtttctgtcacatattcttatttatataaatagaactttaaaagtgactaaaaaatattcttagctcttggatcatagaacatgagcctcttgggatctggatcaggacctctttcccgtaacatatttctggcgaccacagaagggactatagtgcagaaaccctagcttaatggctacctttgggtaagtgttggggtcctttaatatctgcatttggcctgagagctataatctgccaaactctgattggtcttgttgaaggcactgacttacttaataggcaaagacaggggaaaaacacttaagaaggaaactaaacatttatcaagctactaatctctgccagataccaggcaatatcatgtatttttatctagtctatgcagtttaataatagatgaaagtctttttttttgttttttcgtttttgagacacggtcttgctctgtcacccaggctggagtgcagtgtcacaatcaaggctcactgcaacctccgcctcctgggttcaagcagttctcgtgcctcagcctgccaagtagctgggattgtaggcatgcaccaccatgcctggcttatttttgtatttttagtagagatggggtttcgccttgttggctaggctggtctcgaactcctggcctcaagtgatctgcccaccttggcaggggattccaggagtgagccaccatgcccagctgaatgtttatttctatcttactttttccacagcagcatctcctattgtacagatattatgattacaaagtaagtattggtgaagattatatagcataagcctaatcactatcagtgaatgacattaatattatcaaatataaaagggatagtaaattatagcctaaagagagttatactaggagatgggatcatactcttgtctccactctttggggctcagtatttttgaatgaatgagtgaatgctgctaattatatatgaagcagtttaggacagtatgtctagggcataatctacttagaggtatagaaggtacgttagcatattagacattcttaaaagttctggagcaaagaaacctatttgtttgttttgtaatgctacatttccaagccccatttgaccatgttatagactttccccttaacagagcagctattaatattaattggatagtcttctgcagaacacttatttgagtaacattagtttgatgggagtagtttcgcagtaagggtgctttctgtagtggagaaaataccaagagggattaacttcatataatagtagagtgatgtttatcagattaacttttgagataagaatggaatactctggacaaaatataacagctacttgatagtacaagagaataaccaaaggaaaaagaggagaggcatctgcacttgaaagaaaggaaatacactgggcatatttgcatttatatggcttttcccctgagtacagcccttagtctgcatggcaaaggaaggctaaaacccagacaaaaacccatggtcttactggcttgagtcagcagagttgaggatgccagaatggctgaaaagtgaagagggatatactggaatgtagggaaacacattggaaagagctcaaaaaattgcttatagattccatccaaattcttgcttgaatcctgaagtttataactatagaggaaggttcatacaacccagcaaaaaggaacagctggaagtctgcaataactgagcatagatttaaccgttgtccgttgaaaggagaatggagttttaagttcaagttcagctgagttaactatactatttcttaaaatagaagtttaatcaatactcttcagaggaagttaagagaatccagaatctctccatattacctacaatatccagtatgcaattaaaaattaccaagtaaaagtgatctacagtcaataaaaagaccaatcaatgaaaaccaaccctgaactaacacagatgttggaatttgtagactatgatttaaagcagaaaatagaaaaggaaaatctcctcatgatgcgtgaccaaataaggaatcacaacagagtaatggaaactgtattttatttaatttttttttattgttatactttaagttctagggtacatgtgcacaacgtgcaggtttgttacatatgtatacatgtgccatgttggtgtgctgcacccattagctcgtcatttacattaggtatatctcctaatgctatccttccccccacccccaccccacaacaggccctggtgtgtgatgtcccccttcctgtgtccaagtgttctcattgttcaattcccacctatgaatgagaacatgcagtgtttggtttcttgtccttgtgatagtttgctgagaatgatggtttccagcttcatccatgtccctacaaaggacatgaactcatccttttttatggctgcatagtattccatggtgcgtatgtgccacattttcttaatccagcctatcattgttggacatttgggttggttccaagtctttgctattgtgaatagtgccgcaataaatatacatgtgcatgtgtctttatagcagcatgatttataatcctttgggtatatacccagtaatgggatggctgggtcaaatggtatttctagttctatatccttgaggaatcgccacacagtcttccgcaatggttgaactagtttacagtcccaacaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatatgtttgagttcattgtagattctggatattagccctttgtcagataataggttgcaaaaattttctcccattttgtaggttgcctgttcactctgatagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttagatctagcatttaagtctttcatctgccttgaataaatttttgtataaggtgtaaggaagggatccagtttcagctttctacatatggctaggcagttttcctagcaccatttattaaatagggaatcctttccccattgcttgtttttctcaggtttgtgaaagatcagaaagttgtagatgtgtggtattatttctgagggctctgctgtgttccatttgtctatatctctgttttggtaccagtaccatgctgttttggtgactgtagccttgtagtatagtttgaagtcaggtagtatgatgcctccagctttgttcttttggcttaggactgacttggcgatgcaggctcttttttggttccatatgaactttaaagtagttttttccaattctgtgaagaaagtcattggtagcttgatggggatggcattgaatctataaattaccttgggcagtatggccattttcacgatattgattcttcctatccatgagcatggaatgttcttgcatttgtttgtatcctcttttatttcgttgagcagtggtttgtaattctcctcgaagaggtccttcacatcccttgtaagttggattcctaggtgtttcattctctttgaagcaattgtgaatgggagttcactcatgatttggctctctgtttgtctgttactggtgtataagaaggcttgtgatttttgcacattgattttgcatcctgagactttgctgaagttgcttatcagcttaaggagattttaggctgagacgatggggttttctagatatacaatcatgtcatctgcaaacagggacaatttgacttccttttttcctaattgaatactctttatttctttctcctgcctgattgccctggccagaacttccaacactatgttgaataggagtggtgagagagggcatctctgtcttgtgccagttttcaaagggagtgcttccagtttttgcccattcagtatgatgttggctgtgggtttgtcatagatagctcttattattttgagatatgtcccatcaatacctaatttattaagagcttttagcctgaagggctgttgaattttgtcaaaggccttttctgcatctattgagataatcatgtggtttttgtctttggttctgtttatatgctggattacatttattgattggcgtatgttgaaccagccttgcatcccagggatgaagcccacttgatcgtggtggataaggtttttgatgtgctcttggattcagtttgccagtattttattgagaatttttgcatcgatgttcatcagggatattggtctaaaattctcttttttgttgtgtctctgccaggctttggtatcaggatgctgctggcctcataaaatgagttagggaggattcccttttttttttattgattggaatagtttcagaaggaatggtagcagctcctccttgtacctctggtagaattcggctgtgaatccatctggtcctggactttttttggtttgtaagctattaattattgcctcaatttcagagcctgttattggtctattcagagattcaacttcttcctggtttagtcttgggagagtgtatgtgttgaggagtttatccatttcttctagattttctagtttatttgcgtagaggtgtttacaatattttctgatggtagtttgtatttctgtgggatcggtggtgatatctcctttatcattttttattgcatctatttgattcttctctcttttcttctttattagtcttgctagcagtctatcagttttattgatcttttcaaaaaaccagctcctggattcattgattatttgaaggatttttgtgtctctatctctttcagttctgccctgatcttagttatttcttgccttctgctagcttttgaatgtgtttgctcttgcttctctagttcttttaattgtgatgttagggtgtcaattttagatctttcctgctttctcttgtgggcatttagtgctgtaagtttccctctatacactgctttaaatatgtcccagagattctggtatgttgtgtctttgttctcgttggtttcaaagaacatctttatttctgccttcatttccttatgtacccagtaggcattcaggagccggtcgttcagtttcatgtagttgagcagttttcagtgagtttcttaatcctgagttctagtttgattgcactgtggtctgagagacagtttgttataatttctgttcttttacatttgctgaggagtgctttacttccaatgatgtggtcaattttggagtaagtgcggtgtggtgctgagaagaatgtatattcttttgatttggggtggagagttctgtagatgtctattaggtctgcttggtgcagagctgagttcaattcctggatatccttgttaactttctgtcttgttgatttgtttaatgttgacagtggggtgttaaagtctcccattattattgtgtgggagtctaagtctctttctaggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtgtgttttatcagagactaggattgcaacccctgcctttttttgttttccatttgcttggaagatcttcctccatcccattattttgagcctatgtgtgtctctgcacatgagatgggtctcctgaatacagcaccctggtgggtcttcactctttatccaatttgccagtctgggtcttttaattggaacattcagcccatttacattcaatgttaatattgttatgtgtgaatttgatcctgtcattatgatgttagctggttattttgctcgttagttgatgcagtttcttcctagcatcaatggtctttacaatttggcatgattttgcagtggctggtactggttgttcctttccatgtttagtgcttccttcaggagctcttgtaaggcaggcctggtggtgacaaaatctctcagcatttgcttgtctgtaaaggattttatttcttcttcacttatgaagtttagtttggctggatatgaaattctgggttgaaaattcttttctttaagaatgttgaatattggcccccactctcttctggcttgtagagtttctgccaagagatccactgttagtctgatgggcttccctttgtgggtaacccgacctttctctctggctgcccttagctttttttccttcatttcaactttggtgaatctgacaattatgtgtcttggagttgctcttctcgaggagtatctttgtggcgttctctgtatttcctgaatttgaatgttggcctgccttgctaggttggggaagttctcctggataatatcctgcagagtgttttccaacttggttccattctccccatcactttcaggtacaccaatcagatgtagatttggtcttttcacatagtcccatatttcttggaggctttgttcgtttctttttattcttttttctctaaacttctcttctcacttcatttcattcatttgatcttcaatcactgataccctttcttccagttgatcgaattggctactgaaacttgtgcattcatcacgtagttctcgtgccatggttttcagccccatcaggtcctttaaggacttctctgcattggttattctagttagccattcgtctaatcttttttcaaggtttttaacttgtttgcattgggttcgaacttcctcctttagctcaaagaagtttgatcatctgtagccttcttctctcaactcttcaaagtcattctccttccagctttgttctgttgctggtgaggagctgcgttcctttggaggaggagaggcactctgacttttagaattttcagtttttctgctctgttttttccccatctttgtggttttatctacctttggtctttgatgatggtgacatacagatggggtttcggtgtggatgtcctttctgtttgttagttttccttctaacagtcaggaccctcagctgcaggtctgttggagtttgccggaggtccactccagaccctgtttgcatgggtatcagcagcagaggctgcacaagagtgaatattggtgaacagcaaatgttactgcctgatcgttcctctggaagtttcatctcagaggggtacccggccgtgtgaggtgtcagtctgcccctactgggggttgcgtcccagttaggctactcaggggtcagggacccacttgaggaggcagtctgtccgttctcagatctcaagctccatgctgggagaaccgctaatctcttccaagctgtcagatagggacatgtaagtctgcagaggtttctgctgccttttgttcagctatgccctgcccccagaggtggagtctacagaggcaggcaggcctctttgaggtgcggtgggctccacccagtttgagcttccaggctgctttgtttacctactcaggcctcagcaatggcagacgcccctcccccagccttgctgccaccttgcagttcgatctcagactgctgtgctagcaatgagcgaggctccgtgggtttaggaccctccgagccaggcacgggatataatctcctggtgtaccatgtgctaagaccatcagaaaagtgcagtattagggtgggagtgacccgattttccaggtgccgtttgtcccctcttcccttggctaggaaagggaattccctgaccccttgcacttcccgggtgaggcgatgcctcaccctgctttggctcacgctcggtgcgctgcacccattgtcctgcacccactgtctgacaatccccagtgaggtgaacctggcacctcagttggaaatgcagaaattacctgtcttctgcatcgctcacgctgggagctgtagactggggctgttcctattcagccatcttggaaccacccattttggaaactgtattttaaaaaggaaaatttatatttgaaaagcagaatataagaaaaaacaattgaccttatgggcttaacaatagaatggagatgtcagaagaaatagtcagtaatcttaaagataaatcagaagaaacaactgaatctgaagagcactgaagagaaaatgaaaaaaagaaaaaacagaataggaccccagtgacctctgtgacagtgtcaaatggtctaatacaaatataaatggagtcctctaaggacaggagagaaagaacagggaagcaaaaagaagaataaattatggggcactaagaatggcaagaattctccacacttggtgaaaagtataaatttacagatataagaagtccagcaaacctcaagcaaagtaaaaacgaagaaaactatacctaggcccatcataatgaaactactgaaaaaatagagattgaaagaaaatcttgaaaaaagctagagaaaaatttacaccgtgtatagtggaacaattatacgaatgatgacagacttctcatcaaaaagattggataatgtacagcaatgtgaaaacatcgttagagagctaaaaaaaaatttgcaagcacaattattatatacagttaaaatatacttcaaaaataaaggcagatttaagacattttctcataataaaaatagggaattattcatgaagaggcttgcattaaaataaatataaagaaatttcttcaggctaaggggaaatctcactagatggatgtgtgaatttataggaaggaatggaaagtaatagaaatggtgtaaatgcgggtaaatataagaggattatatctcttttcctctatttatttaacagaaagcactgtttcaagtgtaacaacagagattcaaaatacatgaagccaaaactgagagaattaaagggagaaatagacaaatccacaatcatggttgtgattctaacactcctatttcagttgttccactcttaacaacttaggctttattgacataaaaagagcccaacatcaaacaactacagaatataatttttttcaagagccaaggaattttcaccagtgtagactatgtgataggtcacaaaatgagaccctctaaataccaaaagattaaaaatatcagtatattctcttattacaatggaatgagtaagaaataaataataatatttgtagaaaattcctactatttggaatttagaaagcactgttctaaataactgctggaccaaggaataaatcaaggaaaattagaaaatgattttagttacatattgttgaaaactgaaaattttggaatggggttaaagcagggcataggtgggaaatagatttaaatgtctatgttagaaaagaagaaagatttaacattggtgacctatgtttctcactttagaagctagaaaaggacaagcaaattaaatttaagagaatgaaggaaataataaagacaaaagtaacaatatattaactacaaaaaaaatagaaaacacagtcaaaatttggtaattgatagcacaaaagatgataagaaaatagaaaacacaaattacccatatcaggaatgttcctacagccattaaaagatcaataagggactatcataaatcactttgtaacaataaatttgacagcttaggtgaaatggacaaattccttaagaaacatacattaccaaaaacaaaaacaaataaatgcgtgagtgaaagaaagaagcaaaatataaattagccctatatatactaaggaagttgaattatcaacccttccaacttagaattcctgttccagaagagtttactgatgaattctatgaaacatttttgcaagtgacagtgtcaatcttgcataaatttattcagaaaatagagggatattgaatgccctccaattaattttgtgaagcaagcaaagccctgataccaaaaccaagcaacgacaaaattacagaaacagaaaacgacagactagtatccctcatgagcatagatacagaaattattaaaattttagcaaatcaaatccaacaacatataaagtggatgattggttgtgaccaagtgggatctatgccaggaatccatgtttggtttaacatttgaaaatcaaaaattgtgactcactatattaaagaccaaaacaaaatttagagcataaatatataaacccccaataattatcttaatcgataacaaagaatgcatttaatgacattcaatatccatttctaataaaaattactcttagtaaactaggagtagaagagatttcctcaaccttaaagggcatatgccaaatccctaaagctaaaattgtactcaatggagaaagactgagttcctttctcctaacttcaggaacatctgctctcaccatttctattcaacattgccagtacagtaagacaagaaaaagaaaagaaaaagtatccgtattgaaaaggaagaaataattttttttgtttttttgatgatgacatgatttttcaatgtagaaaatgttatgacatatgctaaaatactcttaaaacttataagtgagtttagaaagatcacagaataaacaaaaccaacaaactaagatcagtaaataaaaatcggttgtatgagcaatggggaaataattccctgttcaataaatggtgctgtgataactgactagccatatgtagaagaatgaaatcagacccctgcctttcaccatatacaaaaattaactcaagatggattaaagacttacgtgtaagacctcaaactataaaaatcctagaagaaaacataggaaataccattctagacattggccttgggaaataatttatgactaagttcccaaaagcaatttcaacaaaaacaaaaattgacaagtgtgacctaattaaactaaagagcttctgtatagcaaaagaaactatcaacagagtaaaccagcagcctacagaatgtgcaaaaatatttgcaaactatgcatccaacaaagatctaatatccagaatctataaggaacttaaacaattcagcaagaaaataaataaataaataaataaccccattcaaaaatgggcaaaggacatgaacacatacgcctcaaaagaagacatacatatgggcaacaaatatgtgaaaaaattctcaatgtcactaatcatcagagaaatgcaaattaaagtcataatgagataccattgtctccgttaaaatggctattattaaaaagttagaatggctattattaaaaagttaaaaacagatgttggtgaggttgcagagaaaagagaattcttacacattgttggtgtaaatttaaattagttcacccactgtagaaatcagtttggagattctttaatcagttcagccactgtagaaagcagtttggagattttttaaagaacttaaaacagaattcccattcaacccagcaatctcagtactaggtgtatacgcaaagtaaaagcaatcattctactgaagagacacgtgcactcatatgttcatcacagcactattcacaatagcaaagatggaatcaacctagatgcccatcagtggtggactaaagaaaatgtgctacatatacaccatgaaatactatgcagccataaaaaagaatgaaatcatgtcctttgcagcagcatggatgcaactggaagccattatccttagctaattaacacaggaacagaaaaccaaataccacatgttctcactaataagtgggagctaaatattgagtacacatggaaataaatatggcagcaatagacactggggactactagtgggggaagatgttggggagactgttgaaaaactgcctatcagtacgacactcactacctgggtgatgggatcctttgtactccaaacctcagtgacatgcaatttacccatgtaacaaacctgcacctgtacccccgaacctaaaagtaggtaaaaaaaaaatgttatacaaatggaatcataaagtatgtaactttttaagactgacttttgtcactctgcataattcctttgagaagcatccaagttgctgcatgtatcaatagttatttcctttttattgcttagtattccatggtatggatccaccaaagtttgtttaaccattcacccattaaaagacatctgcttttgtttttcttttccaatttgggaatattatgaataaagttgttatgaacatttgaaaaaaaatcagtcatatgtccataatctaacaatgaaaagtagtaaattggaattataatagtgccatttaaaataacaacaaaaatttgagatacttaggaataaatcagacaaaaatgtgcaagtctcataccctgaaaactacaaaaaatattgcggtgagaaataaaagaagacctgaataaatggagatatatatcatattcatgaattggaagactcaatattgttaagttgacaattggccccaatttatctatagattcagtgcaactccaatcaaaattcttgtggttttctggggctacaaatttaacaagctgatcctaagagttagatggaaatacaaatacagcttttataaaaaacaatgttggaggatttacagtacacaattccaagacttagtataaaaccacagtaaacaagatagtgtgctattagccaaatgatagacatatagatgaatgggacataatagagactcacaggtaaatagtgaatctgttttttgacaaaaatgcaaaggtagtggagaaagtcttttcaataaatagtcctggaagggttgcatatgcgtatgcacaaaaatggctcacactttatataaaagttaactcaaaatgcatcatagacctagatgtaaaatctaaaccttaaagtctttaaggaggaaacaaaggggaaaatccttgtgactttgggttaggcagatatttcctagatctgatatcaaaaacacgatccaccaaagaaaatactgttaagttgtatttcctcaaaagtaataacttgttctcctctaaaagtattgttaaaagaataaaaagataatccacagtgcaggaaaaataatatttgcaaattacatatctgatagaagacttgtatccagaatatataaagaactctaaaaatttaataataaaacatacagctccacataaaatttaattataaacaaattggaagaatattttgacacttaaataaaagcagatatatagatggcaaatagatacacgaaaagatcctcaacattattaattagggaaatgcaagagaaaaccacaatgagatgccaccataaacctgttagaatatctaataaaaacttttagccaaagcaagtatagatgagaatgtggaagcaactggaacaattatagattattggtataagtggaaaatgatctacacagtttggcaatttcataaaatgttaaacacctattaaatgaccctgttgattcctaggcatttacccatgagacatcaaagcgtatgcctataaaaacttgtacttgaaaattcatagtagctttatttgtaatagccagaaactggaaacaactcaacttcccatcaacaggtaaatgaatcaacacattgcagtatacctctacaatggaatactactcaacaataaaaagtaatgaactattgatattcaccataacaagtttgaatctctaagtaattatgctgactgaaaagttagacaaaaagagtacattctttataattccatttatataaaattctagaaaatgcaaattaatctacagtgacagaaagcagatctctaatagcctggggtgggtaggagtagggagatggatataggcataaggaagatatgggcacaaagaagcttttgtaatggattggctatgctcattattttgattgtggtgatgatttctgtattagtccatctttgcactgctataaagaaatactcaagactgggtaatttataaacaatggaagtttaattgactcacagctccgcatggctgtgcgacctcaggaaacttacagtcatggcagaaggcttaggggaagcgggcaccttcttcacaaggcagcgggaaagagaagagtgaggagcaaagagggaagagccccttataaaaccatcagatcttgtgagaacccactcactatcaggagaacagtgtgggggaaactggccccatgatccagtcatctcacaccaggttcctccctcaacacttggggattatgtggtatacaactcgagatgagatttgggtgaggacccagagccaaatccgtttcactggtgtatatatgtgtcaaaacttttggccaggcatggtggctcacaactgtaatcccagcactttgagaggctgaggcaggtggatcgcttgagcccaggagtttgatatcaacctgggcaacatggtgaaaccctgtctctacaaaaaatataaaaattggctgggcatggtggcacacacttgtagttccagctactcagggaggctgagctggcaggatcacctgagcccaggaggtataggctgcagtgagctgtgtttgtgccacagcactccagcctgtgcaacaaggtgagatcctgtctcaaataaccaccccccaaaacaaacaaaaaaccccaaacttttaaaatagtatactctacgcatgtatgatttattctatgttaattatacttcagtaaaactgcttttaaaacatatgtttttaacatagaaataaaacatctagatttccctaaaagaaatgtgtccaagtgcatattaataaacaaagaaaacttgctagacccctgatgagatcaagttaaccagttgacaatgtaaaatctgtgacacaatcaaacattaactaaacaaagtgtgcctctgtcagtggcatcagcatttactgggcgctggttagaaatgctaaatctcaagctttgcagctgacctactcaatctaactctggtgtcagggccaggtaatgtgtgttttaataaggtctccaagtggttctaatgcaagctaaagttttatatctgacttagagtatctccattttgacagtcgccaaaggtctattttcttgttctaccaattgtaatacatcaaatatttctagttctacataactacaaaaacaaaataggtattatgcaaaaaagagaaccgaattgcctataattgcattacctaattaaattatcattttcatttattcattaagggtcttgccttctccacatgtttatataaatatgttcatataatgtctgcatttttacaatattataatctgaagtaattttaatctcaattattattacagcagtttgtcctattttgtatttttcctatcctcagaattctaatattttcctgtttaatttttcttccttgagaaactattcttaaaatgcttttttattttaaagtggcatgattatacaactgtcttattgtcattataaagtgcgcttcctgaagatggtaacacttttatggatgcctttaactcacaaactagtctacttctcagtacattagatttttattcttcttaataaatgatatataaaccactaaaagttatcctttgtataatttcccctagccctaaatcttacatgtttttaacttttgacaaaagtgtatgccatatattttatttaatccattaaggaagtttattcattgaatgagaatttactgagtatttgttctgttgggcactaagaatacaaagttgaagaagatataattgattaatgaagtagtaattcgaggggagttaaagttattacaaatttctggctggggtagttgggttgtgctatttcctggaatggagaagacagtagaacatgaattcagtgttgtttatatcaagtttgttcttaggaaaattacaaaatttttccttgtcctgattcttcatatataaaatggaaataataatgtctacctcatattatcattgagagtattaaataagataaaacatggaaagagtttagagtaattatttggtatatagaaaacactaaatacatgttagctattattattgtcattgagttttaggtgcctgtatgcattcaagtgaagatgtttcagacagttgcctatgagagcctagttttttagtaaaaagagttgatattttagattcccgggtaaagagagagaagatcaaaaaaggaatccagtgtaataccagtatttaaaggataggcagagagagagaaatattattgcacaaaggaaaatacgaatgatatttttatgcaaatatgggcaggcagcataaaccggttttttttaagtttgacctttagaaatagccattttctgtttgtgagtgttagcaaattacaggaaaatctacagtagttgtaaggattaaacgagtgcctaacaacaggcagcaaagagtaggcaacaacaaacgtcaaccttccctaccatatgtattaggaattaggtggaggatcccatccccaccacatcctcgctcaaggcttctataatttctacttagtaaccttagtacctttcaaaggctgtggtattgatctttgaattccttttgctactgtctggtagttgcccttctctcttctttactataatattgctcactctgctagataggaccatgatattatttgactgtagtgcaaggagatttcaggatatatcatttataggtatatggttttattaatatcaacaaaattaagctttttagcacctccacttaaaatttttagcttattcctctcttatctgtaggcgagatagcagttttgcttctgagaaaatatggctttcttcaagtattatcctccagttttggcagagatatgctgtaaataccagctgagatcccaaaatgtacctgttttcccctcatgaaaatctactgtaactagattttttttcctttgtgctttctttctgactgaaacttgtgatcagatttctactactagctctgccagtaataatttgagggaatctagctctaaaaattttaaaacttttaatttcttcctcttgttttatttcctcaaaaacaattgtgttgaggttgatgaatactaaattatcataatttaaacactaattaaaacaacaaggggatatatgtctagaaaataagaagtgtagtaatatgtcagtaataattattgtcaaaactacaggaatgttgccatctatcattaattgactaaaattagcttcattaactttgaaatgaaaagtggaaactgaccagtagtcttttcaaagtacttatatttattataggatgtttgttgaattattcagcataaaatcatctaagctttttagactaaacttagtacttacaaaacacacacacacacacactttcagagtagaaataaaagtgtgctgtaccttaacctctagagatatgtgtcttcaatggccccttagtcagccacctagtagatatggatgctttctctttctcacgtgctgtccaggctgtcactgtgggtaggatctgttaagagggttcccagaatgaggtctgaccagaggcagccttcgagccttagaaaagtggaggaactacttgtaaccctgtagttgggagcacgtgccatgaagctgtccttcggggttcttttatatatatatatattttgtactttaagttctagggtacatgtgcacaactgcaggtttgttacatatgtatacatgtgccatgttggtgtgctgcacccattaactcatcatttacattaggtatatctcctaatgctatccctcccccctccccccaccccacaacaggccccggtgtgtgatgttccccttcctgtgtccaagtgttctcattgttcaattcccacctatgagtgagaacatgcggtgtttggttttttaaagttggaaaccatcattctgagccttcggggttcttaaacttcatagtgatgaattatctttgtgtaactggatcccctagttttggagtttacacccttactaggattggctatatgcagattaactaaccctaatatgttaatccaaatagcattagtacacatgctggctctgcttccccacctttctgactgtacagatattcacatcaggcaaccctactgtaaaggtgctgataagatatgatgggtcctcactggtagataggcagtcttcctgtcctggtgatgataaaggctgcggttagaactgagacctgagtcacaattcaagtaattattctgagtaaaggaattaatggtggtattttctttatacttttgttttctacattgaatatgtattcatttttagtattaattttacaattagaaaaagtaataaaagttttgatgttttgaaggtttttttctggttaatttcaagtctgggagcttctctgatggtttccttttacccttccctgctccatacttatttaatgtaacccttacagatctggtttcctggatttattgctatcttccctattaaactcttgatgtcagtatgtttaaatctcatttcatctctgatatgctttttacttttacaagaaagaaagagattaccacatatgatataacttccagacggtttgtgttttctccccccacatcttaacaggttttcccatgttagtagatactgtgaatttacataattaaattaagttagttttgtctagatagtcatgtgatctttttgaatctcaaccatgcctgtgcttgaaaattcacaaatgaccttacctttcattctcatttaattgcagggagagagagggtttccaggtttggaaggacacccaggattgcctggatttccaggtccagaagggcctccggggcctcggggacaaaaggtatgtatcatgttgccaaccagtaatgccagatgaattaagtcatcttaaatgtgggactaggtgtcacatcaactaaaaagttactgaattatagcaagaaactaatatgtaaatgaaacaatggaatgacggggagtctgtactttattgtattttgttaaaaaactaaatattactgccatattcagatgcttttggaagatgctgttgattgtttgtagttattggctgccttcacaaaaattaagttctgtcaagagcttagctgagctggagagagctgaattaccagttgttagagtagctgattaagagaagaagccaaaatgaaagtaacagtcaaacctttactcacttactgcaatattataagcagaaagttaaactggagaaagtgctgactcccccactgttctatttgtccccatggtgcagcatcagcaaaggtcagatggatcagcacagatgttggaaatcatttgactgctgagggagctcagaacgaaaagctcctgcagttgtatggacccaggggcagggtgggagaaggagaagagctaggatggaaacgtactgaatcagagtgcagaaaaagtatttttatggtttctttctcctctcataagaaggtctccaccaaaagaggcctttaaatgcagaaatgcagttgagcacagccagccatggtagcctgaatctttgactgatacttcagagattgcagtgcattagctgtgcaccaagtttgctgtgtggagggtagctgtcccttatgaggcctaccaagaggactttggttggacccgaacagtcataggtgtttagacaagagccatattctcaattccataccttgatttttcaggacctgagtgagaaacataagctgccccatcatggacctgaatgggttggactttaaagggctctgtcaaaaaacaggataatatctgaggccacagtagattatggtcatgatcaatcatgttctaagcaggatgaacaggcctgcttggagaactgaatgtaagcatgagccccagctattgccaagccagtaatagatgtcccatagcccacttgatctacgttagagagccaggaggcttttttcttaagtcttatgatggattgttctactttgccagttttcattgatctaggtgcaatatgaggtgctggcaattccagagacccctcacagttggccagcaggcagctaagggctatatggttagctaacactatgtgggccaaggagttgaggctagtctgttttgtttccaaagctgaagtaatgtcattaatgacctcagcaagggtcaaagacaggttgcggacaaccttttctaattgagcgatgctcacagtgagaaaagttgtctggagtattcccatgagtagacagtaggtaatgccagctggcaattctcctgaataaccggagtctatctagttttggagttctcattttgttttatgtaatgttatatgcttaatgggagggactgttttgaatatttgagtatctcttatcaatgtcctattatgtatgttacattggtaggaatgttgaaagcctgatttttataaaagaaataataccccaagaagagtgcacacagttctgggaatgtaagagtcattggttaccatggagatcaaccagccagaagtccctcctggtgagcagagtacttgagtggaattgaaaaatttgtgtaaggtggaggcagaaatagagaaataaattgccaccaccatcgaggccaaaatggctccaatggcagatcatatgtcccttttcccagataattcaattgcttccatatgggacaggagtgagctgacatcccaggaggtattttcttcctgtggtatcagagtcaattgttgcaatctgtcagatccagtgtaataaagttagggtacatgaagtactaaaatggtccatgtttagagaaacgtccattcgtaatattcagcagcacagcaatcagatgtttatctgcagggttcagcgataggtgacatatccattagtttgtcaaaatcagaatcttgtgaactacccgggacaggcaatcaatgaatttagtaaggtggaagtcacaaggttagtctgtaggagaaagggaagagaggttagatccctaccttccagccccatggatcagccccatggatcagctcatggatctggaggtagtctcaacctatcagttgtggggactctgtcttttgactgccatgtgggcagtctgtcctataccatgagcaagaatagcatctcaatgtgcatattaagatatagaattggaagagataatagtgaacttaagactcagagaattttctgggtttttttttttaatgactcttttggcttagtgcctttttccatctgtattaggtagactgatgaattgatatatgaaagggctacttctcctcatttgcctggaaaggaaaactggcttaaaaccctttttcttaattttattattttatatgatggtggtacatcatgttgttacaatattaaggaaatcaaatggatactcaccaggtagtcttccagtaaagggagaaaattaatttaaatgcatgaatattttttaacacttaactataatcagagcttagatttggggagaatgttggtcatgatctctgggaaaataggattacatcaggtagttttgttagattcaagagcagaagggacctgtgctaaatttcccaagtagaactttagtacttagaaaacagcaggaccctgaatgtgtgcatacaattttggtggatgaactactcagctgaatttcctgtgtctaatggcacatcaagagcaagagcaacagaatgattcttgtgcacccaggagtagcacagaagtatcagagatatctgaaagagtcaagtggatggaattgagcagtaacttggcagcaatctatgcatactattggcatggaacaactcaatgaataccagcttggactacactgtcacactcctcaacatattggagctagttaagttctccaaaacttagacacgatcttgtgaaaatgaggtggcaactccaatggactgagattaaacttcagccatgttatagaaataggtgttttggaagagaaattaagttaagctacaggaaaagttacatttcttgtatctgagtttacttgggattagggactgagtttcttgcaccccatgcttgctgagagatggtagttttaataaagatttgtattaaattaaaataagttacctaaattagaattcctttgaaataatttagtattaactaggactattctacaataacatgatcatttataaaggtgtgcttgtatgcaggttaagtttagaaagcagtccaatctttttttgtgatttcatttcagttatctaaaaagagagaaggtaaactgctttctaaactttcaggattctgaatttgaagcattgtgtacttctgcatccagtatgactccatgtttccccaaatggctgaatttataccttttatgtgattgggtattctggtacatgtgtatgttaacatatatactaagtcaaaaaacttgtaggagtattctttaatatgcacactcgcaattttccaaaggttttttattctaaaaaatcaaatttagttaattttgataggcagtacgttcatgtcactcaagttaagagggtatacaatgaaagatctccttctcacctgtgtccattagtccctgagttacccacacacactttaaccacctttgtttgtaaaatagtagcacattaaacacactgtttgacctttgtttttaatttaatatacattgtagacatcctattatcaatatatacagaacctcctcattttgtataactgcattgtatttcattgtatatatgaaccataacttagcattgtatgtataaaccataaattattaagccagtcccctattgatgattatttaggtaggtttcaattttttgctattaaaagttcctttttcttggagcagaattaggttttttaattctatttttttaaagaaaatagttaacgaaaactcagtgaggtaagactaaattctcagcaatgcggttgtgactagaaatgggtacatatgttaacatacacacatgggtaggttcttttgcatggaactgacagctaggaaggaaagtttatggttctttttaaatcgttcttacgctctgccaatacaaagtgcattataaaacaaagcagaggtttgaaaacagcaaattcaagaacagcacatatttaggctcagagatgatgctcattataccagcatggcaagcagattaacataatatgggaactgcccagattttcagctcctattttgtttacgaataaattatttggggaatgactatatcaatattttatctttgttttcttgtatgattcataattaactgtacaggtatagagtttgattcatatgtcagcgatttccttctcaggaaataaaggcctttcttattttgggtcatacaatttacctcagtgctttcagtctcaataataaatgcttcttccttgggtgtataagtttttcactaactttcacagatgtttacagtagtttaaatctcctattttataattgaaaatgagttatttgaggacttttttgacggacaaaaacctaaaaatattgcatttttcagggtgatgatggaattccagggccaccaggaccaaaaggaatcagagtaagtagtattttctctatatcaaatactttgttggtggaaacagatagagaacaaatgaagtattatgagacaattggaaaagacccatattaaaagccaagaagataaatacagtcttcaaaaagttaaatttaagagttggtatatgtctataactagcacttctttagtattttgatagctattacatatatttttatatatatgtctatttaatataaaaggattttaaagtagcttatggttgagaattatgaaagtcctaaattctaaagtttgtcatttaattaaaaatctatatcatatagttggtttaaaccagaacttcctaaccagtgtgattatctcagcctaggtccagaaggctggttacctcaggctgtgtatcctcctagtgtaccatgtataaacattatcatttttttgtgtatctagaagagaataagtttagtttaaaccactgtattaaagaataactatttttggaatactgcatttcttcaaatctaacgtgcatgacttttcaagtcttgaggctctgaaaaataaggatgcatctcaaaattgaaatgtacatttagtataattttttctcaaaagcttttaagttgacatatgtcttacagtgtattttacaactgagaggaaactgtagtttaaaaaatagtactggcttttaaaaaatcacatttagctttctgaccctcagtttcttcatttgttaacttaagagagctaaagagaacaatctccaaggtcccttttagctctgaaatactgtgttcatagattgatgaagctctctaatttgaaaataaaatatatagttggtgacatagcatgtttacgtgtgtgacaaagataaccatttgatcatcagaaatttagtagatgcataattttacaaacattaaaaacattctgtttgctatatacttcttaacatcatgtagcttgccttatgtgcatcttgtgactgatacggatagggtactggagaagcagggaagaaacttaaaacccttagtttatttcagcagacataattctttatttttctgttaaaaattgatatcaatatactattaaagctctttataataataaaaataatttttaatatccctatagttaacattaactatattctatattctaagcactattgagactaaaaagaattggctattttctcagtttccattgcaggtgtttgagattgcttggatactccatgtccctcaactagaactccaagagtgcttgggaataggtggcctgatagtttctgcatcctcaggtgtcagctcacaggcaattcttgacacgcagaattttgaagacattattgtggaaactgataaatgtatacaaatgtacagagcatatagtataatgaacccccatgaacccatcacccagcttcaaaaatgaacaacattttgatagttttgtttaacatataccttaccactttattttttgaagtattttaaagtaaatccctcacatcattcattctaccaatgaaaacttcagcatgtccctctaacaaccacgtaacaactaaaccatcatcatacctttaaacattaggaatagtttttcagtactctgacgttcagtccacattgagttttcctcagttgtctgaaagatgtccttttacaatggtttattcaatttacaacccaagcaagttccacgtattgctttgggttgctgtttattaagcttgttttactatgccatcagaaaaactgggtcattgtactgcattccacattctgaatttggctgatttgtttcctcatgatgtcatttaaattgttcctctgtcccccatatttcttgcaaatttcacgttgccttggaagaggcactaaagaactttctgggggtacagaactgtacgcttaagattagtatattttgctgtgcataaatcatactgcaataacattaaagaaaataggaaaaagtatactttataggtagtgttgtgaacttaactattgaataacattatgcagcatgaatatcaggctattcttcttttttttttttttttttgatgttaggtttgatcagtagtctcagataacattagcctgattctgccatcaaaaatttccctgtcaactttgactaatgatttggcacccatggatggtcattattttgctcagacttgcaagatgctgatttttaaaattctattaatcattcatttattagctggaattctaataggacaatgagttgctacaccagaaacttcaagtggtcatcaaggaaaattcttcaactttttttttttttcattatatgcacatggaatttgtgtgtttcaatcaattttagtcatttttttgaaggccaatttgtcccatcttttgcctgtgaaagccttttaaagttgactcctgtcctgtgctcttttcagaaaactccattgatctttcataacttctccctttttgacacaacaagctctttcatgctcatccttggcatttcccctttagatctgaaatgggacatatctctgattccaggttctttttagtgaaaaatgtgatttagataccacagcctgaatgttagggttttttttttttctttctttcttttttggagacggagtctcgctctgtcgcccaggctggagagcagtggcgcgatcttggctcactgcaagctccgcctcccgggttcacgccattctcctgcctcagcctcccgagtagctggggctacaggcgtccaccacaacgcccggctaattttttgtgatttttattagagacggggtttcactgtgttaaccatgatggtctggatctcctgacctcgtgatccacccgcctcggcctcccaaagtgagcggtttttattgctactcgatttgtcactgtttcaatgtcttctcagtggaaatatgtatttttaagagaaaaattaacatgagttcatattattgcttccaattgcaatttaaaattaagaaaggttttgtatacttattatctcttcccctcatctctctctctattgaggtgaaaatgttcattcctaatatcataaatgtaatttcttatttgctttttcctacaatatgcctatttcctacaatatgctttaaaataacaatgtataacttaacaaaataaaaatttaaattttaatagtgatgataggataataggattcttgaaaaccattaattatttctttgttgagttttccccctttgaattgaccagttttgctaaagaattagagttaagataccatgtttgatgaaaggcacttgaagtaattcttttctctgtatggttttgtcaacaacttgaaacagacgtacactggatccaatttatttttcatttttaatgatttcctttttaccttttttaaaattttaaattatttaaaacatctacgtggttttataagacaaggtgtagtcagagatgcttctctttcattcttgccatttccctagtgttttaatcttcctctgagaggtaatcattagtttttacatagtaatcatagttttacattatgtgaatgtgccataatttatttagtcatgttcctattggtggtcatttgagttgtgtattagtctgttctcacactgcttataaagacatacccaagactaggtaatttataaaggaaagaggtttaatggagtcacagttccacatggctccggaggcctcacaatcatggcagaagatgaaggaagagcaaagggacatcatacatggcagcagacaagagaaaatgagagccaagcgaaaggggaaacaccttataaaaccatcagatttcgtgagacttactatcacaagaacagtatgggggaaaccacccccatgattcaattatctcccaccgggtccctcccacaacacgtgggaattatgggagctacaattcaagataagatttgggtgaggacacagcaaaaccatatcaagttgtttctaattttaactataactggttacatggttgtttctaaactttagctataataatgctgcaattgttaactttgtttctcatattttgtttcataatttctagggtatcttcaggacagattcttagaagtgaaatgctaggtcaaagggcaaatgcatgggtaattttgctagatattttcaaatttctctccatagagtttgaatcttcattagcagtatatgagaatactttttcaccatagtctcacctacagagaatattgtcaaacttgtatttttgccaatcatgacagagaaatttaagaattttgggggtgatcactattaatgtcttcagtggaaatatatttgccactcccccatcccctgctgaattaatttttcatcacaaacctgggagatccttatccattagaagagacatttcatccacgaatttgcctgctcctaataagtgcaatgaagacaatgctccctcaaattgaagtttcttttatagttttcaataaaagagacttttaaacacatgtaagagatttttctctaatgtttcaaagaacaatgagtagtaataaatagtgagacacaatttttccaaatctattctaaaataattttcataatatccttaggtaggatattattttatttttatgggttgtcatttagtttaaggattttatttcttcttatagggtcctcctggacttcctggatttccagggacaccaggtcttcctgtaagtagcatttcactttttactttgaaatctcttgaaaagtaatctaagacatattatacatgtgttatgtcgcttttcaaagggaatgccaggccacgatggggccccaggacctcaaggtattcccggatgcaatggaaccaaggtgagatccatccatttaatcttgggtagtatacttgacaataattaacttaaaaacctaaagaaatcaatatgaagaatgtagaagaagggatatagtgtcttcaggtcttggctattacataaagtatgctctgactataattttctatatattgaactatcaataatttcattaaacatgtataattagctgggatattgcattgggttaaagattacttaccaaacccttttttgactttagcataaagtaggatgagaattaaaacgaaattaggatatatatgtttcaaatattatatcaattgttgaaagtaatacttctgaatgtcattcatttgctttgccattattaaaaaactaggtacaatttatgttttcaaatatttcatgtttttaagattttttaacacgccgaataacttccttaagaaaaatcttaaaaaattatatgtaatacagcacatccgtttttactataaactgtcagtatgaaacctgaaacttcttcatcagcaaagatgatacatttaacaattttaaataaccctaactttagatatagcaaacatttttttttctgatccaatgtttcttctctttagtcaactgttggattgaatataaagtaatagataataagaaaaaatgaggaaaatttgctctgcttgtaagcttacaatattatagccaattcttattccctcccctttctccttttcctttaggttaatgcaatatattgttattctctgtattttcttttggtattttctgtttttcacataatattctgtaaaactattcataaaataccttaggtccttctttctttctttctttgtttttgtttgttttttgttttttgttttttgagacagagtcttgctctgttgcccatgctggagtgcaatgtcacgatctcggctcactgcaacctctgcctcccgggttcaagtgattctcctgcctcagcctcctgagcagctgggattacaggcacgcaccacaatgcccagctaattgttttgtatttttagtagagatggggtttcaccatgttggtcaggctggtctcgaattcctgacctcttgatccgcctgcctcagcctctcaaagtgctgggattacaggtgcgagccaccgcgcccggccagatctttctaactaatggcatatgtcagattttatatagggcatatttttaaaataacttgaacaactattttgcattacagtggccatattttgtgataattactgtactctatacttgaggcagtacagttcttttcatctccagtatttcttcaggtcaatgtaacccttgtcaataataataatttttaaaaaaaattttggattcatgaggactaatcgtgttcttcattttagctagggcaaccttaaagtgataagaccaatgtggagttggtttgcctgatacatttcatgttaaattggactaaatttttgtgcctcttctggttatttgtttatttttatttacttatttatttttgccagtgtgctttaagaaacaaacagaccactaaccaaagtttcaaatttgaagggccaatgtatctataatcagtacagtgtgctatatgattaaagggagcattgattaacttgtgtttcaggcttccaattatgtgagtaacaaattttaaacaaattaaattgatttattatgcatatttttaaagtctgaatgcttttcttatatttcttactatgtaagtaaaagaatgaactttaaagttggagccacaatgtataggtttttttctttttctgtcttttaaacttgatgtctaggccacttcctttctctcgggacctactttttccatgtgtaacaaggtggagagaagggtattggactcacaaagacacacaacagtagtaattttattctttcaaaccttctgatgaagttgtttctaggattaccgtggcatacaggtatttgaaaggaggttgctttggtgttcttctacagcaatttcagcttttgttttctaaaccaagtgtccatattagtactttacagtagtgagtgagaaaagctgggtgcctagaaaacataatgacctgcaattgctagaactattgctattattgtcctcttggtgatattaatggccttctttcttaccatcttttcccctttacaaaaataatttgaaatagtttacaataaaagaaaaatgcaacagagcagttaaaataagaatctatataacacatgggcaggaaatggggcagatcattaactattaaatgtgatgatagaatttatggcgtgatcgtctcaaaatgtctttgttggaagaaaagaactgaggtagataattttttttctttacttctaattgggatagatgaattgggataaaagttgaattgatatggatagttgatattgaagtaattggaaagtgaaggctaatgaactttttggcaatctggcatgtttcaaaatggcttttatagaaatcttttcaagaagtcatatcttgatggtatagttattctttgtttcttgttcctccatgctctttatttttaactccttctagggagaacgtggatttccaggcagtcccggttttcctggtttacagggtcctccagtaagttataaaatttgggattatgatgaacacaggaattaacaaaagaagcagaaatgtagtgagagagcccaatgcattcatgtggaacaaagtaatacattttaaagtaataaactagaggaaaatgtttcaaaaagaagttggtaatatagctttctcctgggcaaaagcaaggattttgtatgtatataaatgtcacctctaagtatcctaaggtatatcctattcagaaatgacgctacagcagtctactcattttatactctatttagaaagcattctgtaattggcgtgtttctctctcatacatataaaataatcccttttctttttaataatagggaccccctgggatcccaggtatgaaggtaagcatctcattctggggaacaaatgttttgaataaaatattaggaaagctggcaacttcaataggataatgactcaaacttctgtcttaaaatcgatgtttctagaagttgtgcaggtgtaaacttacaagctctccttaagtagtctcctgtgttcccatggctttaagtaccttgtatgtgctgatacacttgaaaatgtgtatatcagacttgagtttctttgctgacactttaagtcttcatcttcttacactttgatacagttaaccacttactctctgtagaattacttttttccctggcctctgtgacactatcctttcctgatttttcttctacacctctggttaatttgcagtcttctatgtaaggtcattattttatgtccatcaagcatcaggtcacagtctgtactccttccctgcaatgcccagaaatattactaatgcccatattattgattactatctagttactaaataccaaatgagacttttcttctgagttagctatgtgtattcatcagcctctctgacatctccacatgttccaagttaatccacccacaaaataaacccgctcctccctgtggctcctcatatctcaaatttgcatctttatatgttatgtacacttttacacgatctcaaaacctgggagttaatatttatatcttccattccttcacccaccacctcattcaattccatcactaaacactaagtgtgcctgtaaaaggcaccttaaattcatccacttttcttcattcccactgttaccacgttaatcataatgtctcatctggattactgcaataacctcttacgtagtctctagtctctttttttcaccactactccgcccttacctcccatcctgttttattctttacaaagcaaccaagaatgacattttaaaagtgttcattgataatttaatatgcttataaaccttcaagggctttctactgtgtatctaaggtaaagtccatagtttgtttgtaagaactgcatgctctggtccttgcctacattgacagccttatcttaaaccactaaacttatcccttagctcactgaccacatcagtctgcatttagttattgggatgtgccaaacgttttgcttttagggtcttttgtatatatggtttactttgcctaatattcttcctcctatctttgcctggatgactccttattatccttcaggtcttaacctgaatgttaccttcacagattgcccttctttgactacccaagctaattttctccactagtttttttttttcaattattgtaccatgttatttttcttcatagcccttaatattcacagcccttgatattgtcatcttatatttttacatattagggtctgtattttcccattatattgttagctttatgagaacagaggccttgtttatcttctccattactgattacccagaacctaccacaattgttggcaaatacttaatatttactacatattttttaatgagtaactgaaggtactacactcttaataaatctactgttcttcagtgtactctggccacttcctcattttcctttaaaaggtaaacttatcatttttattactgagatggcctaatcttttagtacatctctgttacaaattgaatcttcagatcatttttctggttttgctggttttcatgtataataactgtgtcttagaacttccattgatggcttcttttagggtgaaccaggtagtataattatgtcatcactgccaggaccaaagggtaatccaggatatccaggtcctcctggaatacaagtaagtatccagtgattttctttttttgctatattgattaaaccagaagattacaacaatccctcaacctttagtactctctgtttttgtcataaaaattatcatcagatgtttactagacattacatgtactttctacctgaaaataaaagcaatctggaccagggagaattttaacaacatcggcttcattcttttgcctttctatccagtgttttggggattggcagcagaaatagggttctatattcttattcttgtactgtggagagcagtagggtcttttgtacatttacaaaagacctaattaaaaataaaaattatggaagtcccattgaatatattaagatatatcatttgtaacactatcagttatgcataatatatgaacatattttgaaggctgaaggaatacagtttatgcatggtgaacatcaaatgtaatcttaagaaaaaaattttagcctacagaaaacatgcatagagagagcagtaacttttgagtatagattaggaggtcaatttcttagggtttatatttcatgataatcgaatcctttgccaaaaatgaaaaatcaaaacttcctggtagtttatcactaagatacaagattggggacttttttcattagctaccttgtcattccttacttgatatcacccatccatagtttttaaaattcactcaatcttgccctttatattttataaattgttatgaagtaatatttgaaaatacaacagaatacatgcaaaatatatgtatgttatgaagcataactataaagtgaacaacatttaagagctagaaaattacaaataattttgaatcaacctgtgtcccccttggtaatcaaatccttctgcattcccccaagacatagctaccatctgtgccttaaaaatagctttattatatatgcatatatttctaagcaatagaatatttagctttgctttataaaataatgtaatatttatgtagttttctgcaacttactttttctacttgatatgctaagattcatccatattattggatatggctttagttcactctgtttcactttcatataactttccatttgtggacatactaccatttggtgttttttgttttatgtggtgtttgttgttgttgttgttgttttgagatagcatcttgcactcttgcccagaccggagtgcagtggcatgatcatggctcactgcagtcttaacctcctgggcttaagcaatcctcccacctcagcttcctgagtagctgggaccataggtgcacatcaccacacctggctactttttgaaaattttcgtggagacaagttctcaccatgttgccaaggctggtctcaaacatctgagctcaagtgatcctcctgcttaggcctccaaaagtatgaggattacaggtgtaagcctctgtgcccagcctacaattttttcattacaaaaaaaaatccatgatttatatctaagtatagaattgctagattgtaggccaaattttcagtttttaacatgccaaattattccataacacttgtatcattctcttataatttatcccagttcctctcatttccctctgtctttaatcttatctattttaaaattagagaagctatcttgaaagtagtagcctttcccttctcattggtagcataaaagccctaactaaatgcatacctttatcactttgttttgtaaattttccttattatttgtcttatgtttatttaccactttaaaccacaagttttcttataattacttaatccttttatccctttgcattttaaaatttcacttataatattgctgaatgataaaattgtagagcagaattccaatgacgactgaagtttaaatgaagtctaaatttcatccatttagttctttgtaagatacaattagggggccgggcacagtggctcacgcctgtaatcctggcactttgggaggccaagtcatgagatcaagaccagcctggccaacatggtgaaaccccgtctctactaaaaatacgataattagccggacctggtggcaggtgcctgtaatctcagctactcaggaggctgaggcaggagaattgcttgaacccaggaggcggaggtcgcagtgagttgagatcatgccattgcactccagcctgggcgacacaagtgagactttgtgtaaaaaaagaaaaaatacaataaggggcttgtttttcttttttttcatcattttctttactcactttataacagggcctacctggtcccactggtataccagggccaattggtcccccaggaccaccaggtttgatggtaagctctcttctttaatttaatttccccccctttcctttctgacttctttcaggaatattaatattatttataatacttgaaaacataatgcattctcaacattcataatttataattttcttatgtaaaggtgactttacaatgatatggtgaataatatgcattctaagtaatggctccattttatagatggaaaaatgaggtatataaaaggaaagatttacaatgaaatattttgttggttgctcttgatgtatcagtgttgaagtcaattctggccatttcagaaagtcttttaaggcagttttctaatcacttgatgaaacatgtttcttcaaactgcaattgtttgtttaagaagagcaaaagcagggcttcataaaaaatattggctctcatttcctaggcgcctgggacaaaacagtagaattggtgaggggagtgatcactatgcaattggtcacaggtttttgtaccccaaaaacttctacagatcctgaatgtgcaaccggttctcttactttactagctctgtagtcactcttattttctatcctagtaaattctaagtatttttacttctgcaatacttagatttcattcaagtcatgttttggacttacagctttgctgttgccctcttaaaagggcaagaaaattgtatttcagtagaagtaatttctcatgtgccactctatctctcatctaccatatatttaagtgacagttttcattatacctttataggttgtacatttttgtttgtgacaattggtcctgcacttttgagtgaaggaaataatgtttgataactgctagaagaatctaccagaaaagattgtgatttctgctttcctgtaactttttgggggaagatgagaaaacccttttgtttgttttagttgtagacttcatgcaaagcatgaaactatggactttcgcactttttcctaattctgctgttggaacattggtgccccttgagtatattgttacaccttgaatttcctcaaccattgtggccacttaaccgattcactttacgtttctggatattccttgaattaacgctaattcaacaggtgaagccaaatcttagaaatgccaccaagaggccaggtgctgtggctcatgcctgtaatcccggcactttgggaggctaaggtgggtggatcacctgaggttgggagtttgagatcagcctgaccaatatggagaaaccccatctctactaaaaatacaaaaaattagccaggcatgatggcacatgcctgtaatcccagctactcgggaggctgagacaggaaaatcgcttgaacccaggaggcggaggttgtggtgagccgagatcgttccattgcactccagcctgggcaacaagagggaaactccttctcaaaaaaaaaaaaaaaaaaaagaaagaaagaaagaaagaaatgccaccaagatacaatatataaataaataggcccattgaggttaagaggcaacatacttgagcagaaaggtgcctatttaattttttaaaccttgaaacattctcagatacacaaagtcatattgtataaaaatcaaactggattttaaaaaataaacacatgctttttagaacttgagagttaattagagttaattgctttatggtacctaagtttacctataattctgatgtgaaaaatttgatgggtctgttgagattaacttttgaattgatttttgacaatggggctacctctctacctctgcccatcccagcttttttctcttgcccatttctattttgtcatcagaggtactcacattcatctagctcattttaatcaattaaaatgtgtgtctctgactaaaatgaaaacaaacaagaaaatactattttgatgggctttttcacaccttactctttctgaaactaaataacttttaaaattaacttattaatataacattttattttctcttttgtcttctcttcttagggccctcctggtccaccaggacttccaggacctaaggtaattttctttttctttatatcttttatttggtgtggattccttttcttactgtcagtgagatttttaaatggaaacttctctctccaggggaatatgggcttaaatttccagggacccaaaggtgaaaaagtgagtaaagaaagagagctggttattcagccctcagctttctctttttgtagtcatttgaactgtctttttctttctcttgcttcttgaagttatcttatcttacatgttatattactgtctgtggagattatgaagtatcaccactgtcttattttatcttgcaaacagggtgagcaaggtcttcagggcccacctgggccacctgggcagatcagtgaacagaaaagaccaattgatgtagagtttcagaaaggagatcaggtgagtaagtagggaggaagtcaatgaaaatcttgctatggatatgttaattagtttgatggtggtaatcacatcacaatgtatatgtatatcaaaacatcacattgtttacaccttagatatatacagtttttaatttgtcagttatacctcaataaagctgaaaaaaataaaatgataaaaagttaaaaataatatttctatgtaagtggaattccattaaaatgcattataagctgaaatgtggttatatataagggtatttttttttaaataacaaggatttgagattattaattttttttttttttttgagactaagtcttgctcttgtcacccaggctggagtgcaatggcatgatcttggctcactgcaacctccgcctcccaggttcaagcgattctcctgcctcagcttcccaagtagctgggattacaggtgcccaccaccacaccctgctaattattgtatttttagtagagacggggtttcaccatgttggccagactggtctcgaactcctgacctcgtgatctgcccgcctcggcctcccaaagtgttgggatttcaggcataagccaccatgcctggccaagatcattaaattttcaaaataactttatcaagatacagtctacatacatataatccacccatttaaagtgtacaattcaattttttttttagtgcattcacagggtagtgaaactatcagtgcaatctaactttagaaaattctgaggcttcctcaaaaaaatctccatacctatgttagttgtactccttatttctccccaaattgaccagccctaggtaatcactaatctacttcttggctctgtaaatttttctattctgaatatttcatataaatggaatcatacaatatgtggtcttctgtgtctggcttcttttacttagcatagtgttttcatgttaaatcactttgcagcacatatcagtgcttcattcctttttatggctgaataatatttcattgtgtaaatagtctacattttgtttatccatttattcatcagttgatgggcatttgggttatttccatttttggctatttgaagaatccattcatgtataaaattaggttatggtaagtcagaatgatgacagtgttccctacatttcactgatatgcaaggagaaagataatgttactctataaacctttgttgtgtttagaaataattatctgataccctgcttttgctagagtagatgagggaaattagatatatttttaaagcatactggcccacactttaacaaacagaatgtgtgcatttttgtttcacttaaatgtgaataagaaagttaagaataaaggaaaagttgtattgaaactctatcatcaatatgaatttggccatttaattatctcccaaaatatatgtatgccgtgtgaccccaaaatctctttgttttaggtattcttgctttttataaaatattttataagaataaaaaattgtcattattttcattttaagtgttgccttgttatttacctcaaatcttggcttgtatatagacaaaaaattaactgaaatgagcaaagatagctctagttaattttgcctagaagatttcaactttaagttagaaacaccctattatctttggttgtactacatgagtattcagttcagtttaatttttttagggggagatttatttttattttattttattatttaaaaaagtcaacctttattttagatacagggggtacatgtacaggtttgtcacataggtatattgtgtgatgctgaggtttggggtacagatcccatcagccaggtagtgaacatagtactcagaagttagttttacaagtattacctgcctccctctactcttagtagtccccagtgtctattgttgccatctttatgtccttgtgtccccaatgtttagttctcagttataagtgagaacatgtggtatttgattttttgttcatgcattaattcacttaggattatagcctccagctctaaccatgttgctccaacatagatgtagctgtggttcagtttattaaaaatgctcctagctagctctagtgcttagaatgaaaatgcatgttccagtattaacattgatttcctttcccctactactgcatagggacttcctggtgaccgagggcctcctggacctccagggatacgtggtcctccagtaagtacctaaagtgctttagcatcatttaatgtaaattggtattggtacacagtatcccatgaaccattgtgaaactatttttatgtgtacagggtcccccaggtggtgagaaaggtgagaagggtgagcaaggagagccaggcaaaagagtaagtgatgtaactgctaatattctttgcaaaaaaattctaaatgtgtgtgtgtgtgattttattctttcttcctacatcttccattgtttcaaaatatcactactgacattataatgttgatgtctaaaaagtctacttaatatagtccaagccaggaataaagcttgttatattctttaactttatgcttcctaactaacaaatgtatgttgttgccctatcatttctttgtatcctatagggtaaaccaggcaaagatggagaaaatggccaaccaggaattcctgtaagtagctaaggttctttccccctgcaaaactggagacatttatgtgttggtataacataaggtggcagagaagcagtatgacaaaaattgtggggtctggaaatagtttaaatgaattgaaattatccagtctttgtcttttgaatataattttcaatttttaaaaaattttgtgagtacatagtaggtgtatatatttatttatgaggtacatgagatgttttgatacatgtatgtaatgtgaaataaggacatcacagagaatggggtattcatcccctcaagcatttatcctttgcattacaaacaatccagttacaccaaatataaatttgaggttcctctattttttaaagtcagatttattgagatataatttacataaagtaaaaggaactatttttagtttacagttctgtgtttgacaaacacatacagttgtgtcaccaccaccataatcaagaacacttccatcaccttcaaaagttccctcatgctcttttttagttatcccctccctattcccctatcccaacccccttataacgactgatcttttgtcaatctctttaattttgcctattcccaaatgtcagatacattggatcatattgtatgtagcctttcgaatcaggatcctttcacataacataatacattgaattgtgtatcagttcatttttttattgctgagtagtatttgatagtttgaatataccatggtttgtttgtccatttacacattgaaggatattttggttatttctgtgttttggccattatgaataaaacttttatattcatataaaaatatttatatgaatataaatattcccatacagtttttttgtgtgtgtgtgaacatgttttttcagtaaaagttttgacaggtaattcttctacttactaccaaaaaggggcatgggaaataaaatatgtaagtccaagaacattatttcaagcagcttcagtatcaagagtatccgcagtaggcaagagtttttcaaagacagagagaatatttgatgaaatttgtaagttattctaagggaaaaggataattcttaacaagacaggttagaattactaaattcagataaattggtttcaggatattttactaaacaggcaatcctcaacttacaatctctagttcaaaaatattttatattataaaatatcaagaggtaaattcagggcctcagttcctggcttcttttggaacaattggtctttgtcttgattcaggcagctgtgatattcaacaattgcctcttagtgttttcaacaaattggggttgcggggtggggaggctgttctcttgttctctgtttgcactgggagaacccaagttgggtcaaataaaggcagccttgcaaatagccttcttttgaaccagcagacagatcaaataatgataattctctggatatggggctttgaaggagctccaaccctgttctttcctctccaattgctgctaggctgctggttttcaccttgattgtgaggagaggtggtgtgaatagagcaagttaaaatgccacaaagctctgagaggtggtgggaatagagcaagttaaaatgccataaatctctgagaggtggtaggaatagagcaagttaaaatgccacaaagctctgagttctcaccaagattcagctttttttttttttttttttctgagaaaacactccttgaattgctgcaagctttggttaagttctgaaagttaattctgactgaccatttttgccagtattctcattgcttctatggagaagacaatctttggagatttcctaacaccatcatttgtgctgatgtcaccctatcctctatgttttaaagggtttgcctggtgatcctggttaccctggtgaacccggaagggatggtgaaaaggtaagaattttaatactttgaagtgactggtttagtctagctaaaataatccttttcttctcccaggcttgagttataaatggaaaaagtctacataactagcttttatattcaaaatatgccttctttattcatcttttgctcatttttcttttataccacacttgctaaattttattccattgccataaatcacagtccatgttgcagaaatacattaagcattgtttaactttagcatttccactgtgaaaagtcattgcctttactttgagcatgtatcggcaaaacttctttttttccacaaagagaattcagcactattttagtgaggtcctcttactaaaaaggcttataactgtgaatgtagaacgtcgccactaaacatttccattctgtatgcaattattgtctgtaagtctgtggctaattctttgttgttttttcccccctactgggccaatgcagtctgactgaggtcatttatttagttacctatttttcaagtgactttgaaagattgtatgaagcatacaattaccagatttttagcagggcacaaaataaccagtcctccaatccctcttgtttttaattgcttcgtatcaaaaactgaaagctttttggtttttcaggcaaggaaggaaaggcgttacaaacttgaatgtacccagaaggcacatattttaatggtggtttatttttaaattaggtccaagttctagcatggcttaaaaggcacaattagaatagatggaggtaggaaatactccgataaaatgattttttgtcaaatagtatttgtatatagatggatggcttctatgaacaagtttagagtcagaatagaagtatgaaaaagaccatccttgtgtcttggccagtagtagagtaacacttgaatattgaatattgtggtttttttcatgctgttgtagctactaatcaaggataaaagttttatctgaacttgtctttcattagcttctaagagcaagctcatgaaagcaattcagatttactagctattattgatgatagttaagtccatcacatctaaaatgtctgtcactaatagaaatggcactacatttatgtccttgactagttttatgagaagaaacatggctaaatgtaaaaaaaaaaaaaaaaaaaaaagtaattttttcactgattctagtgctaccattttttttctattatcttctttatagagtatttgtagttggctagaaataggaatcttaaaaatcaaagaatattacaactagaaataccttaaaactctggtccaaaaatctttattctttctatataaaccagagaagttaattaacttggtgaagattacatagctagtaaatctgagacaccatcacaggttaggcttagctcagaattgtttcattacttcatgttgcatttctcatttgaggtattttatgattgatttctgggtctttttggaaagtttctcttatattcttgaggaaattgatgttttcatgtgaattttactaacctattttacaattgcattgaacagggccaaaaaggtgacactggcccacctggacctcctggacttgtaagttttttttttttagtcttcgtttatcaaatttattaatgcattatcatttttgtgccttaatcgcatactccctactttttcttgatagaacacaaaatttcaagtcattatcaatttctactggcttaaaagtctttacatctaaaatcttcagtaatgttgacctcaaggtctttgtattgttctgcctatgcattacttctgcatggtaaaggtctaaaattatggcattgggttgttttgcctcatgattgccagatcatttctcaagcaaccagcaggtggtgcaagtgttgcttacaaaggttcaatgaaaacaacaacaacaaaacaaaacttggggaagttggggtgggggtgggggattggtcctttcccctgcagagctcaggagaaagatagatttggtcttaataggttttctcaatttgtaattgtctgattcacacttctttctttcctgagtgtgtgctttctagggacttttaataacgcatgtaggaagctgctttatgaaagaataattgagggtggcggagctacagattttctgtcatgtttgtgttcactatgaaatttaagtcaaatatacttccagtcttattaggaataaaatatcattgctgaggtttaacatattggtttttctttggttgaaatttagtaagactcttgacttcaaactgcattgaagccgcaacagtgcgaatgttggaaaacttatgtgtccagacatgttagtaacattaacttaattcgtattatccataatgagtctcagttattaatacttaggactgtactaaatctaatgaggatatacttaaagaagatcttagatattttttattcactttcattttaaaatcagcttcagtcctctaggaaataatctctttataaaatgagaagataaaattttaataagtatcagaagaaatggaaattttgagagtacagtcctatttagcagcctagtttcccttttgaatcactattccaatcttaggtcccacaactttttgtcttcttttgtgtgaatatttcttatatccatccaatagagacaggatgaaatatcacactgctattaggtgttgatttgtacatcagactggcagtctcttaaatctgaagttcatttacctttataggtctataagaagaatttgttaatatttaatttatttaatattaagttttttaagaaaatacttaatgagttacaagaatacagagtaaaaagaaatgattagttagttgggtttaatcaataaagaacatgggttttatttttaaatttttttggtatatagtaggtatatatatttatgggggagttttcttttttaaaggaagaaataaatgtgggttaataaagagaaagattggggaaaggcattacacatgtttggaatgaaatatgcaaagacatagacaagaacgtgcaagttgaatgaaatggttagaatcagacagacttcactataataaaaatttattgtaagacgtagtaggagattaaataggtgagagaagtattggaagtgagaggtgacttacagttcaggattaaaagtagcagcacttatagtaaaaagtagtgagcaattttgagtccttaagcagaatagttaacacacacacacaaatggtttttgaggaagcatatcctaacaatagattggaattcaagggacaagatcagaggtgcttctattactctaagtgtgagttgataatatagctgtggcagcagaaatcaagggagcaaattggagagacgttttctgtaaagaattgtcaggcttaggagattggaatgaattgaatgtgaattataggagaagagacatcaaaaatacttttagttttatatgcttcgggctcaggaacatggtaatgttgttacttgtattggacattttctaatcagttggaggatgggagtgatacaaaatgtgactcataaactatgtgaaaatgatgacattgtaatcatatgtagctcccataatgttttcaggagaacaaggcttttcttctttgcatttctttattttttttttctttggtaataaaggtaattcctagacctgggactggtataactataggagaaaaaggaaacattgggttgcctgggttgcctggagaaaaaggagagcgaggatttcctggaatacagggtccacctggccttcctggacctccaggtaaatgagattgcatttatggccttgttcttatagcatccttactaatccatgtatactttttatcacattagttccatggtcagcatggaagtaggagacacaagtcctttttaattgacagatacttcccaactcttactataccttctctcaccatattactcacttgtactttaaaaaagcccaagtgaatagtgtcctttaatcctaagattcctatttctacattttattttttattgatacataattgtacatatttatgggatacatgtgatattttaatacatgagtccaatgtataatgattaaatcaaggtaactagaatatccattacctcaagtatttatcttttctttatgttgggaacattcaaaatcttctcttctagctgttttgaaatatacagtaagttgttgttaactgctgtgaatctactgtgctaccaaacactgaaacttattgcttctatctaactgtatgtttgtacccattaaccaacctttcttcatttcccccgacccttcccagcccctggtaaccatcattctactctccacctccatgagatcaactttttttttttaacctcctacgtaagaatgagaacatgcatttgtatttgcctttctgtgcctggtttatttcacttaacgtaatgtccttcaggctcatccatgttgctgcaaatgatagaactccgttcttttatggccaaataatattccattgtgtatttataccacatttcctttatctgttcatccactgatgaacattcaggttgatttcatatcttggctattgtgaatattgctacaataaacatggaagtgcagatatctctttgaattactaatttattttcttttgaatatatacccagacgtgagattgttggaacatatggtagttctatttttagttttttgaagaacctccatactttttttcataatggttgcattaatttacattcccaccaacagtgtgtgagagttccctcttctctgcatccttgcagcatctgttattttttgtctttttgatgatagccatattaactggggtatattttattattaataaattacaccaaacaattcttaatttagtaggcaaatcatcacacttttcatgctaatagggaaggatattctccccaagtaatgcctagttttgcaagatttcctgtataaaaatggcaagcagcgttatccacctaaaatttcagaaatacctaactagaaatccccatggtgattttgttatacaataaaatcttagagctcaatactgagttttatattattccctttgaaaacacacagtatagtggaacatttctaatttggccacaaattgagtactgcccttatctagaatgtttatttgaatgttctctgaaatagggtaataatagtgatttccgtaagatttctagatgcatgtggtacagtgcctggcacacatacatattcaataaattattattccttttccttcaaaaatacgtggctaatgaaatactaaaatgatgagatgagtgatattcagtgatctttcccaagagaaagaaaataaatataggttccattatgctctaaatgcaaacttcagattcctaaatgtgaacttcagattcctaacctcaagatagtgaattaaatacagactgtatctggaaaattgaaataaagaattatctcaggatgcagtaaaagagataaggagttgggaagtatgaatgaaaagttaagaggtatgaaagataaacctagaagctccaaaattatctcatgagggaggtcaaggaggagagaatgggacaagaggcagcatttgaaaaaaaataatggctgagaacttccatctattaaaaaacacatgcatcactatgaaaaagctcatgaagcactaagcaatagtaaaataatagtaatgcaaaggtccataactagacacattgtagggacatttcagaattcagggataaaaagaagctcttaaaaactatttgagaacaaaaggccaatcacctacaaagcagtgagtcagaggatgataatggagcacattttcaaagtgataaggacaaattactatgaattagggattctgtattacattaaactatcatcctaatgtgaagatgagatacataggaagtttaacaccttcagactgtctctgaaatagttactggaggttttactccaaaaagaaaaaagggaattctggataaaatgagaatagcggtaggatgcaagaaccaaagcttagaaaatatattagtaaagcatattaagtctaaatcagtactggttattttttaaaaaggtgttttaagtaacaacttggagctataattgtaaacattattaacgtgatgtgtagatgcagagagaataaggataagagtttttgtcttgttagggaaagataatataaatcttgttaactgtataaatttttagaaatgtatacatgtttaagtacataggttaaaatgttaatagtagccactagagaagaatagaaataaaatgtataacatacacaccaattgaagaaagaaaatgactaaaagtctcatatatagtataagttaagatgggggcaaaataaagacaaatctgggtaaatagaaaataaaatataaggtgacaagaagaaattaaaaataagtcagtaactccaacaaatttgaaaggactaaacactgattaaaagacagtgactaaaataaaattgaaattaaaaatacctatatatagtgcacagtagacatatctaaagcaaagtgacagatacaatctgaaaataatgcagtatatattgggcaaatgctatacataaaaaagctggtttagcaattctaatatagtatgaaatataattaaattcaaaacttgaaactataaaaattctagaagaaaatgcaggaaaaacttttctggacattgacctaggtaaagatttatgactaagacttcaaaagtaaatgtaaccaaaacaacaatagacaattgggacttaattaaactaaagagcttctgcacagcaaaagaaacaatcagtggagtaaatagcctacagaatgggtgaaaataattgtaaactgtgcatctggcaaaggactaatatccagaatctattaatataaggaacttagacaaatcaataagagaaaaaaataaccccattaaaaactgggcaaaagacatgaacagaacacttcttaaaataagacatatatgtggccaacaaacatgaaaaaatgcttaacatcactaatcagcaaataaatgcaaagtaaaaccacaatgagatactaacacattagaatggctattattaaaaagtcataaaataacagatttgggcaagaaataatttcagttattcagagaccatctgattatctaccagaaagctttaaaaaatccattgacaaattcccagaacttaaagagaatatgtgtgcaagatggccagatctgagtagcatacttaatttgccttcctcttcaccagcaaacgtacaagagaaaaaaatacacttcacaatagtaatagtattaaaattcacagtagaataaccccaacaatacatgtgtaagacttctttgcagaattttgtaaattattattaaataatataaaattactaaatagagaaataaatttaattattacttgatgtgaaaaaccaatataataaacagttgattctaccaaaaaataatctttaacttcaaattaatcccattcagaatcccaaccagtttttgaaaatgaaactgaaaaatttatttagaaaagtaaatttgtagatggttttaaaaatgaacaaagatgagcgtattttccttagcagttttgaaaacattataaagtcatagtaactaaaaagtgtgttaatggtgcatgaatcaccagtgtaacagaagaatgtccggaaacagagccatgtttatatggtaactttgaaatacctttttatcttgctaatgactttccggtatttttgagattataagaacagattgtcaaaggatggggttactagtaatttccaaaagtagtaaacctactttaaattattatttcctaccctcaaactgttacttacattctttgaaacttttcaacctttttttcagacttttgagtctcatagaaaaaaaataacataaccagaattatatgttaaaggaagatcttatcattatctaatgtctcaatgagaactaaagtaacatctctaagatgaaatcattttgatcacttttttgaatcttaggggctgcagttatgggtcctcctggccctcctggatttcctggagaaaggggtcagaaaggtgatgaaggaccacctggaatttccattcctggacctcctggacttgacggacagcctggggctcctgggcttccagggcctcctggccctgctggccctcacattcctcctagtaagctatatttttctcctattaagttctatttttgtttttgtttattttgtttataagtaactctagctaaaggttggcctcatttgttgcgtttctgatatctaagaaattctaccactgcttctgctttttgggttttggtagttcttggatgtttacatttgctcttcatatagtatttatcagcaatgttatattttccttttgcttataggtacttttatttcttcagagaataggtctttttctggcttgtcaggctttcttttgtttaatcttctggatatttcacaattagcttgctatcctttctttatcttactcaggtgatgagatatgtgaaccaggccctccaggccccccaggatctccaggtgataaaggactccaaggagaacaaggagtgaaaggtttgatctccaaacatattcattccttcattttcttcattctttcaaatcatcagcaaaatcccctgtatcctccatcacaccttagccactgactcccatggtcataccccaagaccatctcattaccaatagtgttatacttacatgaccttggtttcatgcatcccattttttggatcgctctcttctttctagcttactacctctagtaacctgactccagcaatactccaaccccactgagacctagcaactttgactaatgcttaactttttgatgtcctttcttccctcttaaccttgcttaagttccattatcaatcactgtaatcaattccattcataaatccatgattcctttgcccttctctcacttcattgcactcacttggaacaaaagcataatccaaattttcatgttttctgagcctacactttctcttctcttttcaagttttaacagttcctcccctattcttaccttgcttcctacttcactgaccaattaaagcaataacaagagaactttcactgattgctaccaccatatttacttacctacttgcacctgtgcccatatagtctcccttcttgcatattactgttactgctcctatctaaagccagttcttctatttatacaatagattccatttcctcttatttccccaaggattttttttccagcaatttttgcctctccgacatcaccaatttttccctctctattcagtcattccaaggagcatacaaatatgcttttttcacctatctaaaaaaatgtaatcctacattccctgccagctgtttctctatttttctattctcatttgcaacaaaacttcctaagaattttctcctcattacctctagatactctcctcttgttttctcttaaacatactccaatcaagatttcatcccctcttcccccaactccccactgcctaccactccacaaatgctggtcagtcaccagcagtctatatcctactaatccaaatgtcaggtctgtcctttttttgcttgctttttgccttctttaaacatttgcatcccttagctttcagtacatttcctgttttttttttttcattcctctgtggtgtacatatatgtgtgtgtgtgtgtgtatgtgtatccatgtaattaccatctaaaccaaaatatagaacattttcaggaccctggaagactcttgtgctccctactcagtatcccccaaaggtaatcactattttatcctctggcatatattaatttgcctaatcttgaactttgtgtacatggaattatactgtatgagctcttttgtgcctggtttctttagctaaatatatgtgagatatatctatgttcttgtttgttgcagtatttttccaccattctttgttttccactgcacattacctcaatattctaatgttgatggacatttggtctggagctattgtgaataaagctgtcataaatattcttgtacgtgtattttttttgtaggacataaacactaatttttattggggatatatctggaaattgaattgctgggttataggttaggtgtaggttttgtttcatagatattaccaaaccatgttccaaagtgattttcatttgcgtttgcctaatgacttgattatgaactatttccttacagtttttatattctcttttgtaaagtgcctgtctttatctttaatttgattattggatatatgtattaaaactatcttctgttttgttaacttttgtttaacaaaagttgctaattaaatgaaatcaaattaattaatttcctattttatcgttagtactttttatgcactgttttagaaatctttacttatctcagaggcctgatgatattcctctgtgttttcttctagacactttattgttttacctttcacgttttgatctttcttcaattaatttttgtgtatagtttggagtagggatcaaagttcatttttcccatatggatgtccagttgactcagtactatagaacaaaagatcatcaattaccccaatgaattgcattagcactttttgtagatcacatgaccatatgtgtgtaggtctgtttctgactgctctattctgttctgttgtttcattagtctctctttgcaccaatacgatactatcttaattactgtggctttattgtaagtgttggatattctaggttctttgcattattttgtgtgcatcttagaattatctatccaacttttaagtttaaaatgctccaaggttgagtccttgttcttcttttctatataaactcatttattcagtcttgtgactgttaataccacctaattgcccatgacttccaaatttatgcctcctatccagatataactcttttcctctagatttgtgtatccatttgcctagtcaacattttgaacttgacatcctgatcaaattgaagtcttgatttctgccacctcctccccatagttgctgcactcacatcttcagcttcttacttaaaaagcaggccactttagccttctagttgctcatgctgaaaaccttggagtcatccttgattcccctcttcttttgtatttcatatatgatccatgagaacatctcattggctctactttcagatatgtctataatctaaccggttctgatcattttcattgcagtcactttgaaatgagctaccaccatctctctcctagatcattgcaacagtagccacttaagtggttaccctgtttccatcattgcctttagaggctattaacatagcagctagagtcatcccttaaaaacttaagttataacatgttgcttttctttttaaaattttctactagattctcatttcactcacagtaaaaaccacagcctttatatttcttatatgcctatatgccattcgttataaactgtcaactttctgaccttgttcccctccctcattctgctctagcaatctggtctgcttgctgttccttgtatataccaaacatggctattctttctgcttgggatgttctacactcttatgcacatgtcatgtcctttaagttttatcatataacaacttctcaatcaagtctatcctgactaccctatttaaaattgcaaccccccacccttccctggcatactcaataccacttatgtagttctattttttcctataaaaataatatattttaaagcatattaaatatttaatgtatatttaatttttttagacagggtcttgctctgttgcccaatctggagtgcagtggtgcaatcacagctcactgcagcctcaatctcctaaggctcaagcaatcctcccactttagcctcctgggtagctggcaagtacaggcatgcaccaccatgcctggctaatgtttttattttttctgtagagatggggtttcgccatgttggccaggctggtcttgaactcctcatctcaagctatctgcctgcctcgggctcccaaagtgctgggattacaggcatgagctactgcagtctgcctatacttaatattctattaaaatatttcatatatacattttgataattcatttcctttattgattattatccctttcccctggtagagtgtgaggcatgtagacatgaatttttatccatgacttttcttttgctcaccaatgtaacacaagcatctggaacagttcttggcacacagtaagcactcagtaatttatttgtcataaattgattcaggatataggcttctccaatcacaccattaagtggaaatgctgtcccttagtgctaacatttttagaacctatctatagaaggtatatgtacccctttcagtaaaatttgtttgttattatgatttcactaggtgacaaaggtgacacttgcttcaactgcattggaactggtatttcagggcctccaggtcaacctggtttgccaggtctcccaggtcctccaggtaaattatgcctcagggtaaccttctaaatattttttggctagattttgttgagcttatacttttagaatgttaccagtttctcattttataactagtcactcatatctataaagaattaagtatgaaatgcctccatttgttatcaaattaattatgctcttgtttctaatacctgaagctaccaatatattctattaaagcattttgacaatataatttcaggaaatatatcttccccattttccatatggagaagaaaatcacttatacagagtcagacttctttcttccagaatactgggagaaaagttcataatgcctagcccctgagtgtagtttccagtggcagagattccagtcactggggatgtatcacatgttgttgttcaggaataggggttctattggagtttggcaatcaactgccagtattcctctctctctatatataacacatctatccccctttccagtcaaaactatatgtgatatctgtcagaccctcaactgtttcatttaactgccccttaggtatcccagtattctcttgaaattacactttatgtttgagtcagggctgagaatagacaccagatctcttacctttctgtctagtgagtctactaaggacaccaattcatttggaggttgggaatactttcaacaaatcttgtagacattattggacattaataatctagccttgtacctctagtctcatggttctcaaacttgagagtgcatcacctggagggcttattgaagcccagaatgctgagcctcactctcaaagtttctgattcagtagacctggatgaaggctcaagaattagcatttctaattagtagccaggtggtgatgatgccactcatccagggatccatttggagaaccactgctttagtaatgtttcctctagtctttgggctgcaaatgtttctcataaaccaaatttcagggaatgacaaaccaaagaaaggactggtaaggatctaggaaaactgcataagtcagaacaaagatattcaaaccttttcattatcttttttctccctttggcaatgggaacatcataggaacccaggaaacgttgtgcatagtatttggcagttgcaaggtctgagaaagtctgctttggagttgaaagtttcttaggatacaatattgtatgtaacatgaaatgttaaatttattttttaaaaaggatgattacctcattttgtgaacataaaaggaaaatacaaatgtgacttaaatgggattgaatggggttcttattttaaaaacttgactttctgacttgatgatttctgtatgagctttgtcaggagttcaagctcaaagcttacgttattgtgtgtgtgtgtgtttgtttgtgtgtgtgtgtgttaggatctcttggtttccctggacagaaaggggaaaaaggacaagctggtgcaactggtcccaaaggattaccagtaagttttgagtatattataaaacaaaaagaagtagaaggaaggcattttacacattgattttcaattattcatatatatacacacatatacaatttaatttttccattaagttgtactttgtttgattccttgactcttcctgactcacatgcctcacttgattcagccctttgtacattaaatgttattggatgggttgaaggggtaaactggagagaagaaaatgttagaaaaaaagaaactgattttctttttctctttcttctttttccactcttttttctttttttccttactcatttcagggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctgtgagttggtttgatatttttggttttgtgatgttaaattttcacttagaaatgttttctaagttaattcaaaggatgggactgatgctgagataaacacccaatcaatgcttaaaacaatgtgaccatacagtaatggcacattgttactgactacgtagggtttctgcactactcttttctttcacttgttttgtaaacttatttttcttaacccattaatattgaatactattttctatgaataggtgggcaggaggttaagatgtttatgagacagtataaggttccccatctcttaacccccacatatctttccttgggtttacttaaacctcatgactgggcatggtggctcacacctgtaatcccagcactttgcgaggctgaggtgggcggatcacctgaggtcaggagttcgagaccagcctggccaacatggtgaaaccctgtctctactaaaaacacaaaaattagccgggcatggtggtgggcgcctgtaatcccagctactcgggaggctgaggcaggagaatcacttgaacccgggaggcggaggttgcagtgagccgagattgcaccactgcactccaccctgggcaacaagagcaaaactccatcacaataaattaaataaataaataaataaataaacctcataaccagcagtttaacttgtttctatatatatagtaagcttagagaatagtacaagtagatagccatgttcaatgtgccacagaactgaaagatttaacataaatgaacaatcttattttgtacataacacacagcccaggatatttaggtaggaagtgatattttataatgttatctagactataacctttctgacttacactaaaatgtaagctgcataaagtcagagatttttgtgtatttttgttttctgttgtatcaccagcacttgacacatagtaggagcccaaaaatatttgttggaggaatgagtaagtggaatgatcacacataccatctcataataccactcacttatatagcttttaagaagaactatttatggctatatcctttccccagttgtattcagtaccaacctacagatagttgttgtatctatatgtttctgtattaaacttttccctttttagggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtaagtttactgtgttttgttttaaacttggtgcttaaaaacagaaatttattatgttttggctactcatggcttcctttcccgagaggtgtgtttccctggccgtttatatttgaactcttcagagcatcttagcaagggatcacaatggtttttataagggggtttctttttaaatcttttctaactgtttcattgttactgttaattttgctctttttaagtacatgatacataatgcaaagtttaataaatagttataacagaagcacacaggtagctaccacacacatcaaaaaatagaatgttaccagcatcctagaaacccctaaccttttctccctgtcatttcctaatcacaatccccttcctcctgtctgctgtcttgacttttacatagttttcttccattacccctctgttttatgacctctgtatgcatttttaaacagagtattttaattttgtttctttttgaacttcatgttaaaggaatcatagggtaagtgttttttatattaacttttcgtgtggctatagtgtattcatttttattgctatatagtatttcattgtatgtatgtttatgtgtgtgtgtgtgtgtgtgttacagttgattgatccattctatggttaatggttaattgggttatttacagttcaggtctattatgaataatgcttctgtttacagtcatatagatagatagctaggtagatagatagatccctatatctccttgtgttcatgtgctcacacttctctagggcaagagttggcacactacagaactacagtccatggaccacatccagcctaccacctgttataaataaaagttttatgtgaacacttccacaaccattcacttttgtctgtggttgtttttgcactacaactgaagagttgagtagttgctacagagactggatggtccacaaagcctaaagtatttactctggtcctttacacaaaaggcttaccaatacctgggctagggtatgtatttaagattagcattttcaaagcataggataagtgcatcttccacttgactggataattacaaactctatccagaccaattgtaccaatttttactaccacaagcagtgttgaatattttatgttgatttacatccttggaaacaatttgtattgtcggacttttacacttttgccaatctgttgagtgtgatattttgcatttctctgattaaagtttagcaccttttcatgtgtttattggtcatttgaatttgcttttgtgaaatgcctaatcaagtactttgaccaattttatattggattatttctttttttattgatttagaggagttctttatatattctgtgcattagttcttagttacctatgtattttgcgaaaagaaatctttacctactgtggcttgccatttttactctttgtttggtgtcttcaatgagcagaaaacaactttcacatcatcaaaattatcaatcttttctctcatggttagtgctttttgtgtcatgtttaggaaatcttttttttcttgagccaatttcaagttcatgtttccattaataagaagtagatatacttgaactttgcacatgtaaaacctaaatgtacctattagccaaaaaaatattttccttgtttactacagtttgatttttaatgctcttttggcctacattttaaaaatacttatataggtaacaccctgttttaggggtttccagagaaacagaaccaataaaaaggatggacagatgggtagattagatagatagatagatagatagatagatagatagatagatagatagatgagaggtgatttattatgggaattgacttacatgattatggaggctgagaaatcccacagtaggccacctgtaagttgaagaactagggaagccagtagcttggctcagtcctagtctgaatgcctgagaacctgagtggctgcttagtacaagtcccagagtctgaaagccagagaacctggagttgtgatgtccaagggtaggagaggatgggtgtaccagtttcaaaagagagagagcagagaattcacctttttttctgcctttttgttgtatccggtccctcagctgattggatggtacccacacacattgggtgagggtggatcatccttattcgtttcactgattcaaatgtcagtttctttcggaaacagcctcacagacatatctagaaataatgctttaccagcgatctcagtatctcttaatctagtcatgttgaaacctaaaattaaccattatacatcttgaatcatggaagtccttaaggctgtcatatcctttttctttttgaaattctatccttctgttttatatatttcttgaatatatagtggaagattgtttttcttgtgaatttttgttagtttacattttcaaaagattgctgataattttcttttttgtttttaattaaaaagagacctttagttgagtaaatacttctcatttaccattgatttactcttgctttcaggtcctaaaggggatccaggtcagactataacccagccggggaagcctggcttgcctggtaacccaggcagagatggtgatgtaggtcttccaggtatgtgaggaatttatttcaaagtaacttcaacaccgatggcttttttttttttttttttgacagagtttcgctctgtcacccatgctggagtacagtggcgtgatgttggcttgctgcagcaacctcctacttctgggttcaagcagttctccctgcctcagcctcccaagtagctgggattacaggcgcccaccaccacgcccagttaatttttgtatttttagtagagacggagtttctccacgttggccaggctggtctcgaactcctgacctcaggtgacccattgcctcagcctcccaaagtgctgggattacaagagtgagccactgcacctggccctgatggcttctttctttgaacgttttcctttcaataactgctgtttctccataggtgaccctggacttccagggcaaccaggcttgccagggatacctggtagcaaaggagaaccaggtatccctggaattgggcttcctggaccacctggtcccaaaggtatgttggaatgggtagcaggcagagtaggttagaagtttagcatgatgttattctctcataaaattcattcaacaaataaaatatattaattgcaccttttttctctgtgctataaagaatgtaaataaaaaatcacagtgtattttcactgtaagttcattatctttatctaaaacagtccagacaagaaaatatctacattttagatatgcaaaagtgatatataagcttaaaaatcacaggaattattgtgttttgtgttcaccatagtattttcagggtttagaacagttcctaacacatagtgtgcacttgatgtttattgagttaaaggattttttaaacagaaaacagacttattgcagatgtgtagccaagtaatgttttatgctaaataatattttcttgatttattgaaatttttagggcttatgcttcagttctgctttattcctcacagaatttattctcacaaatggcaagagcacacagtggtctgaggacagttcttaaatatatctttactcatttatacaaaatgctttcaaaagtatcaggtttgattttatgtgtgtatgtatctataatatctgcagttatttttagatcatttccaaaattatatggtaggccctttgtcatactacatccagatataagcagaagaaaagttcttgggcatttttgtgtgggattcattccttacaatttagttctatcttattatataatagccctcattttcttcagaaaagcatatgttccacatacattagctctatgtgaaaataaaaggaatgtaagatgattgagaggattgtaaggcttaatcctaagtagtagaatgtcattgtgcttttgacatcttactgttgtcactaagcatgagtagaatgtgggtttgggaatttgaatatctttcttaaagtgcctttcctttggtggttaaaaaatgacttatcattttacaggctttcctggaattccaggacctccaggagcacctgggacacctggaagaattggtctagaaggccctcctgggccacccggctttccaggaccaaaggtctgggacatttttctttattccttctcattttcttatctttcccaccttccttatttctagctctctattttgactcagatatcatcccaagccccaagtctttactataaatatacagataacttattatatttccattaaaaaaatatttaaccccaaatcatctttaatagtccaaggtcacatttggagcaaaaaaaaaaaaaaaaaaaacctaatttctgtacctacttttgaatgcccagttctttgattagagaatacaggcataccttggagatattgcaggtttagttccagaccaccacaataaagtgaatatcaaaataaagtgaatcacacaactttttttgtttcccactacatataaaggttatgtttacactatactgtagtctttaaagtgtgcgatagcattaggtctaaaaaaaaccatatgcataccttaattaaaaatactttattgctaaaaaattttagcaatcatctaagcttgcagcaagttataatctttatgctgggggagggttttgactcaatattgatggctgcccactgatcagggtgatggttgctgaaggttgggtggctgtggccatttttttaaataagacaacaatgaagtttgccacatcaattgactcttcctttcagaaaagatttctctgcagcatgtggtgctgtttgatggtattttacccacagtagaacctctttcaaaattggagtgagtcttctcagaccctgctgctgctttatcaactaagtttatataatattctaagtcctttagtgtcatttcaacactgttcccagcatcttcaccagggtagattccatctctagaaatcacttttgctcataagaagcaactgctcatctgttctacttttattataagattgcagcaattcattcacatcttcattctctacttataattgttgttctcttgctacttccaccatatttgcagttacttactccattgaagtcttgaaaccctcaaagtcatctgtgagagttagaattaacttcttccaaactcctgttaatattgatgttttgacctcttctaatgaatcctgaattttcttcatgacatctagaatgaaacccttttcagaaggtttccaatttgttttgccagatccataagaagaatcactatttatgacagctatacattacacaatgtgtttcttaaataataagacttgaaaattaaaagcactctttgatccatgggctgcagaatgggtattgtgttagcagccatgaaaagaacattcatctctttgtacatcaccatcagagctcttgggtgactaggtgcattgtaaatgagcagtaaaattttgaaaggaatcttttcttctgaggagtaggtctcaacagtgggcttaaaatagccagtacactatgctttaaatacatctgctgtcatccaggctttattgttccacttatagagcacaggcagagtagatataccataattcgtaaggccctagaatttttagaatggtacataagcattggtttcaacttaaagtcagcagctgcattagtccctaaaaatagagtcagcctgccttttgaagctttgaaaccagtaatttacttatcttctctagctatgaaagtcctatgagcattttattccaatagaaggctgtttcatcaacatggaaaatctgttgtttagtgtagtcactttcatcaatgatcttagctagaacttgctgcagcttctatatcaaaacttgctgcttcaccttgcacttttatgatgtggagacagcttcttcccttaaacctcacgaaccagcttctgctagcttccaacttttcttctgcagcttcttcacctctcagtcttcagataattgaagttagggccttgctctggattaggtttttgcttaagggaatgttatggctggtttgatcttctgtccagatcactcaaactttctccatatcagcaatagggctgttttactttcttctcattcgtgtgttcactggagtagcacttttaatttccttaaataacttttccttcacattcacaacttggctaactgtttagtgcaagagacctagccttcaacctaccttagcttttgacatgccttcctcactaagtttaattatttccagcttttgattttaagtgagagacatgtgactctttctttcacttgaacacttagaggccattgttgtgttattaattggcctaatttcaatattgttatgtctcaaggaatagaaagacctgtggagagggagagagatgcggggaaaatggctgatcagtggagcagtcagacatttacaacatttttttattaagttcaccatcttatacaggcacagtttatggtaccccaaaacaattatgtggtaacatcagtgatcacatatcaccataacagatataataataattaaaaagtttggaatattgtgacaattaccaaaatgtgacacagagacaaaaagtgagcacatgctataggaaaaattgcgctgatagacctgctcaatgtagggttgccacataccttcaatttgtaaaaagtgcagtgtctgcacagcacaacaaaatgatgcacaataaaataaggtatgcctgtacgatggtctgctccctctgtgcatctctatagagtcatcatcccatgtcatctctgttcatgcctgtgtgatgattggttgaaatggtgttgaatatcatttccagaccttgtatactgttgttctctgtcccaattccattacagatacataatgcaaatcactgcaattgacttagtaatactaataataaataatactgtgtttgagttacttttcattccttttattatttcttatctaatgttaagctttcctgagtcaaccttcagcaaagagctgctgtggcatgtaattatcgtgactatttttatatattttatctctgcgtcattgatttaaacctcctgtgttttgtaattattacttatttttcatgggaaaaacagttaacccgtgacaccagttctcatgagaaaaccacttctctattggttgattctctttattatgaacattttcaaatgaaaataaaagtaaaatgaataatacaatgagctttcacatatccatcacccagattcaaaattattatgattttataacatttgcttcatctagtcctttttactttgcttaaatattttacccaaatctcaacacagtatcatttcacttataaatgcatcagcactcatctctaaataaattgacattttatacaaaaaccacaatgttgttatcatacttagtaaaattaaaaataattgtttagtattatctaatactcagcctataatcatatttccctacaagggtagtctgttctttaatctcatgctctctcagttttttttttttatcctgaaaccagtccaaatcatctaatttgttttactaaaccctgtttccaatccttccatatgttttctccaacataccaattactttttatttaattatcttctcctctccccccatggaaggaaaagtattgtcttgtattttcggcattaaattctctgtggcaaacaataaggacagaaaagtcatgggagtttttgttgtgttttgtcatgtgtatgctcaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtatggaggctgtcactgcatctcaacttgcttttaacttttatagaaattgacacctttgggaaagtttatgggtgataagcccaattaactggaaaccctatgctgccattctgttactgctacacatttttttcaatccttcattgattatttttgtcttttatttcattgaatagataataaaatcatggcccggcacggtggctcactcctgtaatcccagcactttgggaggccaaggtgggcggatcacctgaggtctggaattcaagaccatcctggccaacatggcgaaaccccgtctctaccaaaaatagaaaaattagccgggcatggtggcacatgtttgtaatcccagctacttgggaggctgaggcaggagaatcacttgaacttgggaggtgaaggttgcagtaagccactccagcctgggtgacagagtgagactttgtctcaaaaaaaaaaaaaaaaacaatcatatatgttataaaagtaacactgagaagtcttccttccaacccatcttcatccactttgttcctctccatcctcctgcttaactattttttattctcctttcttccccccaccctccccccataccccaagacagagtcttgctctgtctcccaggctggagtgcaatggcgtgatcttggctcactgcaacctccacctcccaggttcaagcaactctcctgcctcagcctcctcagtagctaggattacagatgcatgccaccaggcccagctaatttttgtatttttagtagagacagggtttcaccatgttggccaggctggtctcgaactcctaacttcgtgatccgcccgcctcggcctctcaaagtgttgggatccttctggtgtttcttatataaataccagccaagaatttgttttattttctctgttcttaaaggagaaggtattttcttttgactttatttgcactttatttttttactgaaatttgtatcctgaagatcactccatatcagtagatggagatcttaactttttgaaaataggtgcctagtgttaaattgcgtggatataccatagttcatcccagttgctagttgctagattggatttttgccaatcatttattacaaataatgccatagtgaataatctttcatgcatattatttcagatgtgttcaggtataatagtaaaataaagtgatgaaaaaggattttctgaattaaagggtaaatgcatctctggatattgtcagattcctctcaatttgcaccatttacactccacccacaatgtatgagtgtgtttccccacagccttgataagtgagtatgctgacaaactcttggatttttgctaacctgatgaagtaagtaggtttctaagtatatttttaaacattttattgttaaaaaattttaagtactgtgaaaaataatagtacagttaacagctgtatatctaccacccagattctacaatgaaccttttatctccctgccaacgttttgttttttaaaattttaaatataacaaagtagacagaactttattgggactactatatacccatcactgatattttactgtcaacattttactatatgttgacaaatactatatactatttgtcacatatctatccatccctgtctccatccattcatctatttttgatgcatatcaaaataaattacaacaacaatatacttctctctaaatacttcagcatgcataccataactaaaattccatagctgtatattacttttcttctgatatgtaattcacattaaatgagatacataaatcttaagggtacatttactggattttgacaaatgcatacacttgtataacacaaaatctttatcaagatattgttttagaaattttccttatgcccctttccagtcagtccctatcccatcatccacagtggcaactatactgttgattttttcatcataagttatttcgcctgttaactccttataaatggaactccttataaatggaaacatacggtatgtactttctttctgaggcttctttcactcaacataatgttttggagatccatccatgttgttgtgtttatcaatagttcttttctttcagtgaaatcattgagtattttattatgtgactgtatcatggatacctgggttgtgtcaagtttttggctactatgagtgaagctgttaaagacattttttacaattcttttttatggatatgtgatttcattttgcttcagtaaacaactaagagcagatttgttggatcataagtggatgcttagttgtactagaaactactagacctttttccaaaatggtgataccattttaaatttacaccaaagtggttcagaaatttgcattgttccacattttctcaaagtttggaatgttggtaggtgtgtggtagcatcatattgtgattttaatttacgtttccctgatgactaatgatgttgagttcttttttatgtacttgtgagctacttacatattcaaatattttgtctattttgaaagatggtttgtttctcactttattattaagttggaagtgttatttctatgtcctgcatactggccctttcctagatatatgtttattagcattttagccctggctggctgacctgttcatttccttactgtattttgatggataaaagttttaattttattgaagtttcatttatcaattttttcttatatgattataattttctgtgtcttgtctaagaaacatttgcctgccccaaagttgccaaggtattctatgttttattttataagctttatagttttagtttctatgtttaaaactattacacatgtcaaataatttttgttcagcatcatttgtttaaaataatcccctctctattggattactttgggatctgtgtcagatcaaataataatatatgtgttgatctacttctgtgctgtcaatcctgttttatttatttattttgctgtcattaagccagtaccacactgtttatattactgtagctttatagtaagactcgaagtcaggtaatgtaacccaccaactttattcttaaaaaaaaaaaaaacacatttctttggctatattaggtcctttgcctttactctcagagtggtttaaattgtatgtctcttactgtgagtgagattggccatccttttatgtgttaagggccatatttttttttcttgttaactgccaatatcctttacccacttctctgttgtttcttctactcccttgattttgagttatctaataatgagaaggaatagaattagtaaagctgacttgcattttttttcctttgatttggaaggaacccgacttccctcgtcaatgttttggctcctagtgagtaatctgaacagggccatgcttctggaacatgttggattgatttctattaaagcagtaagacagcccaatccaattttaaccaggctagattgtattctgccagcaaaagccccagactagctcaatacaaactcttcttagataagctcttaaaaaaatacctttctgtttttgactaaacaattcaggccagctgtaaactgtaacactcaaagttacaagttgtgtttcccaccagttatctcccctagctgtagacctgtagcaacaaaaattgcagataaagatatttgaaatatgtggcaaacagtcttcctgtggaagttacccacttactgtattttgtttgtatatattcttgagacacagtggtagtgaagaaatgcattgaaggctatttaaacatgaatttaacaggtatttgcctaatctttggaaggaaattaggatatggcattcccatatcctcacaggagtaattctcaattattaaaagccgagtacagttctttaggtgctagaaaaataagtgtttgggatattctgccatgtaactccttcattcttcaaacatttattatgttctatgccagctagtacctgaatcagtagaagctcaaatgcatagtttctgatcttgaagatctcaaggattgctctctactgtgagaaaatctaggtagcatcaccatgaaagtgattatctcaatgggaacttctatgaaaatgtatcactaatattttggatcagtagactacactcaaaactcagcaagcagatcacaataaaagttcacctaccaaacacacacaacacaccaatgaatgggtattagaactcagttactaaactgtaggaaaggttgatgcaacactttcaaaacaatgtagtgaccaataataaattaataaggctaatactcatcatgatatatctatatgaggaagaaaatgtgcttaaggttgaacgttagaatcagattatacaaaagagaaaaaaagatgattttggaagcattcagtttacctcatatattacttttgttcagggccttatctaaggtacctggagaggttttatatagatggtgacagttgaatttagacttaagggaaaggtgttccgggcagcaagaataacatccaaaggtattattgtgacaaatattgtgtgcttggaaatgttgaaagaaatacaaaagtatataatttatgctaacaacaaatctatatcaaacaaatatgacaaacaactgcatgcccatacatttgacaacttagattaaatggactaatttcttgaaagacataaattgttgaagctcactaaagaagaaataggcaatccaggaatctatttttttaaaaattgagttgtagttagaaacccaccaacaaagaaaactacaaatccagatggcatcactggtaaattctaacaaacatttaaagaagcagtaacaccaattctacacaatctcttcccaaaaacagaagtagagggatcactttccaaccattacatgaggccagcattattttgatatcaaagccaagcaaagacatatgagaaaagaaagctgtagaccaatatctctcatgaacatagacataaaaatcctcaagaaaatattggcaagtcaaatctagcaatatatgaaaaggataatacactacaatcaagtgaggcttatccttagaatacgggctggtttgacattttaaaatcaatgtaatttgccatatcaacagagtaaagaagaaaaactgtattataatctcagtaaatcctgaaaattatttgataagtttcaatattcattcctggaaaaatagtctcagaaaattaggaataaaagggaacttccttagcatgataaagacatttacaaaatcttgatccattatgtttagtggtgaaagactgaatacttttccccaaagttatgtaacacaaagatgttatttgttaccatatttgatggtatgaaaaggttcaatattgtattggaagtcctagccaatgttataagacaagcaaaataaatgaagggcatacagattggaaaggaagaaataaaactccctatattcatagatgacatggttttatacttagaaaaccctaataaatctacaaaaatttactagaactaaaaggtgaatttcgtaggatcataggacaaagcaaatatctaaaaataaattatgtttttatatactatcaatgaacaactagaaataaaaattaaacaaaaacagtataatttacaatagcatcaaatgacatgaagtgcttaggtatgcataggtccaacaaaaatgtgcaggctttgtatgtggaaaattacaaaacactgttgacagaaatcagatacctaaataaatggaatggtatattgtgttcatggatattgttaagatatcagttttctccaaatcaatccatagattgaaaatattctcaaggagaacacacaatttttcttctaaaatttatatggaaaaacaaatggcctagaatagccaaaacaattttgagaaagaagtacaaagttggacaattcatagtacttgatgttaagacttaaaataaagctacaatagttaaaatagtgtggtatgtgtgaaatacagactaatagatcattgtaacataatagagagtctagaaatacacccacatatttaatttttgacaaagttgctaaggcaatctcaacagaaaggtaagtcttttcaacaaatgttgctaaaatataaagcaattggacatccatatgcaaaaaaaaatataaacaaaccaacataacaaacctctacctgcacttcctaccttgcacaaaatttaactcccaatggatcacagacctaaatgtaaaacctaacattatcaaacttctggaacagaagcaggcaaactttttctgcaaagagctagagagtaaatattttagtctttatgggctacatatatggtctctgtcacatattcttttttaaacaaccctctaaaaatgtaaaaaccattcttagcatgtaggcagcacaaaaagaggcctataggccatatttagccatgggaagtactttgtcatcccttgttttagatgaagaagcataagagaaaactctgtgatcagatgttaggcaaaaacttgttagaataccaaaaagacaattcataaaagaaaaattggatatattggactttattaaaattaactgtattttcatatcatatatctgacaaaggacttataagcagaatatataatgaactctcaaaactcaataagaaaacaaacaaccaacttttaaaatatagttggaaaaatgagcaaacaatttgagtagataccttaccaaagaagacacccaaatgtctaataagcacatgtaaagatgctcagtataatttatcatctgggaaatgcaagttaaaaccacaatgggataccacttcataaatattagaattggccttttttcaaaaaggataactgacaataagtgctgctaaggatgcagagtaactcgaactctcatacattgctagttaatacacagaatggtgcagccactttgaaaaacagtttgacaatttcttatatagttaaacattgtctttgcacatgacacagcaattctactcccaagaaaaatgtgaagcttcacatagaaacccgtagaacagtgttcatagcagcttaattcataatcaccaataattgtaaacaccccaaatgtgcctcaaattgcaaaaagattaacaaaatgtacatattcatctgatagactaataaccagcagtaaaaagtaactactgatacacataacaacatgggtgaatctcaaatgcattgtattaagtgaaagaagacatattcaaaaggctacatactatatgattgcatttgtatgacattctgggaaagaaaaatctgtaagacataaaataaatcagtggttgccaggtaattgggatgtggggacgagttgactacagcgcacaggggcttttttgggtttatgaaaatgttctatgtcttgattttagtggtggttatatgactacatacctttgtcaaaactcatcaaagtgtacactaaaaagacagaattttagtacatgtaaaaattgtttaaagtgggagtgacagagggacagacagaagatggagagatggacagttaagtttctaatgtcaaagagatgttttactaatgaagggagaagcttgaacatgtttataagccatggccctgagttagtaaaaaggaaaatgttgaagttatctatcttaaaatataggtaacttgaaaatatattttaaacttatgaatatataactgtccacaatgagttacaagtagaaggaatatgtggtttgtaatcttttgtactttcttgtgaagttgatttaagtattgaagtagtgatcagcatatgttaaattataaggctgtaactattaatagattccctatcctttgctcttgatacttatgtgtacttttcttgctgaatgaatgcccagtttttcaagattcttgcttaatatgatatggttcccaaggactagtgactcaggtgttgcttttaatatttaaactgtatttatttcttaaaggtgatgttggaccaaatggacaacctggaccaatgggacctcctgggctgccaggaataggtgttcagggaccaccaggaccaccagggattcctgggccaataggtcaacctggtaagattagagtaaatgtgcattttgtagcactcataatatatacatttgttagctcatcaataaagtgaaacctacaaaacagtcttccagaagcagacttaaaaggcaatctatctatgtgtatgattttataaaagtggataagtacaagccacagcataaaagctactttaatccctgatatttcccttctgagttcatctaaaattgatgtatttccaataatacaattgcagtgtattattgatatgtaattgttgagttagacatggttttggaagcagaggcctagaaacttctagtgctgatcatttcagatctgagtagcggtacagcattcatagacctttgtggaacctcctaacatttcttagcacatgacaactagaattagggttcagcaaaactttctgtaaaagtgtattttaggcattcccattttctttttttttcagtgagttattttccctttttgcccctaaaatagcagtcattttgcaattcatcagcactccaaatctttacttttaatattttatattggatactcaaaaaggtcttttgtcaacacgtaacctaatgggtttgcctctatagataggaaatcatatggttcctctaaatttgtgtgaaagcatattgagtttctggattctgagctgtctggtgatgtgaattctcgttatgttaatctaggtaagtacagtaaaggccaccttggggccatcattatgttattgcaaaataccataataatttatgaaattaaaacaaatatgaaatatttaattgttccttaattcacatgaatacatctgaaggcttaaacacagagttcagatgtgcatacatttatctgaagcaatggctatatgtttcctgaccttaaatggcagtagatattttgttattattctaaaaatttagaaactcaggttaacaatataaaaagcttgtaaatgttattttcattatgtactatttacaattgattatatggcacattatacctttttatggtccctgacatgtcactactgatttaaaactaagaaaacttagagtgttgctttgaaccaggttgttacaaaatagctgctttatcacttatggaaaaaacattctgtccaactaacaaagcagagggatcttcaggaaaaagcacttatttttaggtttgacctgctgttttttttttgttgttgttgttgtttttgttttgttttgttttgagacagagtttcactcttgttgcccaggctggagtgcaatgctgcagtctcagctcactgcaacctcctgggctcaaacgattctcctgcctcagcctccggagtagccaggattacatgcatgcaccaccacgcccggctaatttttgtatttttagtagagacagggtttcaccatgttgaccaggctggtctcgaactcctgacctcaggtgattcgcccgcctcggcctcccagagtgctgggattacaagagtgagccactgcgcccggcccctgctgttttacagaggtggataaaatgaacttatcactcctatggtgttttgtcatttgtttcagttccaaaaagtgcatgagtctttagaagcattttgaattcttaagtcacagctgagtgcgaataaaaaaaggaacaccattaatatgaatctaaacaaaatacaaatatgttaacacgtgtcacgctttttcagatttacctgataccttgtaatgttttattaatctaatgttctctctttctttctccctctgttatatgatatatctgacaaaggacttataaccagatataaatataatatatagataaatatatagatataaatataatatagatatagagatattgatttataaagtataaataggatgggcaggaagaaaagtaataatgctgaattaaacttcatctatttcttttgtaaatatatgtatagccatagaattcaagatattaatatgattcaacaaataaatgaaattaacaggaactagcatgaaaatttattgaattcactcttaatatagaaatgttctcaaatcacagtacttttcattttactatgagatggaccacatttcatatttatacaaggcacagatactcactttctaagtaaattttacttacatcaccaaaatagaatattatcttagttcatttaaaaaacatcctgatttatgtccataaatctcaataataaggtaatcggaaagattcttatatcttgataaacctacttatgttgcatggctgaaactctatcaatgtttttgtaataagcttatttaatatacttgtatttcattttgcgataggaaaaatgcaaaatattctatactgttatctctctactgtagaatgtttacattatgctttttaggctttcctttgaactccagttttctattatttaattaagcttttactatttacctttctcttttctaaaccaggctatacagtttaacacggttataagataaggtcccattgaatatcagtttcccattccatagcagggaaataaaagaaaaattgccaaaggactagaaacaaaatatttttcatctcatgacctgctaacccaggcagaaatggaggttgttgattcttgttattttctttggccattacctgtacaattactgtcttactgaatttttttagagatcagttaaatatactctatttcatgttcacagatcatatcataaccagaaccaaacgtgttatagtgtgtgtccagtcttaggacaaagcatatggctaaatcagctaaagaggaaaaaaaaattcatcaccactaatgtgaatcaaaacaaacaaaacaacaacagcaaaaccctaggaattgtttatgaattattcatgtcattttcatagatgaaggagaaaatagttttctaacacttcaggaggctacaaaacccttgggtagggggagggtgtgtgtatgtgtgtgtatggaaagttctcacgaataatacatgtttttgaaattttcctttttttataaactggttccattcggctgccaataaatttagaacatcagtatatccctatatcacatctgtagacatatccatacaattcttgttattgtggggaaatttagcggaactttgggatttatattgacttcttcatcctggatcttaccaggatgtgtattcctgacagtattcatggaaaaaatctatgctatgggaggaagtatagtataatgtctgttattactactactaataataacgatgaagaaagaaatccttgcctagtgcatgcaagttgtttctccataatcatatgctaataatgattgatttatctatacccaacctgttgtagtataaaattaaattaatttttaaatttgaactaaactttaggagcttaaattccaaaaagattatttaaatcattaagtcagagataaacaattgaaaagctgacctttaccaaaaggtaatacttttgtgaatgtaaatattttattatgtcattattggcaaatacatttcatttatagaataagctatatgaacatctaagcaaatgcctaaaataagttttttcactcatttctaatatatgatagcagtgaatcgaggtctaataacttctatttgtagagttttatgttctaatttttaaatgcttagtttttttttccctaacctaatgaaactttttgcaacttacttctgcttgggtggcccaacttgctgctgaactgtaattccctgcctcttgaacatcaggtgtaccaggtactgtagttcttcctcaaaagccatatcttaaagtaaagctttaaacatggaaaacaaacatttctccagatttaagtctttggtttatttcccttattttatagaactgctctcttggagcacgtttcaaaagataaattatttatattgaaaacccaactattaaaaatctttgtgagctataatataacaatagatagtgatccatataaagctataatcatgttcactgttaggcatcatatcatctttcacaaatatgatataaaaatctctctctcctttttatagtcttttactgtaaaatggcagcattggaactatcgctactttgccaactgagtgtaattctctaatcttcaaagtggattttgtcagtttagggccatgctgaaatatgacataaaacagatcttaaaaccctagcatcttactctctacaaaaataatcaccactgagtcttcaacaataaatttagatcttattgttgaaaggagacttggaatgatcatctggctcaacccctagtttccaattggttatggcataatccccatttagcagatgaggatcaacattaagtgactcacgtaagtcgcacagctggtaggctttggagtgggaagttacatagtatttttagtgtaattcttttcccataaacatactcttttttaaccaccttgcttttgggggaaaatcagccttacagaaacttactaaggttaaatattttttgctgtgtcattttttttctgtaaaatcttggttggagaaacaaaagatgacaaaaaatactaatagtaacatattattaatgtattattaaaacaatgtgcaaaacaaaggtaaaatacaatttaagaagtccacttaagtgacttattcagtaatcaataattttgggagctcatagagatgtgtactaataatttataatacattagaacaatgcaaatgtaagtgtgttcaatagaccagtgtcaaataatctatcagtctgcaataggattaatacaaatgttgagaataagcatttagaaacttttatagcaatttgatagtgtaattgtatctgttgaatataataaccaaaaaggtaggcttttattttgcatctttggctttttattcagttttagtaattttcattgtattttataaaaaatattagtctgtgattaactaggaattaagaaaagattggccttttgccagaaataatttgagaagcactgtcttagagcaatctgcttgaaaatcctaaagcttgattgttcagttattttgtgtgcatgatgtcaaaagtatctctaactcactcttaggtctgttatctacagggttctatcacttgtttactagaaatataaccagatacatcttttaaaactgcttcagtacttattaatattgatattgtattaactaggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaatttgtttaaagttttctctgatttggattaaggaaattaaaactaatacgactctggtagataattcccatgttacacttttctagattgacgtgatcccttaaggatgagcattaaatatctatgactgcaggaagctcactttgctattttcactgcacatttttctctgtgagagttccagttatatattactgtataacaaacaaccccaaaacttaatgattttaaccaaccttttaattttgctgaagattttgcagctctagaattaagggatgacttgactggttcatttatctctaacccacgttgccccagctggagtgtttgggactgaaaggtctacttctaagatggcacttctctgacatctgggtgttcattagctcacatgtcatctcatcgtccatggtacctcttcgcatggcttaggctcctcacattatggtagtataaggctggttgctccccttccatggcagctggcttccaacagagagaatcccacaagagaaaagtgagtgtttcaggaactacaggtagaagcggcaagatttcttttctttcgctctctctctccctttttttctttctttttccctttctttctctttctttctcttttctttctttcttttctttctttctctcttctctctttctttctttccttttcttctttctttctttcctctctttctttctctctctccttccttccttctttttttttttttgagacagggtctcactctgtcacccagactggagtgcagtgggacatgatcacagcccactgcagcctcaaacccctgggctcaagccatcttcctgcctcagcctcctcccaagtagctgggactacaagcacataccaccacacacagctattttttttttctttttttctttgtagtgatggagtctcactatgttgcccaggctgctctcaaattcctgtcctcgagcaatcctcccacctcaacctcccaaagtgctaggattataggcatgagccactgtgactggcctgtaagacttcttttgatctaggcttgggagtcacacaatgtcatttagtcaagtgtgaggtacagaatcaaccctagttccaggtgagggttttatagtagattgtacatactgggacatatggttcactggggggccatctttagagattagctaccagactgagtctccttattcatgggtatcagcagtagtgggcactatggtcaaaaagtctaaaacttaacagtgccttacgtccaaccctcaatagttttctggttgacatcttaaaacttactttttatgttccctaagtcaaagaaaggcaaacattacttattgatattcttcaaaggtaccaaaggtgaaatgggtatgatgggacctccaggcccaccaggacctttgggaattcctggcaggagtggtgtacctggtcttaaaggtaataatcaaggtttgctgccagacgtatgtgagagggaaaattaaatatagctttatgtcagtacagaatatttttgttgactgttttaaaatgagcaatggttacttgtgtttctatgtaacatggcatttaaataggtcttgttttcaatttggttacgtgcttagtttggataccatgatacatggtaaatgcttagctcaaaataacaaaatataaggattaagcattaatttttttgtttgtcttttgagacggagtctcgctctgttgcccaggctggagtgcaatggtgcgatctcagctcactccaaattccatctcctgggttcacactattctcctgcctcagcctcccaagtagctgggagtacaggcgcctgccaccacgcccggctaatatttttttgtatttttaatagagaaggattttcaccatgttagcaaggatggtctcgatctcctgacctcgtgatctgcccacctcagcctcccaaagtgctgggattacaggcttgagccaccgtgcccgtctggattaagcattaatttttttatagtcggcctctatcgttgtcaaggaattccagatggagggattgttatctgagtataaaaatgtgtatgcactcaagtaattcatagagtacatccaaggtgcataaatgttttgagtggccagtggcctactcaactatgaaacatatcaataatctttatatgcattaatctttgatggataaaattgatatattgtgttttcacacacattgattttaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtgagtgaatgaatttatttatgaatatttttcctgatatatctgaagtttaatttttaaatagcatgaaaagtgacttataatacagaattcaccaacaaaggcacttaaatgcatcaaattttggtaacaaatattaattttcacttcattcatactgtttcaccagtcaacttttgtttgagtattttctttatagtttacctatcacgagctttacctaaccactagtgaggttttaaaatagacttaggcagtcaactactagctttctaaaaagtaatacaggaaaaggatatatagccacaattacttgaaaaacaaatttcagtgtttaggaaatttgctagtcctttcatttttttctccttgataccagataaggacgaatggtacattgctgtactgcagtgttttgatatccatatcatacttggctttcaaatacagttcaccgttattctactttggcagaataaacaagtattggactatgaacagccaagttcagcccgaggggaagtcactgaaagtagatctagggaacaattgtgtccatatagttattttattagaaacaaatacagcgtaaaatattacgtggggttttcaataaaaaaaaaaccttttttatagaagtataacatgttcataacaaaacatcataaaatatggataagcataaatcattatataaagcacttggcacccaatctatatagaatagcctttcaagcaatatggaatgttaaaactagctatatctgtgtatctgcagcttatagtaaagtttgtggctctttgtacgttctatccatcaatattgtcagttcatgtgtatgtgtatgtgtatgtgagtgtacacagatgttaacagtttccctatgagcaggatttggtgggatttttcctcaaaaaagaattaaaaatattaatgcagtgttgtatatagtcaagaaagaggcagggtcacctaattttttatggaatgactttcttggcttaccccttgcaaggcttcttttctgtttcaattatgcttcctgtataataggggcagtaaactatacttgacctctactataggcttattaaatatagtcagaatctaagagataacctagagattatctgtccttattccttatttcttcatttccattgtaagaaaatgaggcccaaaataggaaagtgatttcactactgagtgctctgaatttcttgatggtaggtaactaaaaagtgaaggattttcgtgtgagtccagtgctaatagctcatactatatcagaatatcaccagttcctctaattcacttatagtttaacacttgagtagcttgctttgccaaagttatttcatggatgaataatatcatcctaacttgcctcttctactcattcttggaaggtatacctggagtttcagggccaaaaggttatcagggtttgcctggagacccagggcaacctggactgagtggacaacctggattaccaggaccaccaggtaagtgtgataggccatttgtagcaattgcttagctgacactgaattctggataaataattatgtgtttgtcatgtttgaagatgctgtggatttgatcatggtaataagcttgggtagctactgaaatatggagctcactttcggcaaaaatattgccctttggctctagttttagcagtccagattttataggatattttgccttgattattcagtttcttctttttgtggcagcagggtatacacagaatcagaaatgtgatccaaataaggtgttgtgttttgttacatacattgcaaaatatataaatgagacaattatctcatgaaggcctgaagaattcatcttgtcctgcttttttttctttctgcctttagacaagtcagtcattaaaccatgtaaaacagatggctattgattctatttttttaaatttctaggcatgaaaatttcacaaattctcttggtagtcagttacagcattaatcactcttagagtcgacatttttttaaatcctactaaaactctttcttgtttcttcttcagccactttcttttagtttgtttcctaaggaaataaagagcagcagtccccattcttacaaagtcccttaagttcagttatttgcgctagactccatactacatggccttgatatagttgggaagagaaactcccttcctatctctccctcacatcttctgcattctcttttccaagttagaagtcattgtaaaggaaaaaaataaaataaaaaaagtttaaggcaatactgtggtcctaggaaaaaacccagatgacatcacagagctcaagcacctatgtgctaggaaaaatgtacaaacagagcagccatgcctgttcaggtcactgcccagtatctgtccaccacctctaatctctccctggcctaatgtactaaactatatcataacaggttaccaccttttctctttctgatctcatataatcacgctctacatgagaagcccatctctgaatcttttaaaaaacagacttattatattggatttatctgtgaaaatacattaagggtagttgtacacatacagcaaatagcacttcaggtgattggaattgttttagggaaagaaacaaggtgttctggtaactttttaatttttttttaaagttatattaggagacctctattactatggttatattgtaatatgttcccaaggagatgttttatgttgggttctatctgtggaccttaatcatatattcagatttaatccatctaatcccatgtttgcattttaatgactatccattcccatgaaaccagacaaccccaatattgctacattgtcttaattttaccaatttgacctttctaggtcccaaaggtaaccctggtctccctggacagccaggtcttataggacctcctggacttaaaggaaccatcggtgatatgggttttccaggtgagtgatgaaaatcttccaaatatttagtcccattaatgaaaggtggttcaatatctctttttttgtcagaaaagaggctggtgttgatagaatcagactgaaacgatatctgaggtaatcagtgggtagtgttctcttgttacacaaatatttaaaatgggaattaagggacaaaattgtagaaaccttaaaagttataattcacaaacatcttttctccagctatacccccttttatttaaacttcctttaaaagtaggcttttatataattgtgtttgtgaggctcattattatctaactcagagtttgcggagctttttaaaaatctttttgctttgtcatatgcatcttagataatccacaagtaaagcatattttgtaaaatattatatatcacatattttcaacagggcctcagggtgtggaagggcctcctggaccttctggagttcctggacaacctggctccccaggattacctggacagaaaggcgacaaaggtgatcctggtatttcaagcattggtcttccaggtcttcctggtccaaaggtaatctttggcatatagttttaggcacatacttgagcagatatgaaattttttaatactatgctcattcctaagttttcattaaacaaactatagaatgacatagtatattctggataagagatttattccttttcttttctcttagatgataagaagatatgttttagggtttgtggccagtccaaaataaaaagggaaaactttctggtttctttgtttttcttctatcttaatttctggatatacttcaataatctcaatgcctagatttttctggtcttgttagtccatccctttttagtgatggagttgttggcctttgtcctaatgttattattaactaatttgaaaagacttataaacaaagtgacagttaatgctaatgtagtagtattcttaactgcgtgtctgagatagtcctctgaatacagttttacaattccctctacttctctcttcaatgtgaaaactttggtggtgtttctcaagtaatcaaatttagaatttgtttcagaatcattggactcaacaggaatttatttgacaattgtttagttccatgtcaaaaagtagtaactccttaatcatgtagtcagaccacagacctaaaaagtattagaaaaggaattttggtactcagttttcatggaaatagtgaaagttcccagtgatataagaatttattgaattgtatgtaaggataatttttcttttaatattatataaaaatactttattttgatcatctaattgatcaatgtcttataaagagataatcaagagaagtttctgtatgttcattccagtttaacaatgtaaagtttcttgaagtgaattttaattttctctgttatatttatattttaccagtgacattgaatatatgattttattaaaaaataatatagacatattaagggtaagagtgaaaatcttcttcatgccccatcctctttttaccattcctttcctcatagaggcccactgtcaatagttgatatataaatttgaattccttgttctatacatttatatatatgcatatagagtttggggttttttctacacattgtgtatatgtagaatcatggtatgcatgctactctgtaccttgctttatcacttacccctttttatttcttttttcaatatatcttagacaattttctttgtcgtcatacattatatctgtggacatatatgtagttatttatactgtatagtttcataaaagtgtaattgttggatcaaaggataagtgcatttaattttttggctttttaaaacacttataataatgtaacatatgaacttgattttaaaatacaaccagtatgaaaagatgtaaaataaaaagtctcctttttacatgtttgcaaaccccaaatccccagttcttcttctccagggtaaccacttttagtagtttctctcatattcttcaagaaaggttttctaaatgcatttatatgcatgcatatatggtatttcatcaattttaatactcattttttacatccaaaatatctaatattggaatgcatcttattatgatggaaagcatattacaattaaaattgtaaatatttttccccaattattgatacatgaaatgatgctggaccttccaaatgtagatgttttctcatattttaattaatatatacaaaattatactatacatctgctctgtacctagctgtcatcacatagtaaatcttgacaaactttctttatcagcctataaatgtatgccttattattttttataattatatagtatttttatgggggttcactataaataatttaacctattatgaatatgaaaattatttctaggttcatgattacaaacatattttgcactgaagattcttatccatattcttacatacatatcttaagaatctttggtaaatatcaccatagaataaattctgagcagttgctagaacccagcatatatgtgcctttttaatatctatatttactgccaaattttccaattaagtaactctacacctttatactttcatgattagtataagtgattttctcctcattctacagatattgggtgttatcaatttaaaaaattttaccaatctaatgggtgaaaagtagtgtatcattattgtttatatttgaattttcctgattacaagtggggtttcagatgtttttaactctttcgtaaattgtctatttatactctttgcctcactgttttacgagaggacttggttatgtatttcatactgatttgtaaaagtacattataaatgtgaagatgcatccactgtctgttatatttgttgcaaatattttctcccagtcagttgtttgtcttatagcatgtttactgtgcatttcgttatgtagatgtttgaaatttttacataggcaaattatgtactcatttatttattcattcacaaaatatctgttgagtatgtatgatttaccaggtactgttttaggtgctggagatacagcctgaacaaaacagacaaacttttactgccttcaaggagcttatatttagtcaaggagtcatacaataaacaaaataaataagtctgtattatgttagaatgtgataaatctcatgatgaaaagtaaagcaagacttgatgataggaatttctggaaattgttatattttgaaataggttactaagggaaagtctctctgataagatagagcagtgaccacactgcagtaagagagtaagtcatacaaaaaccctgaggtgtgagcatacctgacatgtttgagaaacataaatgagtccagtgtgttaaacagaatgagtgagttgaaacaaagtaggagatgagattagattggtaatgggggaaagattatatagtgccttataggtcatcatagtaggggcttttactcctgagtgaatcggggagcaaatggaaagagttaacatgattgtacattaattttaagaactatcacagcacctgttttggaaacagatcatagaggagcaaggatggaaagcagggaaaccagttatggtgatatttaaataatgcaggctaatgatgttgatggcttggatcaagatagtggcaggggaagtgataagaaatgggcagattttgaatatataatatatgtcaagccaggaagatttgtgtatggaatatgagagagaggaatcaagaatgactccagtttttatcctgagcaaatagagtggagttgctatatgctgaaatacaaaaactttgaaaaaagcaggtttagtgagaaagatcaggagcatagttttttattttatttatttatttatttgttttattatactttaagttccagggtacatgtgcacaacgtgcaggtttgttacatatgtatacatgtgccgtattggtttgttgcacccattaactcatcatttacattaggtatttctcctaatgctatccctcccccattcccccaccccatgacagggtgtgtgatgtcccccgccctgtgtccaagtgttctcattgttcaattcccacctatgagtgagaacatgcggtgttcggttttctctccttgcgatagtttcctcagaatgatggtttccagcttcatccatgtccctacaaaggacatgagctcatcttttttatggctgcatagtattccatggtgtatatgtgccacattttctcaatccagtgtatcatggatggacatttgggttggttccaagtctttgctactgtgaatagtgccacaataaatatacatgtgcatgtgtctttatagcagcatgatttataatcctttgggtatatacccagtaatgggatggctgggtctaatggtatttctagttctagatccttgaggaatcaccacactgtcttccacaatggttgaactagtttacactcccaccaacagtgtaaaagcattcctatttatccacatcctctccagcacctgttgtttcctgacttcttaatgatcaccattctaactggtgtgagatggtatctcattgtggttttgatttgcatttctctgatggccagtgatgatgagcattttttcatgtatgtgttggctgcataaatgtcttttgagaagtgtctgttcatatcctttgcccacattttgatggggttgtttgattttttcttgtaaatttgtttaagttctttgtagattctggatattagccctttgtcagatgagtagattgcaaaaattttctcccattctgtgggttgcctgttcactctgatggtagtttcttttgctgtgcagaagctctttagtttaattagatcccatttgtctattttggcttttgttgccattgcttttggtgttttagtcatgaagcccttgcccatgcctatgtcctgaatggtattgcctaagttttcttctagggtttttatggttttatgttcaacatttaagtcttaatccatcttgaattaatttttgtataaggtgtgaggaagggatccagtttcagctttctacttatgactagccagttctcccagcatcatttattaaataggaaatactttctccatttcttgttttggtcaggtttgtcaaagatcagatggttgtagatgtgtggtgttatctctgaggcctctgttctgttccattggtctacatctctgttttggtacgagtaccatgctgttttggttactgtagccttgtagtagagtttgaagtcaggtagcatgatgcctccagctttgttcttttggcttaggattatcttgacaatgtgggctcttttttggttccatgtgaactttaaaatagttttttccaattctgtgaagaaagtcattggtagcttgatggggatggcattgaatctataaattaccttgggcagaatggccattttcacgatattgattcttcctatccatgagcatggaatgttcttctatttgtttgtgtcctctttcatttcgttgagcagtggtttgtagttctccttgaagaagtccttcacatcccttataagttgtattcctaggtattttattctttttgaagcaattgtgaatgggagttcactcattatttggctctctgcttgtctgttattggtgtataagaatgcttatgatacatctctagaactcttcaccccaatcaacagaatatacattcctctcagcaccacattgcacttattccaaaattgaacacatagttggaagtaaagcactcctcagcaaatgtaaaagaacagaaatcataacaaactgtctctcacaccacagtgcaatcaaattagaatttaggattaagaaactcactcaaaaccgcatgactacatggaaactgaacaacctgctcctaaatgactactgggtacataatgaaattaaggcagaaataaagattttctttgaaatcaatgaaaagaaagacaacattccagaatctctgggacacatttaaagcagtgtgtagagggaaatttatagcactaaatgcccacaagagaaagcaagaaagatctaaaatcgacaccctaacatcaattaaaagaaccagagaagcaagagcaaacaaattcaaaagctagcagaaggcaggaaataactaagatcagagcagaactgaagaaaatagagacacaaaaaacccttcaaaacatcaatgaatccaggagctggctttttgaaaacatcaacaacattgatagaccgctagcaagactagtaaagaagaaaagagagaagaatcaaatcgacaaaataaaaaatgataaaaggaatatcatcaccgatcccacagaaatacaaactaccatcagagaatactataaacacctctatgcaaataaactagaaaatctaggaagaaatggataaattcctcgacacatagactccccccaagactaaaccaggaagaagttgaatctctgaataggccaataacaggctctgaaattgaggcaataattaatagcctaccacccaaaagaagtccaggaccagatggattcacagccgaattctaccagagatacaaagaggagctggtaccattccttctgaaactattccaatccatagaaaaagagggaatcctccctaactcattttatgaggccggcatcatcctgatatcaaagcctggcagagacacaacaaaaaaaagagaattttagaccaatatccctgatgaacatcgatgcaaaaatcctcaataaaatactggcaaactgaatccagcagcagatcaaaaagcttatccaccaagatcaagttggcttcatccctgggatgcaaggctggttcaacatatgcaaataaataaacgtaatccatcacataaacaaaaccaaagacaaaaaccacatgattatctcaatagatggagaaaacaccttcgacaaaattcaacagcccttcatgctaaaaactcaataaactaggtattgatggaacgtatctcaaaataataagagctatttatgacaaacccacagccagtatcatactgaatgggcaaaaactggaagcattccctttgaaaactggcacaagacaggaatgccctctctcactactcctgttcaacatagtgttggaagttctggccagggcaatcaggcaggcgaaagaaataaagggtattcagttaggaaaagaggaagtcaaattgtccctgtttgcagatgacatgattgtatatttagaaaaccccaccgtctcagccccaaatctccttaagctgataagtaacttcagcaaagtctcaggagcatagttttttgattgtcaatattttgttgctgaaataggaaattcatcaattgagggggagagagaggaagaggtaaggaaggcttgaggcctgtcacatagattttaggattttttggaaaaaaagtcttctacttatgaagacttctatatcctgagattataaaaatagatttatatatttcttacaggattttcatggtttttttctgtacatttgcattttaatgcacctgagtatttctgtatgttgtatgaggtgagaaactaactttattttttttcccaaataaatatccagttgactgagcctcatttgttacaaactcaattctttattcactgatataaaattgtatttaaattttttttccaaatttgttcatgaatttttttttctggaatgagtgaattttaacattttactaatggaatcaaaattaccataataaattgtctctacatttttaatgggtgatagcagaaaaatatgttttaattggtaaatgtccaaagtatattcaactctacaagcaagaggttagcttttagttcttctgtgtgacctacaagtatatttcagtaagcaaattttacactaaatttagaaacttaacaaagatgatattgtggaaataatgtaaagtagtctgttgtttctttcagatggcattattataccttaaaatagtgacatgttgaaaaaataaaagtttttttagctcagttctattaggtacaggtgatctttgcttttgcacaaatttcagttatcattacttaacaccgatccacaacaacattgtttaaattttagttgctatgatatattaactcttccatttataaatcatcatctaaataagagatgtgcattacaatcagtggacagtaatttcacttctttcaaattctgtcactaattagtaaccatgcatctgttcagttcctgcactgacagcaaagcatttagttgtgtcacctccttgtctcccagtgataaagcaatgtgacattttacaaaaatggataatcaaaagagaaaattagccaacaaagaagaaagtgcaacaaaaaaaaaaaaaaaggaaagtgatagcactggaagtaaggtttgaatctaaagtaaatggggttatagaattaatagccaaccatagaattgtagacactgccaccatttgagagactctagatatgcagctaaggaacttagtgaaggcaaacttatcaacattaatgaggaaaggagcactgatgaaaaggatgaagatgtcacagaggaagtgttgccatcacaaatttcacattaaaggaactcttggagatattttacaagtttgaaagtataaaggttaacatgctggaagctgatctcagtttagaaacagtgagacaatttctgtgccaaggcatagaaaagatgtgtgctctgtattgtaagttatacgagaagaagggagacactgttcaaattactcttggtaacttttttacaatgaaataaatcactttatttttcaatgtttctaatgtttaaattagcatttaccaaataaatattggatttactattttttatttctttatacatgtgtatctgacattaaaacatattttaatgttttgataacatttttaaaggtcatagaataattacattttcccccattgattattaagatcactttacatgattttggtttgcagtttcatttttccagttccacactaccacgtgaaacaaagagtacccatattataaaggaagagaagaagaacagttttaggaaatataatggtatgattgagggaaaacaagcataagacaaatttctgtaattactgagttgttaagaaataggaatagtggtaaaatatcagataggtagtttgttttatggatgtcactgtttatgaaacagcagctctgttagtcaaaaagcatgattaataaagtatactgaaaaccccagacaaggagtcagtaggcagaaatttgagtcctgggtttgtgtacatgaccttgataagtcacttaattcttcagtgtcttcagtaccttgtccataaaaagtgggagaaaaaaaatcctactttttgtagttattgtgaggtttcaatgagattaaaacatgcttcataaaaaagaaaaaaaaggaaaaggaatgaaacactttgtaaattataaagcattctatacatagtatttctttttatctaaaatgaaagggctggagtagagggtgtctaagatatctggaattctcaaatataatgactctatggaactatatgaatctgtaatgctcttttaatatagtgtaattgttctaaccttcataactcctttttaaaatctaatcatactacagattcatccctttcataatcccagatggcttttatgctgaaattgacaagtgtatcctaaaattcatatggaagtgcaaggaacccagaatagtcaaagaaatcttgagaagaacagatttggaggactcactcttctggatttcaaaacttactacaactatgataccagcactgggtagacatagagactgatggaatagatagagtccagaaatacccatacatttttggtcaactgattttcaacgtaggtaccaaaacaatttaaagggagttaaggatagtcttttcaacaaatgatgctggaacatggatgcagctggaggctactatctatcctaagcaaattaatgcagaagcagaaaaccaaatagcacatgttctcacttaaagtttggaggtaagtattgggtatacacagatgcaaagatgggacaataaattctgggtattcccaaaaggggtaaggagtgggggaagtgttgacaaacctatggagtactatgttcactacttgggcaatgggaacattagaagcccaaacatcaacatcacataatatacccatgtaacacacctgcatacataacccctggatctaaaataaaaaacaaaacaaaaatcaaatcatgctgggaaaagaggatacctgtctgcaaaagaatgaatctggacccctatctcatactgtatacaaatattaactccaactggattactgacctaaatataagaactaaaccataaacatattaggataaaagatgactaaattcttgtgaccttgcattaggtaatggtttcttagctatgacactaaaagcacaaacaactaaaggaaaaataaattgggctatattaaaattcattaggtaatggtttcttagctatgacactaaaagcacaaacaactaaagaaaaaataaatggggctttattaaaatttaatgtgttttctgttgcaaatgataccatcaagaaagtgaaaagacagctcacgagatgaaagaaaatatttgcaaatcatatatgagataaaggatttgtatacagaatatataaagaattcttataattcaacggaaagcaaataactcagtttttaaaagtgcacaaagtgaattggacctaacaaacatatacaaaatattctatccaagaaaaatgcagaatatacatttttgcaactgcacatggaacattctccagaatagacaatatattagagcacaaagtaagtcttcatacacttaaaaagattaaaaccacacagcatatattttttaatcatgatggagtgaaattagaaatcaatggcagaaagtaaactggaaaatctactaatgcatgtaaattaaacaagacgctcttaaccaatgaggcaaagaagaaatcacgagggtagttagaaaatgtaatgtctttttttttttttttttttttttgacagagtcttattctgttacccaggttggagtgcagtggcgtgattgtggctcactgcaacctctgccttccaggctcaagcaattctcatgcctcagcctcctgagtagctgggattacagatacgcaccaccatgcttagctaattttttgtagagatggggttttgccatgttggacagttggtcttgaactcctgacctcaagcaatccaccctccttggcctcccgaagtgctgggattacaggcatgagccaccatgtctggcagaaaatataatgagacaaatgaaaatgaaaccacaacataccaaaacgtacaggatgtagtgaaagcaatgctaaatgggaaattaatagctgtaaatacttacattagagaagaaacatctcaaatcaaaaacctaactttacatcttaaagaactagaaaaagaaaaactaaatccaaaactagcagaaagaaagaaataataaagattagagcagagataaataaaatacagaactaaaaaaatcatagatgaagtcaacaaaactaaaagttgtttcttcaaaaagataacaaaatagaaaaagttttagctagcttgactacaagaaaaagagagaagactcaactaaaatcagaaataaaagaggagacattactaccaatcttacagaactaaaaatatatgagactgctatgaacaggtgtttgctaacaaattagataacctggatgaaatgggcaaattcctagaaagacacaatctaccaagactgaatcatagaagtagattatatgaatagacctaaagtgagtaagaagattgactcagtaatcaaaaaccttccaataaagaaaagctcaggaccagatggctacactggtgaattctaccaatctttttttttttttttgagacagggtctcgctatgttgcccatgctggatggagtgcagtggtgcagttacggctcactgcagccttgtccttgtgggctcaagtgatcttcagcctcccaaatattttccaaacaattaaagaaggattaacagcatttgttttcaaggtcttccaaaaaaattgaagaggagggaacacttccaaactcattatattatacctggattaccctgataccaaatccagacaaagacactacaataaaagaaagctacagaccaaaatcccttatgaatattgatgcaaaaaatccttaacaaaatactagcatactgaattcaacagcatattaaaaggattatatgccatggtcaagtgagattttttcctgggatgcaaggatagttcagcatacaaaaatcattagtgtaatacaccatcacactaacagaatgaaggagaaatcccacatgatcacttaattaatgcaaaaaaaagcatttgacaaaattcaacactgtttcatgattaaaaaaacacaccacaagctaggaatagaagcgaactatctacttattataaaggtcatatatgaaaaaacccacagctaacaatggtaaaagtctgaatgcttttcctctaagaccaagaagaagttaaggattcttaattttactacttcctttcaacatagtactggaattcctagccagaccaattaggcaagaaaaagaaataaaagtcatcttaattggaatggaagaagtaaaattatctttgttcagagatgatataatgctatgtagaaaactctacaaagataccatatatgcggaaaataggtagaactaataaacaaattcagcaaagattcaggataaaaaatcaacacacagcagtcagttttgaatgttttgatgcatcaacaatgaacattccaaaaaggaaattaagaaaattaaatttacagttgcatcaaaaagaataaaatacttaagaataaacctaaccaagaaggtggaagacttgtgctctgaagactacaaaatattgctaaaaggaattaaagaagacagaaataaatggaagatttaatactgttaaaatgtccatactacccaaagcaatacacagattcaatgcaacgcctatcaaaactccaatggcatttttttttccagaaacgaaaaacttagtctaattcacaaggaaatctcaagggaccccaactagccaaaacaattctaaaaaagaaccaggttggaggactcataataattttttattagaaaacatattacaaagttatagtaatcaaagcggtgtggtgctgacataaagacagcaaatagaccaatgtaatagatagaccagagataaaatctctggtctgtagttgaatgatctttgacaagggtgctcaatggggaaaggcgttcaacaaatgcatgctgggtaaaatgaatgtccatatgcagaagaatggagttgaaccattttcttacatcatatataaaattaattcaaaaaagaatgaagacctaaatgtaagacctaaaactataaaactcttagaagaaaacatgggacaacatgcctcatgacattagatttttttcaatgatttcttggatatgacaccgaaatcacaggcaacaaaagaaaaaatagattaattggacaacatcaaaatgttaagcttttgtgcatccaagaacactactaatagagtgaaaaggcaactcatgggatggaagaaaatatttgtaaattgtatatctggtaaaagattaatttccagaattttaaaaagaactcctacaagtcaataacaaaagccatcaaacaacccaattcagaaataagcaaatgacttgaatagacctttcttcaaagatgatatacaaatggcaaattagtacatgaaaagatggtcaacatcactaatcattagggaaatgcagtcaattctacagtgagataacacttcatacccattaagaaggctattatataaaaaacagtaaataacaagtgttggtgaggatgtggagaagttggaactctcctgtattgctagtaggaatgtaaaattgtgcagccactatggaaaacattatggcagttcttcaaaagtaaacacagaattatcatatgatctagcaatttcacttctggagacacatctaacataattgaaaacaaaaatgggacctcaaagagatgtttttgtagccatgcttctagcaacattattcacaagtcacaaggtggaagcatcccaaatgtccattgatagaggaatgtgtaataaaatgtggtatgcacacacaatagatattttttgaccttaaaatggaataatattctgatacatactacaatatggattaactttgaagccgttatgctaagtgaaataagccagttataaaaagacaaatattacatgaccccagttacataaggtacctagaacagtcaatttcatagagacagaaggtagaatggtaattgctcagggttgggggaggggaaaataaggagatattggccaaagggtacaaacatttagttagttataagatgaataaactctagggatcaaatgtacagcatgggcactatagtttaaaatattgtgttgtatacttgaaatttgttgagagtagatcttaattgctttcaccacacactgaaaaaaaaattgtaactcggtgaagtgctagatgtgttaactaatttcattgtggatatgagtataaggtttccgtttgggttgataaaaaaaattctggagatatatggtggtgatggttgcaaaaagtgtgaatgttgtttatgccacaggactatacccttaaaaataattaaaatggtaagatttatgttttgtatattttgatactctaaaaagccacataaaatgaaaatattaattagcttgatttaatcatttcacaatgtatacatgtatcataacatcacatcatactctataaatgtatatagtttttatcagttaaaaataaaatatttttaagtgaaaaaatgaacaaaggaattgaatagctatttctctaagaaagatgtacaaatggccagtatgtacatgaaaaggtgtttaacctcattagtcattatgaaaatgcaaatcaaaaccacattgagataccacttcacacttacttgagtaggcataataaagagagaaaataacaaatgttggcaaggatgtgaagaaattagaacccttttgcattgccagtgggaatgtaaaatgatgcagctgctgtgaaaaaatatttgacagtgcctcaaaaagttaaataaagagttatcatatggctcagcaattccactcctaggtattttcccaagagaaatgaagctgtatttctgcacagaaacttgtacttgaatactcacagcagccaaaagtgaagaaaacccaaatcacaagaatggctaaacaaaatgtgctatcccagagaaaattgaggagagtgaggatcatcatggtggacgggagacaggactggattacagctccaactcggacagacagagcagcatacagaggtacgcattgtgaatttagttccagatcaactgcaacaacaaaccagtaatcacaagaggatgcacagaccctctgaaggaagtggacttctcttgcaggacccaggagacaccccaaatactgtgagtgccccaaatatagaagtggaaagtggagatccttctctcccaaatacacaccgccactggagaaactggaggtctgtttgtgggagaagtttctgaccttacctggagctgagtccatttagagagccaagtgaaatacaggggtagaggaagcagcaggaaaggccctgggggcttgctgggtcaccaagcaggccattcctgcctggcaccacagggatccatcgggagggcagccagaggagtggaggaaagcaccacagggagaaggaagcctccagctgaactttgtaacaatttgaaccaggcgagaagcctcctggccagaactcgggggagggcatgaatccagtgtgcagactccacagatgggggaagaaccaagcccttttcttttgcagcttggtggcaggtagcctgcggcaagttctcaagccctgctcacccaccacctggaaacagacttggggctgttaataggggcacagtgggagtaagatcggccctttgatttgtgtgggagttgggtgaggcctgtgactgctggttttcccccacttctctgacaatctgcatgactcagcagaggcacccataatcctcctaggtacacaaccccattgatctgggaacctcacctccatcccccacagcagccacaataagacctgcccaaggagggtctgagctcagaggtccctagccctgcccccacctgatgagcctttcctatccaccctagtagctgaaaacaaagggcatataatcttgagatttctagggccccacctaccactggttcctctccatactaccacagctgatgctttctggaaagtgccacctcctggcaggaagccaaccagccccaaaatagagcattaaaccaccaaagataagaaccctcacagagtacatttcaccccctgccacctccactggaagaggtgctcgtacccatggctgagagaccatagacagttcacatcacaggactttgtgcagacaattctcagtagcagctgagagctgggtagactttctgggtggctaaaccaagaagagagacaataatcactgcagtgcccctcacaggaagccacatccataggaaaagggggagagtactacatcaagggaacatcccatgggacaaagggatcagaaaaacagacttcagccctagacctaccctgtgacaaagcctacccaaatgagaaggaaccagaaaaccaactctggtaatatgaaaaaacaaggctctttaacactccccctctccaaaaaaaaaaaaaaaaaaaaagtcacactagttcaccagcaatggatccaaaccaagaagaaatccctgatttacctgaaaaagaattcaggaggttacttattaagctaatcaaggaggcaccagagaaaggtgaagcccaatgtaaggaaatccaaaatatgatacaacaattggatggagaaatattaaaggaaatagatagcataaataaaaacaatcaaaacttcaggaaacaatgaacacacttatagaaatgcaaaatgctctggaaagtctcagcaatagaattgaacaagtagaagaaagaaattcagagctcaaagaataagaaaatataaacaaagcctccaagaagtctaagattatgttaaacaaccaaacctaagaataatcggtgtttctgaggaagaagagaaatctaaaagtttggaaaacatatttggggaataattaaggaaaacttccccagccttgctagagacctagacatccaaatacaagaagcacaaagaacacctgggaaattcatcacaaatcgatcattgcctagggacatcgtcatcaggttatctaaagataagatgaaggaaagaatcttaagagctgtgaggcaaaagcaccaggtaacctataaaggaaaacctgtcagatcaacagcagaattctcagcagaaaccctacaagcttgaagggattggggccctatcttcagcctcctcaaacaaaacaattatcagccaagaattttgtatccagtgaaactaagcatcatatattaaggaaagatacagttgttttcgcacaaacaaatgctgagagaattcgccactaccaagccaccacaacaagaactgaggaaaggagctctaaaacttgaaacaaatcctggaaacacataaaaacagaacctctttaaagcataaatcacataggacctacaaaacaaaactacaagttaaaaggcaaaaataaaaaccccaaaataccaaggtacgcaggcaacaaatagcatgatgaatgcaatggtacctcacatctgaatgctaacattgagtgtaaatggcctaaatgctccacttaaaagatatagaactacagaatggataagaactcaccaaccaatgatctgctgccttcaggagactcacctaacacataaggactcacataaacttaaaggagtggaaaaaagcctttcatgcaaatagacaccaaaagcgagcaagagtagctattgttctatcagacaaaataaactttaaagcaacaacagttaaaagagacaaagagggacattctataatgctaaagggccttgtccaacaggaaaatatcacaatcctaaatatatatgcacctaacactggagttcccaaatttataaaacaattactaatagacctaagaaatgagatagacagcaacacaataatactgaggaacttcaatcctctactgacagcactagacaggtcatcaaaacagaaagtcaacaaagaaacaatagatttaaactataccttggaacaaatggacttaacagatatatacagaacattccatccaacaaccacagaatacacattctattcaaaagcccacgaactttctccaagatagaccatatgataggccataaaagaagcctcaataaatttaagaacattgaaatcatgtcaagcactctcagaccacagtggaataaaactggaaatcaaatccaaaaggaatctgcaaatacatggaatttaaacaacttcctctcgggccgggcatggtggctcacgcctgtaatcccagcactttgagaggccagtttgggcagatcacctgaggtcaggagtttgagactagcctggccaacatggtgaaaccttatgtctactaaaattacaaaaaatagctggggatggtggcaggcacctgtaatcccagctactcaggaggccaaggcaggagaatcacttgaacccgggaggcggaggttgcagtgagccgagattatgccactgcactccagcctgggtgacagaacaagactccgtctccaaacaacaacaacaacaacaaaaaaaaaaaaaaaaaagaaagcaaagaaaagaaacatgctcctaaatgagcattgggtcaaaaatgaaatcaagatgaaaattaaaaaattgtttgaactgaacgataataatgatataacctatcaaagcctttgggatacagcaaaggtggtgcaaagaggaaagttcttagccctaaatgcctacatcaaaaagacgaaaagagcacaaactgacattccaaggtcacacctcaaggaactagagaatcaagaacaaatcaaacccaaacccagcagaagaaaggaagtcaccaagatcagggcagaactaaatgaaattgaaacaaaaaagaattgcaaaagataaatgaaacaaatagctgcttcttcaaaaacataaataaaattggtagaccattaccaagattaagaaaagaagagagaaaatccaaagaacatcattaagaaatgacacaggagatattacaactgacaccactgaaataaaaaagattattcaaggctactatgaacacctttatgtacataaactagaaaacctagaagagatggctaaattcctggaaaaataaaaccctcccatctttttttttttttacaattagtattaaaatgggaagcatatctagctcccagatcttggttacttttttttaaaattattattattatactttaagctttagggtacatgtgcacaatgtgcaggtttgttacatatgtatacatgtgccatgttggtgtgctgcacccattaactcgtcatttagcattaggtatatctcctaatgctctccttcccccctcccccgaccccacaacagtccctgatgtgtgatgttccccttcctgtgtccatgtgttctcactgttcaactcccacccatgaatgagaacatgcggtgtttggttttttgtccttgcgatagtttgctgagaatggtagtctccagcttcatccatgtccctacaaaggacatgaactcatcatttttaatggctgcatagtattccatggtgtatatgtgccacattttcttaatccagtctatcattgttggacatttgagttggttccaagtctttgctattgtgaatagtgccacaataaatatacatgtgcatgtgtctttatagcagcatgatttataatcctttggtatatacccagtaatgggatggctgggtctaatggtatttctagttctagaaccctgaggaattgccacactgacttccacaatggttgaactagtttacagtcccacctacagtgtaaaagtgttcgtatttctccacatcctctccagcacctgttgtttcctgattttttaatgatcgccattctaactggtgtgagatggtatctcattgtggttttgatttgcatttctctgatggccagtgaggataagcattttttcatgtgttttttggctgcataaatgtcttcttttgagaagtgtctgttcatatactttgcccactttttgatggggttgtttgtttttttcttgtaaatttgtttgagttcattgtagattctggatattagccctttgtcagatgagtagattgcaaaaattttctcccattctgtaggttgcctgttcactctgatagtagtttcttttgctgtgcagaagctctgtagtttaattagatcccatttgtcaattttggcttttgttgtcattgcttttggtgttttagacatgaagtccttgcccatgcctgtgtcctgaacagtattgcctaggttttcttctagggtttttatggttttacgtctaacatttaagtctttaatccatcttgaattaatttttgtataacgtgtaaggaaggtatccagtttcagctttctacatatggctagccagttttcccagcaccatttattaaatagggaatcctttccccattgcttgtttttgtcaggtttgtcaaagatcagatagttgtagatatgcggcattatttctgagggctctgttctgttccattgatctatatctctgttttggtaccagtaccatgctgttttggtgactgtagccttgtagtatagtttgaagtcaggtagcgtgatgcctccatctttgttcttttggcttaggactgacttggtgatgcaggctcttttttggttccatatgaactttaaagtagttttttcccattctgtgaagaaagtcattggtagcttgatggggatggcattgaatctataaattaccttgggcagtatggccattttcacaatattgattcttcctacccatgagcatggaatgttcttccatttgtttgtatgctcttttatttcattgagcagtggtttgtagttctccttgaagaggtccttcacatcccttgtaagttggattcctaggtattttattctctttgaagcaattgtgaatgggtcttcactcatgatttggctctctgtttgtctgttattggtgtataagaatgcttgtgatttttgcacatcgattttgtatcctgagactttgctgaagttgcttatcagcttaaggagatttggggctgagacgatggggttttctagatatacaatcctgtcatctgcaaatagggacaatttgacttcctcttgtcctaattgaataccctttattttcttctcctgcctgattgccctggacagaacttccaacactaagttgaataggagtggtgagagagggcatccctgtcttgtgccagttttcaaagggaatgcttccagtttttgcccattaagtatgatattggctgtgagtttgtcatagatagctcttattattttgagatacatcccatcaatacctaatttattgagagtttttagcatgaaggttgttgaattttgtcaaaggccttttctgcatctattgagataatcatgtggtttttgtctttggttctgtttatatgctggattacgtttattgatttgcgaatgttgaaccagccttgcatcccagggatgaagcccacttgatcatggtggataagctttttgatgtgttgctggatttggtttgccagtattttattgaggatttttgcatcaatgttcatcaaggatattggtctaaaattctctttttttgttgtgtctctaccaggctttggtatcaggatgatgctggcctcataaaatgagttagggaggattccctctttttctattgattggaataatttcagaaggaatggtgccagctcctccttgtacctctgaaaaccctcccatcttaaatcaggaagaattagataccctgaacagaccaacaacaagcagcaagcttgaaatggtaattaaaaaattaccaacaaaaaaaagtctaggaccagatgaattcacaacagaattctgccagacattcaaagaagaattggcaccagtacttttgacactattccacaagacagagaaagaaggagccctccctaattcattttaggaggccagcatcagcctaataccgagaccaaaaaagaaaactgcagactgatatccttgattaacatcgatgctaagatccttgacaaaataccagttaactgaatccaacagcgtatcaaaaagataatccaccatgatcaggtgggtttcataccaaggatgcagtgatggtttaacataggtaagtcaacaaatgtgatacaccacataaacagaattaaaaacaaaagtcacacgatcatttctatagatgcagaaaaaaaacattcaacaaaatccagcatcactttacaattaaaactctcagcgaagtcagcatacaagggacatacctcaatgtaataaaagctatctatgacaaacccacagccaacatagtactgaatggggaaaagttgaaagctttccctctgagaactggaacaagacaaggatgcccactctcaccactcctcttcaacatagtactggaagtcctagctagaacaatcagacaagagaaagaaaaaaagaacatccaaatcggtaaagaggaagtcaaactgtcactgtttgctgacaatatgatcgtttacctcaaaaaccctaaatactcctccagaaagctgctagaactgataaaagaattcaacaaagtttctggatacaagattaatgtacacaaatcagtagctcttctttacaccaacagtgaccaagcagagaatcaaatcaagaactcaaccccttttacaatagctgcaaaaaataaaataaaataaaataaaatacttgggaatagacctaaccaaggagacgaaagacctctctacaaggaagactacaaaacactgctgaaagaaatcatagacgacacaaacaaatggaaacacatcccatgctcatggatgggtagaatcaatattgtgaaaatgaccatactgccaaaagcagtctacaaatttgacacaatccccatcaacataccaccgtcattcttcacagaattagaaaagacaattctaaacttcatttggaaccaaaaaagtgcctgcatagccaaagcaagactaaacaaaaagaacaaatctggaggcatcacactacctgagttcaaactatactgttaaggccatagtcaccaaaacagcatggtactggtataaaaataggcacatagaccgatggaacagaatagataacccagaaatgaacccaaatgcttacagccaacggatcttagataaagcaaacaaaaacataaaatggggaaatgacacccttttcaacaaatggtgctcagttaattggctagtcacatgtaggagaatgaaactggattctcatctctcaccttatacaaaaatcaactcaagacggattaaggacttaaatctaagacctgaaactataaaaaatctagaagatatcattggaaaaatccttccagacattggcttaggcagagattttatgaccaagagcccaaacacaaatgcaataaaaacaagataaataattgggacttaattaaactaacgagcttttgcacagcaaaaggagcagtcagcagagtaaacagacaatccacagactgggagaaaatcttcacaatctgtacatctgacgaaggacgaatatccagactctacaacgaactcaaacaaatcagtaagaaaaaaaaacaaaaaacaaagaaacaatcccatctaaaagtaggctaaggacatgaatagacaattctcaaaagaagatatacaaatggccaaaaaacatatgaaaaaaaatgctcaacatcactaatgatcagggaactgcaaatcaaaaccgcaatgcaataccactttactcctgcaataatggccataatcaaaagatcaaaaaataggagatcttggtgtggatgcggtgatcagggaacacttctacactgctggtgggaatgtaaactagtacagctactctcgaaaagagtgtggagattccttaaagaactaaaagtagaactaccatttgatccagcaatcccactactgggtatctactcagaggaaaataagtcattatacaaaaaaaagataattgcacacgcatgtttatagcaacacaatttgcagttgcaaaattatggaaccaacccaaatgcccatcaatcaaagaactgataagctgtggtatatatacatatatacaatggaattctactcggccattaaaaggaataaattaatggcatttgcagcgacccggatgacattggagactattattctaagtgaagtaactcaggaatggaaaaccgaacattgtatgctctccctgatatgtgggagctaagctatgaggacgcaaaggcataagaatgatacaagggactttggggacttgtggggaagggtgggagtggggcaagggataaaagactgcaaatacggcacagtgtatactgcttgggtgatgggtgcaccaaaatctcacaaatcaccactaaagaacttactcatgtaaccaactaccacctgtaccccaataacttatggaaaaattaaaaaaaacaagcaaacaaaaaccaaagtgtgctatcccatacactggaatatcatttgacaattttaaaaaatgatgtactgatacatggtgtaaaatggatgaaccttgaaaacattatgctaagtgaaataagcaaggcacaaaatagccacatatcatatgatttcatttatatgaaatgtccagaataggcaaatctgtacaaagagaaggcagattaggttttgctacggcttggagggagtgagaatgagaaatgactgctaatgtgtacagtttcttttagggggaaatggaaaattttctaaaattagattgtgatgatggttgtacaatcctatgaagatactgaaaacattgaattgtacactttaagtggatgaattgtacggtatataaattatatctcaataaagttattttaaaacaatgcacattatagaaaatctacaaagtttctgctaataacatgtaatgtttttagttgtctttaaattactatctttattttaggatgtttttagttctagaatcctgagatttgatgaacaaatgggtgtgattttccccacaattaactttgggcacattttaagtaattgtatgtgctgtgattactagaactacacatgctgtgctagtatggaatagcatgatttatgaatcatattttttctttaatatttctttagtattttgagccacctgtaggctcattgagctgatgtttggagcaatttgctattatgcctatcttgcatggtaaagggtagtatagagctcattatcttttaagtttagttcatattctttttctctaagttcatcattaccttagacatactactattgaatttcatgtggcagctttggcctgctcaggcagccttgagccattatttatcagtttgttactgttagcttaacatttcactactgggaagagctaaataacatgcaaatttgaaggtcttattgtataattccttttctagataattaaaatgttaatggttgctcaatggatataaagcttcagttatgcaagatgagtaagttttacagatctgttatacaatatggtgcctacagttgacagtacagtattgttcaccttaaaatatgttaagaggatagatttcatgttaagtgctcttaccacaaccccccgacacaagaacatgaagaaatttttggaggtgatggatatgtgtagtactttgattgtgcttatggtatcatgggtatatgcatatatccaaactcataagtatgtatgcattatgtgcagttttatatataaattaataaagctttaaaaaagtatctctgcatgcacttttaaatttccctctgttaatattctgggtctaaaatagaacctatttatggttttgttcatggtctttaatctccaaatacagataaggttgtaaaaacattaacaattatgtgggaaccacaacttccaactgatggtctactcttgtaatattcttcttgcataaagcaagatatgatgtttactctttctcctcaaatattttccttttgttgtctttgtttcccccagtggcaatgcttctctagttttacagtggaatgcaagaacaaaagtgattagcttttttaccaatagatgtcttctgttctgtaaaatggggcaagcctgtaagtttattctgaattttgggttatagtatggaatggaggagaagatgctattactaggacatagtagagattggctatgatccaaataccattacattacaatttgaatcttaacaacaaagaagatatcaaattgactcctttttctacgtgatacaacacagtgaccttgaaagcagttctaatttcaggcttgtctttcagtgttactatagtcattagatagtttcacaatggtaaatgtgacttattaggtatgagatatttcattttcagaattatatcaaagcttgacattagaacagatgtagatatttgcagctgtgtgtccgagtcattcaaatcgcttctacctagaagtgcaaatagatttgaattttcctttctcagagtgatttgtgtccagtttgtagattttctgagcactgtcttctttatctcttcttgctttccttttttgaaattcattgttttcaatgagtttgtgtgtgaataataaaaggctagataaagcttaagctagcaaatttcagtgtttttttcagaagccctaataaaatatttactttatttttaaaaggtacttggtttgaaggagtagggccataagagtgattacagaaacggtattgagggcaagtgctggctgaacttagagactgggcttacagtagtccccccttaccaagggggatacattccaagaccccccgttggatgcctgaacctgtggataatacctaaccttttatatactgtgtggttttttttttccatctggtaacagagacagctactaagtgactcatagacaggtagtgtttatagcatggatatgctggggaaaggagtagttcaggtttcgagagggatggaatgggacaacatgacattttatcatgctacacaaaatggcgtgcaattaaaaacataaattatttatttctggaattttcaatattttcagaacacaggtgactgaaaccatggatagcaaaaccatggataaggaagaatttctgtacttttagaatttaatgtcctttagtatcataaataatccagagtttgccttctgcctttcagatttaccactagcagaatagtggaatttttttcttgttttttattttggtatatacatttaattttttcatgaataacaaaaagaatcatgatagtttattcaaaggtttcccatgtaaacacctaagatgggaccaattcaatccaaaatttaattgtatacctattatgtgcctcaaaatgaactagatatttgatttacaaggttcagaaaaaatgtatatattcccagcccaagattcttaatttttttaaataataggatgtaaggaaaaagagactttagtttaaagagctattaccataatgcagaaacatgagtcaaaaatagatcttactcacctgcaagtgtatgtactaagtgaggaaggaagtattcagtaggtgatgttgaacactagcaccttattgtaaaggtcctgatcttcatgcgcagagcagcaagccctgcagtagagatttagtgttaaggtatatgttgccattgttattgggaaaaacttgttttaattgtgaaagtgggtatgaattcttctaaggctctattggaaaaaaccttaatgcaaatattcattgagcaaaaacggttatacatatgtgaattatctcttacccaaaataaactttcaatgtaattaaggagttaagactgcatatatgaagccattgtagacatgacagagtaagaacctaccctaacctcttggggtaaactctctttgcccaggaatgcttcatggaagaagtaggatttttcttttcttgttaagaggcagggctccctctgtcatccaggctggcctgtagtggcatgatcacggctcaatatagccttgacctcataggctgaagccatcctcccacctcagcctcctgagtagctgggactacaggcatgcaccactacgcccagctgatcttttttattttttgtagagacagagtctccctttgttgcccaggctggtcttaaactcctgggctcaagcaatcctccagccttggcttcccaaagtgctacagccacaacactcagccagaagtgggattttagatgcccactgaagaattgatagacttccttatgttacagtgaaaatcacctttttcagtagaacgtactatagcttttggttgacatgtgtactggaagcaatgaattgcattatggcacagtaggaatgataaacacaggttctgaagtcagactgtttgaatccaaattcggatttcatcacttactagctccatcactataacatgggaataataacagtatctttctaatagggttgttaaggattaatgagaataatacatctacatactgtgagaatagtatgggctatgtagtctgattggctacatagctgattgtagtctggttcaaatcccagttctgccacttacaaaaaccttaggcacttggcttctcaagattcagttttctcatttataaatggagataatgaagcctaactcacagaactgttgtgatgattaaatgaagcaatttacatcaagtacttactggagtgcctgacatataataaaagctctataaataatgttatgttcttatacaatctaagtcgtgtagagacttcagtattatctttttattcgtgttttcagggtgagcctggtctgcctggatacccagggaaccctggtatcaaaggttctgtgggagatcctggtttgcccggattaccaggaacccctggagcaaaaggacaaccaggccttcctggattcccaggtaaaatttcttctcttaaatgcttccttctttccttccttatctactccaaccagtatcacagagcagcttcttatttggcagacttatattttatttcccaatcagatactgactagcaacataatctcaaactatctctttaccttttctttgcccaaatttatttctgtataaaatgagaatgaatattactgactcagcaggacaatatcctgtggacagagagactgtttggtggagcatttttcaatctttgactgctagccacaaatcacttaagaagccttgctatttttgtaggtaataatatatacttccaagcctctgcctgcagctgattatcttagaaaggtatgcccaggcacaccgctggtagcggttggtagaacaatcatacagttccttcaaatggcaaggattgagccattcaagtaagagattagcactatagtcaattatgtagcctgaactagattattatagtacctacttgtttagggttgaatttattttttgcttgttttgaattacacagtggcatggatgaatgaacctttcctttttattgaagtgaagcatacatgtagtaaagtacacttaagactatagatgagtttttacctaagtacatatatgtctttgaattgaccatatgtatcaagatataaaatagtttcttcatcccacgaagtttacccatgcccctacgccccccaaccccgaggtgaccactactatgacttccattaccatcagttaattttgcatgttattgaaattcatataaatgaaatcatacagtgatccttgtatctggcttttttcagtcatcattatgtgtaaaagattcatttattttgttacacgtgtcagtagtttgttctttatcattgctatgcaatattacattgaagaatgtaccacagtcaattacacattcccctgttgatggacttttgggttgtttccagtttgggactattatttttaaaaatgctattaacattcttttacatatcttttgataaacatatacattgatttctcttagacaaaaacttagtagtagaaatactgaatcacagggtaggtgtacattgaactttagtagatgctgccaaacagttttccaacatggtttgtaaattagtttcaacagccatgtatgaaatatccagttctccaattgcccatgtcctcaccatcactgggcagtgtcggtcttaattttatctgttttgatgagtatgtagaagcatctaattgaggtttgaatttacatattcctaatgaataatagtattaatcatctttttattatactattggccatttggatagcatctttttgaagtttcttcttaagtacttttgttcattttttattgaattgtctgtcctttttcaaatagattcagagtagttctttatatactcaagatatgagtcctttgtcagatacatatattgcaaatctattctctgtgcctcagatttgcctttcctaatgctgttgtgtaatgaacaaaagttgttaattttaataaaatccagtgtatcaatctttcctttcatgaatagtgatttttttatccaattcaataaatatttgtctatttgaggttatggaaataatcttctaatttttataacatgtttcatgtttaaactttcatatttggcttatgagctatctcaaataaaaatatttttacagtgtgaggtaggggtcaaggttcattttttttccagcacagttatccaattgctccctacactattttttttttaaagaacctaaacgcatccaataaattacagtcacacctttgtaagaaagccaaatgactgtacatgtggtgggctatttccagactctgtgtactgttccaatggtttattttctattgctgctttaacacaacactgaattactgtaaatttatattaagccttgaaaaatggtgggtaagtactagaaatttgtttcagttttttaaagcttgtcttggctattctaatttttttgcaggggaaatcagtttatcaatttccatttaaagtatctgtagggatttttaagtttgcaataactctctaggtaaggtagaggagaattgatattttgacagtattcaaccttccaatgaaatgaacatgttatctctccatttatgtaggtattgagtttgatttaacaatatgctgcactttttgttttgtaaatcttgaacatattttattaaatttatctctggaaatttgatgctttctggtgacatttaaatcatattgcttttcccagttcatcttccagttgtttcttggaagtatatggaaataattgacctaggaatattgaaataatatatgagaaaattgccaatttcactttttaaaattctgagtttgtataattttttgttttataaaatatcaccttagatatttttatttcttctttttcatttctttataccttttatttctttttcatgcttaattgcaccagttaggacctgtagtgcagtgtttaatagaagtggttatagtcaacatcattatcttttttctaaactcagagggacaatgattgctatttttccattaaatgtaatgttagtgccagggttttggcacatatattttactaaattaaggaaatccctttctagtcatactataatgggaatttttataaagaatggatgcgagttttatcaaattctttttctgaatctacagagatgataattgttttttctcctttactcttgatataatgaattacactgattgatattttatgtaaaaataaccctgtattcttgggataaactccaagatggtcatactgtacacattatctttaagtattgttggactggatttgctgttttttaaaaaattatacatggccatgagagagattggcctacgattttcttttctcatagtgtccttgtcaatgttttagtatagggatttgctggccttatgagctgggaagtattccctccttctctattttttctttaaatgtttcatagaattcaccagttaaggaatctggatctgtagttttctttgtagaaacctttttaaattacagattaaaagtctttaacagttatattactattcagatgatttatttttatgtcagtttaaatacattgtgtttttcaaggaaattgaccatttcatctaaattgtcaaattcattggcagaaagttgttgataatatccttgttttgtccctttaatttctgcagaatgtgtactgaagtctgcattttaataatgttttgatataagtaattttatttctttattttgatcaagcctctgaggcattcattaagctttattaattgttaaaaattaactttcgtaagtgattttctctaccatttgttttctattccattgatttctgcttatatctgtattatttcctaccttctaccttctatggatttaatcttgctgttctttttctagcttctttacctggaagcttaaatcatagatttttcagctttgtcttttctaatagatgtatttaaaaacttaaatttccatctaaggagtgctcaaaccatatcccagaaattttgttcttttgcgtttttcctttgatcattcggtttaagatattttctaattttcctgttgatttctgtttttctccatagattatttagaattgtgttgctcaacttacaaatatttgggggcttcccagatatctttatgttattgatttttaatttgattctattgtggccagaatacatattttgtatgatttaactattaatacttattgagacttatcatatggccaaatttagggtttatctgggtgaattttccttgtacccttgaaaataatttgtattctgcaatttgtgtattgcattataaatgtccattaggtcaggtttgttggtagagttgttaaaatcttgtgtattcttaccaacttcttgcctaattgttttatcaattactgagaggtaggtgttaaaatttccattatgattgtagagttttctatttctccttttctctctgtcaattttttgctgtatgtcttttgagatatttttattaggtatatataaattcaggaaacgtatgtcttcttgaagagttgacctttttatcattatgtaaagaccctctttattttcataatactcttttctttggatttttctttgtctgatatcagtatagatacatcagattctttatacttagtacagtataactttttctatataatttttatttttacctgtctgtacatttaaaatatgttttttaggaataaaatgcattcatatcttgcttcttttcgagtccaacaatctttcccgtttatttggagtgtttagttgatttatatttaatgtatattgttatgtttggattttagtcttccacattgctatttgttttatgctcctcctttgtccctggtttcctgttctgtttgggttcatcagatatgctgtggtattccattctatctcctctattggcttttaagctctccctctttctactatttttaaatgattgctccaaagatttcagtgtgcactcataatttaccacattctgcattaaattaatattatgtgacttcacatataatgtaagattcttacaacagtgtaattttatttacatataatgttcttttgtgtgattgtgtttatatatttcagatgattattatataggtaataaattttacaattaattgctattactattgctttaaacagcttcttctaaataatttagcatgagaaacaaaaccaattttcatatttaccaacatatttacatttctactcttctaccctcctgtgcagcagacttctagttggtatcattccctaaagcctgacgttcttccaccgtcatttattgtaaaatgattttgctggtgacaaattctctcaccgttaatttatctgcaaatgtctttgttttagttccattttaaataaatttttcactggatatagaaatccctttttgatatttgttgctttcagcactttaaatatttcttccactgtcttttcgtctccatttttcctgataataacacatcaattatttttaatattttgctcctttatattatgtctggtttttctctggatgtatttgagattttctctctgtaattggttttcaatagtttctttttgttgtggttagttatggttgtatttattttgccctctattcattaatattcctggatctgtagggttgttattttttaataactttggaaaatctcagctatcttttcctcatatatagtcgtgtgtcacataacaacattttggtcaacaacaaaccacgtatatggtggtggtctcatatgattatcatggaactgaaaatttcctatcaccacgtgatgtcatagctgtagtaacattgtatcacatttataatgtatttttactgtaccttttctaggtttagttatacaaatacttaccattgtgctataattgcctacaggatgcagtacagttacatgctatgtaggtttgtagcttgggagcaataggctctgctatacggcctaaatgtataataggccataccatctaagtttgtgtaaatacactttatatgttcacacgatgacaaaatcgcccaacaactcatttcttaaaacatacccagttgttaagtgacacataactgtatttcttctgtcgtattttctcctcttcttttggagtgcatattagatcacttgatactgtatcacaggtcactgagggtctaggtatgttttcaatttttattctctctgagtttaatttggatggtttttattcactgccttcaaatttactgattttttgatgtgttcaatattctgttaatcgccacaaaaattttaatttccatttggttcttttaagagttatcatatttttccagaaattccctattttttactcattatatacatgtttgcctatagattctttaacatatttattatagctattttaaagatcttttcagcttattccaaattttcagataaccatgtgtctatttctattggtagttttgtttttcttgaataagcaccacatattcaagtttcttccaatctgctaatttttattgtatactaaatgatatggatagtatggtataaagattctggattctattaaatttcttgaagaatgctgaatattgttctacctggcagttcaattcctggtatcaacttgatcctgcagtgatggagttttagattttgttatagcagggctatttccaatgccctttgtcttacgtgtatcccttggacttggcatacgggctttattgttaatgtgtgggttttctggggtaattttatttaaaaaatttcatttagtatttcttttttttaagtttattattattatactttaagttttagggtacatgtgcacaatgtgcaggtttgttacatatgtatacatgtgccatgttggtgtgctgcacccattaactggtcagttagcgttaggtatatctcctaacgctatccctcccccctccccccaccccacaacagtccccagtgtgtgatgttccccttcctgtgtccatgtgttctcattgttcaattcccaccgatagactagattaagaaaatgtggcacatattcaccatggaatactatgcagccataaaaaatgatgagttcatgtcctttgtagggacatggatgaaactggaaaccatcattctcagcaaactatcgcaaggacaaaaaatcaacaccgcatgttctcatttagtgtttcttatagtgaagtctgttggcaacaaattgtcttagctgtcattcattagaaaacatttccattgtgctttcacttgttattgagttacatagtagacagaattctaccatctccaccccaagatttctggcccctggttatttagtaaaaaaccaatctccttaaagctggtaagcaacttcagcaaagtctcaggatacaaaatcagtgtgcaaaaatcacaagcattcctatacaccaataatagacaaacagagagccaaattatgagtgaactcccattcacaattgctacaaagagaataaaatacctaggaatacaacttacaagggatgtcaaggacttcttcaaagggaactacaaaccattcctcaaggaaataaggacacaaacaaatggaaaacattccatgctcatggatagaaagaatcaatatcatgaaaatggccatactgcccaaagtaatttatagattcaatggtattcccatcaagctaccactgactttcttcgcagaattagaaaaaaactgctttaaatttcatatggaaccaataaagagcccgcattgccaagacaatcctaagcaaaaagaacaaagctggttgcatcacgctacctaacttcaaactatactacaaggcttttatcacctagtgatatcatagccatagtaacattgctaaggagagaatccagctcagctgtgcccagaatattacctacagaaatggtgagataataaatgggtattgttttaagtcattaactttgtggtaatttgttacatagcaagagaaaactaatgcactatccttttgttcattatttaagtttttacttccctcctaaatatgcttgttagtatttattttagggtctttgaatagttgctttttgtattctgtcaagttttaaattataatcagtgagaaaaaaaggctgtagtgggcttattctatcttggcttgcctcagaagtgtttaggggtaaatttaagaaaatatttgcatggtatattcactgaaaactataaaacctgctatgttagacttttaaataccaaaataaatgaagagatagatcatacttatggaatggaagatcaaaattgtttggaagccattatccttagtaaactaattcaggaacagaaaaccaaacactgcatgttctcactgacatgtgggagctgaacaatgagaatacatggacacaggaaggggaacaacacacactgtggcctgtggagcagggtgtttgggtcagggggatggagagcatcaggaaaaatagctaaggcatgctgggcttaattcttaggtgatggtttgataggtacagcaaaccaccatgacacacgtttacctgtgtaacaaacctgcacatcctgcatacgtaccccagaacttaaaataaaaaaaaaaaagatgccagttgcctctaaagtcattcatagattcaaagtgattccagtttaacccaacaacctttatttggtaacagttgacaaatggattctaaaatgtgtatggaaatgaaagggacatagaatatccaaaacaatattgaaaacgaggccgggcgcagtggctcacccctgtaatcccagcactttgtgaggctgaggcgggcagatcacgaggtcaggagtttgagactggcctggccaatatggtgaaaccctgtctctactaaaattacagaaattagccgggcatggtggcatgcacctgtattcctagctactcgggaggctgaggcaagagaattgcttgaacccgggaggtggaggttgcagtgagccgtgatcgcgccaccgcaatccagcctgggcaacagagtgagactccattacaaaaagaaaaaaaatgtgtggtacttgataaggattgagaaatagatcaatgaaacagaatttggaggataaaaaagactaatatacaataaattgacttttgataaaggtatcaaataaattttttagagaaagcaaattcttttcaacaaatggccctgaaacatctagatattcgtatggggaaaaaacaaaacttaattcatacattacatcatacagaaaaaaaaatgtttttaattagatcttagtctgaacataaaagctaaaaccataatgcttttagaggaaaacatagatagatatttccgtgacttggcataggcagattttcttaggatacaaaaagcagtaactgtaaaagaaaaaaattgatagattagatttaaatttttaaactacttttatcagaaaacaccgctaggaaaatgaataggaaagccacagacaaggagaaaatatttgcaaaacataactgacaaattactgatatctaggatatgtaaaaaacttcaataactcaataataacaagatgtattatccaattttgaaaaatggagaaaactttgaatagatacttcacgaaagaagatatacaagtggccgataatcacatgaaaaggtgatcgatgtcgttagccatcagagaaatgcaaattaaaaccacaatgaggtagctccatatacccaccagaatgtctgttattacagcaactgatatcatcacaaaggttgtgcaaggatctggaacaattggaatttccacacattgttctgagtgtgaaatggtttggcagtttttaaataaaacacaacatatacctactttttgacccagcaattccacttcttgttatatacctaagataaattaaggcagtggtctacaaaaagacctgtgcagaaatactcatagcagctttatttataatagataaaagctggaaataaaacaggtttttataaataggaaagtggatatttgtaataactaaaacctgtcaataaaccaaaagtccagcaagaggaatggattttttaagttatggtatattcatataatggagtcctacaaatcctaccagtataatatggtggtagttatttttatgtttatgaatatataataatgccaacttcaggataaatggttaaaaacataaaattattattaaaaatagccaacaaacaccagcatcttttgggtttctttttgttcttcactgtttctatgctagcactataaattgtaagtttgaattgtagctcttaaagcaatgcagtttttctttcatttttaaattgagctctttactctaggaaccccaggccctcctggaccaaaaggtattagtggccctcctgggaaccccggccttccaggagaacctggtcctgtaggtaagcatgaaaaataacagtttgctgttttataaaactaatgtttatcatattaagtttgggaaagtcaaatcatgttcagctgtgaacattttcaacacaaggaaatatagtgttcattcacttaacactgcatgtgaggtacagaatgaataacttttaataaaaagtgcttaaaattggctgggcacagtggctcacgcctgtaatcccaacattttgggaggccgaggtgggaggatcacttgaggtcaggagctcgagactagcttggtcaacatggtgatacgccatttctattaaaaatacaaaatattagctgagcatggggatgggctcctgtaatcccagctacttcggaggttaaggcacgagaagtgcttgaacccaaggggtggaggttgcagtgagccaagatcgtgccactgcactccagcctgggtgacaaagcaagaccctcgaaaaaaaaaaaaggacttaaaatgatcatatgtgaccttattttctaggcccactttttccagggagagttaattcaagtgtcctagaatagaagctttgatttttttagaatggcaggctgtagtaagtaagtttgtttattgatttctaaagtaaataacttctcttggccccatatgaggcctataattctccccaccacccttcgcaccttactctcttagatattctgaaactatattaaaatgaagaactgaaaggttttagatgctgaatgactattccttattttcattatcctccttcatatttttataacattttgtgatccaaaggagtgtctcaaaagcaccttgtttcttttggataaagaagggagcatatggaagtaaaagggagttggaaattggaaaactgggtgtaacctgctgtactcaattttttaggtggtggaggtcatcctgggcaaccagggcctccaggcgaaaaaggcaaacccggtcaagatggtattcctggaccagctggacagaagggtgaaccaggtgctgtagtttttcatttttcctatttttctaattttctctgtgttgaatttaacttgcctttttattacccacagtgaaattgtatcttctttcttactaagctaccacacactttccccttttcctagttaccgtcttcctcttcatcctgagactattagctcatgtatcttgatcaagttgcctcttacaaaaaaccccatatcttttcttgtctaattttttatatcaaaaagaagttacctagcctttgcaaatttctctgtggtttactatgcaatctatatttcatttatatttttttcttataagcatatagatatatttaacattcatcggaaatagaatatatgtttagatcattttctcatgttagaattgcagttctgtgttggaaataaatcttctgcatgtttcatataatatacattgctgcacctaatgaaaacctcaatgatctaaaaataatttggccttgtttcagtttgtattatccacttgagtttttgttttgttttgttttgtactctgacaggtcaaccaggctttggaaacccaggaccccctggacttccaggactttctggtaaaccttaataaaacatgctaaatcaatctataataaaatgagattatttccaaatacatctatttttccatctccaccttttactatcataaaatgcatgtaagaacccagaaaactcaaacctagtgttaacgttaaaacatttattatttagcaacttagtttaaggagttgtgttaaataaaaatgtatccttacggaaatttacatgtagagatctcttcactaaattcataaataagtgctgaggaaataagaaagaaggcaaaattgcaggaagataagaaaagtctgtagaaataagaaaagtctgtagaaatatacgccaataataaaaatgtttctggaaatttcagtcttaatatatgttttgcatatttgggtagatgtgtgtgtgcacacacacatctaccctccctcttttgtgcttactcttactgtgagcaccaaatagtagaaggactgaatgtacatacagacatgtatgtttatgttctgaaatgacgactggccattttatggagacttttctcaaaccatacacatatctcctgtaaagtcaaatagatatccttcccatgataccaacatggaaattattactttaatgtgccactgttacattgctcttaaaagtgtcagaggtagagaaaaaatgttgagaacaattttgctagacggtgattataaatattgggtagaatggtcttcggggacacatgacaaccattgaagagccatatctttcattagtctcaaaattagactcaaaatatttgttttagaaatttcctccagccatcttgaaactatttttgaagatactttatactttttttcctcacagctattggtgatgtatcattgctctgtcttaacacaaaggataccttttaggatgaaagctattattatttctacatttctatatatactctaataaatacttctgctaacaaatgcatatatttaataggaaggatggttttctgggtagatttgggatttggtaggagatagaaatgactcttgtgaattccattaattgccctaatgtatgtgaatagctaaccttataagcaagcttgtaactcggtattatttatcttctaattatactttactttcataggccaaaagggtgatggaggattacctgggattccaggaaatcctggccttccaggtccaaagggcgaaccaggctttcacggtttccctggtgtgcagggtcccccaggccctcctggttctccgggtccagctctggaaggacctaaaggcaaccctgggccccaaggtcctcctgggagaccaggtatgtccgtgagtggtaggagaatggtctatttattagtccatgtatttcgttttgctggcaggttattcagtctttaagactttagaatttttccggtgcattggaggatgttaaaaaaaagactttaaaatttgtgatataacttcttacaagtaaatagcttggttcatagctaactccatctatttccatggttctaataatttgctttagtaatgcattttatcatttatatagaggaagtaaaacaatttggaggaataaaggaaatggtagttttattagtcttgttactaaaaggtaaaactatactgttaacctgtcagcaaaatgccatctgcatttttaaatgtgagcttctcagcatgtcatcacagaaatcattttagtgatcacccaatagatgcttgtggtccataccagaagtattgctttggttctgtcatatgatcagcaaatctcaccaggcacaattaaaaaaattatcttctataggaactgggcaatcaaatttatctccaacatcacagcatgatcaaattgactagtgatctcttcataccaacctcatgtctatacctcatttgtcttgtgttcactgctctagtagtctcagttttgcatccaatgttcaccttttcattttgtatctgtgctgtgtcatttcattttactaattttggaaatgctcgttttcatccttgattaatgtcactgagcctagtcactggtgataggttatgaacagattttgagacttgatattcaaattttatatttctggtcactgaaaacttggaagtaaatgtccttttattctttgaaagtctctgacattatataagtgcatttcaaaatgaaaaatgttatttatattacagtaaaatctaaagtgattggaattcattttaataagatgttctaaacacatgaattaaatgggatcacatactgtgttcagaggatcattttcaaaaccaaattttatctgatctgacataatctgatggaaagtattgtttaaggttttatgtttgtatactactgaagaaaaccagtgaaaatctcctcagccatgttaactctcttgcatgtaatgtaaagaactgaagcaagtatcttgcttggttttgcatgcagtaattcaaataaaccaaactattatcttttttatattttaatcatcactgtggttattcgttcttactagtaatgaatgagtaatgagctcactgttgaaccttactttgaaatttgtcggtatgaagccattagtcacaaagatgtcctaaaaattacatttttaaagaaataataacaaaagtagttagaagaatgcacacctgatgagtgtttgtgacttctcaaattatttcataaactataaattaaaactgagttgtaaaccccattgctcttagaattgattgttcttagtctgagctcatagtaatgattatgatagcaatgacttttggcctttaaaaatacgccacagtgtgctgttttcattttagttttgtcactaagtggtgataatttggtttatatacagatgcatggatatgaactttcagagtattcttttattgaaatgaattttaacttgaaagtatttagtgtaatgctttttagtttcttgatatttctaacagttttgatatttttcctttttgttaatgatgacattgggccttggtgaactttgatccctatccaggtcctacaggttagctccttaactccaaagtagtaactgcatgaagtttgaaacttatatacctgtaccaaatgttttcaagtgtttgaatgtattttaagagcatatgtgccaattcaattcttacatagtggcttatctctttaagtttttaggaacttgtagaacccagtgtttctgtctattggaaagacccaaaattacctaactaggaaaactaatttaacatttaaaaattcatatatttgtgtcattttcagttgaaaatctgtagtaccgaaaacagccttacatattctacctttctttggagtctgtttcttatgtttaatttatatctgttaatgcaaacgaattgaactatccttcaaaaggacattctttttttaaacaataatatgtattatcagatcttgaaaatatgtaattcttaacttgccatatcttttgcaggttttcaaactatcccaccttcacattttgggttgtcacaaagttctcaattctactgctgttaaaaatggactaatagggccgggcaccatggctcatgactgtaatcccagcactttgggaggccaaggcgggtggatcacctgagatcaggagttcaagactcgcctgaccaatatagtgaaaccccatctctactaaaaatataaaaattatccaggcgtgttggtgtgcgcctgtagtcccagctactagggaggctgagaaaggagaattgcttgaacctgggaggtggaggttgcagtgagctgagattgcaccactgcaccgcagccagggcgagactaataggcacagagaaaaaaaaaatcaatgcaaccagcacagattacgaggttcttaatcttattttcattatacatgtgtaaacagtacacaccaaagaacaattaccaagagctacctaatggaaaattgctgattcttagtgaaagatgtttgtttacctaattagcagtaaaaaaagccacaaatatttgaatgtatttattgttattcaaaataaatagtccttttcaaattgttaagaaagaatcaaaagaggtaatagtataccccatgatatctggctgttgagaatggcaggacattttttcatcttataaaattaaaaaaaataatttttcaagattatttttagggagccatttgtttctacctgaattgattctctagtttcttactccactgcaaactcattatttcatagaaccatagaatgtcagatctagaagggacctaagttttacctatgtcgaggagaaattatccacaagacagattttattcaggactattgcagtagagtagaaactattgcagtaggagagagactgagctcaacttcaaatacaacaaagaaaagtgattatttacagccaaggagcagagtgagagggccagtaatggaaaattactaagaggagacatcaagggtagagaggggtgggttcttgttaaactggcccaacaggatttttgccagaaacaggccaaggatttagacatcaaaggtgggagatcaggaacttgatcagatatcggggtgaagggactctctctaaaccgatttagcaggattattgatgtaaatggatttggaaggccaaaaagtaggcccaaggatgaggcctaattgagaggagggctcagaggagcctgtctaaagtttgatcaaggaatctttgtcacatatgaaaaaatggaggcccaaagaggttaagaaacttgctcagggtaatactgttagttagtggcataactgggactctgacttaaggctccccagtgatcaattaggtgtctattctacagggagcagactgttcgctgcatccactttcttgttttctgttacctcaaaagctccgtcaacacctccatcaaccagattgcttcttgtgttcttcttaaatgatgtcatcaaaaagattaagacagtgcatactatttaactatcactaagataaagcaaagactagggggttactttgaagtaatgttgagtcccaccttatctgacctacatagaattttgccactttgattactgctaaactctactgttagctaggagatttctatcttctgagttactataatatattcaaagaagaaaaagaaaagtagccacattcctttaaaagaaatttaacaatttattatttacaaaatgtgctctaaattgcatagttgttggaacttggtctctgtgatgttttcttctttgcaagactacaaccttaagtggaaactgaatttaaaatataccagtcaattcatcagtatacctttagtaattactacttatggacaatattttaggtttttgttttgttttctttttcagtttaactttgttacacagttgaaaaataatggattgtggacctcatacaaaaaaaaattgacttggcatatagctcattaaaatgttgctttttaaaatagagtcttagaagttttgctatgatatgatccacagttttccttgctaattactcaggctgaaatgtcatatttcaatgaaatattttgctgagagttcttgttattggtccctctatatcaaacacatatataaaatgtctttactcaaaccttgagttgtcttagttgggaattctaatttatttaactaattttgtggccagactctgctctaagtattgtcttgagttaatttgctgtctgtgatttagaaacaatttaaataaacagaagccaatatttagctttctgaatttcaaagtatcaaatgctttgaaagttttattaggagataatgataatgttttctatttatatgacatgccacaatttacatcatataatgtacttttattgtaagcatcttaagggcagagtttgagtcttgctcatctttgtgtttcctgtagcaccttgcacatggcagacattaggccagtattttacaacttgaatttgatctttaaaacattcctgtgagggaggttagggcagataccagtattcccattttacaggtaaaaaaccatactcagaaagattgaattgcccaaagtcatatagttattaagtagcagagtcaaaaatagatcctaggtcttccaactcctaggattcattgctctagcacaatttattctctctgctaacatttggtgcttataaatcatagcaaaacttgtaagaaaagaaaattgtgtttttagtcaattaacactaaccaaggggtgctctatttgtaggcttttaatctttttatttaatgatccttcttttaatagtgaatagcctgtcttaatatgtgcattgaataataatagagtaaatatgatattttctgtggttcggggtgggatattgcatgccaaaacattttcaagtaccctttcactgataggcttcatatcttggaaaagttgaatctttatttttgtgttcaatgttgtacaaatatatattggctttttctccttaagtaacttattgcaagtactataataataatataataataataataataataataggccaggcatggtggctcacgcctgtaatcccagcactttgggaggccgaggtgggtggatcacctgaggtcaggaattcaagaccagcctggccaacatggtaacaccccgtttctactaaaaatatgaaaattagccaggcgtggtggtgggtgcctgtaatcacagctgctcgggaggctgagccaggagaatccctagaacccagaaggtggaggttgcagtgagctgagatcacaccattgcactccagcctgggcgacagagtgagactctgtccaaataataataataataataattcaataaatagtaataggaaagcctcctggtgaattatgaaaaaaatcagaatgtggcttcatgaaatgcttttcaaatacaagcaaaagtacagttggtaatggccatcgtatattcatgttttgatttttctattctgtcacccatgatctttatatttattgccaatgaggcctttaaagtcaactgtatcttcttgaagcagtctgagcatatcaagaaattggcacctggtgtttttattaaaagataacacaagccaagataaacttcagcattaatccaaaaatacccctttactaaaggaatttgaaggctgttggtgaaatggtactatctagccaactttaatgttttgagaagctaatttttggaaagccacagtagcagtgttaacatgatgtcttcagtagagttttctattttctggattaacgaagaccaacagcttatcctttagaataagctctatttgaaaaagtttggctctctatacttctgtatggttctgtttgcatactgattatgctgtaagtataagaaatgctggcaaagaacattattgttttaacttgtactataatgtgaaccacttctaactcataatcttattttgtactgtgtgatgtctgatactgctaacatcgatctttgggctttggtgaactctgatcttcccaggttttcaaggttagactcttcactggtcaattcttttttttttttttttttaatgctttgtgtgtgtgataagagaaatgcaattttttgctataattcagaagtcattggagagtgctgttatcctcaagctggggttttaacattttgatgaaggtaatgtgacttgattataattaagtttcaaatgacgttagggtctttgtgtttgcaattgtttataataagtaatcaatacataaagacatgttgaattttaaacggaaatacacttatttttaccttcaagactgcattaaaatatttaggcaagcatatgacctatttgtaatctctgaatgttgattttattttctcaaaattttgttttctcagattgccctgatctgtgtatttatggctattttcagtgatggcagagatatactattgaatactgttaaaaataaaacttatatgttctttatgtaattaataactcataatttgaaggactctaaacatcaggtctgaattaacatgcaagtttcccatttttttttaatttcgaaaagtgcagtgccttaggttatttcagatgatacagtgttctgataacttttaaaatggagtagagggtcataaaaggtttctttttttcccatcttactttgttattgttatcaggttgattcacagtttatttatttttcataattagctgatttgctacttaatttctagtgcaaatcatacattgtggattaaattgacaagtttgcttagaacactgaagttctgtttttttattcaaatgtacaatgtactaaaccttttcgttatgattgagaagggaatttctgtgttgactggttgccagcctagggtgactatatgagttaaattgtttaaatgtaaaacaattgttgtactattgtaaatctccttcctctttctcatatgccagatagagtcatgttatattatgaaattacatagaaatacctgaaagattaaaaagatgctcatattttaagatttgtttttatcttcaattttactaataaagaaaataataataattttaaaaagtccttccatagcttctactatataccaggcactgtgctaagtaatttttacattgtatctcatttaatccttggaacaacctgctaaagtaggtgctattcttaattccattttatagaagaagaaattgaagccaaggagattaataatcttactgaagtcaaacagctaataactaatggagctgtatttgtaacccagcattctagctccaaagtcctgtgttcttaatcacagtgtcattctgccttgttagtattttgccattgattctgaatcttaagagtattggaaagggaactaaagtctgaattttattttaggttaaaaagacaaccctttgtccataagaatgaactctattctaaattcataacaagtgcctattatagttcctcaaaaaataatccctacatatcttcattttttgttgaaatcaataaaatttgaaatgaccagaggagagaaggtgtaaatgctaactattggctgttcattatttagggttttgtaattattttcttaaggcaggattacttagtctcagcctcagccactgaacactctgcaagcaagtaacacctatttgccacctggtgacaaaagacttggccaatgataagatctccctggttgcttaatggacctcatacctttattcagaaaaagaaattaaaaacacagcaaaagtaaaaatgctaagcaaaatccagttttaaattattttgtttattcacaagatacatacagaattctttatttttcttgaaaaatatttaaaatgtaaagaatatgaaaacattttaaaaatgaattttaaagtactttattgattcaataaatttctaacatttaaaaaaattcctatgtatcaagcatatcactaaaatgaaattagtttgcttaaattgctatctgtattgcatagtaataaaagctgaataaatgtaactacttacaaataaagcaatttgatcttaatcacaatgagacatggcttgaatttctgattgccctacagcagtgatgcttaaagtgtggtcctggaactagcagctttagcttccacaaagcacttgttagaatgcaaattattgggcctctcctaagtctcttttttctaaattatttattcttaagactggtcaagtgcagtaacgagaagggaggaaagagttgaacaaggagttcaatctataactgaacaatcaattgagataactcactaccttcagaccagtctcctcagtcttacggaatccaaaactcttggggtgggcccaggaatctgttttaacaagccctctagttgattctgatgcatgctccaatttgagaaaataccctacagtttctgtttaatttaactttaagtcaaactctttgttaagaattacagagccacacattgttaagccatgagtctttttctttagatgttattttattgaatttaatatataataaaatgtaaactaaaagagtctgcaaatcagtgttcataacaaaaagaatccagttcaatttatattagaaagggaatcagcataggtctagatattttaatgttgtgtgggttttattctgcaaactaataggaagatgactgatattttaaaagcctgacttttatgctactcttaacactatactgaaatgtcgtcatttgctgtggattattaaggtctaccaggtccagaaggtcctccaggtctccctggaaatggaggtattaaaggagagaagggaaatccaggccaacctgggctacctggcttgcctggtttgaaaggagatcaaggaccaccaggactccaggtaggaaatggaagtagatatctgatgagagaagaatgtgggtgtttgtattcaaaatgtgaattctaagctgcatcattttaattaacactcactagacaaggttctatgtgtggctcactggcgaattaaaaagacagtagaaggcaagtttcctatagtctcctaaagggactttgttgtattatagtcagagttcctgaaaagatacttcacctggagtctttggtatgcatatttggatttgagtagccttcatttcagtgaaagcaaatttatgcaaaggagacatgcatattagagcattgcatatagatgaatccacccatagagaagtaattatggtgaatagaggcatcttttaggctttgaaattagataaagttagggtcaaatgtcagctcccctgcacacttctgctttgtatctatgaggaaaacagacactgggtttctgtcttcacctataaaaagagaataataacatatccactcatgtgctttctatgttggtttgagtgacccagagcagagagtcacattcctctttatgggttctcaaaactgcctccattcggtcaagatgattgctggtggatttggcagtcaacacaatctggactgtcttttaattctgaagactgctttatggcagaaaaaaagtatttaaagtagtgatccttaaagcttttcaaaatctaatctttttccccatgccatcactattcttccagttacctagacttaaaaatttacttctgtttactcattctctactcactccctataaatatgcatatttccagaaacaattaagagtaagtttcacctgctatacccctttaccactaaatattttaatgcagatttcttaagattaaaaatattctcatgttttattataagatgacaataaaaagctatgggattgtttatattttataaaattcttaccaaatgtcttggctgcagcctgtaatcctagcaacttgagaggctggggcaggagggttgcttgaggccaggaatttgagacgagcctggacaacatagcaagaccctgtctctaaattttttttaattatataaccacagtacacttattaacttcagaaaatttaacatagatatacattaatttctatctttcatattccagttgggtccaatgacctaataatgttcttagcatttcttcttccagtacaggatccaggccaagtcatgttttgcatttaattgtcatatctctttagccttctttaatctgaaacagttcctaagtttattttctttttttcatgacctcgacatttttaagaaattgtaccaccacccccatttttaaatagaatattccttttttgcctgatgtttattcataattagattcaggttatgcatccccagctggaatactacatgagtggttctgtgtccttctcaggctaaccgataaggaggtccatgatgtctatctgcttctcatttgtggttttagttttaatcatccagtcaagttgttgctcagtttctccactgcatcattaggtttttccttgcaactaataaaactgtaggaaggcacattaagatagtgcaaatataccaatactcatcaaaaatttcccttagatttaacatctattaatgattttgcctcaaccagtctctagtgggatagtggcaaaatgatgttgtttcaactctagcactacctccacatatactagtcagtcctactgtaagcaagagccctcccttctctctggtttacctatgcatttcttatcatttttgactcattttttctcatgttttccactaatttacaatttctaaactatcattacttatttcgatgctctcattgttccagatttggaagccccttcaagctggatttgatgtttttctgatatgtacttccctccaactatttttttagcactttttaatattatttcataataagatgctccaggcttgttcctctttcattcttactaacataagcttcgttgtcctgcacttgaagtagagcaatagcctcctatatgatcttgctattctatattcttcctgtagttgggtggctgaggggggatgattgtttgagcctaggagtttgaggccagcctgggcatcatagtgagatcctatctctatagaaaagaaagaaaaaacaaagaataaaataatagttacctttcattaagtacacaccacacaccagtcttctaagcacttaatattgtcagcaaaagacaatgagatctagaggagaaaaaggaagagctttattttctgtaaaaagtaatctgcggattgggaaggcacagctttctgtacaagcgaaagtgtgatctctgaagaacaaagggagggtttggcttaagtagggaaagttctcacccatgttctcaaccaggtccatttatgcaaatgaaggattcagacttatcagttctgattgattgaaatacttgagccctgatcaggtgatttccaaaaccaaagccagaagtctgccagatgtttctttcaaatggccaatgggcagggggtgtgttcaagccacagtttatcttcgcagtggtttgacttgattgtacaaagggagatcctgtgacacttttacaacatctttccaagaacacaaggtatgtgacatttcccttacccaaccacggccagttggttgtgttttaactttgcgcacctcagttagccatgggaagttcattttgtctgtcagccaggggtatattttaacaatatgaactgtctcatttaattctcaccacaaccctatgaagtaaatactgttattttctccaaatttgaggtgagaaaactatgaatcaaggaggttaaataatcaactcaattcacacaagataatataaggcaaaattgagattacagtcttggaagtttgactctagaaatagtgctatatgccactatgtaattcttatgccctcaatcaccttcctcccctcgctgcaatttttttgtaacattaatgattttatttattcagggtaatcctggccggccgggtctcaatggaatgaaaggagatcctggtctccctggtgttccaggattcccaggtatttgaagggatttttgtggtttccctttatattaaactcctctgggacaagatagccattttctgatttgactgggtaaaggttgtagccctgttgctttgccataaaactgtatgtaccttctgtgcaggcatgaaaggacccagtggagtacctggatcagctggccctgagggggaaccgggacttattggtcctccaggtaagacttattcctgaagatagttatacctgatacttagatgctttaaagaatttgaaagttttcattctgtctttcagccagaccatcggaggctaagtccccaacaactgaggcaaaataaacaaggctctgcctttatttactaatctcttaaattctctattttagtaacataatattgatagcagaccttttaaagttaagataaatgcaggatcaacaaaaatgcttccttgacattagcttctatactaacttccccaaattcaattgaacagatcacaagagcaagtcacatatgaattttttataatattttcgatattaaaatagttctttttcctaagaggcttatagaggtttcttataaattgagaaataaggaatctgctaaattcccctactagatcaaagggtccctggacaagcacagcaagcaaaaactgcaaatgatgttggagtcagaatggatgtgtaagggaataaaattgtcttcccctgacaccagtgttcacagatttgaacacagatggatgagactttgtagtaactgagtaagattcaaggtttgaaaatagagatgatatgcttaatttttacactgaccctaagaaacttatttttcaattgaaaattatttttcaattttaagttttcctaaacagatttctgttagatatggcagcaattcaaaaactggtttctctcacaccaatttttgtcctgaacttaggtcactttggcttccatttcttgtaacctttctctttcccttcaaatttgtgtgttttgtctcataggtcctcctggattacctggtccttcaggacagagtatcataattaaaggagatgctggtcctccaggaatccctggccagcctgggctaaagggtctaccaggaccccaaggacctcaaggcttaccaggtaccaatgcagatcatctttattatcattattatacttttaatttctgggatacatgtgcagaatgtacaggtttgttacataggtatacacttgccatggtggtttgctgcacctatcaacccatcatctacgttagatatttctcctaatgctatccctcctctagcccccctaccccttgacaggccctggtgtgtgatgggcccctccctgtgtccatgtgttctcattgttcaactcccacttatgagtgaaaacatgtggtgtttggttttctgttcctgtattagtttgctgagaatgatggttttgtccatgcaaaggacatgaactcatcaattttcatggctgcatagtattccatggtgtatatgtgccacattttctttatccagcctatcattaataggcatttggattggttccaagtctttgctattgtgaacagtgctgcaataaacatacgtgggcatgtgtctttatagtagaataatttataatcctttgggtatataccaaaatgggatggttgggtcaaatggtatttctagttctagatccttgaggaatcgccacactgtcttccacaatggttgaactaatttacactcccacaaacagtggaaaagcattcctatttctccacatcctctccagcatctgttgtttcctgactttttaatgatcaccattctaactggtgtgagataatatctcactgtggctttgatttgcatttctctagtgaccacagatgatgagcttttttcatatgtttgttggcctcataaatgtctttttttgagaagtgtctgttcatatcctttgcccactttttgatgggattgtggttgtttttttcttgtaaatttgtttaagttccttgtagattctggatattagccctttgtcagatggatagattgccaaaattttctcccattctgtaggttgcctgttcaaactgatgatagtttcttttgctgtgcagaagctccttagtttaattagatcccatttgtcaattttggcttttgttgccattgcttttggtgttttagtcatgaagtatttgtccatgcctatgtcctgaatggtattgcctaggttttcttctaggatttttatggttttaggtcttacatttaagtctttaacttatcttgagttaatttttgtataaggtgtaaggaaggggtccagtttcagttttccatgtatggctagccagttttcccaacaccatttgaatatgaaatcctttccccattgcttgtttttgtcaggtttgccaaatatcagatggttgtagatgggtggcattatttctgaggcctctgttctgttccattggtctatatatctgtttcggtaccagtaccatgctgttttggttactgtagccttgtagtatagtttgaagtcaggtagcgtgatgcctccagctttattctttttgcttatgattgtcttgtttatatgggctctttttttaattccatatgaaatttaaagtagtttttttctaattctgtaaagaaagtcaatagtagcttgatggggatagcattgaatctataaattactttgggaagtatggccattttcatgatattgattcttcctaaccatgagcatggaatatttttccatttgtttgtgccctctcttacttccttgagcagtggtttatagttttgcctgaagaggtcctccacatcccttgtaaattgtattcctaggtattttattctctttgtagcaattgtgaatgggagttcactcatgatttggctctctgtttgtctattattggtgtataggaatgcttgtgatttttgcacattgattttgtatcctgagactttgctgaagtcacttatcagcttgagattttgggctgagacaatgaggttttctaaatatagaatcatgtaatctgcaaacagagacaacttggcttactcttttcctaattgaatacccattatttcttcattttgcctgattgccctggccagaacttccaatactatgttgaataggagtgaactcaggattaagaaactcactcaaaaccgcacaactacatggaaactgtaccacatgctcctgaatgactactgggtaaataacgaaattaaggcagaagtaaataagttctttgaaaccaatgagaacaaagacacaatgtaccagaatctctgggacacagctaaagcggtgtttagagggaaacttatagcactaaatgcccacaggagaaagcaggaaagatctaaaatcaatacccttatatcaaaattaaaagaactagagaagcaagaacaaacaaattaaaaaactagcagaaggcaagaaataactaagatcatagcagaagtgaaggagatagagacacaaaaacccttcaaaaaatcaatgaatccaggagctggttttttgaaaagatcaacaaaattgatagcaagactaataaagaaaaaaagagagactcaaatagacacaataaaaaatgataaaggggatatcaccaccgatcccacagaaatacaaactaccatcagagaatactataaacacctctacccaaataaactagaaaatctagaagaaatggataaattcctggacacgtaccccctctcaagactaaaccaggaagaagtcgaatccttgaataggccaataaaaagttctgaaattgaggcagtaattaatagcctaccacccaaaaaaagtccaggaccagacggcttcacagccaaattctgccagaggtacaaagtagagctgataccattccttctgaaactattccaaatgatagaaaaagagggactcctccctaactaatttcatgaggtcagcgtcatcctgataccaaaacctggcagagacacaacaaaaaaagaaaatttcagtccaacgtccctgatgaacatcaatgcgaaaatcctcaaggaaatactggcaaaccaaatccagcagcacatcaaaaagcttatccaccacgattaagtcggcttcattgctgggatgcaaagctggttcaacatacacaaattaatagacgtaacccatcacatgaacataaccaataacaaaaaacacatgattatctcaatagatgcagaaaaggccttcaacaaaattcaacagcccttcatgctaaaaactctcaataaagtaggtattgatggaacatatctcaaaataataagagctatttatgacaaacccacagccaatatcatactgaatgggcaaaagctggaagcattccctttgaaaacggcacaagacaaggatgccctctctcaccactcctatgcagatcattcttttaaggcttattcattggagaacatttccctagttctccttttacatgtcagaggttgtctctgacaataggagtctaagcaactagtagaataccagaccaccacaagttccattttcttttttcttgaaagtgttaatttcccatggttgaatttctcttagactatgtcaggttactgttagcccctctggctgttccaatttgaacaactaattaatgttagaaaaatttataatgaaatgaaaatgcatttaagatctggtgctttctgtacatcatccagcagaaagattgaaggctgatttggtgggctatcagtttcccactgtgaagccccttgtcttttaaactaactggtgtctagctggccatttgactctacgtttatagccaactttcattaatcattataaaagaaaactagaactaacttcagtcttttgctcttattaagtgatcaagtgacagtcttatcaaaaacaaagtatacctggcagtaacttatggtggaatagaaaacgaaagttgggacttacattcttgtctgattctgaagacaaagagagcacaactccattaaaagcatcccagaagcaaatggattgtttaaaactaaagctaaatccttgttggcttctttggtcctggacttgagttatctcttcttttttctggatttaagacaaaaccaaattgtgaattcagtgtctcgagaaccttatgtctcctagatctgtccagatgtgaaaatattctactcatatttgaatgcctcattcttttcctgtaggtccaactggccctccaggagatcctggacgcaatggactccctggctttgatggtgcaggagggcgcaaaggagacccaggtctgccaggacagccaggtaagacaagtaaaacatgctgttggtggagggaaagtctttgagtctgagagacctctggacatagggcctccacttagagctgtgagatcttctcttgatgttagcatagctgactggtgaatgtggacctgaggaaaataggaaagcacataataaggagatttgtcactatcagagaagcatacaagattgcttttatttgtgtttagagcagtggaaaactcagttaaattttccaagcactcactgtacttacttgttcagcaaattttcaatatgttgatttaaatcccttgaccatattgaaactattgtgaatatttccacatttgaaaatatcgcagtaggctgtaatttctttcataaagagcagcaaatataaatgaacagtttaagtgattgccatagacctttaagagtcatggtgaagtttcatattgagatgataaattgatattaggagcattaataggtgctcctgataatattgagtctggtatctgttagattttcaatttgtactcaacctacttccaaaaagaatttgagtcaacttgaaataaaaaatactttaacgttaaggtttctaaaatagaaatagaggatcatacattatatatgttaacaactctagattatataaatatgactaataaataaacataaagagtttgtatttcaaatatcagtggcaacacagcagagtggtaatacctatagccttcctagagtcaatgccctgacatttcattaatgctatatttctagggaaataacaagttagtgtcatcttcatcacaagtgtttctgtgaagtttccctaaaatgaaaatttatacacagactgtccaaaggcctgtatatacagaaaattattaaatgaactcaaaccaagaggctaaatcaggaagggaagccagtggtggattgaaaatgggcattttgaaaatacttctttagaatgccctgcctgttctctacacaaaaaggtatgcctgagaataattcccccagacggattcaaaggaaaatgtttttcagcaatgaagctggcagattgatggcaaccacacccttcctttctcattgatgaacaaaacagcaggctgaaaattgaccatggggttcagattcttttagtacaacaagagactaaataacatacagactctccaaataagcatattttatttgtctcctagcccatgatatctgacaatgcctttatagacactctataaatatcaaataaattaactagtcaaatgaggtcataatgttttgtcaatatccataagagtggatcagagcttacttaatcttgtatactgattatttcgtggaaataggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttgggtgagataatcaatatctaatttcctactgtgccttttgtttttgtttcagaaatcctgttgggttctagagtagccttggccaaagtgcctctctctattcttttggggcttccgaattgaaaaccatgtcaaaggcaactgaatatattcactatgatttttaaataaataatatttaaccttaaactaaaagcattaattagctcttgtgaggtacaattcttggcctaaagcagatcatttcaaaaaggccacatttacttttagttagattagttattaagggaacagtttccctgggctctttgcagtatagcagctgcttgagtgtgcagtgtttataattcctgggagatacttacctcatctttgaaactggtcttcatcaagttcataagttctgaagagaatcttggttcatagatcaaagaaagtaaggtcattgcttaattatgctagtttgtagttcctaaaataagtgccttagctttataaagtattgctggagtcatttaaagctatataaagtatgacatttctgtacaaaatccagttcatttaaggtgttcccatgtatcttctctatactggggtggacagctaggttgatgggatgaggggactaaatcactctcaaggactcttccatccccatgaattcttttcctggaattctgactttggatgttgaagtcccattgtcttacctggggctgcattttgttgttgttgttgttgttgtgttgtttttttttttgatacggagcctcgctctgtcgcccaggctggagtgcaatggcgtggtctcagctcactgctacctctgcctcccaggttcaagcaattcttctgcctcagcctccgaagtagctgggaattacaggcgcccgccagcatgcctggctaatttttgtatttttagtagagacggggtttcaccatgttggccaggctggtctcgaaatgttgacctcgtgatctgcccacctctgcctcccaaagtgttgggattacaggcgtgagccaccgcacctggcagggctgcctattttaagactgactatcccctttgcctccataaagacatttaagaagatagtctgggctcccagtttctgggatctctatgatgagaagcttcctgagatctcattgtctgggccattcattctgtggaaatgtttctgcagcagcagagaccccggaggtcagctttactccctatttttccaaggcatatggccacaccagttctggcccaccagggtaaggatattcacttacatgtaagtcagtggtcataggccattttatgaaaccaaataatgtaagggtttgcccaatagctttcttttccatcttctttttttcttccgtttatatttcctttttctccttttcaactttcctctgctacttttctttctccttttcacttggttacatctttttaaattttataattgaccaatcttcattaaattagtaattaaattatctttccataatttaatcgaataataaatatctaaataattaatttaatttaatatcttcaggtaattttctctagtctttctcctataaatttcttttttgttcattctctctacactgtcagacttataatcaaactttaaacttcaaatccctaacctaccaggtcaacagaggaaccattataagttttgagcactacgaattcaaaaatgtaatgcagttagaagatggaatctgctatcagcatgtaattataacttttcagaatccatgtattttctctaataagaacaatcagatttggaatctataaactggccctgactctggtacagtttaggcctcagacacaggaaggccatgacggagcccaagatcctaggaatggtcctggattgcagaggctctgctggggctcacacaaggatcacattggaagtatcttgatgactaagcaaagatacaggcagctgtcactttgatgttaaagaaacaattacctcctgatcgaataaatgcagtctgtgttgaattagtggaaggattataggatgtaagaaagaagacagagaagatggattaaatactaaagcttttctgtctgggagaaaagaaaaacatactgagaaccattagtctattaaagtcttataactatggggtatagagggcattgggagtatatgggatcactctctcttcgaaaatttggagactataacccagaattctgcatcattgtgggcagccacaggtgcaaccagatactccagatacttccatcattatgggccttccttttatttacctttcttttccttacgagactggatattttcagctctgtcccaaattaggcagtagaataggtttttttaaattactttataatgtacaaagcactttcatgtccattgtctaatttaatttacacaactatgattaagaaaaatgtatataaatattctgctttttcattttatacacaaagagactggctaataggttaaataacttacagttagaaagtgatggaggtaacacctgccaattctaaatccatttctttttaaattttcccatgttgttcactcttacatgactgtgagtcagtcaggtttttcttaacgagtttttgaaagggataaattagactaaatcaatgattttcaacctagggaattttttaagactcctagtcttatgccaaatccattgtataaaaattccaaataattctgataatacaggtttaagatctattggtcttttatcagtcatcttcagtctgagataagcatacccctttgaatatatgaagaatttccatgatgcacagaggcattattttttaaaaatcaaatttcaactcctcgacttttatatgtattttctcctaaagtcaatctgactttagcagatgtgctttgggcaatctcctttcccatgtctcctttgtctcctttcactgtcatgcattccccactttgtaagagtcatactcttgcacattgccttgaagtatgaaaacctctgacagacaaattcaaagggataattcaaaataacagctttgctaaagatacaattaccgttagatccagcaatcccattactggatatttacccaaaggaaaatagtatatcaaagagatagttacactgacatgtttattgtagcactattcacaatagcaaagatatggaatcaacctaagtatccaacaaaggatgaatggataaagaagatgtggtatatatacacaatggaatattattcagccatataaaaaatgaaatcatgtcatttgcagcaacatggttggaactggaagtcattatcttaagtgaaataagccaggcacaaaaaaaacaagtatcacatgttctcacgtatatatgggagctaaaaatttgaacacatggaggcagagagtggaaagacaggtagcagagacttggaagggtaagtgtggggaatggggaggatgaagagaagtgggttaagggatacaaacatacagtaagatagaaggaattaattccatatttgatagcagaagagaatgactatacttaaaaaatatattgtacatgagtgatggacaccctaaataccctgacttgatcactatggattatatacataaaaaaaatgttcatgtgccccataattttgcacaaataaaaaattaatggttttgttaaagtctccattaactcaagctctgtaattcacttttaatccaaccttctaagaaatacgtttctaataaaagtttttttgtaataattatataaaaatttataatacatatatttttatcagttgtgaattaataataacaatgacaggtcaaaataaaacatttaacacgtaaagtcttatagtcacaaagttttaaaaaggtatattcaatattaatttttgagaaatatgatagcatgatcaataaaaaactttcaaaaataaaaatatgttacattaggaaaaaactgtgtgagaaaagtggaatggaaatataatttttaaatgtagaaggaacaatgtataatttccaactgctaaagacaagtttatatattttctataatggttaatgttagatctcagatcattatattggatgcatttaaaagagtgatataaaagtttgttcttagatatcaatattcacaaaacaccataaatgaaaactggcaaggtagaaatgtggtttgcaaattcccagtccctgctattacaaagtggaataccgaagggtgggtgtggagctgagagacaatagctaaaatcttaatactggcacagtatcaatttaaacttacgatgaaatttagatatcaaaactttagatatgttaactttcaaaagtgtaagagagtgcatttttcatcattcttttgtgagtaaatgagaaaagaaaggcttgatcacaagtaaagataacctctcttgtccctactagctctgaatttcaaagattagtttctttctttttttggtttgtttgttttcccctcacatctttccttcctgtcttatttttttcctttttacgtattcttcaaacctgactgtggtggctgtgcacactggccagcattactattgtccctaggcctaagaagattgcagattcacacaagatacatactgaggaagtcttagaagaagagagggcagcctggagcacgaaatattgataagatatcgtaaggactcagtatgtgtccttcacttgtacacaatgaattactaaatatcctccataagacaccattgtttataagatgcatcactagtttaaaaacagcattagggaatatataatgagctaccacaataaatattaacatactttattaaacacatcctaattttataaatgttaaaatatgagtaaatcttagacttaagaaatatagtatatttattacctatgaaaggctggcaagtttccttgaaaggctgtttgctattgttttagaagaaaccaaagtatcattatcacgcagtcctttactgttttctctccaaatctttctagggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcggtaaggcattgatttagctgtgacttttaccaatccccagttagttagctagtcagatttgagtccaaagctaacaatctgatgatattcctcctaggttaggtagaacagaggtacctcttaatattcaattaagtatttagtttgactcatatttattgggggtctgcttttgaccaggcccccatgatagacatagtgtaatagccagataatgcacagtgtagtaattatttattacataaatttgtctaatatatatcagatttgggctaagttctataatagatataataaaaatgttatgaaaacatagggaaagagatgtttagtttcaactggagaaatgtgggatggccatatggaaaaaatatgtcttgaactggtcagtccttgaatgactagaaggacttgaggcacaggcagttataaaggggaaatatacactaggcagataaatgacaatgggtaataaaacaatgtgtctaggatgtagtatgtaaaggttatgttgggagaaaagattgtaaagttagcttgggcccagatggtagaaggccttctgtaccaaattgtagtttaaagtttatttgatatgtaacaaggagccctgaaatattttagagctacacttcaggttagattatagtgccatcaatgtgtaacatggattacaaaagggatagtctcgaggtagagagaccagttggattgaagggtattgctatagccctgatgtgagtaaattggaactcacagtggggtacatgtatcacattattaggctagataggatttgacagttgattagctatgggaagaaggtggtagctgagatttggagcatgagtaactaagaggagggtgataccattaatagaaatctcttagagttttgccattttgaaacctagtttaactcaatctcttaggaatgttggttattgccgtttttattctgatcatgacccaggatttcaataaccataaaggatgaattgctggaaattctcgttcctttgatagtaaatataaagattaaagctggttcagccttagtagcaaattcatggtgccctttttaatacattttcctgaatcctttgggaatttgggtgtatgtgtgtgtgtgtgtgtgtgtgtgtgtgtacaattttgtcagtcccaactcttgggagtaaaagcttgtctaaatgtattaactattttgttaggtaaactgcaaaactggcctcagtaatatgtcaagaggtccactcatgttttttattaaagatatggaagtctcagctatattcattctgttgctatcttacttgattttatagatttcagccacatctccaagtgcctgggtacctgcccagcattctggatatggtgtacttctccagatatagtcaaatgtttataaatgtcctttggaccaagaataatgagtagagattgagaaagcgtccgtttcttatattttccagtctttctgacattgttcttaccacagtttcagcattactaaatgtctcccctccaattgagtactttgacaacaagtagtatgtgcaatacaccaaaccaaactcttacggcaattgaggcattgactatagcaagtatgaatagacatttagggcataatggaatattaaaaggccattgcactggttctgcagttttttgaaaaaagtttacagtttattatgtatactgggagacaatacttagcaaatgcaatcctcaaagtgcattttttcaccttttgtgatcattgaaagagacattaatcggcttccatactaagaaggcttccaatgaagcaggatggctacttctcacatgctcactctgtagattatgttccttctccttttcctttaccagatgtgcagtatgtgaagctccagctgtggtgatcgcagttcacagtcagacgatccagattccccattgtcctcagggatgggattctctgtggattggttattccttcatgatggtattttacactcttccttgcatttgtcatcatagctgactgtccattccatctacatttcttcccaatatgaggaatccctgtcatttgcataataagaagcttaaacttcaaacagcttctatccaagcactgtgttccccctcacacattttttgtaacatattttcataatctgcctattacttttttttgactacccttggtgtggatactattgtcttacctctgggcctgttccttcactagatttgaatttggccaagctcagcacacatctttggatattcactaagctattatggcacatgggtattgcggcacatttttccttgtcttttatagcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcaggtaaagtgcttatagctttaattcaggtccaaagcttccttcagagatgctagggaagaaagagacaatttatggatggtttatcctcaacaaatgttaggaatttattggattgtgtactttattcttgcttgttcttctcatatacatgactcaggtcagaaaaacagacttgattattaatattaggtgagtttggtttgtgatagcttagtagtaatccttcaataatgaaacagagataaagaaaggttatgtgaccttcctaataagtcagcagctgttcaactagattgagaccaccccaggaattgaagttacagtctgtcttttccctctcagtccagtggtctcctttcccaggatattttaaagattctcatttaagggtttgaatgagcaagacatacgtaatgtatgtacctcaggatacttcattctgttgatttttttcagtttaaatttatttttatgtgttgcttttgggttatcactacttggtatttttcttatggtccttgttatctatcataacatcatcagttgcccagatttccctcatcctgtgaatattagaaaaatgtatgagagaaagagaaaaagatagaaaatgagagggaaacacaaatatacaaagataatagtggtggggagaatcgttacaaaatatctatgaccactaatggctcttaaaccatactagtcactgcattagatcatattgctgaaaagtaaaccattaagtcaccaagagagctacttaacacacaaaaaatgtttagttataaatttgaaccagtaacagaattgaaataccagaaaatgtggatctgattgtcttatttcttatttcccagtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattatttttcacggtgctactaatcctgctgtatcccgggtttttaatataaaggtgttaagcttattttgctttgtaagtaaagaatgtgtatattgtgaacagccttttagctcaaaatgttgagtcatttacatatgacatagcatgaatcactctttacagaaaatgtaggaaaccctagaatacagacagcaatattttatattcatgtttatcaaagtgagaggacttatattcctacatcaagttactactgagagtaaatttattttgagttttatcccgtaagttctgttttgattttttttaaaaaacaaacccttttagtcactttaatcagaattttaaatgttcatgttacataccaaattataatatctaatggagcaatttgtcttttgctatattctccaagattatctcttaagaccatatgccccctgttttaatgtttcttacatcttgtttttactcatttctgactggacaaagttcttccaaacaattctgagaaacaaaaacacacacgcagaattaacaattcttttccctgtgcttcttatgtaagaatcctcctgtggcctctgcttgtacagaactgggaaacaacacttggttagtctcttttaagttacaaaaagccaattgatgtttcttattctttttaaattttaaatattttgttataaatactcacaggataccttatttccctagctatcatctcctgacttaatgttttttaaacccaccaatataaatttaattaaagatatatgttgtaaggatggtctgttgtgtatctcttcagcctgtgtggaaaaaacccctgctcattt
